United States Patent 10,724,096 (METHODS AND COMPOSITIONS FOR INHIBITING AND TREATING NEUROLOGICAL CONDITIONS) - sequence listing, part 122

SEQ ID NO: 2255 - DNA, 696403 bp, Homo sapiens
ctgagtggttaacgtttttatttcaaaaaacaggatattgtatatatcatttctgagaaaataattaaggtactataattaagttccatgtttttaaacacaataaggttatacagaatctctcaaatgtgagtttactcaaactttatttaaatatagcagaatttaattgggagttttaagtggtgatttctgcctctcacaaaataaaagctcttttacagggttttatttatttattttcttaaagtttacagctttaatatatgttacaagggtttaatcttttaatagagatattattcagttatttgaaaaataacggagaacatgattcaatattattcaattattatttaattgttcagtattgaataatcctttgggggttatacgtgccatgaaaagtacattttcctttttttttttgagacagagtctggctctgtcacccaggctggagtgcagtggtgtgatcttggctcactgcaaccgcagcctcccgagttcaagcaattcttctgcctcagcctcccgagtagctgggattacaggcatgtgccaccatgcctggctaatttttgtatttttagtagagacgaggtttcaccatattggccaggctggtcttgaactcctgaccttgtgatctgcctgcctctgtctcccaaagtgctgggattacaggcgtaagccattgcgcctggccacattttcctttttataaccaatgaacaacaaactaacgttgacacaaaaaggaaaagaatgatctcaaaatcttgtctcattcaagaatacagtgtgagattcaaggagaatacagtgtgagattcaaaacatattcttccctgaaaaattgcaactacttcccatatgcctaaaaaacgaaaacaaaataaaatgtggaaacacgtatgtgattcattagccctcactggatttaaatttctgtctgcagtagactaggctaaacatctgagccttttgttttattctggctatgatcacatgaacctgttttaaataaaataaaaactgttttaaaatgttaatttttaaacttcctgcaagatatctccttccaccacaataaattgatcagcattttcacatgaaatacatggtgtacacaaggaagtggaaaaaataaatttacgtcttttaaactttctggttctatgtagatacctcccttcctatctcttagaagcgtggatatcaaggtttactctgaaatgtctctctggaatctcatcaactcagtgcctagcaatgtttagcagagtgcatgtctcttttccctctttgtttctgactgctgttaagtccagcattaatttacatttaagagtttcagccacttaaaactttatgtctcctatattaaaagagggcgactcaatagctgaaaatttatctgcacacatagaagagaagtttccatcttgtaaagctaacaacattcatcattcaatattttaatatactatagaattttccttaaactatatatttttcatatgaagctgtcataaaactgatgagaatatcttctctgatttcaaacccatcaagttacgtttttaaaaactactttccaaaccccaggggcagtatacttgaaggggcaagtacatcagtgtatttagaaaatgagttgagaaaagtcaaattggattcctatttgaacatttattatgggtaccaaagaatccatctgactgaaaatgtaaccactattagcactaattgtagttatacagctacactgaagtgaagctgcatcccattatttcaatcattgaaatcttataagcaggttgtttaatttgtctcatcccactgtctatccaacagctttctactgtacagattgttaagaatgattcacaaactgttgctgccttcaaactatatactataaaaggtagccaagacataattgtatgttgtagcgaacataaaataatttgtggcttcaaaatatgtttttgacacaaagcctgcctgcccattgtagaaaattttgtcaattcatgtgaaaatatttattacctgcaaccatagatacaaaaaatcaatgtgtgtgttacgtaacattatgtcagtaatgtacttgttactgttttgagatttctttctttcttttggtctggattactcttctgccaaacaacttttttattttataccagcgcaagtgattgctgtactaaatttgcaattgtaatcataattttcctgggaatgctaaattatgtcttaattttattcaaaagcttttatttttaaagtaattaagcttattgttgattgatatttaccgtccaatgttccaggaacactaaaagaatacactttgtacgtaatcttccattatagcacattgcttgagagcagctatttgatataacagcattcagttgagttttcaaaccaaagaactaaaattatagcaatttcacttgaaatccataaatccatgcacaggattgtgttcaacagaatcactaaatgctatttgttattcaaagaaagatgaatgaatcaataacaaaatagaaccgataaatcattagcactttaatgcagagtggagagaaactaataaatcatgcagttcaggcactcgttttccttatggcatgtttgaaaacataaaacatgcaatgatgagatgcaggtcaatatgaatgaacaatattacaagactgctcagaagcatttcattttacatcataggcttaatgaaacactaaaagaaaagtactgttctgtgatttctttaaacagtcagagactccaactatgccatgaacaccttcaacagtgatctaggctgttgtttccaaataaacatttgaaatgtcataaagatgggagtggagtaggtgaggaggagggagctaattgcatgcatgattcgcttccaagagctcagtattattacaggtacccatttatactagaaataaactgatacaatcatttacttccttcaagtgtacttaactgatccatgaaaaattacacctatatttataaatgactgaaaaaagcaagaaatcatctattgagctttgattgtgttgtctggcttattgtctgtctgtgaaaggtgagaattttaatcataattaatgggcaactcactcgctttccagcattttagtcatcacaaaattaatcacaggaaccctaaatttgctccacaatgcttaattaattatgcattaacccatttctctcaagcattgttttctgaatctttggtgggaaacacattgattaggcacatagtttaaaacttctatttcgttattggtgtggttatgaattctctcctagattctcatgcagaaaggaacaaggcttgccatattaccacacttgactgtcaagtaacatgttttcacttatttctggaattaaaaagaaaactaagcaaaataaaaaccgcgttctatttttcagcatgagaaaaccttatgcctgatatttttatttccactcagaagagttaagatgttgaagaaaaactatgtatatatagcaaggtattgtagtcaactatttaataaaatcttcgaattaaaagtttctcctcaagtcataggtcactgatacactgattctaaaagggaaacgtatagcaatctgcaattatgatcattgtagcgttactgattagtgcttcgtaataattggaatcacactgagaatcacgtttcccatggtatttcctttttcatgtttcacgggtttttctcacaggttagtaaaaggaaattggggaagagttgggtgggagatgtaaaaatctatgggaatgcatgcaccaaaaatatgcagtatcacttcaggtaaacttctgctttcttcatgcaaagatgcctataaaaactgagacaataaattttctaatagctgaattttacattagcttagtaacaaaaactgttaaaccacttccatgattttgcatgagcaggagacttgaaatggttcaaagatttccagcatatgtgttccatggcccaattatgctaattcaatttctaagagtgaaacaacacaggattattccttgcttcggtttcttgtccttttgacgagggagcagaataaaccggtttttggaggcgggcccatcagcattggggcttggttcttgtgtgtaatttttatctagaaaaaaagagagagagagagagagaaagaatagagtaatctccagatagatacaataccaatttgtgagactctctgttaaggttaataatatttcatgagtgactgaaacaccgcaagtgtaaaatgtaatttcagagtttctattatttcaaaaatatttttaagggagatagggatatgtacttaaataatatcccagtgctcaggataataattttaaaaattatctgaagttgcattttaaatagtatgttacctctaacctcacttgtagcaatattccagaactgcttgcttaggttacatgattatccagtattatttcttgaccattagttacgtatcatttattgaagtcaggaaagaaggcaccattatagtttccagagtcctagttacagcccaatatcaagatgtacttggtatcaaggcaagccttatttatcttgctaatcagattgtttctctctttcaacatgaactgcaaggcttaatttccaaacagtcattagaaatgaaagttaaaagttaacatgcataaaaggtcagaaatgatgaactagctttctaatttgttaattaattggtaatataatagaatcaaatattgaaaagcctgcttaaaacactttgagagactgttctaaagctactcgttttgatttctttgatataaaactacgaatcaccttaaatgagacaaccttaaagtagattacgtctgcaattttctctaattcgactctaaattagagaagacattttatgaatatatgctatgctcaaagctaattgaaagcaattatcaaagtggcattttgtctgtgactttaagatacattgtaagataataaatgattctcattatgtaataaaaaggtcacatcttgcctttgggctagtgacgctaagagtttttcaaaagcaatctgagacattttctttagcgaactgcgactaatacaagaaccatcgcttattaaatatcagttgtcacctgcacagcattcgcatcagagatgagtatttctttcaaaaagaagcaccacctcattaaaagctgcaaaaaatatatctcttaaagtgcatacctgacattttcaagttaaaatgaatatccttcacttgtcattcactaatagcaatgaaacaaaaaaatgtacatcacgtggacaggatcattaaaatctgcagtggggcttttgggaaatggaaatttacttcacagtctagaaagacagaagtatgtgaaaaaccttgaaagaatgaacaactttatttaagtctgctggaatcaggttattctggaaggattcagtgttctctttcctgcaaaaataaattgcacctgtaaaaggccactaaggctaacccagcctcaaactctatggatatctgacttcatcttatttttgttatcttatgaactagggaattgatagttggatagttaagacaccagaatgcacttaactatgtagattgaaaatgatctatatcagattttctctcaataagtcagcattagagtatactgtaccttatgtcattgagatttaaactcctctgaaattctagctgtagacagggtctaatactgcatcattcatcatttattcatttcacaaaatttgttcagcccctactatgcttcagatactgtatcaggaactttgaataaatagacaatatacaagctctgcccccaagaaattataatctagcaggaaagataaattgaacaagcacattgaatggtgttacagatgctgaaatgggaggctaagcagaaaggcactatttttgaacattgaaaatgaaaatgaatcattttacgcacaaatgtcatttttaaatgagtactgggaaagcagttatcacatattacttacatgataaccttagattcaaacagaacattaagagctaaagtaagaaggttgagatttcgggttcataatttctggactaaatgctttacacggtataatagcattagggcattttgggaaattagatcattatttccaaatagttgttaagactatgaaagaaatatatcttcctagccatttatatatatatgttagtatcaatttatgacaaagcataaccaaaatgtcacataattattatctataagacttagcttcttctctgtgtttttttttggcgggggcatataaattttgtttatgactattcttatattaaaaactttttaaaaaaaaaaattacatgattttatgcctttgaaaaaatagcacagtatctcattcagtgctcttgacacaatgggacctttaatctatgtgactaagtaaaacacaagttctagtttgcagtcactaatcagaataatggccagtactattttaaaaattatatgtaacctgtcttcttgcttgtttaatcatttctacagtcaaagtacacaactgtttctttactctaactttatttctgcaaaaaatgaaatccacatcctttttgtctgttgtttatggaaacgagaaccaattggttgtattttcttctttgttaggggagaccacatggaggaaactagcattcagtaaatgcctattatgaatgctgtctcttcacatgccttatttcattggatatttacatgtcttggtatatttgggcagaagcaaaatcctacgagagtaattccaagccacatggattgtcggtgtcacagttacagaaattccaggtgtaggctctaggaagctgcagagactcaagtgaaccctcagactcaggttgctcatgtgggaaaatcctggttacggggggttaacagggcctgtaattatgactctgatgcctgttttgtatacattgaacattcttgctttttttattactcttaattttctatccactagagaaataacaatgagtaaaaattttatccccaaagaatttagaatatattaagtttcagcaatctgaggacatgaaccaaatggcctttgagtgcctccttctattaagcgtcaggtaattacttctcagttattccttgatacatcaaatattttgggggcactggctgtgaacaaggcattttgcaacatgattttggttgtttagtttctaagagactctgacattattatttgaaagaggatactgggcactcataaacagtggtgacggggctcctagaaactgcaatggttccatgacggtagaagagcattgcttacaacatgcaaggtaaattctatcagatacagaatggtgtcctcctataaaactcttccttctccttatcatgtacccttctagaaaagcaacagtggcagagaaaggttcttccactgcccatgactatttctacttctgtcttcctgtttcaaattaagactggccacttcaaaaactataaatacgaaaaatgtgggttcagtttcacttttataattattcaatatgaaataaggatgcacatatagaaaccagtaacagaatcaaagattacaaagcatagtcttcatcttcttatttctattacatttttaaggttgcatagtttgatagttgtgatagttccacctcatagttgtaatgttaagaataacagccagaataaaaaataacgttgatctggctcttactgtgtgctgagcattttgctaagtgttttacacacgttattcaggtgccccctatttcatccacctctttgagctgccctcaaagtccactcccataaaacatattatcagagaagagtgcaaaactgaagtagaatttcataaaagggatagaagagggtatttgtatctcacagcacatagcaaataatgtttattccccagatatttgtgttctcttcaaagactttgttcagcccaactaaaatcagagggaagagagatgggtcttccctgattagttttccagacagtatttggttcagctcgttggtgatttctttcttgcttccctgtcttccagcatcaaatatttccaaaccctttattatgaaaagtagcatttccctttcttttgttatctgaacaaccgctcgacatcctttccataagcatttattgaagcattctgttaagtttagaacagaggtggatctattttctttcaggaattcttgtacctgctattgaaattattttaaaaataattttacttttataatgtctaattttggcctcctaacaactctgggaggtagctgtcaacacccttattttacactgaaggacaaagagacttaaaagggttctgctacctgcataacatcagtcaagtgggtaaatgcaagagctgggtttgatagttgactctcaaatctcctgggccctccttgctaattcctacctctgcacctttgtgctagttattgccctagagagcattccctctcttttttgccaatcaaatttctatccctgtcctgcctagcttaaatcacacattattgtaaaatttcaaagtgaagggataaaaagaagattctaaatgtcctcagagagaaaaaaaaataggtcacttacagaaaaataaaaatcagcatggcatcaggcttttcaaaaacattagcgctagaagacaatgaagaaacaccttcaaaccccagaggaaaagttaattttatctgagaactctatacttagtcaatgtattgattaacttcaagggtagaatgaagacattttcagtcacaaaagtatctagagaatttgcctcttatgtaccctttaaaacgtatttggggtgttttctagcaaagtaaatgagtgagctaaggagacgagtcaaaaaaacaaaggattcaactcagatccaggatgacagatttgcaagagagctagacagaaacctaaagagaagggcttctggcatataaacaaaaggagtgtggataatagataaattgatatggtagagttttgtcttttttttttttttttttttaagaaaaatgagatctattgtaaggatcactttgcagagagaagaaagaaattctgaagctttacaggaaagaaaatgtgatcgtgggttagtacttggttctgcagttgacaatatttttatagtctgaatgattatatattttttattgatttaaacaaaattattatatacttctcagaagcagaacagcttaatggctgcctaggcccaccatttcctatctagggactttgagcaagttactacgattcatttccctcatcaatactgtagagcttttcatatagtgtctcactggtttcttgtaaggactaaatgaatcaatgtgcacgaaatgcttagactgttacctggtacaaaaaaagcactcagtaaatgttaactattagtaatagagtaatagaggtaaatacagtaatgtaagagtgttagaaaccacctttctatagcactaagtaagtagagtatacctaaaactaatccataaaaaaaaaacaaacaaacaacaaagcgtatttccagatatggagtaaataatcagaagaaatagtccaagaatcaaagtggtagcatctaatgagaagatctgttgacacagaaaaaaggacacaggatggctatttttcttgcaagtctatacattctgctttttttttttttcgttacacgtgcatatactattttggtaccaacttctaaatactttttaaaaatccctctgcaggtgattctcctgcactctagtgttttagttctccaaatgtgatccacaggctaggaacactgacatcattgttagaaatgcagactccccggtcccaccccagatcttctgattcagattctgctttcgaacaagaacgccagatgattcctctgtgcttttaaatttgagaagccctagcctatttgtcattttacttctcttcctaagtggcaagaccaataagaatctgttgactgactgaccaactgaataaatgaatgaatgaaagtccctttttctaggcccccaaaacacatgaaaacaaatatcctaacttactcaactttaattacctttattgttaatgtactaggtaccagcctaccttattttagtgtggaggattgcaagttgaatagatacatatgtatttttaaacctaactgaggtgcttgtagtataatgatgatagaagatatgtgatggtaggttgtaatatgctttgagctagggatattttcagggtacaataagattgaaaaaatatgccatttagatcatggtggagggacagtggcagaattaaaactgagttttagttacatcatctctctgacagcagagattaggggctggtgccataccagaggcatggagatcaaatggaaggttaatttgatccagaagagaagtgaaatagactttagtcagggcagtgccaatgggaacagagtggaggcagatttaagagagattgaggaggcagaagtacaggatacgatgggtgagtggatgtgtggggcactggaaaaagaggaagattttactgcaatttccatgcttgtggtcttcgtaatgtgtgtagtgatgctttttatagaaagagaagcgtttttggtaggggtgaaaaccaggaagttggtgaacctactgttgagggtgacgttctgaaggagatgctcagtatcttttgggtctgtgcatgtggtgttcggaagggagaacaggtcttgagatagatttgggtttgatcatcttataacaatgtcagcaattgagacgaaattactgaagaccagtggggcatatatgaatagcagatgttagactttgtaactggggaatgctgccatttaagagtgcagcaggagaatacaaacagtcagagaggtaggagaaaaactgaaagaagtgctatcatataaacatttccaatcagtcctcagagtgcctattaattaggcagtcttccattaattagggtgaaaccttcaaactacatgaaataaggtgaggcatgcctcggtttggtacaatggtctgtatgtccgtgatataaactgttaaattatttaacttaattctaaatatagaattattatattagagagtgatctactgaatgatatttaagtagtcattcatattgcttcaggggttggcaaacatgttctgtaaaggattagataataaatgatttcggctttgtggtctctgaactactcaacactgcccttatacagcaaaggcagttttgggctatatgtaaataaattaatgttgccatgttccaataaactctatgtctaaaaactgtaattttaattccatataattttcacattaggaaatattattcctctctggattttttcagccatttaaaaatatgaaaactcttcttaactctttggctacacaaaaacaggcagctggtcagatttggctcacaggccataatttgctgacccttgatataattaagtcaaacactgaaaattaaattcagaattatgaggcataaggtggtagaaataattttaatttaaaatcatgatttattgggtcaatggctaaaagatggataaaagtggaaataattttctttggcgtatctttattatactaagtgccaccattcagaaatcattctgtggaaattctgaattagaatgtatactaacattcctcaattttgataatgtaccaactgatcaaatttggcttaaatgcattctctttttaattaattctcattgctttgcaccagagtgggcttaataatattatggttcttcaaacatacctcagcaggtagcattttttcctattaaatattcaccctgtatctagccaaaaattttctccctgcttcatctctttaagagtttattatcactgaatttattcagctaccttaaaaatgaatggggttttcagagcaaaataaataccataaaatatctgtgagtagagcttaatttagcaattatctggaacactaaaagttacttagcttgattctggaataagattgtctccttctaataatggaaaccattttgaattcatgtgtgtagctgagccatatgacagcgggaataaagtacatgctaaatttttcaggtccataactgccaaaaaagcaaagcaatgaaacataacaattttctaaaatccttttgccagtttttttttttttttatgattctagccattattttctggaatgataatttccaagtttaatgttaaagtcttcgatctaacatcaaattcagagaaatcattgtgaagacttaaaataaaatccttaaaaaatggagttgggaggtttacttgccaattaaattcacaggaagtttaaatatgtatggaaaagagaacacttattcctgaaagtgatggactatttggccacattgcatgggaaatattcatacctggatttgaaatctcttttaacatataaattgtgttcttcattccaaaatatttttgtggctctaagttagttgtcagggaaggtcaaagacattttaaaagcatttttattatttccatgtctctacagagaaatgatcctcacaattttaaaccagtaactgttcatcttttcttagagtatctccaaatctgtggtcacatggaaaatagaagtcaaaaacataacaaaacaatacaaaaacacttcttttcttaactagagaatatttacaacttgtgacttgacttttcttactgagtaatatttcaactaaaattttctatatggcctttttcacgtagtaatggtgttaaggacatagacccaggacatgaggcaaggatttgtttcccagattagtcactggcagctataaaaccctgaccaaagaatctcagttttgaccttcggtctctgtttgctaaagtaatataacaatagcacctactttgaaagaccactacaaataccaaataaggctatgcatgtcatatacatgcttaataaatgttattatttttagtgttactatatttagtcccgtggaaacacattttgctaacccctcttctatctgagacaacacagctttctgtgttccttgggtggcattgggaaatggcatattatggccatctgccttctccctgtggcacctggcagcattcccgccacatgccagacaccaattttacccaaaagaaaggttagaaaaaaattaatgtggggcatttactaaccatcagagagcataattatttctgtttgtttgtttgtttaatcaagggagtccaataagctcacactgtcttattagaagaagaaacttctttaatggcccaatttctagactcagccataaccttggctatttggagcatcatagcactgatctgaaagactttctcctcaacgttaaactacatcatggtaatacaattggatacagatgttcaattttgataacttatccacaaaaaaattgccattgcttggtgttatgataattgatatttctaacaatgtgcttaaggcattgaatagggagaataattcagttgaaatagtactggattagagaggaaactgattgttttttcaggtcctcctgtttcaaggtattgtttcatcatttattcagttgttcaaaatgatccagaaacccagatcatccttgacaccttcttttccttacctcttataaccaataatctattattgactctaatcattttcatcccccaaatattttttgtatatcttgaaatttttttcctttttactaccatgttctaaggcctgaacaattatagaattcttctaaatggtcattacctctcccgccaattaattccccacctagaatgatcttgtcaccgtgcacatctactcacatcactttcctgttgaaacctctctttacttccatgttacccttaaattaaagctaaacatttctcatgagggctcccaggtcctgctgttctgctcccactggaccgtatgcctcaccccacgctgcctctcttctttcatgtcttccttctgaaccctgtacacaccaggttccttcccacactgtactgttttctctgcataagacactcttccctctctttggggcctagttatatccttctcctcttttagttttcaggtcaattttgagtttctttgaaagccttcctggaccttctacaacaagatcaaacacctctattataccctgtcacagtataatagtaccacagtaccgtagtatcacagttcaaaggatcatgaactttccttcacagaccttatatcattattgaaattttatatttgtgggactatttgagttatgtgtacctgcactgagttcagagatcatatctttttttggttcactttgtattgttttctctccattcattgtaacactaggacaaaatgtcagcagcttcatagagatggaattcaataaatgtttgctgaaagaatgaataaatgaatcactgatattctttttttgagatggagtcttgctcttgccacccaggatggagtgcagtggcgccatcttggctcattgcaaccacccccgtctcctgggttcaagtgattcttctgccttagcttcctgagtagctggaattataggcgtccaccaccacgcccagctaatttttgtatttttagtagagatggggtttcacatgttggccaggccattctcaaactcctgatcttgggtgatctgcctgccctcggcctcttagagtgctggaattacacgcaggagccactgtgcctggccaatcattgatattcttgacttggcttggataaaagagttgtaaattatatttatggatttaaaaatcatgtttaataatagctattttgttcacctcacagatttgtcatgagaatgatatgatataatctatcaaaagtctttgagtttttcaaaataataatagctatttatgacaaacccacagccaatatcatactgaatgggcaaaagctggaagcattccctttgaaaactggcacaagtcaaagatatcctctctcaccacttttattcaacatagtattggaagttctagccaggagaatcaggcaagagaaagaaataaaaggtattcaaataggaagagaggaagtcaaattgtctctgtttgcagatgacatgattgtatatttagaaaaccccattgtctcagccccaaaactccttaagctgataaacaacttcagcaaagtctcagcatacaaaatcaatgtgcaagaatcacaagcattcctatacaccaataacagacaaacagagagccaactcctattggcaattgctacaaagagaataaaatacctaggaatacgacttacttacaagggatgtgaagggcctcttcaaggagaactacaaaccactgctcaactgctcaaggaaataagagaggatacaaatggaaaaacattccatgctcatggataggaagaattaatatgaaaatggccatactgcctaaagtaatttatagattcaatgctagtcccatcaagctaccatggactttcttcacagaattagaaaaaactactttaaatttcatatggaaccaaaaaagagcccgtatagccaagacaatcctaagcaaaaagaacaaagctggaggcatcacgctacctgacttcaaacaatactacaaggctacagtaaccaaaacaaacagcatggtactggtaccaaaacagatatatagaccaatggaacaaggaacttaaacaaatctacaagaaaaaaacaaacaaccccatcaaaaagtgggcaaaggatatgaacagacacttctcaaaagaagacatttatgcagccaacacacatatgagaaaaagctcatcatcactggtcattagagaaatgcaaatcaaaaaccacagtgagataacatctcacgccagttagaatggcgatcattaaaaagtcaggaaacaacagatgctggagaggatatggagaaataggaacacttttacactgctggtgggagtgtaaattagttcaaccattgtggaagacagtgtggcgatttctcaaggatctagaaccagaaataccatttggcccagcagtcccattactgggtatatacccaaaggattataaatcattctactataaagacagatgcacctgtatgtttactgcagcactattcataatagcaaagacttggaaccaacacacatgcccgtcaatgatagactggataaagaaaatgtggcacatatacaccatggaatactatgcagccataaaaaaggatgaatgagttcatgtctttgcagggacatggatgaagctggaaactatcattatcagcaaactaacacaggaacagaaaatcaaacagcacatgttctcactcataattcagaattgaacaatgagaatacatagacacagggagtggaatatcacacaccagggcctgttggggggtggggggcaaggggagggatagcattaggagaaatacctaaggtagatgacgggttgatgggtgtagcaaaccaccatgacacatgtatacctatgtaacaaacctgcacattctgcacatggatcctggaacttaaagtataattaaaagaaaaaaaaagtctttgagttttttaagtctcctccaaagaaatatatgcaactgtcttctgaatattcgaggaaataaaaataataaactatgatattctagtcagttcatttttattaagcactttaagttcaaatttttatttaaaattagtattctatcccaggaagatccctgtgaaacagtggactagttctgtattagtgataagcaggctcactctttaaaattttcaacaatacagattattgccttttaatgaagagcttagaatgtggtagccttgttttctaattttaatacacaaaatcggagatcacagaaaattaatagttagaaaaggcaaggtcagaaggcaaatgtgagaggatagtcaggcccagaccttgtgagtctatagtctgtatccaccagcagaaagatttctaactgctaaaagcaatcaaacctgtgcattattattctgatgataaccatcaactgggagattatttccaattttgcacattccagaggaagatattcagtttcgaactggatgtgaatattggtcctcttgcaaactaatgacaaaattctgataagtacatacagttttatcatttttatcatatttacaggcttgggtcacatcaatataaatacataaggtattacatatctggcatatttctcatttaatttttaacctttcatgtttttagatattgtgtccaacatagatttggagttcctacatgagaatatgattatgagagatattactatctgctagccaaaatgaaattaattttttgaattggaaactaatgactagattaattcaggtttcaaaataaagaataaaagaaaaacttaaattcattgaacaatatttaaattgaatgcattaaagtgaagagtgacaaaaatgtaagtttaattgtaaacataacatttgggatggaaaacatttaaaatatgctatgacaagaaaaaaatctttaaaatatttttatacaaaaagcaatcatatctaatcagcttggcattaattaagctctaataatgtacttcagtatctttccaaagtagtatgatccatttcccctttatccaggtcgatttgtgcacattatggtgtcatcataattttaaaacatactgagaaaatgacagagctgcaaaattaaaataaatgattaatggtatttttttttcatgttttgtactaataggtattactgagcctttaaattaatagagctgtcaagctcacgggtgttacagatccagcaatgaaccaaaatggaaattatatattccagagacacctaaagatgacaccttggaatattttaaattttaattagtaggtgcaatggttttgttcccctgtaactactgcaaattaattggaaattagtcacaatcaatcctttttttttaaccaatctgaaatgaaaagcttggtgctttacatcttaacattgttgcttgagggccagaaagcatacaagcagtaaattgtgttgtcaattacaaaaaacaacaattgttatgaaattaggaaaaattatgcacaggtaaaccaaactaattaatgcataagtaacaggggaacacacaaaataatgtccaactaaacactgatgtgccagtctttggaaaaataaatgtttaaaattgtaaatttatgcaaaagcatttactaatgaagatttaggtaaaaaggtgcttttagtttatgttttatttaattgcttttggagtctcactaccactcacaccttaaaacatatactcacaagaacagcagtctgctcatgccagtatgtttcaagggggcagaagactattaattttctctcttcaaattatcaacatttaggcttattaaataacaaactggccaggcacagtgactcacccctgtaatcccagcactttgtgggaggccgaggcaggcagatcacctgaggtcaggaattcgagaccagcctgaccaatatggtgaagccctgtctctactaaaaatacaaagattagctgggtgcggcggcaggtgcctgtaatctcagctacccgggaggctgaggcaggagaatcgcttgaacctgggaggcagaggttgcagtgagccgagatcatgccattgcacacctgcctgggcaacagcagagaaactccatctcaaaaacaaaaaacaaacaaaaaaaaaaacaaaataaaaaacctcaccaccacaacaacaacaaaaaatactgtagtatttatttctttaacagatatctatagtatttaaatattaggcaaaatgcaatttctaggcacatcaggaaaatactaattatctacacctacctgttaaagcattttcttactgtttacatatgggttagtctttttctttcatcactaaaaatacacgttcttctgttgattttttctcccactctggtaaaataagccattagagcaacttaagattctttaaaaacggtgtgtctaccaagtcagcaagtgttgctacaatcgctgtgcaacttttaactagaaaataatattattttcacattttcaaaacaaggctactatccagataatgaaactggtacattaagaattatttaatgatatttaaagttaaagaatttaatgcaacggtcttgggagattcaagagttatgtaactatgcggataaacttcatcgcactatttcagagcactgttttcagtgcatctattctagatgagttttaacataattttctttttatgtaattatgaaagttaaacattatgataaaacaatgtccttctttaatatcagtttaactgtaaatgataatgaggaaacaataatgatgttgctacattttctgtaacactttggccgaatttcaaagatgtcaaatactgtcccactgtagaataacatgggtttaactttttgggggggtataattggggattacagggaatttagtctaaattatgaaaaagaagaaaattcagatgtattattaaatataacaatacttaatatataccagaaattaattaatgctttcttaatatcactaaatgtgatatatggtaattttcaacaaccattcaatatttctttgtgactcgtaggtagcaggttttaggactaggaaaataattccaagaaaaatattaaataactctccaaagtccagaagtcactaaaaaagcaaagacaagaccgtggattccagccctcatttctattttctgcccctttggatagtaatcttcctaagcagtttttcccctccttccttacagatatcccagaaaacattattttcaaggagtgaaaaatatttttaacctcagactacattgaatttctgttaaagtgctaggaaagttgactatttcagttgcagatgccaactttctcaaaataacttttaaaatagtagaacctagaataggttttaaataaaaatctggtaaacagaagttttaataaaatggctgagattctgtaataaaagagtggtaaggttgtacaacttactaatttgtttccagtcctctgttctgtgattagttaatttacataggaggtaaaaggagatccacctatcacaaaaaaatgcgaattctagctattttttaatttctcaaatttgccctattcctgctataaatcctttctcatgtactgtttatatttaggctttagtagcttctagtcaagaaacatagttctatccccaagttaaattaaaaaatacctattgtttcttgaactaaaaattaagatataagcacatagactatgggaaaaaagtgatcaacggattccattatattttccaatatatattatgtgaagtgctcatttaaatggtatttgaaatagaaaggattttcatgatattcaacttcgaatgggcctttgaaaggaccattaaaacaatctcttcttacaatggtttatgttgcttcttcacgtagatgccctaggctgtgtttgctaagtgtggaactgctaaagaaagccaaaatataaaggagtctcattggactactgtctgttttacacctgtgctcctttattcatcactgcacatttcagaaagcctcagaagcatggtatttcttcctttctgaaccttttatccttaggcaaacaagcttaacgaactgctgacaatttcagcaataataaaaggtaggaacagtcccggttctataactctttgtttcatgaccttggacattcacctaacctcatccgtatagtctaaaagtgtcttatactaacagataacttacttggaatagtcctaaaatgtgttcgcctacaatgtaatttaaaaaagaaaatctcatgtggtcatccacatcattactcgcctatagaaatacctaaaaccttaatcttataagtgggtaaaaacaactaaacttttttggtcaattattttctctcaatgtggtaaatgctgtctcaaactgcttaaatctggggcacaagagtagaaaaaatatcagtgatgttttctcaaattgggtatgttttaagattcaaggtttagggcatttattagacttatttagtatttttggaaggaatatgaaaatggggaataatctatgaaatctccaagtcagcacgcaggtagttctagctaataatatgccaatctgatggagagaatttagccagatctcaaaatagtcataaacaagaaaatctaatggtgtgggggtgtgggttccaatttcagttaagaaggaataagcactcttcactctatctctcccactgaatgcactataaaccctgggcagaacacatgaagcagatatctgaagttgctgaaaagaaaataataaaaggcaaattggggaagaagaccagaacatgaagtgccatcaaaccagtgatgagtttttagtttttagtttttttctctactcttgcacctcctggcctggacttaaaagcagaacaaaaactggaattgtataccaggtacagatagaaagtgccaagaaaaaccctgtcctactggtacaaaaataggaaagaagggccctacagatcagagtgaatgggaaaaatattcgttaatcaggccagacacagtgggtggctcatgcaggtaatcctaccactttgggaggccaaggcaggcggattgcctgagctcagaagtctaagaccatcctggctaatagggtgaaaacccatctgtactaaaaatacaaaaaattacctgagcgtagtagtgtgtgcctgtagtcccagctactagggaggctgaggcatgagaattgcttgaacccgggaggcggaggttgcagtgagccaacttcatgccactgcactccagcctgggtaacagaatgagactccatctcaaaaaaaaaaaaaaaaaaaattctgttaatcatttccatcccagtcctctggcaattccatggcagtggaaggtaattaaaactccaatggaggagacatcttttctctgactagagaaagtatgttcccaaagcatggggggagtcctactccttttttctctctctattcctttatcacagaaccctggaggcagatgctacttcgagaaatatatgacaaagtgaggaaacaaaagccttggattattggtcagagaaacaatatgagagccctgggagtaaaaaaaaaatatcagagagatcatggagaggaggtggcttgagaaagctatcctatgaagttgcatttgatcacctgagtttatcccttagctgtgtatgcatagatttgaccttaacaaacatactgatgactttgagagctgcatttgggggtatatcatcaccaagttttcagacaggcatatggatcttttacaagtaagatacatctgaataacattgcaaacactttgaaaaccaaacaaacatactggaaccacaactcacagaagatagagcagcttttgtaacctgaacctaacagagtcaactacctgctaaaatagtaacagcaacaacaataaattaacatttcctgtgagaattgaaaatacctagagtcttataacacaatattaaaactgttcagaatataataaaaagtttctcaagatatgaatcacagaaaaatctcaaaaacacacaaggggaaatatagccaatgatgcaaaccctgagatgatacaattgttggaattaacaaagacttaagaggtattataaccatgctctaagaagtaatggcagatactcttgaaatgaaatgaaagacagagagcctgaactgagaaatagaagatagttaaaaaatgaatcactggaaattttaaaactgaaaaatacaatgaacaacataaaaaataactgaaaggactcaacaacagaatggagataaaagagaaaaatgtcagtgaattcaaacacaggtgaatagatatccaatgtaaacaatagaaaatatagaaggaaataaaaagtgaacagactcaaagatctatgagacaatacataaagtgcttaacacacgtcatcagagttttagaaggagaggagagagtgtgtggcgtagaagtcaatatttgaagaaataatagctggagatgtgccgatgtggcaaaacatacagctacagattcgtgaagctcagtgaaactaaaacaagataggctcaaagaaacccatgcccagactcatcaaagtccaactgctgaaaactaaagacaaagaaaaaaatcttgaaagcagcctaagaaaaatgacgtattacatattgcaaagcaatgattcaaacgactatgaatttcttatcagaaattgcactatgtaagaagacatttgcaaagtatgaaggggaattaaagatgaaatttaaaaatgcttacaattaagtcagaagagctggatgcaggcatgcgtagccgaaatacaagtctgtgaattggaatgctgttaagaagatatcaacagagtcacaggagtacaaaggatcaggcaaatatttctgacagatgggaagttaaaaaggcttcatgaggaaattgcttctaagcttggcattgaaggaagagattttattttatttttagtatgtatgtatttatatctcattgccttccagaaagattttgaagtaacttataaaaatacatatatcccaataggacagaataattaattcaggcaatctgactaaaaggggaaaattatgtgtatgaaattaataaaccataggtaagactagatgaaagaaatgcaaaccatgggccgggtgcagtggctcacgcctgtaatcccagcactttgggaggccgaggcttgtggatcacaaggtcaggagatcaagaccaccctggctaacacggtgaaacccagtctctactaaaaattaaaaaaaaaaaaattagccaggtgtggtggcgggcgcctgtagtcccagctactcgggaggctgaggcaggagaatggcgtgaacccgggaggtggagattgcagtgagccgagatggcaccattgcactccagcctgggcaacagagcgagactccgtctcaaaaaaaaaaaaaaaaaaagaaatgcaaaccatgagtcctagataactactggaagaagccacagatttggaggtagcctgcctggagaccagaagaatgaatctatttctaaagcacaaaatagagggtaaggatttgaggcaaaaaacgaagtactatgcatggtaatcctctgggaagtggttcctatgaggcatagcagtctggtcccggccttgggagaataatttaatgtcatgacaaagattctgaacttttttctgtgtaaaatgaggaggcattgaactttgagatcaagggagtaagatcatcatagctgtgttggtcagtagtaattctggcaacaatatgatggatagctttggctgcagtgggaagcaaaatatgtattacataaaaataaataatataaataagatgaaaagggattttctgttttaaatgatagagttgtaattaattattagtattagaaatacattaaggcagccaggtgccatggctcacacctgtaatcccagcactttgggcagccaaggtgggtggatcacctgaggttgggagttcaagaccagcctgaccaacatggagaaaccccatctctactaaaaatacaaaattagccaggtgtggtggcacatgcctgtaatcccagctacttgggaggctgaggcaggagaatcgcttgaacccaggaggtggatgttgcggtgagccgagatcacaccattgcactccagcctgggcaacaagagagaaactccatctcaaaaaaaaaaaaaagaaagaaagaaagaaagaaagaaagaaagaaagaaagaaagaaagaaagaaagaaatacattaagcctctgaagagtgactgagtgaggcagcaaagcatcataattaagagattaaaacccaatggcctatttctgccttttgctgtgtggccttgggcaagttacttgacttctctggcttcaggttttttcttaaatttataatatggggattataataactttactgacatcttagggttgctgtggaaattaaataagtaataaacatgtacacatacaacagaaactggtacatggtaagcaaggtaaattttatatctaggtattgtcaccagggtttcctccaaatatctccaggctgttcttatgtcttgaaaaatccagcaacctttgtctagttgatattaacttgctgggtcttgaaaaacttaaatttatacaaccttttcctttatatcttaatggcctgagattattgtgtatttagcaagcgattaaagagtaactaacactttaatgttatgatcattttaatgatttgaaaaaacaaacacataaacaaaaaatgtaataagctccagaatactgtttttctttttgaatagtctgtattttaaagttatggtgggatgtgtgaaaagaagtgtcaaaatgaactctagataactgcagtagctagagcaacagagaaaagaccaagtcttcctagtagaggacacaaacaaaggcaaagcaagcagtcagtgtccaagtcaaggaggtgctagtgtcagggaggggaactggcagtcaagtcagaaaatagcatctcatggaatgggtcacacagtagaagtctgggcagtaggagacaggtgctcatagggtacccaggatttgaaaggatcatacctaagacagcaagactagcaggcttggtggggattggtcccgcaccaggtcagggctcaattgcacaatgaaggtagttgtaagctaagactgggcaaacaggtttaagatcttaagaggtattatgccagggaaggtacagaaaaaaggcaaagaggggttaaaacatacataaatgttttctagaagttgccgtggcctcagctatcactttgtagagtcttcttagtctacctgtgatcatttcactatttaatgtataatctgttcatgatttcctttccgttctctaccacatggaaggaagtttcaggagtttttttctgtcttcatcataaacaaaatacccagagtaattttgcattaaaatcttgttggcactacttttcataaatgtgtcatgagtaataatacatgcctattaatatttcaaataattaacagaatgcagctttttgaatgtgcaaaagcaatgtataattgataatccagagggaagtggcccaaagaagtttaatcataccatacaggaaatagaaggattaaatcttttgagattgagaaagaatttcttctctgatacattcaaattctttgctttgagaatataatgaataaagataactcaaaataacttttacatgtatttatatataaaaatatgtgaatgaattgctagccaacctacattatgttcagtgaaagaagatttagtagaaaaacactttttaaaaatgttatactaccctaagaagtatttcagaaatttgcaaattcaaagtgcatttggtattggcaatctaattatgtgtgaggtacagtgctacgctctggggctaccaagatgatccaaatcatggtccatgacctcagtaagcctgtgtctaaaaggagctggacatataactgagaattccaacgtaatgttgttattgttttgataaaactgaaacactgaggctgagcttttaggctatttggagaaaaaggagtggagaagtggaaggaggggttgtgctcagggaagcatttatggaggagggacagcaaggaatgagcctcaaaagatgtgttgtgttaccaaactaaagaagaggaaaaatttgtttggacaagagggaagcgcatgaaaagactttttaaaaagtaagagattatgttggtaaaacaggaagcctcactcaaaccacattttatcagacagagagtaactaaacaatattttaagtagaagagtgccatggtgagattcatattttatagtgactattctgatagaaatgtgaagcatggacttaattggaacaaaaattgagatggggaaatattgatgtggttttgccaggaatgagagagaaatgaattgggccaaatctaaaacagtggttaatagggagagaaagaaaggaaaagattccagaaataggtcatatcattatatggacacgtaaattggatttgagggtatatagagaagtacaggatgactttcagatttctagcttaggaaacaccaggtgtttcaatggtttcactatctcagtatgatagagggaagaatcgcagatctaggatgtgagaagacctcatctggggaaggagagatatggggaggcaaatgatgagtccattttagttgtaataaatttgaggttcctgaggctttgaatagtcacttctcacttaaactttactggtcatgtgtcacttaaaataaatgggtagtaaaggggtgctggttgtacagatacaaaataaaatcttacctagtctatgtcctctcctatcctaccactctattccctctaccctccaccccaagctgctctttcttcttcccattataagaacatattgactacagaatcatatgttctacatgctcaggaggaaggatgggggaggaagaagaaagaataaaatagactctggagtctggcctaaagacagctcttctaagacaattttcaatatatactctcttctagaattaatattgtctttagtttgatatgcttattatcacaagcaatagttatatggctaaaataattgtgttaactcagtgactattacaaaacaatgaatacaggagcacttaaaaatttatgttgatggctttacagtgacagaatctagatggtcctaaaaataattaccaagtgcatatttgaagaatgagtactaagctctttggttttttcttttcctgatctttgaactcaatattggtgaaatttataaatgtatcttacattaatttttctattagtgacttttttattgtggtaaaatatacataacataaaattcaccacgttaacttacatttttaagtgtgcagttcaatggcaccaagtgcaatcacattgttgtgtcaccatcactacccaccaactccaaaacttgtattatcttgatatttaagcattaattgatatttctgttttatatattctactaatagaaaaaacagaacttctgctctcctctaaaattatgtctagagcaattctttcataaattgaatatcagcttacagatatttaaattcagcagagaatttaaacattgtagcattcttattttctgtaagaaaaatattgggttattcaactgaagcaaaaaacgctccatagttaaccataccaatgctatgaatactaaatattctcttcaattacagtgaaatttaaagttcagaaccccatgcggctgtgggaaaagtagagtatgccagaatgtaaaatcacaataatgagccatagtctactatgattcttggcctactgtaagctgcaataaatgttttaaatgaataagtgagtttacaagggaagaaaattaatataagttacataaaatttttattaatttaacaattgtaagtcatgatagttaacaggtgaaatgaatgtcttattacttattgaaataaaaattaacaaaagtagttaaaagtgcttgtgttaaacaagcttaaattattctaacacattaattaaatttcaataggcagacattttcaagctggagaagcttgaaaggtagtcagggagaaaggtagtccgtcatttaccaaaggtcacacactctggagggagatttccagcatgcaccggggccattttgtgttgagcttcacagtaaggagcagagatgaagcgtgcagatgctggagtcagactacctgggtttccatttctactttgctatttattagctgtgtagaattagatgaactatttaacctttgtcttcctcagttatttccttcataaaataaggctaaccatataatttttgtgagaattaaatgcatcaacatgggtcaagtgtctccaactggatgtacaggacattctaagaactttttttaggatattaccatagctgtgaccgcttctcgactcaaaacatggaataagggctaaatgcctcttctcctgagaagagtccaaaataatacaaagagtattcatggacgctagttggttttatttctttgatttacttattcttttgttaccaaggctgatgaaaagtgacttttcattaaaaacaccgctaccaaccactactgtcttgcatcacaaccaccaccattgcaactaccatcaccaccattaccacgagttttaccactatttccaccatcacggtagcagctattacccccaccaccatcataaccatcaccacctctgcaatagcatcaccaccatcactatcaccattatcatcactatcaccatcaccatcattaaaaacaacatttttaacatccatgtgaatagaataatgtgaatttagaagtgtcatttggagagtgaaggatcacagaaaagatgtatgtgtacacatactggtgaagggaggaaaaagatttagtgttcaggcagctaaaggaatacaccagaaacaaagatgaagtaatgtttatgtgttatacacaacgtttgagccagtagtttcagagtaaaaccattacaaaggtaaaatgaaaaattccttcttacatgctaatctgtgctgtttgaaatctgtaactaaggttgtttacagtagtggttgagagaatgggctttaattaaagagtcttggattttagttccatatctacttcatacctgcccttgagtatgctatttaacctcccagaacttgtattttctccatctaaaaaatggtggttccattatttagaatttgtgtgaatatttaatacatactcacatataacataagcattcagcacaatgcttgtgcaagattaagaccttcccctgttgccctctaatcagtttctctccaaattttaactactcagtaaatcacactatcattcttaggtaagagttgacttcaattcagccctttctctcctccacctcctgcacccccaggaactcattaataaatttttcctgttctacctctggaatatagcttacattcatccactttgattttacttccctgctgccatctttgcccaagcccagagtactaggatagaccaatctctcagttgctgctcaatacaatcaatcctccacagagcagccaatgtgaacttaaaaaaatgtaaatcagatgatgcttaaagttttcagtagtttcctattgtacttagaatcaaaatttagctctttaccgtcaattttttttctacatgatttgttctctgtctaccttttctacttaaactcttaccattctcccctaattctagaagctttggtcacaccaccctccttagtgtcttttttttgggggggatggaatttcactctgtcacccgggctgaagtgcggtggcacaatctcagctcactgcaacctccgcctcccgggttcaagtgattctcctgcctcagcctcctgagtagctgggactacaggtgcgtgtcaccaagcccagctaagttttttttttattttttttaattttatactaagcttttggctatgtcctttcaaagaggtctcccttatctcaagtagtatttattctccacacctaatccagcttcttatcatcatttcaccttattttttaataactctcacagtctgaagttatatttatcatgtagttgtttatttattcggtcctctattataggaatgtaagtaacttgaaggaaattacactgttggtcttgttcatgtgtctactcccagtgccaaaagcagttcctagcatgtttttgaaatgcaataaaatattcactatgcaaatgaaaactgatttttttttgagaggggcagtgtctgccttaaataatacctcattctggaaaacacaattaattatggtagaaactggagagaaatttttttcttatggagaagaaagccctcaaatccccaaatggaggcatagaaaagctgagaaataagttcacatataagcttaggtctgcatttcttgcaaataatattctaataatgtgctctgaaataaacaaaaaagtttcagataaacttttattaatattttgtttagctccatagtttataattgatctatggtttataattgatctatttaaaagatctatttatacttaggctaacacaaacattcaagagctaaatcattgccaagggtatataatgtctacaacctaaatgtagtggctctgacacacacataacaacaacaacaaaaagactatttgctgataggttgaaaagaaataaagaaaaaaatcagttattgtggttatttagtcaaagaggaaagcaaaactgagattgacatagcatatcaactactctgtactcactgtgcatggggtctgcatccatggctccccatcaatttgcattggcagagacttgctcgtcctgggggaaaatatttcattgtaagtattgcaaggaaatactttatattacagactatatgtgagatataagatgatgagaccagggaaggcaatatggtaatagttgggctctaaatttatctccaatgaaaggagcttcaactctccactattaataaataccctgaaaagtaccttagtcacaggaatattatgagcttcctggtaagtgtagtgacatttaaaaaaattctggatgccaaaagaaaaatttcagggtttatgtttaatgacacgatcagaatttctacagccaaaagagattccttgtttttataaccctacattgcaaactgggagaaaggtgtttctcccagttcttctagcaccaacacttccagataaataacatcaattattcctgtgctacaatccgtggcttcacctgggcagatcacgaggtcagtagtttgaaaccagcctgaccaacatggtgaaaccccatctgtactaaaaatacaaaaattagccaggatgtgttggcgggtgcctgtaatcccagatactcgggaggatgaggcagaagaatccttgaaactggaaggtggggttgcagtgagccaagatcgtgccactgcactccagcctgggcaacaagagtgaaactccgtctcaaaaaaaaaaaaaaaaaaaaaaaaaattggggggaaattttgggcaaaaaaaatgcttgaaaaagttaaaatttaaaacatatataaaatcttactgtggcactttagtccatgaaatgatttaagtcaatggtgtctcatcattgttttcatagataatttgcccagtaaatactttggtgcttcagtagactaatatgagtataaatcataaaatttgtatgtttgaattcgtgcatcaatatgtccatggtagtcaacaagagagaatcagattccaacaaaccatatcagtaatagctaaccaatattttagacaatctgccaatgtccattattttgaaatatattagtattaataactgattatttggagcccaaagaagacaatgttactatcagagttctgcatacttttaattagtttgaggctatgccatatcaaacgcctttgtcagttacagaaagggaactacctgatgaccacgcaggagcactgagccagccgccggccagcacttttcaggcctgtgtatatttgccccatctccatggctccttccaagccgaccacctccagcagctggtcactgagatctgaaagaaagtagatgccttttaagttgcaatgtgtatacatatgtccacaatttaatgccatttgatattatggagattaaaaaaaataacagccacttcacaaagaaagcttgtcttagaaacttaaagtaataaaaagatggcctacttttataactctcagtttaactaaaccttgaggttctgtggaaaatgatttgctgtcagcttattctaaaacaaaatgggaagcacagattctgagccaaataataccaaaaaaaaaaaaaaaaaacccagtagtttttaacatcaacaaacttaatgttattccacatgtatataaggaccatttatacatcccacatcagacatttggcagcaaatacacatttcaacactataaataaaatatgaggatatgctgtcaaacatgattttgttaaattacttgaacaagagaccttggagatcatggagttggagcttctcattttatacattagaagatgggagtccctaaatctttgagtaacttgtctgtagtaataggtaactgtacagaagttcaagaaacaatagtaattttgtgaaatgtttttccgatgttaaggaatattctacaaaatactgtttggtagtatactagataattagtcccatgcaatcattattattaaatttttttttagcagaagacattaaaaaggggctaatagttaagagttgtcgcttgttgagtatttactaggactaattactttatattatctcatttgctcctgctccagaccaatttaagataaatgtgattctcctcatttacagatagagaagctaaacattggagatgttaataattattcatattcacatacctagaaagtgacagagccaaaaagtgaacctaattgctttgatgcactatgctacatttgataaatcaatcatatgaaaaggacagaatttacaacgttttagaaatcatcttaacataaaggtggaggttggactgcgtgagcttcaaggttcctttccaatctgaatatttgcattcagccagaaagcagaagttgaactcacatcaatagaatcccacacagtcctgtcccaagactcagtgacagcccatctgctcacctatttaactcagagtgctgagacccttgatttggaggccaaagtctaggtgcatatatatggttcttttccattgtaatattcttatgtgtttttgtgtattttcaaatataaatacacaattgtacattgtttagtagcagaaaaactagaggagtggaatacggtgggaggcatgattattatacaagaaagccatgtaatagttggtcatatttgaggtcggactcatagaaaaacaagcaaatgtgttttgtagggaatccactttgtacagaaagtgctcactcctcactaatgactccattttagcatagagtttagagatgctaatgatttattttcagtgtagttcaactgtgtggcagcaaatagtgctttgcaatctccaagttcgttaagcccaggatcgtaggtaaatttaataaaagcactttaaaaagaatatgcaaccaagccaccaaacttttaagtgaataataaaaatctattatttttaactttaagctgtagctgtagcaccggattactccaagtaaaaacaatattttagctacaaaatcaaatgttaacttagagcttccaccttgctgttctaaaccccatttagacttatttctcatgaaacttattctgtgtttctagtttaaattcatgttgccaagaacagatggacaaggaatggaaacatattctttcagctgtagccggcactaaaatgtgcttggctctatagcctgggtgttaatatacgcatttcttagatatatgtcaaccagaaaacgacattgtggcaagcactgaagccccagatgtgtgcctgctgatatttataaaacaacaactaccaccacgatgatcaccaccaccacaggactggagttcgcatttagtattgtagattttgcacggcctgattcctaaataggtagaattctgtgttaatttctgcaatgatctgaaactggttgatgggaaccattctataagaaatgaaacactttctcaagacagagttaatctgtgagccctaactttttcatgaatcacagggatctgtctacacccacaccatattgctactgtctaccaccctccttctgatttttttctttcttttaatttgtctttgtttttctgcatgcaaaaatgccttgaaaatcaattctgctgttaataatcagtaatgaagatatttctcatagacttagaacacccaggcttttaaactttcatgttcttgctaacacaaataattttataggaatagtgccatctttactaactctagcaaaggcaaataaataccatactccttttaattaggcattcagggagagaaaacaaaaacaaaatgaaactctaaatttgtgttgcacgaatttgcccccataacacttccacattttttgatacagcacaatctgcaatctgtctgtatacaattgatgccccctacctgttaatctttgagatcagggtcctgattgatttcagacagagagagtttctatctatgcaattttgaattctgtttctatatgtggtatcctttggaacatcagacttcctcacctcacattctagctaagagttattttaagaacagttctccttgggatggcctaaccagctagatcaacctatttaattggtttgctacctggctgctggcttcatatttaagagtgtgagcagcaaaagatggcctatggaccaaatctggcccctagccctttttgtatggctcacaacaattaagaatggttttatatatttaaaaatataaaaaaataaagtactataacatctgaaaattatataaaattcaaatttcagtgcccatcaattagtcttcattggaacacagccacattcactggtttaggtcttgtctatgtctctttttgtactacagaggcacagtagagaccatatggtcgacaaagctgaaaatatttactatgtggacctttagataagtttgcccacctatgctttagagaaacatgaacactttcaggtcactaaggttgtcactttagtactgcagctataaatgctaaatggcaatttattttttagtgcctgaaagacataatgttccagcattaattccacagtgtatgtaaccatgcatagaacagctgttctccaccagggagtctcaccacacttgtgtactatgagcattgccacaatccattggttatttatcacggaacaccaaaagtttccaaataattttattacaaaagaaagtagaacagtttaacattcattagtgtgctcaatcattgcctctggttggcttccttgagtgtgagaaaaagaagaatcatagataggaaggcagaagttgcaaccagacctggagattcaggtgggaaacagctctaccttcaaaagttaagtgtcaagaactgtgaaatcctgacaccatgatactgaaatccatttgtgtctatctagaggaagacgttgcttttgttcagtttaatgttataaagtatacttttgaaggaaaacaaagtacgtttctgaaagcatttatatgtctttttaaatacctccatgggagtaaacagagacaagctttcatattaggtattttcacatttaaaacagaacatctataaaaggtatttcagagggaagaaacttaataaaatcatcaaaattgggtcatattggatcaagattcttaacacatggtctgtgaatctgaataggaaaaatgcaactttattttcactaacatgtaattgaaattaagcatttctttcaaatataaatgtagtcaggaatacctgtgactttgtcactgataaatatcacgttatagttgttacaatatttcctactttaagaaaagataatacgttttaattatccacaataccaaaatatctacaagtctctataaaataaaataacacattaaattttattttttttatttttatcttatgtaatttttcaaaatgttatttatattcattatgtcaaattttaataattattgaacttctagattttaatttgttaataagaaagcatatatatctctaaatcaaaatttctaacagcattttaatctaatttttcatagaaaagcatatatatctctaaatcaaaattttaacagtattttaatataactgactcccttttttagcctacgtattttatcttataaattttaaaacattatgtctgagaagagtcagtagatttcaccagacaggcaaaaagactatagcacaaaaatggtaaggaaccctactttagaatggaatttgtcattttaaagtttataaatctttataaactttataaatctgtgaaaataattagtgctgcattcatctgttacacaggtaatcagggatatgaatgtaaatttgaaagtcaggggcacatatagattagaggacacacgagcagctcagctaataagtgggtaatatttattcatagcttagtcttcatttttgacagttatgccctgataatatgtctcattatgtaattgtttcagactgccatatgtgaagaaacagaagagaatgcattacaaacacagaatgaatgtgggttgtagcatttcgcagaatatagtgggtactgaagaaagggggagaaaggctggagcagagtagtataaacccctttgtgcagagtgtccagcaacattctgcaccactgtcagaggccatgtggaggtactcattgactcagcaggagcattttgaaatcaacataaattgctaattataatgacacttattgagccattatttggccatagtaagaccaggctagctatggagttgtaccttttgagtgtttgtagattgtatgccttccagtgatgtttcatttatctagcaacattatgaaacatgtctgaggaccaagaataaacttttaaaaggccaaggaacatatgaaatccattcactagagtgaataattcaatgattcgtcttcaaaatgtccatctacttctaattgattcttaatttagatatacttctcacaagcataaatgcctgtttttcctgacctacataacccagaagacataaattttaaaagggggtgggtaggaagagttttagcaaaaatttattaatataaactgtgtttcagagtacaagtatgtaaaacataaaggcaggctttttgcacctgaaggaacatacaatccaattgtaggtctattaataaaggagaaactgtatggggaaggctaatatatctactatatgcctgctatgagcaggctccctgctaagggatttataggcatttttccatttaagactctcaacagtcctttgagataggtattattctcctcattttattgacagggaaactatgtcacttgttcaagtctttacatagaattgaaaatctggttttctaaataggtatgcttgactctaaattccatgttactgtgacaacagtaagaactaaccaattaaatgttaacagttctcttggatcatcatggcggacaggaggcaggactagattgcagctccagacagagcagctcgcattgtaaattttagctcaatagattgcaagaacaaaccagcaatctcgagaggacacacagacgctctgacggaagtggactgctcctgcggagcctgggagaccccccaaatactgagtgcccaactgaggaagtggaaaagggagaccctcctctccccatcacatgcccccactagagaagctgacagtccatttgcaggagaagtttccggctttacttggagctgagtcaatttggaaagctaagccaagtacaggggtagaggaagcagcagaaaggccctgggagctcctggagtcccctaactggccgttcctgcctggcaccataccacagggatccaacgggagggtgaccagaggagcagggggtaaaactccacagggagaaggaaatctctagctaaactttgtaacaatttgaacggggtgggaagccacctggctagaactcaggagagggcgcaaatctggtgtgcaaactccacaggcaggggaagaaccaagaccttttctttcgcagttgggaggtgagttttcaggccggtctcaccttctgcctggaaactaactcgggtctgttcgtgggggcacggtgagagttagaacgggccttcagtttgcatgggagctgtgtgaggcctgtgactgtgggctttcccccacttccctgacaacctgcatgactcagcagaggcagccataatcctcctaggtatacaagtccagggacctgcaaatctcatccccatcccccatgctgcagctgcagcaagacccacccaaggagagtctgagctcagaaatgcctaaccctgccctcctcctgattgtctttccctactcaccctggtagtggaagacaaagggcatataatcttgggagttctagggcctcgcccactgccagttcctctctggaaagcaccacctcctggcaggaggtgcaaaaaaagcattggattaaatccagcgtctctttatgattaaagctctcagcaaaatcggtatgcaagggacataccttaatgtaataaaagccatctattacaaactcacagccaacataatactgaatggggagaagttgaaagcattccctctgagaactggaacaagacaaggatgcccactctcaccactactcttcaacatagtactggaagtcctagttagaacaatcagactagagaaagaagtaaagggcatccaaatcggtaaagaggaagtaaaactgtcactgtttgctgatgatataatcttttactttgaaaaccctaaggactcctccagaaagctcctagaattgataaaagaattcagtttccagatgcaggattaatgtacacaaatcagtagctcttgtacacaataatggcgaccaagtggagaatcaaataaagaactcaaccacttttacaatagctgcaaaacaaacatcttaggaatatacctaaccaaggagtcgaaagacctctacaaggaaaactgcaaaacgctattgaaaaaaatcatagatgacatgaacaaatggaaacacattccatgctcatggatgggtagaatcaatattgtgaaaatgaccatactgccaaaagcaatctacaattcaatgcaattcccatcaaaataccacaccatcattcttcacagaattagaaaaaaaaattctaaaaatcatatagaaccaaaaaagagcccacatagacaaagcaagactaagcaaaaagaacaaatctggaagcatcacattacctgattttaaactatactgtaaggccatagtcaccaaaacagaatggtactggtacaaaaacaggcacatagaccaatggaacagaatagagaacccagaaataaacccaaatactacagccaactgatctttgacaaaacaaacaaaaacataaagtgggggaaaggacaccctttttaacaaatggtgctgggataattggctagccacatctagaagaataaaactggatccttatctctcaccttatacaaaaatcaattcaagatggattaaggacttaaacctaagacctgaaactataaaaattctagaagataacattggaaaaactctcctagacattggcttaggcaaggatttcatgaccaagaacccaaaagcaaatgcaataaaaacaaagataagtagctgggacctaattaaactaaagagcttttgcatggcaaaaggaacagtcagcagagtaaacagacaacccacaaagtgggagataatcttcacaatccatacatctgacaaaggactaataaccagaatctacaagaaactcaaacaaattggtaagaaaaaatcaatcccatcaaaaagtgggctaaggacatgaatagacaatcctcaaaagaagatatacaaatggccaacaaacatatgaaaaatgctcatcattactaatgatcaggaaatgcaaatcaaaactacactgctataccaccttattcctgcaagaatgaccataatcaaaaaaataatcaaaaaacagtagatgttggtgtgtatgtggtgaatagagaacaattctacactgtgggtgggaatgtaaactagcacagccactataaaaaaacagtgtggagattccttaaagaactaaaagtagaactaccatttgatctagcagtccctctactgggtgtctacacaaaggaaaagaagtcattattcagaaaagatacttgcacatgcatgtttatagcagcacaattcacaattgcaaaattgtggaaccaacccaaatgcccatcaatcaaagagtggataaagaaactgtggtatatatattcaatgtaatactacacagacataaaaaagaatgaattaacagcatttgcagtgccctggatgagactggagactattattctaagtgaaataactcaggaatggaaaaccaaacgtcgtatgttctcatggatatgtgggagataagctatgaggaagcaaaggcataaggatgatacagtagactttggggacttggggggaagagttggagaggggcgagggataaaagactacaaatatagtgagtgtatactgctcaggtgatgggtgcaccaaaatgtcacaaataaccactaaaaaacttactcatgtaaccaaatatcacctgtatcccaataacttatggaaaaataaataaataaataaataaatgttatcagtgatggaagagaaaaaagtgctacaaaggaatacatacataacaccttaaaatagtccagcaaacagtcctaccaataaatcatttcaaatgtaatcacaaaattaaaatgaagtacaaagctcccatttataataccatgtggggtaatgtatgaagaatactctggagaagctcagtaagaaagctaagagcctggccctgctgtactcacatgcacctctgcctggcccaacatctggttcagcagcagacaaacctccctggacagatagccacaggcctgcttggcatcaccacacctgcacacacctgagcccagcctgacagccagtctgggtggtcccatttccctgcaaataccattgcaggaatgcctggcaccattgctctcatgcttggtccaacagctggtccagtgataattctgctttcctagacagattgccacagagtccaacaaccagcctagcgctcctgtcctcagcaaaactacactgctgccatcacaaacgcctgcagcctagagcactgaggcaatatatatcactgatgaggattacagctgaagaaactgcatgaagactacagtactgagtcgacctagagctaaagccaatgcaccacatttaacactaggacttgtttacaggaaaacatttatccctacaaaagctactccataatgttggaaaaaattgactacacaattagattcacagatataaatgtagggacacaagaaacataaaaaagcaaattaacatggcacccacaaaatgtctccagtaacagactcccaaaaaggacattcatataatatctgaaaaataaattcaaaattatgattttaaggaaactgagcaagatataagagaacacagagaaacaattcaataaaatcaggaaaacaattcatgatccgaatgagaaattcaacaaagatgtatataaaataaaaaaagaaccaagcggaattggagcagaaatattcaatgaatgaaatgaaaaaaatacataactgacagcttcaacaacagacaagatgaaggagaagaaagaatttatgaacttgaagacagatcttttgaaatagcccagccagaggaggggaaaagaaagtagaaataagaaaaatagagaatgaagaaagcctacaggacttatgggacaccatcaagtgaataaattttctcataataggagtgtcagagggaaagagacggagaaaagcacagaaaatttatttaacgaaataatagctgaaaaattcccaagtattggtagagttatgaacatccagattgaggaagttaaaagatccccaattggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtggtggcgggcgcctgtagtcccagctacttgggaggctgaggcaggagaatggcgtgaacccgggaggcggagcttgcagtgagcctagatcccgccactgcactccagcctgggcgacaaagcgagactccgtctcaaaaaaaaaaaaaaaaaaaaaaaaaagatccccaattacattcaatccaaaaaattctctctgaggcatattataatcaaaccgtcaaaagtcaaagacaatgaaataattctaaaatctacaaaagaaaagtatcaagtctcttataagggaatctgcatcacactattagcagatttctcagcagaaaccttaaagctggtagagaatgggatgatatattcaaagtgctgaaagaaaaaaaagctgtcagttgagaatattatataaagcaaagatatttttccagaaatgaagaagaaataaaaatttttgcagataagaaaaagctaagggaattcattaccataaagttggtgttacaagaaacacttgagagtgctacaaatggaaacaaaaggaccataattactaacaggaaaacaagtgaaagtataaaactcaccgtagagtaagttaattaatcaaattcctaatatttccagtgatatgatacgtctttcaatcctctagtatgaacgtttaatgtcaaatggtcaaaaccaagaattacaattaatggcaaaggaacacaccacagataaagaagtaaattaagtgaacaaaagtataaattttagggggaaggaaaactgtctagagtaattttatgcaaccaaagttaagttgccatcatcttaaaatagtcaattctaactacaagactctttatgttagcctgtggtaatcacaaacaaataatgtactgcagacaatcaaatgagaatgagaaaataaagcttagcaccacagaaaaccaccaaaccacagaggtaaatagcaagagaagaagaaagaaataaggaatctacaagataaggaaaaaataatgaacaaaatggcagaagtacttatctaacaataataaccttgaatgtaaatggattaaattttcccattaagagacagaatggctgaataggcaaaataaaataaaataagacccaactatatactacctaaaaaagattcacctcaaaaaaggcaggctgaaagcaaagggatagaaaaagatattccgtgcaaacaaaaacaaaaattgaacagaataagccatattgatatcagataaaagatattttaagtcaaaaactgttaaaagaggcagagaatgttattatatataatgagaaagggatcaattcaacaagaggatataacaattgtaaatatatatgcaaccaacacaaaagcactcaaatatatagagcaaccgttattagatctaaagggagagatagaacacaatacaaaatagtaggggattacacccactttcaacaagggtaagctaatgacaaaaaatcaacaaagaaacattggacttacactgcaccatagaccaaatggacctaacagacatttacagaacatttcatccaacagctttagaatacatattcttttcggttgcacatggaacgttctccaggatgaatcacatattaggccacaaaataaatctcaacaaatgtaagaagagatgatcagctatcttttcgggccattatggtctaaactagaaattaacaaaataaaattttggaaatgttacaaatagatggaagttaaacaacatccttttagataaccaatgggtcagtgagtaagttaaaagaaaattaaaattttcttgagacaaatgagaatgggacacatcttaccaaaacccatgggacacaataaaaccagtactaaaagggaaatttatagtaataattgtctacatcacaaaagaagatttctatgaaacaatccaacaatgcatctcaaaggcctaggatttgttattaatttaataataaactaaagccaaaattagcagaaggaaggaaataataaaactcagagcagaaataaacaaaattgatgctaagaacaaaaattcaaaagatcaacaaaatgaagaatttgtttttttgaaatgataaaggaaaatcaataaaccacaagctaggctaactaaaaaaaagaaagaagactcaaaaaaataaaatcaaggatgaagtaggagatattaaagctgataccaacttttttttgcaatacgtttgcagctagaacaccagtgtcatgaaaaccatccctaaagtcaaatgggaaagaaaagaaaaagactcccatcaacattgtcaaaattggacacattgattcaggcaagtccaccactactggccatttgatctacagatgtggtgggattgaccaaagaaccatcgaaaattttgaggaagaggctgttgagataagaaagagttacttcaagtatgcctgggtcttagataaactgaaagccgaacctgaacatggtatcaccattgataccctgtggaaatttgagaccagcagttactacttgattattattgatagtctgggacacagatgctttgcgaaaaacgtgaatacagccacatttcaggctgactgtgatgtcctgattgttgctgctggtgctggtgaatttgaactggtgtctccaggaatgaacagacgtatgagcatgcatttctggtttacacactgggtgtgaaacagttattgttaacaaaatggattccacttagccactctatagccagaaaaggtacaaagaatcattgagaaagctgaaacttaagaaaattggctacaatgccaacacagtaacatctgtgccaatttctggttggaattgtgacaatatgctagagccatgtgctaacatgcattggttcaagggatggaaaatcacctgtaaagatggcaatgccagtggaactatgttgcttgaaactctgcaatgcatcctatcaccaactcatccaactgacaagcccttatttgtggtctgcctctccaggatttctacagaattggtgattttgatactgttactgtgttctgagtggtgactgggttacctttgctccagtcaatgttacaactgaagaaaagtctgttgaaatgcaccatgaggctttgagcgaaactcttctgggggacaaagggggcttcaatgtcaaggatgtgcacgtcaaagatgttcactgtgccaacattgctgatgacagcaaaaatgacccaccaatggaaacaaatggctttcctactcaggtgactattctgcaccaaacaggctaaatcagtgacggctatgtccctgtactggattgtcacacagttcacattgcttgccagtttgctgagctgaaggaaaagattgattgccagtctggtaaaaagctggaagatggccctaaatacttgaagtctggtgatgctaccattgtcgatatggttcctggcaagctcctgtgttgagagcttttctgactatcctctgagtcattttgctatttgttctatgagacagatagtcgctgtgggtgtcatcaaagcagtggacaggaaggctgctgatggtggaaaggtcaccagagttggtgaggaagaaataaaaggcatccaaactgggaagaaggtagtcaaattgtccctatttgtagatgttataatattttacataaagaaaactctaaagactccaccaaaaactagtcaaactgaaaaacaaattcactaaaattgcaggatacaaaatcaacatacacaaatcagtagcatgtccataggataatagtgaactcgctgaaaaagaatttttaaaactttcttttaccatagctacaaaaaaactagatacctaggaatatatttaaccaaggaggtgaaagatctctacaataaaactgtaaaactttgatgaaaaataaatggaagaggacacaaataaatggaaagacatattatattcatgaattggaagaattttttttaaatggtcatagtacccaaagtgatctgcagatttaatgcaattcctgtcaaaataactataatattcttcagagcagcggtcctcaatgtttttggcaccagggactggttcatggatgacagtttttccacagaccagccacagggttgggaggtggttttgagatgatccaagtgcattacatttattgtgcactttatattattagcactttatttatattattacattgtaatatatagttatatattatttcattatgtattacaatgtaataatacaactcactataatgttgagtcagtgggacccctaagcttgttttcctgcaactagatgataccatctaggggtgatgggaaacactgacagatcatcaggtgttagattcacatacagagtgctcaacctaggtcccttgcatgcgcagttcacaatagggtttgcactcctatgagaatctaatgcagatgctgatttgacaggagtctgagctcaggcggtaatgcgagtgatggggagcagctataaaatacagatgaagcttcactctcacctgctgctcacctcctgctacgcgacccagttcctaataggccacagacccatacgcctgtttgtggcctgggggttagggacccctgcttcagagaaatagaaaaaaaaaaaaacaactataaaattctgtagaactacaaaataccctaaatagccaaagacatactgagcaaaaagaacaaagtggaagggatcacaccacctgacttcaaaatacactattatacaaagatatagtaaccaaaacaacatggcgctggcacagaaacagacacatagactaatagaatagaatggagagaccagaaatacattcaacacctacagccaactgatttttgacaaagatgccaaaaacacacattggggaaaaagtagtctcttcaataaatggtgctaggaaaattcaataatcacatgcaaaagaatgagactagaccctgactcatgttatgtacaaaaatcaactcaaaatgaattaaagatttaaatgtaaagtttgaaactatgaaacaactagaagaaatcacagagaaaatgctttatgacgttagggtgggcaaggactttttaaataagatctcaaaagcacagacaacgaaagcaaaaagagacaaatggagtttcattgaactaaaaagcttttgaagaggaaactattcacagagtaaagagataacctagcaaatgggagaaaatatatgtagactatacttctaacaaggagttaatatatagaatatataaaggaacacaaacaactcaatgggaaaaaaacccccaaatacctcattttaaaaatgggcaaaagactttaatagacattctcaaaagaagacatacaaatggccattagttatatgaaaaaaatgctcaataccactaatcataaaggaaatgtaaatgaaaaccacaacgagatgttacttcattccaattagactggtggttatcagaaagacaaaagaaatcaagtgctggtaaggttgtggagaaatgggaacacttatatgctgttggtagcaatatatactagtacaaccattatggaaaacagtatggaggttccccaaaaatagtcaaaatagaattaacatgtgatctagcaattccactactggatgtatagccaaaggaaatggaatcagcacgtcaaaagagatatctgtactctcaacttctgtagcactatttataatagctaatatattgaatcgacctaagtgtccaacagtggatgaatggataaaaaatgtggcaaatatacaccgtagaatattattcagccataaaaagaataaaatcctgtcatttgtgacaacatggatgaacctggaggacaccgtgttaaccgaaataagccagacacagaatgataaataccacattatctcactcatttttagatgtggaatagtaaaaataatttttaaatataacaagaagataagaatctggtacataaatggattaacaagagtcatttaaaaaatctagcagtgtgaaatgttgcattccctgttgaaatctaaaaatgaggggttaatatatgttatattatgttatatatgtatgcagaaatacatatattctgttatatatgtacacagaaatacatatatattcatagtggaagcctgactttaaaaagaacttttcaagaatggatttgatcatctcttttaaagccatctagtttttgaaaacaaccagccggagctgactataactttgtttttatgctaaaattctgaactcctttaaacgagtctaaaataaggaaagaccagaaatcacagtacagcatattgtcaacaacctctctatagcgaccaaaggagttcagggcctgcaagtcactgtgttatagtgtacttgaaaagtcatctacaccacaggaacgcaaccaaataaataagtatttcaccgacaaaacccatagagaaagagtttaaagacttcccacagcaatccattgctgccactagccatgtgtattatcagtaaatgtaaatggtgtaaactagtggtgaatatgaacactgctgcttctgggttcttgaagcagtttgttctcgttaagctttgtgaagggactgaaggctttcacttgttttctgtgtgaatgagccgttagtgtgtgtgggaatgttttcacagcaccatgcctcttctgcccttttctataaactgagctacttcacgtgtctcctcatattagtgccatcactaaacaaagcaagcgctcatgaatgaaggctgatgtcagcaaattctgaatagcttctggaggggcatcctgcaccctaacactgatgccagctaaggggatgaagtcaccagggagatcacccactcttattctcctaagaactgagcagttccagcaatgaaaagcaatacaaagcaaacaaacaaatattcagattaaaatgcaatgtaatacagggcagtgccaacattactttacatatgactacacggtctttacactaaatatccagaagtactgtgaaaatcagttattttcttgagatatattataaactataatgagatgtttctatggtccctttattttagtttcagtgaaacatgaaaaacacataaaaataaaattttagaaacatggtagtacatttgaactcacttataaacttaataatgctgaacattaaaataaggacagaacatgatgatgaggaaaagtgatttacagtaaacatttccttgtaaaacagaactgtttctggtatccaatttaccctggttgcatgtaagtcttacgtgcttagcaagagattgaaagactttataatatttgaggttattgtgcataaaaccattgctggtcagaagtaaatcttactgtcttggcagtttgtcttcagagaataggcgacatgtctaaatagaattaaatctcagcaaccttcatgtagaactgtttgttgccgaaaaatataggattatatcatgacgtctggtgacttgccagagaacccttgaaaccctgctgagttcaaggctctgcacaacaggaatgtcatagtttctgcttagaacagtgtgtgtatttaaggagttttgctgttaatgcaggactaaggacccctcactcatgaactgagacagggactgttattgtcgaaagcactaaacacactttcctcattgcctcaccatttaaagatgagcagtttttgactcatgcctcaaagaaagaattattctagtcataaaagcctgctaaagttttcttttttaaagcttataaacagactgcgggcagattgaccatcatatctaataagctaactgttaacaagttagtacagtttagtatacacctgaatacttctattttctatatttttctcctccccccacactccctttcttttgaagtaattttatttcatgaccttatgtctacagaaaaagaattatattactgtcttggattactaaattgaattaatgttgacataaatagttttatttggatggaattttaaaattaattccatttgtaaataaccataagaaatacaatctcctttgtcatttcgatcacaaagtagcagagaaatctattccacacataaaatcacttagaagagagaacttgcaacttactacagtataagagattttcagtatctagtcaccttatgactcatattaatcatgtactgacaagtttccaaagagcttgaattaaaaaaaaaataagcccttgtatatagacatgttgaaggacttagataagtacaaaaaatctctgtgaaaaagttttcattgatgttttaaaaagcgtgttattttatctttacaaaggaactgcactaacactaatctagcttttggaaaatacagcaacattcatgactaatcgtagtgtgaaaagtagaaatggacatgaaaagtatcatcacctctagcaacacttgaaaccctaagagaggttcaaatgcaaactttcagattttcaacactgaaaaaccaaggactttatcttccctttcaaggagttgctttgtggggcgggggaaaccaaaacctcttttgtagtacaaactttgccaatatatctgattctttttctacctcctcttagaagagatataccccctttttaatagtttaaaaatactattgcagtgaaactcttggtacaaaggaaaattattctatttagtcgtattcttttaaaagttatttgtttaaaagggcttcactgtattggtcttgcagcccttcatacaacagaacaaaagcagttctatgaaagaagactaaacttgaacaaaccgtaaaaaaaaaaagcaaagttcctctctgtttttatcaaatttgattgctgcagctgttcccagtttctgtattttaaaaatagccttattcagtgccttgttggctaaaggccagagtgccattagaacatgctgtacggaaaacctctattcagttacagatacagaaatatatttaagatcagtgggggtcatctgcagcaaacacttgtaaaggaaaatcgaattttaatgtgtttggactgattgccacttttaccagatagtttaaagcttccatatagaaccatcctattattttttcttttaggtaaaaatgcaaaatgcgtatgaacttcattggacaaatattattagaaaggtctgtttctcaaataacaattgtacagctgagatacacatttcaaagaatacctactagtggtttctgtttgacaagctcacaggcattcatcgagtgaaaaggtaggtaatattgagcaaatgctacaaatggaatcataacttctttctgacacagtcctcctaagtaaggtcacgaggtgtgaaatagattgatctgcccaagggaaatgagtctggggactcattttggacttaaagtgtgtggggaaagggtgaaagaattgagttattcagtgatgtttcagagttgaccttcacatctcttcagttctttcctttgcctcagcaaaggattgaaattagcatttgggactaaacagattcctgtaggagtcctaatttgagttgtaagtaaaaaggatctgcttcgcataaatcatcaataaaaaggaattttgattccaggtattgaaaatagtaagaaaaaattagaaagcagaggtctagggaaaactaaggtgagaagaaaaaatttcattagggaaatatacagcagttgtcaaggtatgggaacatctaagatttcacctttcttgaaagctaacatgttagcctgccacagctttgttgaggctggcagaagacatgagttccctgcatcagagacccaagacgttactatccacagcaacagcagtcaccagtcttaacatctaaatcagtcccccaaaccccaacttccatagggtgaaacaaagaggtctgggagatacctgcacacataatgggctgcattatagaagagaaacccatggcttacaataccttgatctttcataatagaaaataagcctgcctgatctcttcccagctgccaaactggctaaaaaatgaagctcttattgacatttttatggttatatgtgaattgctaccatgatggtattaaaatagaagagatatcaaaatatttcacaatcagcaagagtactggccacagtgtatcctagatattgtaagaaaatagggtcccagaggtctctaaggtacctggcattgatactttaaatgttggatttggaaaagtctgggaggtcatgaggagggatagggggaacctggaaggacagggcgaactgtgcagaaatatttaaataatttaacatttggtacagctatgctgaaggtcccagtggaaggtactaaactgaaatatgtctcagaagttctgattcctagtcctaaattttgatttagctaaagggcaacttcaggtaagtcatttaatgtttctgggacccagttaccctatctctaaaagagaaatggtactgaccttagattgtgattaaatatattgttccaatcagttacatagtaatttttttgctcattctctttctcccctacactaaataaactttatgtataagtaataaaattataaattctgtggctattccacttttgatagacaaaaatttccacgagaatagcttgaaaaatattggaagtgaagtaattgagcgtgatgggtctcagatgaaagacatttggctacaaatattaaagtggtggggggaatacagaatgaataggaaaaaggaatagaaaaacaaaagaacagcaaataaaaatgtctgatctaagaaagcatttggatcagatgaatgggaaatgtaattaggctggacacctccggaaagggcaaaaatatgagcatttccaccatgaaatcaaagtaagatagagtaactaggtcagcactctgcaggcggcctgggacaggactgggctcactgtgaacttagaagcagaaataaaatccacatggtcacatttccacaaggaatggaacaaatagatgatgcccaggtgttctaggcataaggcattgtagagcaaaaagttcagtgggattcaattagtaagtagaacaaagcttcactataactgggcaagtggcagtgcactataatgaagctcttaattaggctaataatttaatataagtatgttactatgttattgctttaagatttctgaaataaaaggagtagtgacaacgaagtatacaatttcttagctttctggataacaatattgcaaagcaagatatttgttatttagcaaatacttactacaatgtcagaaattatgaaaacaaggatcaaaacaaacaaacaaacaaaaacaaaatctagctcctgagtatatagtggtgtacagggcacaaaaagagacctttactacaataattgacaaggagatgttcagatttcactccaggttcagagctggcctttaagtctagaacttctggaggccaacatgccactgcatagaggtcattctggttaataaattgagcacaaggattcacccattcctgaatctagttctttaaagttgtttagtaacaattctcctttaatactttctcttatgttgccagtcctctgctaaatgttataaaaacacaatatgtttatgactcttttgtactcaacctatactatgaggcagcaatgagagaatcaaaaaattacatggtgtggcccccagagtgcaagacctagcagttaaaaaatgatacctatcactgtgcactttggctacctcattacctagtgagacaactcctcattgttgagcataatcactaggaatattttagtgcaactcatgtattccccacattacccacaaaagccgtcctcatttttacacaggtgttatgaatttctaattgtctctttttgtttcttcttgattaggaatttggcaagaatttttattttcctggcttacattttatctcaatgtttattttcttatacatattgtttcataatactacatatgatttctttgcccatttatccatttacctcatccaacaaagttacattgagcaccaacagatgcttagtagatcaatgtatgccaggtactctggaatgtgactgagatagatgtaaaaagctattagtctccttaagagcactaacatgtaaaaaaaacgtaatgtagcattgtcaaaaagggagagtgtttaactctatggaggatggttggtggtggggagagagttgggattgtagaagcttaggaaaagcctaaaaagttgtgagaaattaggtaatgaagattcagtcatgaagggcctgagagcttgggttttccttacatttgactagggtgtagttaaaaattctaagctaagtagagaggcagttagatcacattttataaaggacatttagggagttgtggaagatggtttcttcattcatttaggctgctacacaaaaataccataaactggatcgcatataaacaacaatgtatttctcacagttctggaggctggaaatccaacatcaaggcactagcagcgtctggtgagggcctgtttcctagatagctgtcttttcactgtaaccttacaggatggaaggcttgagggatccttgtgtggtccctttttatacaggcattaatcccaattatgatggcaccaccctcataacttaatcaactcccaaaggtctcactcctagtaacatcacctaggggttagaatttcaatatatgaattttgggcagacacaaacattcagaccattgcagatggattcaaaggcaatgaggtaagaaacagcagggtgatcaattagagaagcattgaaataatgctgatgagagatgatagggagttaaagtaagctgtgaccaggtgcatgagagtgaaagttgcttaggaggtagaactgacagcattatgaatagccacctggggagtgtcggaaggcattgcagtggccaccggggttcagggttggtagacaagctgatgatgatgtcaccaactaagatgcaaaatcctgggggaaaagcaagtaggaaagtaggaaacatggtaagtttgattttgcatgtgctggtattgtggactctgtgggacatccacatggagctctctatagagaggacggcctggtgaatatatatctgtagatgtgaacattatttccaaattaattacaaattaaaaaaataagaatcatatatcatgttgctttggagtttgttgttttgtttttagatgtccaaatgcataacctggcacagagcagacaatcaataagcatacgttgaattagtaataatgtattatattaagtacacttgaagctttcctgatagtcttctataagaggctccaataaagggtagactcacctttaaatttggcttacaatgagtactagctaggaacaaaataattgctcatgatttcagagaacacttcttgaagtgacaaatatatttcttttgataaaggtaaccattaatggattatctataatgtgataattgcttcttatatttatctagctctgtttagtttcccattcttttttatgatttaatgtactcatagtatttatatgcttaaaccattgttaactggattttttttctggtaaccaatagcatttcttactgatacaattttacagatggaggaaagaagtcagagaagatgaatggtttgctcacagtaattcagcagtgtctagagttcttcccatgatatcataattcctctcaacatcatgaggctactgatggaaagtgcctttaggtatctgtcattaattactaataacaaggtatttttcaggggcaaaagctgttgttacttagccacactgttgaaaactcctttgccgtgactaactcttgtcaatcctgacagtgattcaagaaaactgttaatttcattatttttatactgactttgctaaagattgaaatcaatttgctacatttttggtatcttttaaatagtataaataaattagaaccaaatctgtaacaatataaaaaaatattatatagaactgcctattaaatgttttgtgttttcaaatatttctaaaaatgattacaatttgatactattattaaaatttaaaattccgtctttgaaacagaagttgtcaggtactgatctgttactgtaagatgccaatcatattatcacatttctagttgctgaagtattttatgaattttgaattctattaaatggtgatttatttttttccagataagtcaccatgcaagaggcacttattacacatgtttttcagcatatgttgcaagtttattttaatgctgaagaggcacattatgatcaaagcagaattctgcccaatttaaactgttccaagctattttcatacattcactcatgtaatactgtaagatttacattaaaatgaatgctcgtctacaattaagcgattcagtcaacattttaaaaaaaggtgcaaatgtgtgcaacgtgaaaaaaaatcaacagatgtgcgaataatctctacttcggggccagtatcaaaaagagcagtagccaaaaaaaaaaaaaaaagttaaaagtttcagcacttatttttcgtctatcctctaaggttttctatacctaagttaaaggacacacacataaaacagtcataagacatttccttatgatgataattggattagtcaataataaattgggttgaggaacaaacaataaactacagtattcacagtagaacttaaagatggatatatattttgttttcttctgattcttatactcttctattctgatgatgaatatattccaaagcagcaatgattcacctctgttcagagaagagtacacatgtaaaaccagaatatttagcactaatgtatttttaaaagatagccagctaggatataataacaaaagcagaaagagcttctgatcctagaggtgaataaatctgcaagccagtgcatgcatgcagttttgcaggttgtataatgcataactgaaggggtcaccattcacattgtggtctaaatgaatggcatcttcttgaattttatagagcacatcctgcacaattataatgtactggggccatggaaaacatcatgagtatgatggaaatgtaaagagtttgttcagataggataactgagatcaaagtgcttcttaaaacctcatctctgttccatgagatatattttggtgaccattggaaggatgtccagttttcacctacttcagtagcagatgtggggcaaagaaaaccttgatgccaattgacagtctgtaatatttagacaatctaaagcttctggtctgataacatggataaaaactactcaaatctcatccctattctctcctcccccagcgaattaattgcaggatatttcttcctttattattttaactgagcttcccagtgacatctatttgagaaaataagaagtggaaatggcactcactgacaagcacattcttagacagggagaaaatgaattggtataattttacttaaaaatattctccattaatgtttttcaacatgattaacatttatgaaaacattgatctatattatagtaaattacatactgtactttaaaatgaggactgtgcttttgtttacaaatttcaacatgctttgctatcctagatgaaatctgaatacatgaaaacttgaggggccttatatatgtacccatgtttaatcctgatgtggcccaaggcttcaactgttctaatttattgcagctcttctacacagttctacaagtagcttggtgagctgacacatttctgtgtctatgtgggttaatctgagcaagaaaatgattagcctgaagtctctggctaaatcactaaccatactttaatccattagatgagaccacctctctacttacattttaaattgggaaacatacaacggctgagaaaacatagggcttatgctttttgatgagctaatatagcctaaattgtcttggtaaactcttcattggccctttgcccatgagaactaaaaggttcaagtgcctagtcaactggctaaaaggaagtttagcatgtttctggaaattacaaaatagccaagacctgtgttgtcacaacagggcagcaaatattctccacattgaaaaagggatgttaaaaacagggccacgagtatgggaagagaacgtacgttcatgtagatcaattctaggggaaaaagaaatgtattactataaattgttggtagttattttctagcaattctttgatatcagggaatgtatttttatttggaaacactttaagcacttgtataagctttcattgtgtgtgtatgtgtccacaactgtagctattcaagaaatatcctatgtttttatcctcttaatcaacttcattcttccttcatgttcccattgctccaacctatcagtaaatctactctcagatatcttacaggcttatttcctctctaaagattgtataacagctaggaaaatgtgaaaatagcctctcatcttagtgtgtcatactgtcactgtgtattcatgtgacacaagcttgcattctgatgccatgtccatgtggggctgaggaaacttgtggagattcatcctgatatctgcctccccggatgcattcacatctctttcaactgataatgtctttccacctcctcaaaactcttccagggagcagctatggttctacattgttcttgagacccacccacagtaaccatcttctctgcttggaccatcagaatctttcctatctcttttcttatgttttaaagcttctctttcttggggacacctcatatcatctcttctgggagcagaagttatacattgttggccagagggttgaatctggttcacagaattgtttggctcataacatattatgttctaaatttttcaacatttgttaaaggttttaaaaaataagtggattctacataaacatgtgattctgagactatcttcaaagattggaggatcagacaacattgggccaacttatcctccttataaaccttttcacctttagacaggacatgctctttccaatcacccaagtccctgcccagtgtgcttcatttctggccccacaaggcatttgtgatttgtcttctgatctctcattctcaactgcttctatgttgtactctgcaaaaaatcacacggccagaatgagggaatgaaccttactacgtatgggaagtagaatcttactatagcttactaaaatagggtggcaaaatacaggcagataggccaaataatatgatatatatatgtatgttatagaagatagatcaattgattgacaggtagatagaagcaagaaaaactatagactttgggtaagatcatttctggtatacaataccaactagttgataattaatttaataatgcacatattcaaaataaaaacttgcatattaactacaaaatgtaaattctcttaaaacttggctttactgaaatgagctatacagacataatatgtgtccttatagagactacagtctatactaagaaagactgtaaagagatgtggaatccacataggaaaatgtgtaattaaaacaccagttgaaaaacatgataggggttatgacagggctaagtccaaggtgatagatagtttgtaggaagaaaaattaaccaaccttaagggaagatttgcctgaggaattcatgtgtaagcaacaactggaagcatgtgagactcatatccaggtgaacaaggaggtgatggtggtttcaggaggagaaacagcaagtgcaaaagtacagcaaaaggtgagatgaaatctagtgcttaaatctacctagaaaccgttcagtatggttgcagcacagaatttcagggcatgtgggagaaaaggcatattaggcttaataaggcaagcaatacctgggcatatgaccttataaatcatgttaaagagtttgaacttacataagggactgtgggtccccactgagatattttttacagtaaacaacataatcagatttttgatgttgagaaatcacatgaacctgctgaaatgtagtttctatacccataaaataggaatagtgtcgtatatcctggttgcctcattggattgctgcaaagatcaaatcaaataatatatgctaaaattcagcaaattctaatatgcaagtaatattataatgcataaagtttatttattgttgcaactattttttgtagaaagtgtgtgagccaatctctgataggctaatagattgtactacatgacaatgagtagtaaagcacaactcatatcagttattagcaaacattctattaagaaatgtgaagaaaacctaagtattagggtaaaaatgtatgagatggaatttataaatgttggcaataacttttaattaatcttttattatactgtttctcttactgggagttgaagaggttgatcatgttttcttgctgcccaacactttttaagcaacttctatgtttcaggaataggaaccctgcctttagagggctacagaagctctctccctctgcctcctttgaggtcaacatgtgatccatcagtatgtgatccatcaacatatgatccgatagcacctgatccctcagactgtaatctatcagagtgtgagtcatcgtgtgtgggatctttcaaagtgtaatctgccaacatatgacctaagctttgccagtcgggtgcattggtgtgagatgtttggaatgcagtggcttgaagagggagataacaggcagaaacagttctggccaggatggcatggagacattctgttctctgagggcatggagtccgaagtcctaggggtagcatcctgtgcccagcttctctgtggtgaggtgttggactcatgcacagaagcagagacattaaggttacctgtgggaatgccaggcaatgtacttggtgagtggttcctggctgtatggcttttaagcctaattatctgtcctttggagagattttgggggtaactaatatcagtaaacatgttccttttctcctcccacaaatgagagtggattctgtggtttacaagtaaaaatcctgactgataaatgtgtcaaaataaaactgttttttcatcttaaggtggcaacctttttttactcctttattgtacttgggaaccagggcacacaaaccatgaggatgagtatataaatgtggaacaaaagaggggaaggaaatggattccaatactctatcttcaaagtgaactaaaaaaatgtaaaatgaataatccccaaaattatatatgacttgtcagcacaatttctcatttgaaccttgaaccagcatctacagaactttgtagatgaacttctatagaagtttgtttgtaaagctctactctatgatattctcagtaaagttttacagtgattaaatatgcaagcttttatatgagttctgggtccagattgttgctccttaagttattaattgtgtgactttgaaaaaagtatttaatctgtataagcacctgtctctccagtaaaataaaacaaaatatccagtgagagagtatattcaacacatttagtgctatgcttggcccaagacagacctttaatagttgctagtactgctaacaattaaaataaaacatttacttgagcttgaaaaaatatttcagggatggaacaggaatagtggggactagtattcgggtttttaaactgctggtggaagtgcagtattagaaggccttaaaaacttgaagaaaacaaagaccagtctaggataaagaagtatattctacttaatcttcatgtttgaagtaggaggcaggaaggattaatgggggttcaacttctacttcaaacagtttccctcccttttgctgggttgcaagggattgtaaacagcctcaatttctccctctttatacatcttcttccctctttcttctgtgttatgcattgatatttctttatgtttgtgtgtacacatatactagtatttctgtattgagtaaaataattcaaaacgagaatagttgcattaattttacgacagttaaaggaaccggctttattggttccattcttcatttttctgcattctagccttctcgctttggttttgaaatatagaagtactaggtagcctctgtatctagcttgattctttattcactgaaaacacagctagtgttttttcagtcctatatgagtgctccaagagttgttagaaataaacaaaagaatattcatagcctcctggaaatagctagtttttttttttttcatttatcctttttactttcttccttttggattctcctcttctttccactccatctcttaattggcttgcttcttggtagcctatatattctatacaatgacttactaaattactggagtaatatcgacatacttgcatacatcgtttctcttttttcctgtagggcacatgtctcaaacagaatataattatagctagatgctgagtgggaaacaagcagtccttatatattgaggacatgagtataagcctgagtaactattactactgatagaaaaaaaaaaaacgccaaatttaaaaaaccatcaccattcatcaatttttaaattgtatctcatgtttaaacatttatttgcttcaaatgaataattaaagtcagtcccatctccccctaaaccaaaattaagtagcattgaaattccttttcatagagagatatatacgacaagattgggtatttggaaagatacagacactgcttgcaactataaaaacaagatcaaaacatttggatgccctttctccacttcagtaggacagcaactacacaaggctattctctggagtaatgatcttgtctccttccaaaggtttttttatcctatattcaggaggtcatatgcagtcttcagctgcacagagctccactcctattaatttaaaatgggggctccagaggttcacattcagcaaaatctgccccttaagaggtaagctttaccaatctcccatttgaagaaaaaaagaagcgtttatctttggaaaaaataacctacttaaatagtctatcttccctaacaagaaataaagaaaaacttcagacataagttaataaaatatccttttgattaaacagagttcactttattttcatgttttggcaacactgttttagtggatttgcatgggggggctctggtattgttattttatcattatattatcattttgttaagctatctggcaaattgaaaaggttattcaccctatggctgtctttttttttttaatgttgagcattcattgaaaagaatgaaagaaatctggttgaatatgcaggtgcactaataaatgggtggtctttggattacagtatttatgtgtactgtggcaaagctgaacagaaacctaaatgttatacatacaaagtggtacaacaagaacatctgtgttggggggattgaactggcatggctaacacctccagtgccaggtgcaaaggaaatttcaatacagcttgagtaatcttgactgctagcatctgcctgcatcagattatctcctatgttcctagtccaccactatccattagagtatttatatgatacatctggtggtgcaatggccaagcaagaagcagcaatgcctccgttactgggggcaaatgcctgactctttaactcaatacaaaggcaaacaggaattcatttcaggcccacaggcagccagccaactcttcaagactaattagaagatagcactccagtgtgatggctgctttgtcctttcagtttagttacttacatatccatgtgcacaatctgcagacatttaacttttcattttaaaatcctatttctaaatatcatttccaggaaaataacagggttttaatatgttgccagaatcacaacagagctttaatgtgacttggctcaatccaaagtctcaacatgcacctgattttcagaatgaatcaatgtggtcgggtgagaatggtggagatcatcagtccattagtctccgcaacatcaaatctcacatgtccaacaacacaaagattatgtccctctcttcaagtcttcaaatctttctcacctcaagagatgactgtgtcacctaatgcagagaaaatcagtgggattgctttagcagtctgccatctaagaatctacataaaccagcacctacctttcctctctgcttcctgttaccatagatgtgtgacacctctgtctttgactttataaagcaaacccatctcttcctgctttatacacccacatttccctgatttttgcatgcactccccctctccactgtatccttgccatctgaatatattgatccacttgcaatcctcttcaaagaaaacctctgtagatgttatgttcccctacagctatcaccttccccagggtgaaggtgttctttcacaatcaaacatctttataggtttcttcactgtgttctcctactcacctctcaaactgttcaaatctggctcctttcctcaacatttcatgagactgtatcatataaattgtataggtcccatatcttcacgctgctaaaatcaaagggcttcatcatcctaatagctattcctgcagtatttgaaacgtgtgaccattacttcctcatgaagtctctttccttagcctctactatgtgatatttactctcatgttttgtgatatttactctcatgttttgtgattttactctcatgttttgtgatatttactctcgtgttttgtgattttactctcatgttttgtgatatttactctcatgttttgtgattttactctcgtgttttgtgatatttactctcatgttttgtgattttactctcatgttttgtgatatttactctcatgttttgtgattttactctcatgttttgtgattttactctcatgttttgtgatatttactctcatgttttgtgatatttactctcatgttttgtgattttactctcatgttttgtgattttactctcatgttttgtgatatttactctcatgttttgtgatatttactctcatgttttgtgattttactctcatgttttgtgattttactctcatgttttgtgatatttactctcatgttttgtgatatttactctcatgttttgtgattttactctcatgttttgtgatatttactctcatgttttgtgattttactctcatgttttgtgattttactctcatgttttgtgattttactctcatgttttgtgattttactctcgtgttttgtgattttactctcatgttttgtgatatttactctcatgttttgtgattttactctcgtgttttgtgattttactctcatgttttgtgatatttactctcatgttttgtgatatttactctcatgttttgtgatatttactctcatgttttgtgatatttactctcatgttttgtgattttactctcatgttttgtgattttactctcatgttttgtgattttactctcatgttttgtgattttactctcgtgttttgtgattttactctcatgttttgtgatatttactctcatgttttgtgattttactctcgtgttttgtgattttactctcatgttttgtgattttactctcatgttttgtgattttactctcatgttttgtgattttactctcatgttttgtgattttactctcatgttttgtgattttactctcatgttttgtgatatttactctcatgttttgtgattttactctcgtgttttgtgatatttactctcatgttttgtgattttactctcgtgttttgtgatatttactctcatgttttgtgttcctctacatctctggacacttattcctagccttctttggcctccctttccaccatattcaacaattcaaggatggaattatgcagggatttgtcctgagtcatctcttcactatactttttccttagaaattctcattcaccaatacggcttcaattgccatcatcttgcagatgagctacacattttaatccccagcttagagtaaatcagtttcctaaacttcaagccctagcatcaaatcattcattcaacatctgaatctaatacttctgaatctaactcatcgttctctttgccaccaaaatacttttttttctaaagtacctagtccttccaaatttcaccaccatccatctaactgattaagctagataattcaccatttttgacatctctgtcttgttccttttccaaatcgatcaattagtaagtattgccaattaacttttaaaaacgtaaacattatacatgactatgtactttataaaaaatggcaataattgtcctttcatcatcactcctaatccttgggcatctttctttacacagaggtaatactaattatgaaatatattcattcaaatttttgtctattcttatactcatatatgtaccagttcaatttgaaatatatcagttttgtatatcaatttttataaaaaaatggtaacacattctaaaatttgatttattcagacaaaaacatgtcctggaaagctattttcgtatatatatcaatttgattcattttaattaatgcccaaaataccacagtatatatatccctctgttagagtttcttctatttaaagttgcgctttctcattttttctgttaacaatgctgcaatgaatatattcaagcatggctccttatatgaatgattctcaagatagagaaatagagattgaaaagatattgacatattacattcccaagtggtactgggagaaaattctccatggatttgtcacttttctgtatgtctgggaagcaaagcatcgtctgtcatttattccataatatcttttaaaaagatgtagagtgaacagccttggaaaacaacatgtctccctctggagcaaggggaaggtatgctaactcttcagtataatagcatttcccctaagcttggagttcttctcctatgatgcaaaccattgcagaagcaggtgttacctggcccccttagtgtcatcctgtgggaactgggacttcaggaactagtgcaaaaatgctgattattctggttgctgttattgctctgagtaataaactaaatttatctctggcccaggattctcatgccttccaccagctttcacagaactgtggtgacggtgatacagtttaccctctcatcatacaagtctgaacaatatcagcttcttcacattacagccaataagtgatagtaataaatgtttctttttttccaaataaaataaaagaaaaaaggtatcttatttcagtttgcatttccctagttattagtatagtgaggttttacatgttgcgttctctctctttccttcttcctctttttctctcttgccatttatctcttcccaagtactccttatactttcacttttgttcatctctgatgccaccatcctagttcaaagtagctgcaattatttcctaactggtctccccaagtctactcagcctccctcaaacacagatctgatcacatggcttccttccttaaaaacacttggtctttccaattgtctttaggataaaacttgaaacccttgacagggcctacatgctcgggataatcttgtctctagctctatttgttgacactcttgtcttcattttcaacttacatttagcttttaactttcttggatatggcacgctctttcttcttttggggatttcattcatttagaaaaaaaattccatgtgctatttcaaattaatgttttttaacaaagaaaaatttaatgtttaggaaataaggagaaaaaatctgctttggttgtaaactgcaatgaaaagaaaagaaaaagtttaggcagaaaatatatgtaaatattatatggtacttatttctggataaggggataaatgcattttcttattttagttattttaattttctctattctttctttctccaacaaacatattttgctctattaattagaaaaaataatcttaaaaaactgcttttttggcctctatcctgctctctcctattacataattacaacaaagcaagtaatgaagtttcaaaaggaaaagtttaggaagaaaatatataatttcacccacaaaatgtagcacaatttcaaaaataccaaatgaaaactaaatgcccaaacagcttctttgtcatcacctaagctaatttcaaatgaataagactaagggaatacagtactgaattgagaaggccaatgcctgcctcaccagttttagagtcagagtcacacagtactgtcctgacttccattcgctcctccctccttctcccactccattgcttctcctcccactcaacatttagtaagcactgtctatgtgcagtgaagtgaaagtccaagaagttcatgctgaaatagaggagctgatctgtaagtacctacactcatcctgatggcaaatgaacagacaaaagcatgaacgcaatgattatgaccggaggcagcagttgagtggtcttgagaaaagcatggactcttgcctggtggctgagagatgtagtgagatttctcatacagaataaacaggaagaatatggcaatctagggcaaatataaacaatcccataagaaaggaacctgtagtataggcatgcatgtgagtcaaggtgattaatgatgaacctgggagaaaattaaggttttcgagccacattagtctcaagggtaaaaaagaggcaatgtatttataaagtgccccacaaaatgcagggccccatagtaagcataaatattattcattcttcctctcccatctcttgcacgtacactccctttcaaatttcataaaagtctatgtcatgtagatgtattccaaataataataaagatggtaataatagtaaaaataaccactaatctataataagtacaattagcatacaaatgttttacacgttttatctcattcaatcttcaattactctcataaggtggctactggtattaccttcattttgccgatgaggaaaccgagacacagagttaagtaactggcctaattaaattaattcatggttgaggtaggatttgccatcagccattctgatttaggattggagctccaagataataacagtaactagaagtgtaattagtaaccagtgttatttctctgtgcaatgaaattatatgcaaatggaaaaagacaagatttgaaaggtatgcattttattcacaaaagtcaaacattaaaaaaatttatttatacaatgttaagcatgtttctctctgtatgtttgccactttgtatatatggcctggatattatttctttaagcagattaattttcagattcattcacaaacagttacaaacctcttactatataccaagttttatgttagaactttaaagagttgaaaacaagcagataacattcttgccttcctggagtttatggcctaatgagtataacaaatttaaaacaaaaatgaagatatacgattgtaaaatataacaaatgccattaaggaaataatatgaacacgttatgaaatagaacaagaagaagaaataatttaaattttttctactttaactttttaatctggacagaagtggagataaggaatgtggttagagaagaaataaaatgacactggtaaatatcagtaactattactcaactctcagccatgtctaagtttttttggactttcaaggtcacactagtgtactgttatatgtcatgagtaataaatttggtttaaatattattatgaacccaaattatagaataaaaaggtgactatgaaaatgcatatagcaggccgggcacagtggctcacgcctgtaatcccagcactttgggaggccgaggtgggtggatcacctgaggtcaggagttcgaaaccagcctggccaacatggtgaaaccccatctccaacaaaaatacaaaaattagccaggcatagtggtgggtgcctgtaatcccagctacccgggaggctgaagcaggagaatcacttgaacccgggaggtggaggttgcagtgaaccgagattgaaacattacactccaacctgggtgacagagcaagactccgtctcaaaaaaaaaaaaaaaaaaaaaaagaaccatatagcaagttccctcttttgtcaacgtgtatgtgtatgtgtgggtggggagggaggtgtgtgtgttcttaaaataacttaaaggtcttttaaaggacttacaccaatgtgttggtaatcactgtcttcagtagatagaattatgaatgattttttgtttctttccaacaatttattttctatacagtttatcagtttttatgtagtacactgaacaagaaaaatgtacaaatatatagttttaaaagtttttctgaacctctaagctaggatcttgtttcatctcacacactgaatgaaactttatgaattgagaaagccacttcattccctggccttcacatcaaatgacaagagaaagggccagacagtctagtctctaaggaactcctagagatccagagtgtatctaaagcagatgcctaagtattctaaagtcctatttatttattaaaattttaaagtgagaataattcagttttatctataagtaatattttttcagtaatactttttataattgtgaacaattgttcactactttcctctacctttatttgaatttaatgtttggatttttgtttgcttccttgggacgtgggtttttttcctagacttcaaatctctgaagccagtaccttattccagttgcaatctgtataatttcactttttccatttttagtaacattaaagaaaaaaatcatcacaaatcattcttggttgtttatctggacaagtgttctcaactattccaaagctctaagaccactgtaaacttttgaaatgagtaattataccaggtttatataaaagtcatatgctgaccagttacacgggaaattaaaaaaaaaactagaacgtacatgagaaggagaagaacaggcctcaaaacaagctaaaagtgagatgcaagtgaaaaaaaaaatcatacgtccacatatagacctgtatgaatattttccacatggagctcaaactatctagtcccttacgctttccctgtgaggtcaccatgggcttaatgaatgtaccggtgcttgatagaaagttaggctctcctcaagacaggtgactctccatctttctcactttttatcttttctttctttgtccattgaagtctagatggtgtccctctattgcgtctgaatccatggtcctgtccatacttttgtaataataaatacctttgtaaataaacccttctgaggacatcctaacttgtttgtttcctagtaggttcattactaatatgcaaatattagctttcatttggctttaaaataaaataagctttatttggaagggtagattcatatgaaaacaagacacatgtcccagatgaaacttcgtgttcataacacttaagccttcaaagtgttcagattatgtaaaatttgagagaaaagaataatcagtttcaatacgaggtattccagtattcatgtgttcaaaatagagaagaggaaaagaaatggagaaggaatttgaaatattttccaaacagatcatacacttgacctctagcttaacttagctatgatacttgaagtcatatttacaaggtcatagttttaaaaggagatacatcttgatcaagattactctatttgtctctacactgaaaccatcttgcaaaagcattcaatagttaaataaaaatatctttctaatgaaaaactagtgaaaaccacaatgatatttgcttaacctcataggtgaatttgttggtggtctaagatgtctgccaacaaaagctctttttgtgctttgaattgaccaaaggccaaatgctaatggaaatgaatacctgatctgctttgaaagtgaatcctgcctacaatgaataagagatggcttgaaggaagataaggggaagctgatcatacttttgtccatttatggactttctaaactaaaatattacattatatcctttgagaaagaagctgaaccaccattcccgggacagagtttttttttatagctttattgaaatgtaatccacatatcattcacccatttaaagtgtgaaattcagttttttttagtatattcaaagttatgtgcaaccatcatcacagtaaattttagaacattttcatcacttcaggaagaaaccctgtatcttttagatattgctgctgtattctccaatcccccacctctcaccctcagtccactattctcccagcaactaatgatctactttctgcctctgtagattttcctattctgaatatttcatacaaatggaatcatagaatatgtagtattttgtgatttccttctttcacttagcatgtttttaaggttactccatgttctagtttgcatcagtactcaattcatttttataagtgaataacatttatttgtatgaatataccatattttctttatccattcatcccctgattggcattttgattgttttgacctttggctattatgaataatgttgctttaaacattaatgtacaggctttctgtagacataagctttcagttttcatggactctgacctaagattggaattgctgagtcaatgttctaaatctatgtttagccatttgataaacttgaaagaatgttctctaaattggcagcactattttacaatgtgaccaacagggtataagggttatgatttctccacattcttggcaacacttagtgttatctgacatttttattctaatgggtgggcagtggtatttctttagggttttgatttgcattttcctaatgactaaggatgttgagcacctttgcatgtgctgattagtatctcttctatacgtatatataccatttctatgtgttctttggataaatgtctattaaggacatctgccatgctgtaattgggctatttattttttgttattgagttgtatcattacatattatagaaataagtctctatgagatatatgattccaattattttctctcacttgtgttgtcttttcactttcttgatagagtcctttgaaatgcaagttttaaattttgatgaagtccaatttacatattttttcttttgttgttcatgctgttggcatcatatatgagaatccattgctgaatcaagtttatgaagatttacccttgttttcgtctaaaagttttatagttttagatcttacacttacatccttgattattttttagttaatttttctatacagtcatgtgtcacttaatgagtggactactttctgagaaatgcatcattaggtgattttgtcattatgagaacattatagagtgcacttacacaaatatagatgatatagtctactacacgtctaggctaaatgggatagtctattgctccccggctacaaaactgtacagcatgtttactgtactgaatactgtagacaactaactgtaacacaattgtaggtatctctgtatgtaagcatgtcaaaacatagaagaggtacagtaaaattaagttattattatcttatgggaccaccattatatatgcagtccatcattgactaaagcattgttaatgtggggaacgactgtatagcacgaaataagagtccaactgcattctttgtatgtagatatccagttgtctcagcattttttgttgaagactattgtctccattaaatggtcttggcactcttatctaaaattagttgaccacagatacatgcatttatttatggactcccaattctatgctatatatatatatatgtctatccttatgttactaccacactgtcttgattactcatggtttgtactcctttttcgaaatcagaaaatgtggatactccaactttgttaatctttttgaaatattattttggcctgaatctcttgcaattccaaatgaattttagaatcaccttgttgatttctgtaaagaagccagctaggattctgatagtgattgcattgaatctgtagatcaagttggtgagcattgccatgttaacaatattaagtctcccaatccatgaacacaagatgtttatctgtttatttacatcttctttaatctcttttgacaatgttttgcaattttcaaatgttttctttcttttaattttttaaaatttttaaaaatttctttcaatgatgttttgcagttttgaatttcatttgctaaatttatttttagcattttattcttttctgaggctataataaaatttttttttaatttcattttttgttgtgttgcaagggtctagaaatacaattgattcctacctattgatcttgtgacttataagcatgccaaactcattgattagttctaatattattttggtgaattccttaagatctcctatatataagaacatgttatgtgcaaatagaaatagttttaattcttccttttcaatctgatgccttttatttatttttttgccttttatttatttttcttgcctaattgccctagctggaacttccagcacaatgttgaataaaagtgatgtaaatggatatccatgacttatttctgaataaagcatctagtatttcaccattaagtatgatattagttgtgggttttacatagaagccctttatcaggttgagtactctctatttctagtttgttgaatgttttttattataaaaattgttaagttttgttgagtactttatctgtgtgtactgagttgatcatgtgatttttggtttttattctattgctatagtgcattacattgattgatttccaggtgttaaaccaactctcattcctgggataaatatcatttgttcatgttgtataattcattttatatgttgtgaattcagtttgttagtattttgctaagaatttttgcatctatattcataaaaatattggtctgttatattcttttcttgttatatctttatgtgatttcagtgtcatgataatactggcctcatagaattagggagtatttctcctcattttttggaagggtttgtgaatagtggatattaattttttgtcttacacatttggtagaatttgccagtgaagccatctgggtctttgcttttctttgtgggtagattttgattactactctgaattctacacttatcaattcagattgagtccatttcttcttgagtcagtttcagtagtttgtgtctttctaagagtatgttcattttatgtaagttatctgatgtagtggcattaaattttttatagtattgttatagtcttttcttttttaaaggctgatagtaatactttctctttcatttctgattctactagtttgaatcttctctttttcttggtcaatctagctaaaggtttgttaatttcgttgatcttttaaaaaaacttgtttttggcttcactgactttttatatttttttcactttcctatttcactaatttctgccttaatctttgttttttccttccttctgcttgcttcaggcttagtgtgctcttctttttttgttttgcagtgtctgaagattgaagtataggctatttatttaagctgtttttttcttaatgcttacatttagtgcttcaaatttctctctaaacactgcatccccaaaatttggtatgttacgtcttcattcatcttaaggtgctttctaatttcctttttgatttcttcattgattcattggttattttagagtatgtttttgaattttcaatgttagtaaatttcccatatttcttttgttattgatttctaattttattccattgttgccaaacatgttttgtattatttttcatctttgagctttactttatgggctagcattcggtctatcctggagaatgtttgatgtacacttgaaaagaaaagcatagtctacagttgttggctggagttttatataaatgttatatagatatttattatattggtgtttgtacagatgctgatacacatacagtggttcacagagttccaatgttctatttccttgttatttctacctaattattctaccactttgaaagtgggatatagaagtctccagttattactgaattgtctatttctccttccacttctgtcattttttgctttattttgattttctgttgttagggtatatatgtttacaattcttatatcctactgaaggattgacgatcattattaaatgtccttctttatctctggtatcattctttgttttaaactctatcagtataaccactccaactttcttgtgattgctgtttgcatgatctgtctttcccagtcatttactttcaatctattttttatcttgtaatctaaagtgtgtcccctgaagagagcatataaatagatcttgtttttcctccccattctgacaatctctgcctttgattaggttatttaatccattcacacttactaccattgttgatatggctggattcatgtctgccatcttaatttttgttttctataagtctgatgtctttgttgtaaatctattgctttcttttgcatttagtattttcaaatgcagaatttatcttactttaatgatctttttactatctcttcttaagcaaccttagtggtggctctagggcttaccatctacatcttatcagaatcagcttcatatttatactaacataattccagtgagatatagaactgctactcctacataatgcaacttcctttctgaatttttatatttttatacctattacatctataaatgttacaaacacgttactttcctacattattacattatataattttgtatcttttactgaagctcaaagaataatatatataaaaaagggcaatgaatatgtatttatactatcttttataattcaataactatatcagtgccttttgtattataatgtggattcaagttattataatatctggggtcagttgctttcaacctgcacacttgcctttattactcaacgtgagtgagttagcaacaaattttctcagttttggtttatttgggattatgtttattttgctttcatttatgagagacttttgatcaatacagaattcatggttgatttttttttctttcagccctttaaatacagcatctcattgcatactgacctccattgttttaggtgggaagccatctgttagttttctttaaattcacttggaatttatggagtgggggttacttcttgctgtttctaaatttttttccaggtctttttccaggtccttttttccaggacatttttttccaatgtctccaacatttttactatgtgtgtatgtgtggatttcttcacgtttatcctatttggagtttgttagccttactagatatgtatattaatatttttcaataaagctgggtagtttttagcctttttaaaaaatatttctcctgcttcctcctatctttatttcccttctagtactccatcttgcaatatgttaatatttctctgagtagcatttttcttcattgttaaaaattgtttggattatataatctttactgatcaattttcaagtcattaattatttctttgccacttcaatccagggaaattttcacttcagttatttttcaacccttgaatttaaatgtttcctttgaaatagtttctatttttatgtataatgtattgatagcatttatttgctgtgttattgttatcattctcttctttactttaatcatgatttcttacttctgtgtacttataatggctaatttgaaggctttgtctgtttaactcaatatctgcttgcaatcacaggtagtttctgttgcctgttttttctcccttgtgtatgggtcagattttcctttctcttcaggtaccatacttttgtattagaaacttgacactttaggtaaagcattttagctattctgggtactcacattgggacttgtttgcttgtttgttttgtgactgtctggcttatctttgtgaattctagtccaccaccaccaccaaatgccccatttttccctcttgtggtgtgaagtttctaataatgctcctaagggaatacaaccttggctatatgccctgcaatgatagtgactttttcaggacactctttgactatctctttctttgaccatattcaatttcactaattaccagcctcttatgctcttgtttttaacaatgccctggtgcatagattgcttgaccaacagatccaatcaaattcaggattatttgaagagatagttcctgaggtcggtgtttgagatatgttttgaagttaggaggacacttcctagttgcctctattcgtggttcactccagcaaagtagccagcctacagtgcagcctgcatttccaaagaatccaccaatctccccccaattgcctttcatcattaccttcactgtttttgaaagcacccttaggtttgaacttattcacactctatgacaaattaagtcagttcctgtgggaagagatatggagctttctgttttgcagtctgtttcttcccttcgcaaaacctctgacagccttcaaactggcatggggacaatagtacagtctttctgcctgacactctaactttagttgctgagtatgggagactcaagagttttaatagattttcttgactacatatttatttatttattcattacatgatccatgtgtgcctttttaaggaacatttccagagatttgttgcccctaagaccataagaccatgtagagagacttaaacactttcttaaagcggtttttatcagtttcaccaaggagtgggtccacagagctccttatgttgaaagagaaacttttactttttaaaaaatctagctacttgtattaatgaaatgtttgtcctttttttatagcttgaatgtggctaaggccacataagcaaataattcttatatatagatattaacaagagtgatcggaatattgtgatgggttattttgatcaggttaatgatatagacaatcacaggatatatttttaaaaagtgatagagatttaaaaaaaataacaattagtggattaattaagagtatcattttctactttgtctaccacacaaaggcctaaatttagtctttaaatatagtcagtcaaatttatgataataaaatgtgctattattatataaagggaattatttatttactacttaaaaatttagaccatttaattttataattaatttctctaaaatgaatttaaaaatattactgtcctctatgcttggtagaatttctatttatttttgcctccccataagtcaccaatctcctagtttccaaactagttagtaagtttccatttgaaatatctgaaggtcaaattattatttagctatagatatccaaggattgagaaaatgtccaatcacataataaataacctgtcagaatcccaagaaggtataatagaaatgaaataagtaaaaataaatccacacacagagacagaagcctatcagaaattattataaatggttgaatttcagggaaaaatgctattacaaacatataatccctagttactcattttttttcttgattcttagatttaaagccagattccttcattatttctgacctgatatgaaacaccatctggcatgtgcgtgctaagaggattatatgtaagcaaaatagatatgttttttctccttctgactctaagactttttaaaggcgtgtagattatttaggtttgaaatgtgaaaattaaactggtaaagagaaaagacagtttctagtaatatattctttaaaattaaagcaattatacattgctttaacaatgaagtattttaattggcattctgcaatatctcttttaaattttaacatcatgactattttccttgaggattataaattaagattccctagaggaaatgataaagattttcataattatcttatgattcatacacatatcaaactgtatctcatagctcactaaatctatgttggccaaatttttcagataattatcaaatatttatcaatatccagtttcatttaacttataatacatgaaatgaatcaattatataacacatataagattgcaattcatgtttgtggttacttttcaaaatgaagaatttctgctgtttttaacatttactttaaattacataattttaaagctagtagtttacaagtcatgtggttaaaaaagaatctcatttatctatttaatgggggtctcactgtgttgcccaggctgcactcaaacttctgggctcaagcgatcttctcacctccaccttctaagtaactgggactacaggtgcccgcaccgcaccaggcaagaatctcatttttttgtctgtttgttttaagagaaagctgccatccagaaaggatatgtgacttatctcaaggcccacagctatttgatgagaagtccagggttagaatacaggtggtccaagccttggttcattctaccttggacactactgtgtttccttcacaatcctgatgaacttttgttcaaaaaatttcactttggagggtctgagaatatatatagttgcccaaacttcatgcacaccacactgtaaattgaactagattcacactttggaaagtaatcttttcctacattcttactcaaatgactatagtggctaatgtttgaattgcaaaacatttcctaaatatgcaaactaccagataaatctatgagaaacagccaaacaaactagccaatgcaaatgaaaagaatagatcataatgaaagtatccaaaaaggatctgctaaagtcaatctaccaggcatacaagtgatctaaatttctattttatatatggtataactaaaacttatatggctttatcttgacaaaattacacagaaaatagaagaaggaaggagggaggcagaaaggagaaggaggcagcaatcttgtttattggcctagtcctttgtgctggagtatattaaaaatgcaaatactaaaagcatggaacaagggcacataatggcatatatatttcacacatacctatgtgataacatttacccataatttcattaaaacaaaaagcagcaggcaaaatgagagggcacttaagatgtggaattttattaaaattttatctattctcttttatctcttgcatataagatcatatctatgttcagaattctgaatgactatgtatgccacaagaaaatataaaataaaatagtttagcaagatttttgttattgttgtcagctgtgtctgacaagaatatcaattaagatggcatttgttaagcccttgtctatgctgaactagctacagtatagagtagtttaacccatcttatcctataggctcagagaactcaattccagaatcatggagaatttctggctttgacgatgagggttattatatcatcagcttctgtgtctcactaattccagtgatgacaagatttttcatcatttatttttattttatttttacaactggtgcgtgttaggtttgtagaacacagggtagaaacagctggagttagtgttattatttttcactttgaaggaaataagaggctgacaacagtgaaggacaaagacaaagttgttgctggacatgctctggcacataggccacctcccactgcaaccagttctaaattaattatttattgttattttagttgctgtaactttctgaagtgtcctatctattgtgaatgggagtttcaactcattattgttttgtaaaacctaagactctaacttgaagagacactaaatttaatatgagtaatctgaaaacaattttagagctgtttatagtacacacacactcgcacccgcacacacactcacacacacagtacagcgctacactggctgcttcataatgccactcagacaggactacccacaaagcacactggctttgcccaaaactaatggatgtgagcaaaagtgaagctggtagatgattttgaattttgtagcgatcagtaaaatcaatcatgagagaaattaacactaagattttcagggccaaataaatactcaacctctaccattgctctggacatattaaaacactttcaaaaaatgtattcttttctgtctcaaaactcattagttctgtcatcaccaaagaagagtaaagcttcaactacctagcatcagttttttttctgtgtgtgtgtgtgtgtgtgtgttcaaaaataatttgctgtgaatggtgataatgaattaagaatagcatttagaagtactcacagtaaatttgaacatataaatttcattaagaaaatgagcaggctgtgctgaaattatacacaaaaccaatgtatatgtatgagaaaatctattctacaaaagaagggcagaacaaattttgcattagcccaaattaatttacttatatataaaatccagcagatctgattatttctttgttagagaagttttccaattttaaacattctatattgtgtttataatatgtggtcagtattactcatacatacatacactcatatacagtaatgcattgctcaacaacagggatacattctgataagtgtgttgtgagatgattttgtcattgtgagagcatcaaagagtgtacttacacaaatatagatggtatagtttactacaaacctgtatagcatgttactttactgaatactgtaggcaatggtaacttaatggtaattatttgtgtatctaaacataactaaacatagaaaaagtacagtaagaatacggtattataatcatatgggtctagagttgtatatgcagttgtcattgactgaaatgtcattatgcactgcatacgtgaatagatatggatatatatgaacacgtgtatctatatttatgtctgtagcattatttatttgtttctatgaaatttataccactatagaaatgccagaaaattaagctatctggggagaaaattactggggttaatctttagggatattgttttttcaacaattacaaaatacacttatgatcaatgaccatccttcattcccaagaaatctgtctctaagcataaagttgttaaataaaatattttgttaagtgtaacaggataaattatgatatattccgtccatgccaagataaccaaatagttttaactgatagaaaaacatgtaaaaataaatattagacaaattttatatgtattaataacaataatgcaaaagtcaatgtagtttgtacataaatgcaatgtaatgaaattttcctatctttgccaaaaggtaaaactgctttatagtgaaagatttgtggtggaggaggtgcgaaaaagagttggtctttggaaaagtcttgttgcatcctttttttctactgttgttacttcctatgggctcatacttaccttgtactaaacctgaacttaacatttttagggcaaaacaaatatttaacaaaagagtgcctcaaaacaacaaaagtagagttcatgtgcaataaactgaagtactttgtcttcattcttttacttggcaaatacacacaattcaaatttattccatatgatttctctttctagaaaatgtgacttcacataaattgatgaatgctttttttgcctgaaaccatgatgtcaaaataatacttagcatggcctagtcacttagtgtatttttggggtaaatgccattatactgaaggaaaaatttctcttacctgaaaaatggtgtatgttttcaaaagctgttatggtaaaatttcattaattaaagagttattatgtgaggtaaactgtaaagtcaaaaatactccacaaattaaaaaacaggagtagaaatcaatgccatcaaataagatagagcaataactaaactctttcaagtgaaaaacgcatataataagagaattattgtaacattgccacattttattatgactctatagattcaaacatactttaaaaccttagtttaaactttagaataagcttctgagatcaaccgatctttcttactagtcttatctcttttcattctccttgtttactttgctcatttcactttctataaagaaccattctctattcagagtaatctttatacacattactacctctgtctggaaagctaccctctccatatttactactaagtcaaagtacctcagggaagtctttcttcctctcctaccggatgagatgtgttcttaacatgtaagactattataaatattttcacaacaattaaataattactatgttataatttgtgtcttgactactattatgctgtgatcttccaggaggacaagggctaagtccctaagtctctgttgttcattgttggctgacgaattgtattaagcaaggttaaaaattctttcttctttccctttctttctttctttctttctttctttctttctttctttctttctttctttctttctttctttttctttctttctcttggtaaggtctcactgtgttgctcagactggagtaaaatcatagctcactacagccttgaacttctgggcttaagcaatcttctcacctgtgcccctagagtagctgggactataggcctgcatcaccaccatgctcagccaatttttaaaatcttttgtagagacaaggtcttactatgttgcccaggctggtctggaacttgtggcctcaagccatccacctgccttggcctcccccaaaatatgctttttaatgactgtccagttcacgttatattttctgataacattctacaaaaaactatttaataaaaataatttattagcatttgaaagagatatatcagaaaatcatgaaaagatttctgcaggaaaataatttccatattataaaattatgcatattttatgtgtgtatatgtttattattatgcatatgtatgagtgtaattgcacatatgtgtgtgtgaatgtgtgtgtgtacatatatttatatatagtcttttggtatgaaatggatggtaattttctgctatacagaaaaaaaaataaaactcatactgtgttctattccctaatagtgtctgaaggttcactttaatgtgattctgattaaagatggtcatctttattgattttcgaggaaaagtaagttgaattgatgtgaagttttgacatttctaaggaaaaaataccttgtgattgaagtatgtcagtaacagtattcaaatatcccaaagtaatcaagtcttctatgtaatgtttaacttagctaaagcctcattcggtgggtttgagagaagttgatgtgtttattggattttcctcttagtctttctgagaattcttaggaatgctttcaagacccaaagatggttggcccatcccggtttgctaaggaccacttccggttgcttttatcctctcatatccttttgcctccctcttttcctctcctatatgggataaaatgaagtgaagatctaagagtaatataagaggattaaatgaagaattgtaaaaggctaaaggagattagacattcacgctccctagaatccatctgtcttatcttctcagagacccctacatactggcccattttgtactcaatccttcaatattttggtgttttagaatccatatgtctttttaggcaaaaggctgccctgctcgaaattccttgcccacaaaatctagagtaagttagtgaaaaaaaaaaaaaagaatttaatctcttcaggggttaaaggttggcttattattattattattactattattattattatttgttttgaacttaggatgattggccatatgaccatgcatttgctttagggaagaatctcatggcactatatccagaccctggagacaaaagcaagagaatcataagagtgaaccaaatgcatctcaaaatttgtgtgattccatcttaaactacctagcgtatagcatgcactcaggactaactcaaatccctaattcagaaagcaaaaaaactaactttttaaagggcacagtctgattagaaacaccccaaatgtgttactaattagaaaacaatatttagtgtaaagtgttttatcattttactagcttagggtttcattgctctcaaaataatgaagaggtacttgtaagacaaaaaagtgctcactaaagtagcaactcccagaatgatgaatctgtctgttttagtgacaaattctaggctctattctacaagcaaaacttctttacaagctctaatgtgtcaatttccaatctccaacaattttaagttcttgactacatccagagcatcaggaagaatctgctggtcactctgaaatagcattttgtttttgctacacaaagactattcaagcttattattcatgcttgttattttgcctgaatggttgcaaaaagagagtaatttcttgaggtgtcttggcttgagttggaagacagaggggaacacactgaagatccctcaagacaatgcaagcctatgtataagaagggacttgccttaagctatgcacaggcaaagaaagaaaaaagggacatagaaaggaagtggtggggaaacaattttcagacaattccccaccctagtctggtgatccaatgacaaatgggactgtctgaagcaactctgactgaagagcaatgtcaaagtctctctgtctctctttttctttgccaggggaggatgttcgtatttgctactttgtaaagcaatatttcatgccagtgtcctttgttcttgcctataaattgagtcccagaatttcctttttgctatcttgcaagcgtaaagtgggtgtgattggggataatgtcccccactggcagtccacgctccacactaatgactcttcccttagtcagacgtgctgtgaagtgaatcattgaaggaaggttgataaagcaggaatgttttcaaatgatttttctacacacttctataaattgcctaaagatgatcattatcatctgagaatatgaagtatagctgcgtggaggaggggagaaagggcggacaggtagtccaagagggaaattatctgcatcattgagaaccaactgtcaaagcagagaaaccagagtccagggagtgtgtggggggtgcaaccacaggtcgaagaagagaagagccacacacttctcaacccccctcccactccacacctactccccagagagtgagagaaagccggaaataaagcttctgtttgtcactcctcacatcacaattccacttaactaaacaaaggcctggcaaaggcagttttaaccctaaagctcagagtgagaagtgcacctgttttagattcaacaaaatagtcccaaatgcctggaaggcatggtatctttgtggtcccccttgcctggcaagtacaggcccttctgagctacaaacctctggctatgagttctttcttctttgcctccttgggatgaaactgtcagctatggagaaaaagtaaggaaccttgtgatggactttgaaattcaacataatacctaagtagtaaagataaaagaatcctctcctccgtctcacaaacacagttgcatgaacccttgtccgtgctaattgaccaaggaatgaagtataagatagtaactacagatttaaaagaaaaaaaaattcatacactcttctccaaaagtaagtgtaagatttctgaaaattacaaacacatatactacgtgtatatttatggttcttaaactacttgaatgtatcttagcagtaaaatatcccccaataaaatattcctctccttcttgaaaacatgaaccacgcaatgctaagtgaaatatttgttacaaatatttttccagtggtttaaacactccaaatgccaaataaattgcaaggaatgaataatatttttgaaaatagttttatgtgaatgaattgtttatgcaaacatagatttaataatctgaatccaaataacaaaaaatcattccaaaatattttatcaccctatccagtttttactaacctttatgccctcagaaagttactttatttcgatgcttttctattggcagcagtaaaatctcatggaacttagaaaaggtgatgtagggggagtattctccatcttatatcattgcagtattcactttaaagcaatgtagtccttttctgtttctaccccaacatttcataattatatcattttacaagaattgtgtaatttacataaccacctaaattgtcataattgctagaaagtgctgaaaaagcatacggtaggcatttcagattcatttctgctctctgtttgaaactcattttaaatgccttttgcataaaaattcttttggtcaacaaaaaagtaacttggatttaattttgcaggaaccttctcttcttctccctctcagactgacttctcttctttcaggaagcctttctcaggtattagacctgagtactaacagggtcacctggtaaacaaacccctcctcttgatcttacagaagaagctgagaccacagaggttagctgacttgatctgagtaccacaggtcacatctgcggagccaagactagaaatcacttttatttaacttgcatgttttgttcattgtcccgcactgttctacactgcatttagaaagaggaaaaggaaaaatacaagaatggaatggtctctctacagttttctcagcatgccatttctattataattatcttaaccatctgttttgcttggaacaggcaaaagaatttgatattaagaaacaaaattcattctgtacaacagagaagggcttcagaaatgagactttatttcagaatacaagagtggatatcaattttatcagaggtttcatctgtgaagtagaatgccagtatttgaccattactgttttgaaaatcagtggctcatgtagttttgtaaataaaaatgtgcaactcaaagttattgcagcatattgtttataatatttgcttagagtgtaatgtggaaacctgaagtaaagcaccactaaacagttaagggcattggaaaatggcaacttttcccaatacccttaattgtttttctttcttgaattctgcttcaacttctctcctaaaaagctaatctatccttgcatacttaaaagacaatgtattgatgtttagctccttgaaactaatttagctgttatgtgaagctataaaacttagtggcaacatatgtgataggcataaataatggaccacctttctggtatgcttacctagtgcacgtgtgcacatatatggacgcacacactgcaaaaaacacacacatggatgcacaagacatacacgcagatacacaaaaacaatttatgctactaataattcagagttttgaaataaataagaaataagctggttcacttattttcctttctgtcaaaaattactgtaaaatatgtattttattgcaaattaagaaaaaaattgagagtgatgtacctgtcttgcagttacaggcttttcaaattacagatagtatttgaaagaaccaataatacctcaaaatcattattttaaaaaattataattattacaaattaaccaagcttcagaagaggtaaactcccaacatgaaagacagcttatcacttttgaaataagcatggaaggcagaacaattttcatagaaaaatggagagtattcattccaattaataaaaaaaaagctattatttctgccaaaaaaaaggaaaattaatagcaaaggtaggatgaaccagagaccctttcaatattgtcttctagaacataaagttattataataacactaaagaagaaaaaaaacttgaaacaacatatacattgagaaaagaacaatttttctgttcaacgagaatcaaattttttacagctgatcgatgtaatatagttctgtaattttcgtgaaataattttagaactgctgggaaatctcagctgaaggaaacaaagaaaagttcataaaattttctaaaaatcaaagtcgtgaaattttttccccctatgaattatatattagaaacaagtaattcaattccaactttctctttcctgtgatagtgaaaaagcttataaaccaacaacttaacacatgaaagccattttaattctcacaccagcacacatctcacaagaattgaaaataaatagaaaaatatgtggtgaaaacagtcgtgtagacccctaaacattttcagaatttaacattaagcacttttttttttctcgtggtgacttttctttttccctttcctaagttgtaatgtgatgtttatcctccacttaatttcttggcaatgtggtagtggatcaataaatcaatctggcatattaaccctagcaatcattttggaatgtggataaacttctttctgttattgcttaaatttgtgctcttcctgtaaatgaggttcattttataaaccacaggtaaagttccatagtccagcgttacacttgcctagcacatttctacatgaatcatttgtgatatgctactactttgtttaaaatatatacacccacaaatgtaagtatttatatgcatatatattatttatgtataaatgtgaaggtgaaattgactccactgaaacaagcaacatgggctataaatggtatgctcaatgtattcatgtttcattcttcccttcctccattcctccctttctccctctttccttccttctattacttttgacttccttctggtttgtgtattgtcctttattccttcaagagacaggctgtgaaagcgctaatatatgaggaatttattctttaatgtagtgtgttcaatccactaacgtccttgcctaggccaccaaataggcattaatgtgagagcacagtcttgagtaagtatagataatatatattttattataatattttacagttactcaaggtaattttaaaaatgccatttgaattttcattcatatataattcatgcttttattttgaatatgaatcagaaacaggcctgagagcaacaaaatagtttatgtagtagaatcaataatatgattacctaagatatgcaacaagatgctaaaatgcattgttatcttggcaccgaaaaatagatcatcttttttaatttgcctgtttaagataacataaaaaacaagacgtttgttttttatttttcttgataatctttgcagtgtttaaggaatgttaatcattcattcattcaatattaatgtaaacacaaaaagtaatcaataatcttgtccctagtagaggtgataattattaaaggccatttatattactacatatgtcactaaaacttcacaatattatttttgtattaacacattttgaatatgtctattagattggtgtttcctatatatacacccatatgacaaatatctctcgggttggtgaaaggaaaatttctctgaaactcataacccttttatcagaaataagaattaatgaaaactgtttgatatggtttggctctgtgtccccacccaaatttcatgttgaattgtaattcccatgtattgagggagggacctggtggaaggtgattggatcacggggaggatttcccccatgctttctcatgatagtgagttttcataagatctgacggtttaatagtgcttggcagtttcccccttcattctctctctttcttgctctgacatgtgaagactgtgccttgcttcttcttctgccctaactataagtttcctgaggcctccccagccatgtggaatggtgagttaattaactttcttttctttataaattatccagtctcgggtagttctttatagccgtgcaaaaacagactaatacttttgatttttttacttagtttccaggaatttccaggctacattttgggcttaacaagaataacttttcttagagtacattttctgatttaataaaaataaaacagcaatgatcgtagcaaatcattctgaaaatggtacaggacagagggttaaagttgttgtcttctgtagagagaagagaggtggacgtgaagttgaatctaggcagggtagttacaggcaatcctctctatgtgggatgtctgggtggttgaattgctgaatggttacaaatggtggaatttcatattatatctatgagtacctagtaattaatttttagatgcttattgaaatatcatgaatacaaactaaggatgttagcatgctttatatggggtcttacatttttaaaaaataatttttttatttgttgtttttactaggtcaaaaaaggatagaaacatctaaaacaatgattatgttacagtgaagaaggactttgttttgtcagcaatggagcattttccaagggagatagatgaatgcccactcccactgcctaactttgtaactgcttttgctgtttgtttcctctcattcattttgcattcgtgttaggcttgcatctgtttatgttacttgtctattattcatctacaggataactgctcagcagtcgttacttcctttcatatcttttctgcatcttttgtttccatgggttgttttggcaataaaaccaagaaaagggtacaaagcttataaaaaagtgcagttggaacatcatgtttttacagctctaagaacattattgctgatttcaaaaagtttttttaaatgttaaaatgtattcagcaaagtttaaagctcataggtatgataaatttgaaaatttgagaaaatgaaatttaaaaagtgtttccaaaacagctcgctactgtttgatcttcacatggcagtctgccttgtgcaattctctgtttactgtacattttaatacctaagtttcaagcaatgaagtcatagtaattccttacatttgtatagcacttcataattttattgtgtgattactcattcattatgtcctctaatctttctaggtagataattagcatcttcattttaggataggaaaaaagagagtaataactttgttaaatgacatgctaagatcaaaagatcaatggatctctgagcctggaatctacactaacttgatacctggtgtgggtcaggagaatcctcacaatataaagttgctccagacttcctgcaagcctaagtggtaaaataaggtttggggattttagattatgttagcatagttttatgtgtgattttaaatcattattgtgtctccaaacttattaagactctatctatctattatcaagggattgaagtttagctgggaaaggggactaatacgtatctattttaccatattacctttataaatccttaaaggaatatactttaggtcttatttttgacatgaagaaaaaattaaaaataatttgatcctgctaccttaccagccactgcgtatacgttttgtttagaaaataatggaaagaaacatgtgacaaagtggagaagataacaccatagaggcacatatatgttctgtatcttcccttatcaattacatattaccaatatatatatgcccaataagcagaaaacttttctgccaaagagatttcacttttatgtctctgttaaataatttctacattctacgtcccactgttgtaaaagaacaacccagtaatccctcaaagcctaggttccatgtaaaataaattttgtacgatcattatgtagtacttgtgaaaagtcatagaattttaaaaagcatttgatttgcacccaaaacaaccaagaagtgtcaatgtttcaataattgcataattatttttaaagttatcatctttggagtgctaaagctatcattaagtgataaataacaacataattttattttggcctgtgccatcctggactcacctaagaaaccttagttcatacttccagatcattatcagagctgtccctgtgaccatggtgtaagatgactcctaaggaaaaatgaactatgtctctctatctcctcaaccaaaaacatcagaaagtgctcccttaccttttcttccctccccaagagaaagatctttggtgaaaaaacttagtttctgccatgtgggtctccttatttacttatagtggtgagaagctacctttctactctgacatcttgctctctgttgctgtctttcagttgttgagtaatcaactcttaataagctgagtgacagtaaatggttacagtttaggaggattaataaaagttgctattaaaatatatatatttaataagcacagaggtatctgaaaatgtttatatattctccttattgaatttgtagaatctgtttaggtaatcactaagcctttagacagaatctctccaggtttccttcaatagatatgactttaatatcaagtcagctctgtccttttgttgactctcagtcataaatgccagctagaggttggaaactcaagcatcattaagaaatggtctgaaagtgacttaaattgtgttctggcctagattaagcctttcagagcaactataaatgtacggcgctttcatctaacctagccccatgggcatttaatgaaagtaagtgctcattattgttattgttatgaattataatatatactgtatataagacaaaatcacaatagaaaaaacaaccagcagcctaatttacattgagtagtccaaacatacaatttctcccacctaaaatttttaccttggaattttctttcatggctatctgtaattctataaaggtcagcaaaatactgagctgttttgaccaggcaaagaagggttaaacataaatcctaatatactataattaaatatataaatgttatgttcctaaacccaagttatacagcttaatataaaaaacgacatataagtaataacctatagcatacatacgtcaggaaattgtccttaagaaatcagctgactttaagtagcttataaatactaaataaaaatatattgcaaatgaaaagcttttttaagttgaattggaaattttttttgtaactggtttgattttacctgaaagtaggaaagcaaagtaaaatgaacaagtaaaatttatttccctaaaccccagggagtttataaatacatcatgagaacatttatgtagacacaataacagaaaaggagaacattagagatacaatatgcaaattatgggagaaaatattaagaaaaacagttttactaacattataacatgactgaaaattaatgattaaataagaaaatatctcacaataaattatttttagaagcagagacaattaattgggataacaagacaaattgcatcaagatatatacacacacacacatatagatatatacacacacacatatacacacacacacacacacacacacacacacatatatatatacacaaaagtgacctaatttatacatttcaacacatttatattgaaaggtcaatatggagcaaatcaactttatttaatttatatttattaggcagatgatgcctgaagaatgcagaaaccttagccattttgatttgattctttcagtccctgacctgcctacaggctgacataattttccttcacagagaccagtctccagtggttaccaatcttgatcttccagtgtagactgagttctctttgaattactggagcagggtgtatgcgaggttggataaatcagccaaaccgaaaggccctgcagggcaaagaagcagtagggcacctgtccttacattgtcctgaaagtgacctcctgtgtgactttctgtgaggtaagaggtcattctgcctctactttggcttagcttatgtcactcacagtaaaggtcacaaatcctgacagctttcggtgcttgagactcagattactgcgtgtctgagaaggagcggagagctgtgagacctgcttctcttaggaatctaggtcagaattcattcagtaatgccacccaggcccttcaaagcaatatcttacattgtagaaatgctttgagcaaatcctgacggttgttcataaattatattacaacctgaagggagaaaaagttattctgtcccttttttgactccagcttcttataagataagtcataaaatttaattggtgtcctcagagcaaggtcatagttcttaaattcacctatacccttcataacctccaagtcaataataataactgaagataatgttagtgccactaaatttgatgaaagtgtcggcagcagttaatgtacaagaaacccatccaaatatatgaaggctgttttttttttttttaaagtatgtgacgctttctgagtgtctctgaaatactgtaaatgtttggaatttggactttatataaataggaagcatatgcacatttgttaacagaggtgacagtatgaagattggagattggaaaagggtaagatagagggagagaataatcttttaagaaagcaagttcagacattaaatgtaaataaatggaaaagtctatgaggaaatgctgtaagcctatttttaggtaatttacctttcctatacaaaaagagaggtaggaaaagaaaaaaaaatagaaaaggggagactgaagtgaacacttgcttattgctttgaggttgtataaatgttgccaaaactatgcccaatgcctacttaagtgtgggaaacagagttgacacttaaagaattgtgcagtggtgactctggagtctagaagcctgttgctagtgtgaatggaactgaactcatttcctttaagggaaaggccaaagacagtgagtaagtgataaaaacttgtggtgagaatcaagcaatgcggagacattaaaaaattcctagaaccatatagatgctaacatattagattttgataatgaataactaattcaaatatcctgattctttttaaaaatcaaagtaatgtgttgcatccacctaagacactattagaaatataggagctatacttttataccttggcatggcatttcactttccaaagcaaatatgtgagactgtctctttttaaatgtttcattcagggataaaatatgatgtttggattatctccttaacccactgcatccaataaataaaaatctctcctcttaatattacctctattctctcagtaagactgatgataattcaatcttctttgactgtaatctctctttccaattcatctacaatattgtcagatcttgcttcaaaatgaccccagctttgttttttctatttctacagccattgtcgtaacttgaaactaaattgggatccatgataactgatttattgtaccatctttgctatttgatgttggtcaaatcacctaacttgagtaaaatgaaggagtggaagacctctaaatctaaatctaaatttctcttattgatattttccttctatgaaatacagtgttatgagagattctgagagagagagacagagagagagagagagggagagagagagagatcaatttaccttccaggtgcttattatcacataaggggaataaggcggcttctgacagagtgattagggaagacataaaaaggagatcgaaagtggactaggccttgaataaagtgcagaatattaacaagtcagaggaaagggcagtaagattaaaccaccgttgctcttgtcaaatgttttctcaaaatttattctttcataagagcctttagctcaatgacactgttatagactgaatgcttgcgttcttcccaaattcatctgttaaacctgatcctcaacgtgatattagaagagggtgctggccgggcgcggtggctcacgcctgtaatcccagcactttgggaggctgaggtgggcggatcacaaggtcaggagatcaagatcatcctggctaacacggtgaaaccccgtctctactaaaagtacaaaaagaaaaaaaaagaaaaacagcagggcgtggtggcatgtgcctgtaatctcagctactggggaggctgaggcaggggaatcgcttgaatctgggaggcgcgggttgcagtgagctgagatcacgccactgcaatccagcctgggtgacagagtgagactctgtctcaaaaaaaaaaaaaaaaaaaaaaaaggggtgcctttgggagttgattaggtcatgagggtagagccctcatgagggtgactggtccctttccagagagtttccttggccctctcacatgtgagggcacagagaaaagacagctctcttctctatgaaaagtggtccctcactagacaccaaatatattggactttctagcctccagaactgtgagaagtaaatttctgttatctgtaagccacccagtctatactatttttgttataacagcccaaatagactaagacagtaatgaagttcaggcaactcttcttaccccatggctctcattacttctgttcttcatatcacatatgcgggagagtcatgtatgcagtactttttgaatggaaggaaaattgagattcatgaagatgtcatgagtaaatctccccaaatctgaaactaatttagcctccagatttactgtatattagggaaatgtgcatatgtacacatacacacacacacacacacgcacaaaacacacactgtgctaaactttaagaataataagagaaaagactactggctaaaaataaatgtcctactgaaaagtgtactaaaatcccatatttaattatgattatttaacagtgatatcaggtaaggatgatgtacatttgaatgtaattgattaaacaaaaatacagaaagcatttttaattaaatataccctattgggaaaagtactcaaaaactaaaagaatggagctgaataagccaggtaagcatcggaaaagggatatcacagaggtagattctagccaagaggtatggagcctgtctccaagcagcctccaacattcaaatattgtgggttccttggcaagactaatggtataatgggtaagagtgcttcaggctattttaattaaaggacaagtttaccaagaaaaattataataattttttttcctccatttaacatgatttctgccaggcgagacggctgacgcctgtaatcctagcactttgggaggccgaggtgagtggatcacctgaggtgaggagtgcgagatcagcctggccaacatggtgaaaccccgtctctactaaaaatacaaaaattagctgggcatggtggtgtgcgcctgtagtcccagctactcgagaggttgaggcaggagaattgcttgaacccatgaggtggaggttgcagtgagccaagatcatgccactacacgccagcctgggcaaaaagtgagatcctgtctcaaaaaacaaaaacaaaaacaaaagaacagaaaacatgctttcatgacgagaatgtgctggctagattggactgaaaatagaattatttgacagttatttcaagttgcacataggaattggcattctggttacaaattagctttctatatggaaaggagccttaataggggacatttctgtactggtttgtctgcaatgttcatgaaagcttcatttagcctaggtttctctatatattactgcttgaatgggttttctttatcagtatattatataaaataaaatctacatatattggctaataacttttgagtggtgattgtttgacagatgttgcttgacatgcttcacatctaatctgtaacaggactttatgttatctgttttaaaatgaatgtaattttatagccaaagggactgaggaatagaaatgttaagtactttgcctaatatcacacagctggtaagtgaaggagcccaaattcaaaagaagataatctagcttctgaacccacattcttaacccctgtggcaaacggcttgtcagattgggctgacaatacttaaatccatcttccgtgctgagaataccatatatgatttgctataaactaagtaacaaattataaagaatatactctgtaagtttggaaatcatactcaattttgttgttgttgttggctaagaaactttgggtaactttagcaaatgtggctcagagattagtcccctgatttatttatcacccctccagctttattgaggtataaatattgtatatattggaggtgtacaacatgatgttttgatgtacatgcaaattgtgaaatgattaccacaatctaattaacatatcatctcacattgttaccttttgtgtgtgtgtgtgttgcaagatctattctcagcaaatttgaagtttacaaaacactattattaactatactgctgtatattattaatgacactgcaatacatactttatattagatcttcagaatatattcatcctgcaaaactaaagctttgtaccctttttaaaacataatatcctaatttccccaactgctagtcactggcaatgatctttctatttcctatttctagaagtctgctgttgttgttttttaagattgcacatataagtgagatcatgcagtatttgtctttctgtgtctagcttattaacttagcacaatgtcctctaggtacatgtgtattgtcacaaatgacaaaatttccttctttttaaggctgaaaaatattccactgtgtgtgtatatgtgtgttaatgtgtgcatgtagcacatttctttatctatccatgaacacaaatactaaggttggtttcatattttggctattctgaataatgcggcaatgaacatgagagtacagatatttcttcaacacattgagctcattttcttatatgtacccagcatttagattgctggatcataggcagttctgtttttaattttgtgagaaacttccatacatttttccataatggctgtgccaatttacattcccaggagcagggtacaagtgttcccctttctccatatcttctccaacatttatctttagtctttttgatcatagccattctaaaaggtgtgaggtgatatctcattgtgattttgatttgcattttcctgataataagtgatgttgagcatttcttcgcatatcttttggccatttgtatgtctccttttgcaaaatgtctattcaggtctttgcaaattttttaatctggttattttttttcttgctacttagttgttaggttccttatatatttttactattaactctttatcagacgcataatttacaaatattttcttccattttgtaggttgtctctttatgcctttgattatttcttttgctgtgcagagatttttagtttgatgcaatatcacttgtctatttttgtttttgtcgcccgtacttttgggattatagccaaaaaacaaatcattgcatagactaatgacgagtagcttttcctgatgttttcttctagcagtttctagttaaaggttttatgtttaaaattttaatccattttaggttgattttttttatatgttgtgaaataggagttcgattctattcttcaggatgtggatgtccaggtttcccaacaccatttgttgaggagactatgatttcctgattatgtgttcttggcacctatgtgaaagatcaattgaccacaaatgagtggatttatttctgggctattttgtttcattggttgacatgtctgtttttatgccagtactatactgttttgattactatacctttgtagtatattttgaaatcaagtagtgtgatacatcaatgcctcaatattctacttgtacaagattgctttggctatttggggtcttttgttgttccatataagttttaggattgtgttttctatttctgtgaaaaatgccattggaattttggtaggaattacattgaatctgtagatagctttgtatgtagtatggacattttaacaatattaattcttacgattcaagaacatggatatttttccatttattcatgtcttcttgaatttcttttatcactgctttgtagttttcagtgtataaatattttaccacttttgactttgttcctaaatattttattttttgatgctattttaaatggaattgttttttaaaattctttttctgtagttccttttcagtttatagaagtgcaactaacttttgtgtgttcattatgtatactgcaatactattcaattcatttttaattctaacagtttttggtatagtctggagttttctgtatataagattatgtcgtctgcaaagataccattttacttctttcttttcaatgtgaatgacttttattttgttcttagctaattgctctgattaggagttcctatatgtaccatattgaaaacaagtgttgagagagagcagtcttgactcattcctgattttaggagaaaagctttcaacttttcactgttgagtgtgttggctttgggtctctcttgtatggcgtttattacgttaatgaatgtacattccttctatacctaatttggtgagcgtctttattacaaaaatatgttaattctttttcacatgttttttcagcatctatttaggggatcacatggtttttgtacatcattctggaaatgtggtatatcacacttattgatttgtgtatgatgaagcatccttacatccttggaataaatcccacttaatcatagtgtatgacccttttaatgtgctgctgaatttggtttgctagtatattgtggagtttttgcatctatgttcatcaggaatatgggcctctaattttcttttcttgtagtgtttttatctggctttgttgtcagtgtaatcctggccttgcaaaattagtcgggaggtattccttcttcttcttccattttttgaagagtttaggaagcactggcattctttttaaatgtttagtagaattcaccagtgaagccatcagttcctagacttttctttgttgggaggttttgattactgattcaatctccttactcattattggtctgttcgaattttctattactttatcatttagttttggtagagtgtgtgttcctagaaatttaaccattttttcaaggttatctaatttgtcaacatataattgttcattatagcctcttatgatcctttgaatttctgtggtaacagttgtactgtctttgctttcatttctggttttaattggatcttctcttttttatcctagtctaattaaaggtttgtaattttttttatctttccaaaacaccaactcataatttcatcactttttaaaatcattttctcatgtttatttcatttatttttgctctgacatttattatttccctccttctgctaattttgggtttaatttgctcctcattttttagcttcttgaagtagaacatcaggttgtttattcaaaatctttttcctttcttttctttttctattttattttgttgagagagtcttgttacattacccaggctggagtgcagtcgtgcaatcatgggtcactacagcctcaacctcctgcattcaatggatcctcctgcctcagcctcccaagtagctgggactacaggtgtgggctaccacacttggctatatatatatatattttttttttttttttggtagaaatgcggtttcaccatgttgcctaggctggtcttgaattcctgggctcaagcaatctgcctgccttagcctcccaaagtgctgggattacagacatgagccaccatgcctggtttcttttcttaatgtaaggatttattaaatttccatcttagaactgcttttgccgtatcacatgggtttcagtaggttttgtttccatttttatttgtctcaatatattctttaatttacattttaattttggcttttatccaatggttgttcaggagtatgttgtttagtttcctcatatttttaattttccaatattcttcctgttattgacttctagtttcatgccatttcggtcagaaaatatatctaatattatgtcaatcttcttaaatgtgttaaaatgtgtgaactaacatatatattctggagaatattctgtgtgcccttgaacagaatgtgcattctgctgtgttggatggaatgttctttatatgtttcttgtgttcatttggtcagtagtgttgtagaagcccactgtttccttattgattttctgtctgtgtgaagataatggggtattgaagtcccctaccgttattgcattgtggtttatttctcctttcagttcagtaaatatttgctttatatatttaggtgtgccaatatttggtgcgtatatgcatacagtttttatatcctcttgatgaattgactccattatcataatgtaataaccttctttgtctattgtgacaggtttggacttaaaatctatttcatcttatgtaagcagagccaccctgctcttttttattattatttgcaggaaatatctcttgatttctgtaaactttcaatctatgtgtgtccttcaagctaaagtgagtctcttttaggaggtgtatagctggatactgtatttttatccattcagcccctctaggtcttttgactggaaactttaatctactcaaatttaatgtaattgttactaggacaggacttcccactgttattttgttgttttctgactgctttgcatttctttctttctttttttcctctgactgtattacttctgaattgatggctttttgtgctgctatactgtgattcatttctcttttgtgtatctactacagattttctttttggttatctggggatgatttaaaatatcttataattagaatagtcttttttaaagctgataactttgactatagataataattctacacttttacttctcccacattttatgttattgatgtcactatttacattttttatattatgtatccattcacaaattactgtagctatgggtttttaaagttttgtttgtctattaacttttagaccagattaaaaataatttatatactatcactacagtattagagtctgctgaatttgatgatatttttacctttatagggagttttattttttactttcgtatgcttttatgttaattagccttcttttgtttcaacttaagaactctagcttttcttttaagttaggtctgatagtgatcaatttcctagctttcgtttgtctggggaagtatttttcctttattactgaagaacagccttgttaggtattatacttctagttggtctgctttcttttatcttttgtttttatctcatttgatatgtcacatctcctttcctggcctgcaaggtttctgttgaaaaatgcactgaatgtcttacagagatttcctttgtgtaacaattcactcttctcttgtcactttcacaattaattgtctttgacttttgaaaacttgattataatgtatctccatgaagatctttatgtttaatctatttggattatttgggcttcatggattgggatgttcattttcctctccaggttgggaagttttctgtcattatttctttaaataagctttttgccctttctcttgctctactcattctgaatcttgtataatgcatatttggctttcttgatggtgtcccataagtcctgtaggcttctttcaggttttttattcttcttacccagatcaagtctgctgttgaaattttacccagatcaagtctgctgttgaacccttgtggctcattgagtttctttaagatgaatatttaaaattcttttgtcaggcagcttgtagttaccaatttccttagggttggttactggtgctttactttgatactttgatactatcatgttttcctgattattcgtgattttatggctttgcttgatgtctgcttatttaaagaaatggcagctctttcagtcctcatagactactcaggaagggaaaactcttcacaagtcagcctatccagagattctggatgaggttcaggggcaggctggatgttagaatactccaacaggctggcttggtgcctgggtcagtgggtaaacattgctggcacctgggcccacagggctcaaccaggcgccaggctccacagaaacaggccttgtccctaggccttgtctcaaggcctgaagccttggaccgtggggcaggtatgcctctggaatgggcttagaacttaggtccatggggtttaactggagcttgggtacacaggagcaagtctggggccagagtccactggcattggcatggttctgtggttgacagaaagtggagtactcgtttcactcttctttcccatgtggaggatatctctctccatgttgtgctatatgggcttggacaaactagtgttgcgtgtaaggggaaaatgttctttctgccctctttaatgtatgtttgttctcttatttctgtgttccactcaggtgctataatctgtcatccagattccttagctcttgtgaagatatctttgcatgtaaatgattgtttaaattcatttttttttttttagagggggagtctcgctgtgtcacccaggctggagtgcagtggtgcaatcttggctcactgcaacctccgcctcccgggttcaagcgattctcctgtctcagcctcccaagtagctgcgactacaagtgtgtgccaccatgctgcactgatttttgtatttttagtagagacggggtttcaccatattggccaggctggtctcgaactcctgacctcgtgatccgcccgcctcagcctcctaaatgctgggattataggcatgagccaccaaactcggccacttaaattgatttgtatgtgagggcaagagtgctgccaactcctattctgccgtcttgctgtcacttgaggagtcccctgatttccctatatgtgatctcctctacatctccagctgtctggcccaggctattagcactatattgtctaacaattcgttaagggccctattgcctaatcttaataattgaatattaacatctgaaataactacagcttcctatccctctatccttattgctattatgtctgaaatctctctggcattaagtttatcttaccctcagggggattagatttttgaatactgcgatgtaaatgaaattttaaaatacattcaattaaaatattgttatacttgaagttgaaaactaaaatgacctctttactttttattatcctctcagaaatatgcatctcctctgtgttagacttctgtcagactgcatctatggggcttctcttgtatgtgtccatttgtctcccaaatatacagtatgtgcctttggtttaggtactacttgccagtatcagttatgactaggttaataagatcatattaaaatgaatgatagtttatgctcagaaaacaaagtatgcctaggttataaaggttatgtgttatttataactgtccaatgcaactaataaacatttccctgacattaagctgtttagactcaatattatgtgggtctcacttttgctgatacaaacttgtgaagacgaagagaaagaaggagtgagaggtacaaaagaagaagtaggaggggactatattctatagatgaaaattttcgatctagaggaacaagtagcttttctgaggctacagaaccaagagaaaggaccaagatttgagttgaaagcattgtacctgccttatactctcttgctacatccggaagagatttcagattatttttatcatgctttcttcacatcctcaatccaacctcaatgaaagtattcagccatttgttgagggtgcaggaagatatacacagctagtgaattactggacaaaatgaatctatttctctgatcttgatatcacatgatagaacatagaatttatcctcattaatgaggaagggtgctatttaaaatggaccacagaatatagaatcagatgattgcatttgagtttcaactcagatatacactagataaaatgttagttacatcacccagcaaccctgaatcttactcagtttaaccatatgcatgttaattagcattgatctattttaaactgttgtaatatatattggaaagtacttctctatatattttatcaaccctacatatacatacatagagtactttatatatttcaattattatttctagccacttctagttacctaaaaatctttctttctgtgcaaaattgtgtctctgtttgttttcctccatagcaaatgcagcagtgtgtgatcaagtatattctaaaagtaaaataagaaataaaaaatagaacccatctgagatttttcctctttaccccatcttcagcccttccataataccttgtaaggaattttcttaccatgagtattcacaaattcggattcattccctagagttaacaatgtccctagcactgggtagtgtaaacaactgggtttttcttttaaacgtggcaaggcaccagtagaagttggaggaagtcccacattcaattcattatagtaacgatataaaaaattcacaaaattttaaagtaaataataagttatgaaaaaaagacaaatgggcacgacaatgtgaagaagtctgaatctgttgtcagaacaaagcaactttcttaaaactgttctccattgcctgggtaagaagtatttgtaatcaaccagcttgaaaactcctcttgaaagaagatgtaaacttgaaacaaaaatgaaaacattcccatttaagccttggaaaaaataaaataatttagttagaggtgttttagtgattaaatattttaatattaatcaccctcctattgctactacacataatgcaatcagcagagtcaatatgtgtatactcttatgatgataaagatcaagacatagaattcaattaaagacatttcactctacttgcagcatctcccttggcccctaattaagtgggaagaaagaaaaaaagaataagaattcttgaaatcttttcagagcactgtgaaacacgaagcacatccagagattacttggtcacctgtatgttgttgcaaaagtaagaataaataacaaggttaaaataatgcccttgctaaagactttcacgtgtaaaaaataatataatgcatacctactcctagatcctgaacttaatgttaattctctctattgattcattcaccagagtttgtaaaaaagcccttcatctttattacactgtcttctcatctcttttttttttttctcctcttctccgtgcagctaagcttttagtatggttatttgcacttttttcttcactttctcaccttccatttcactgttctgtaaactgcaatcaggctttgagcatgtgctccaaccccaacaaacctgtcgcagcaaagatcactgaggtcctattaagtgtgagacacagtgcacatatttctgtcctatattcttgacctttctgaagctcatgaaataattctatgtgccagaaacccttatttctagctttttaaggtagtgttctcttatgattctcctcattctttattaatcattctgtctaaatactggccaagttttgtctatttcattagactttgaaagaactagcttgtttgttttatttgcttatctattgaatctttgctttttactgaatcagtttttacttttatctctcatattatcttcctcttccacatactctgcattactgccattttcctaaatttctgagttgatctcttagctcatttatttttatgctttcttctttcctgggacttctttcttagtactttcttcttttctagtacttgtattatagtcatattgatttctcagctcattaatttttaatcttttttgtagtacttttataattttccctttaaataccacttgaaagcctctcttaaagttaatctacagtattttatttttatttccattctaaaataaatattttatttatttatttcattttgatagtttagaatttccaaatgtatgaatacttgaagtgctattttttgtattttataaaaaatattttaagtgggaaaatgaaatgatctgttttacatgttttaaaagattactcaggttgttatgatagttaatggaatatagccagagtggatattttgaaaataaattggaggttattgcatagtttgagagattaggatactcagtaaaggcagaagagatgtagacagattcaaatatgcattgaaggtataatggacaaaataaatagtagcatcaagaataacattaaagagaaaagtgaggaaagggtgagcaagggccagggccaataagcttctccttggtttttctatatgtatctcttctaattaaattatgagaataactcagctgggcacggtggtttacatctgtaatcctggtactttgggaggttgaggtgggagaattgctggagcccagaagtttgagaccagcatgggcatcatagtgagatcctatctctaaaaacaaacaaaatcaccaggaatggtggcatactcttgaagttctagctattggggtggctgaggtgggaggattaattgaacacaggaattcaaggttacagtgagctatgatcttgccaatggactctagcctgggtgacagattttttattctgtcatttattagaataaaataaaaaaatttattctgttactagaatagaattttattctaatttttttaaaaaattagaataactcatattagttctaggctttctgttacctgaacacgaaatgcatttacgatttctaccctcaacaaaacacagacatttttattagcttggaaaacagactgtaagtggtgtcaatacaaaagaatgccattctttatttggaagagtctctgagtagcataaccaaataaaccaacggactatgatgtgtgatatggtttggctgtgtccccactcaaatctcatcttgaattgtagttcccataatccccatgtatcctgggaggcacatggtgggaggtaattgaatcatagaggctgttacccccatgctgttctcgtgatagtgagttctcatgagatctgatggcttcatactgggctttttcccctttgcttggcagttctctttcctgcacccctgtgaagaggtgtcttccatcatgattataattttcctgaggcctccacagccacgtggaactatgagtctattaaaccttttatttacttatttttttgagatggagtttggctcttgttgcccaggctggagtgcaatggcacgatttcagctgactgcaacctccgcctcccgggttcaagcaattctcctgtctcagcctcccaagtagctgggattacaggtgcccaccaccatgctcggctaatttttgtattttttaacagagatggggtttcaccatgttggctaggctggtcctgaactcctgacctcaggtaatccacttgcctcggcctcccaaagtgctgggattgcaggcgtgagccaatcaatgtgtctggcctaaaccctttttctttataagttacccagtctcaggtatttcttcatagcagtgtgagaatggactaataaaatgagtaaaagttgacatatttaacagaaaaatttcttctaactgtgaaagggattaatataagttttattcaacattcacatttttgtagaacagtacgactttgtgataccatgtattcaagtatggttgaatttaatttttaaaggattaccagaataagaagactgtgtgttaagaatagaggtaatcatgcttggagaaggtattttggatgagaagaatatagattagttttgtttgtacattataactttttaaagttaagagccagtaaatagtctggattaaacactttttagatttgttgactaggagaataattaaagacatgttttcaaagactacagatgaaatttataaacagctgaaattagggggaaatgcaacaggatattctctgccactttgtcctatagcttccttgcataatccaagaacatttaatcagttcaaatttgcctgaatggaagagaacaagaattgctagagggtgaaaggaatgggagggaacaaccccagagacagcaaatgcagctgcagctctccaatggcaacaagtgttatggaaatacgcataagcacaatcaagtctatgtacagcaggaacttggtctttggtgcaaaaaggaacagacttttcacagttgatttaatttgtctatgttataaatggaatagtaatcatataaaggaataaaaaagaatccatagccctagggtacgtgtgttgcttcaactgtgcctatccctcaaaaacatgtaattcttcctaggaaaatctgcagcttttgaattattattggggggcactttttttcaaaacaggaaaattttgactcttaaagcctgatttaagtcctgctctaatttgtaatgtagatttcagatggctttgtctatgaaatttgttcaatagattcaaagcaaccattctatacagtgtaactttccttgttgaacatggtttaaaaaaaagccttgaacactcatctctgtctctcctagtatagagaacagattcacaaatgggcattgactgtctctgtcctacttaatgagtttcttcatagaaaggcaaaaggtgaatacaacacaaagacgatagtgcaattatgtgtagaaattgttgacataaaaaagcctattttatatatttatgagcaaaaattatgtaaaaatgcaatactggcaaattaacaaggtctattaagttaacctcaattaaatctttcgtgttcattcaaaatatagtaaattctcatctagtaaagtttctctctctctctctctctctctctctctatatatatatatatatatatggttttgttttgttataagacggagtcttgctctgtcacgcaggctggagtgcggtggcgtgatctcggctcactgcaacttctgcatcccggcttcaagtcattctcctgcctcagcctcccatgtagctgggattataggcgtgagccaccacatccggctaatttttgtatttttagtagagacgggttttgccatgttggccaggatggtcttgaactcctggcctcaggtgatccacccacctcagcctcccaaggtgctgagattacaggcgtgagccaccgtgcccagccaaagtcaatgtatttcaaatgttcattgtcattgcgtttgccttgtaactatagatcacgggtggtgcccagtgggtagctatggggttctcttttctggttcgtaataggaatgtctgacattgtcattgaaacattaaaattataggaatgttttattgtttgctaccatttctctttttacctctgatccaatattaaatggtgttcctcaatttcacaagcatgttatgtaaaataaatacatttcaaattgttgagcacttttatcttctgggtttgaaattattcatgtcctgactttgaaactttattgcagattaaaaacaaattaaaacacatatacatccctacatatgtgtacacacacacacacacacatgaacacacacacacacacacacacacacacagttgaatttgcttaggaaagaaatccatcaaaataaataattcatgttgggatggactgaaatctagtcttttaggaggtgccaacagatggtttacatttatagaatgcacacttgctgacttccaaacagaaatgaaaattcataaagtatatcattaggactccttataagcagcattatgattatggtatgaatttggattttcccaggtgaagagttttccatcataattttactaagaaaaagtgaaacaaattactttccagttactatcttgtgttagcatgtttgaaatcaaaccctgctgctgatcatccagcagcacatgccaataaactcagacctcaataaggctgttgttctcatgatgatcatcattttataagaagtcttgggcatttttaatcctttaaataataggcattattgcaactaataaaataaggcagtttctttagctttcacttcctattacatcagttaggttaggaactttctatcggtataattaggggtgagacctcagcttattaaagttcaggcaacaaggcacttttagttaattttagcaacccttttggtttaagtagagctacttaataccgtgggataatagtaacattttatttttagtaaatgttgctgctcaccaaaatgttaacatttatatcaggtaaggttataattaaaacttgttttacatctacaaaaagctaattcattgctcatgaagattttgtctacacagtacaaagtaaagtggattatgattggttatacatttaacgaaatcaaagagtcatgaaaatcacttaaaaccaaaacacgcctgagattttattcactaagtgtgtctagtagctcacttgatcaaattagctgaataaatgacaaaccctatccagaatggtagtatttacaatatggagaatataagaaaacataaaaaaattaattgggcaattgctagattttcttaatgatattttaaccggtctaaattatgcaggcaattgttttcagtctctttttcaacatgttgggttgcccactaccaaaataatttagacaaatattacggtgggaaaaatctgtcatttcagtgaaaaaaaaaaagccaaactataaatgttttgtatcatagaaataaaataactagtgttttaggctgaatttgttgtttttaaatcaatgattttaataatgtataggtggcctcttcatatttttatgcagaaatacctaagtgttggcatagatcattccaagcaaatacaatattctccgtctgtaaactttagatatcatatactgtacagtgaaggatgagtgaggaacagaacttttagacacatttattcaacaaaaacacctaaagttgatatttttgcctttccagtgattgacttgatatcctcaattaggggaaaaactagatattatatttggattcaattaatccataatccattcaatatatagtctatacatgactaaatataaaataagattgagcagcactttcttgcttaaaatggatataggaaagaaacaaaaacatagtttatatagatataatttgtgacgttttaacagaggtaaaataatctggtgatatttttgaattttatatggtagaattcaatattttaatctgtcagcctgattcttttacgactagacacaatattccaaaagcttacattccatatttttcttggaaagcaattggcattaaatgtcattaagaacacaaagcagaaataaattcttccatgtacaactcctcaattaaataccttaacagcaagtcatgataatacgattatgcatagtgaaatgtgctatacgcactgcagaagactttgaatgaatcctgggttgtgtggtgaataatcaagaagatgtatttatcctatcttgtcttaggttaggagaaagtataagtaaggcagaggggtcctctggaatataggagcttccaagataatgacgtatcagttgaatttgcagcctaaaaaaggaaacccagtagtccaatggtcttgggtagaaagagtttagcataattgagcccacgtagaatttacgttgtagaatggatggtactgtggtttgaatgtttatgtcccctcaaaattcatatgttaaatgtgatagcattaagaggtggtgcctttaggaggtaattaggtcatgagggtaggacttccataaaagagattaatttttttataagagacacccaggggaccttgcttgccccttctactttgtgaggacacaatgaaaagaagctgtgtctgagtgagagtgagagcacaggtcctcttcagacattgaatctgcctgggccttgttctcagactttccagcctccagaactgtgagaaataaattatgctgtttaaaagccacccagtatgtgatattttgttacagcagcctaaacaaactgacacagatgggacccaaatgtagttactgttcctagaagaatagcttggaagatttctgagctcagagccaggcatctttctcagggctattgcaaaggccagtccaagaggatgaaggggcaagatagggagtgcatgtggaatgataaactcagaattagggccaaaccagctccaactaatcagaccactttaaagtagaatcagactgcagcttagaacactaactgggccagcagcagtaaactgaacaagggtcattgcccagggaaccaagaaaatcagaagacgttttattaaacaaatcattcccaccaagaggtagcttgggccacaattctcccattacacatcaaggaagattccttccttccttggaaggaatctgaggactaagatgggtagttaacatcctgaagggctgcacattctatcttagaaatactatgcattatgtaaagggattcattaagaattggaataaacatgttttaaagtaggtaggactatatcttgtttttcttccccactactcagcaaatggaggtaaattcaactagattaattattgataacataaaccgttttctatgtgcccgagtaaactgtgagtttgcaaccctacaacagcaggtagtattactacgattgtcatcacctttttcattgtattgtcttacagtttcctttcaggctagtatttctaatacactatagctatagctctctttaaaatattttggtggatacataatgatgagatgaacctttgctttttaaaacctatttatctccctaagctcatctattgcaattttgccccaacccacaactcattttccagccaacttttagattgctattcctgaagtatgccattttctcttttgcctctgggtttctgtacatgacatgctctccttacatgctatgcatggctaaatcctgcatatctgttaggaatcagttcagatattaccttttccaaaaatctccctaatttatggtggccaccttcagaagagcaacattctttcttgctcttgaggactcctcagaaccaaggttgagaaatgatcatttttgagaacattgtagattcataaagttaaaggcaagatcttcctaatctgagaactccactgtcctaagaattgctacttgaggtttctttatcccttaggcaaatcattttttattgtatttgtctctttggctaaaggaatcctttatgttatatgccacttcacacactggaggtttacactgaaacatgagagttaagtctccaagtaatgctgattatttattcttaatgtatagcaaggcttctgtatgagcagagtcctggcatttagaaaaaaatcttttgcggaaatatcaagatttttgtaatagggagagcctctgtggtttgaagtttgtagagggagtgcagttctatttttgaaatgtatccaggacttccaacaggtagagtcacagagctccatgtgatcaaatcagattcatcatgaattgccagtagtaagatgagggacttaatggtatgaaatagacattggtagatgacagtggattgactgttatatgttctgttctttattgtatgatgacatatccaggtgaagcagagaaacaggaaaagataattcacagctcttcttaggattaatgcatttttatcagaaatttatctgaaatagccaaaccacacgctttcaggttggccctgatttctatattaaataggccctaaagacaaatgaaaacaaccgcttctggggacctcagtagcctgattgtgacacacataggcatgcctctgttgctttgtttttttaggcagaggtcctaagagaatattgttaagtcctgaccataattaaatatctcacccacagtagaggctccactcatgagtactagagattattaatgaacagggcctaaaccttaagaaagtcaagcaacttctatttttgcaatttttagatctatgagttgccatataagaagtctggctgttctacacagtgccttttagagaagtcatgtggagaatgatagtccctgagacaacacagaaagaaagagaggtcaaggtgtgcaagcatcccagtataggtggcagctatgtagatgagacatcttggatatttcagcccatttgtgcacccagataaccacagccacagccaacatcactagaagcagaaaagctgccaaatttggcccaataaatgcacaaaatcatgagaaaaatgggggttgttgttttaaactactaaaatgtgtgaagggttgtcatacagtaataaataactgaaacaaagactttaccagaagtagggctttgctgtaacataaataaaaaatatatggcatttgctttgtgatggacactggcagaatctgtaaggactttaagtagactgtcagtaaaagctggagggacttcttttttcaggtttctgtccccgccccacccaaatttatgcaacagcatcttaatcttcctgtctccaatccggagatcatttttttttttttcacctaaaaacaagtctaaaacattcagagacactcactaaacactaaacaatatttttcagtttcatacagagggcttcagggtttggctcgggcttacttctctgatcctactggttagcatacactttctcaatttggactgctgtcttttctcttgcattcttttttttttttttttttttgcttagtagtctcattcagatattacccatcttaacattaactagccatgcttttctgctactctcccgtactgtgctaattgctccagctagcacatttccccctaatcctgtgacagtttcatattatcttctttctattgtgtcttctacatcccttccttggccaggctaattcccacatgcccttctggtacttcttttggaaaacctttacccacttctctaagaccgagttagatgacttcttcatatattccatagtatctcatccttgctctaataattacatttttttaagctatggtataactacctgttcatatctgcctttcccttagattctcagaatattgaaggcaagaactgtgtctgtttttcaatataccctcatggttgacaacagtatctggcacataggaggttctttatcaatatattttaaatgaatgaattaaaaatgaatagatgattgggccaagtacttgtgtacttttttccaaataccatgcttattctggcaaagtaaacatatataaaacaatttccaaattggggtgtttatgtgaattttagtttgtttcttatctttactgcaagggggttatatagtaagaacagtggcgaaagagggtagcctattttgtttttgaagcatcctcttgcccctgccccagactaagtcggtaaatgctactgagtgcatgttagtgctacataaaaggcaaccttttctgtggcggcctgttccctgtgctcgttcaattgttatttttataaggcaaatagctatcagtgtgtagagaagccatcaagctcttatagctggttttaaaatactgtttttagtttgtatgccttcaaattgcgcctaaataacacagttatttttgactgattgattctaagaattttgctattacagccaaactatgacattttgcatcatatatttttagcatttttaaagaatgaaatgcatttctattttttaaaatgattttttcattttgagtttgagccaaatatctcaaaaatccacagctcctagaactcaacagaaaatttgcaaggccaaataaaatatatgtggcttactgctgcagctgtatgttttaaagaaagctaatatattgactaattcttagaagagcatccataaattgctgtctctgaaaaatgtttatagttataaaggctagagatgatgtcatttttgctgttacaggtaaagaggcatctgtgtttttgaccttttaagtatttctattgagattctaaataccaacgtaccaaaatacacctaccattatttatccaacaacactcaaaataaaatgacaacattttgtcattccactctatcaatttatgtctctttaaccctttgattgctttaatggttcagttgcttttaatacacaaaggaatatacaattgtttaactaaatagacaatactgtttattttaatataaccttataaggtgatcattctgtaaccaatttctttgatattaatgatcatcactatgttaaaatacgttaatacttaagcagactgatgtacataactgtaacaggttttttgttttaatttctttgtcatctaaacattaccttatattttaaagccaatttgttttgtaatatagataatgaacaagttggtttccccctagagatgtctatgatacgtgaaagatgtttgtgaatgaatacatgtctttgtgtgtattctatggtgtgacagattaaaaatgccacaagttttttgatgttttttctatcaagtcttagaagattctatgactgctttgaccaaaagaaaaaaacagaagacaaatgccaatttctgggccagatcttaggagagtggcggcctccacctcctatctcaacacttggtcttggagccctgagaaactgtgtaagaaattcaactagctattcagctacaaaaatcatgtgaagaggccctgaatctacatgaagaagaaggtggacctaggtgaactcagcctttcagacctgtgctaagatgccaagtgatcttgtcatgccacgtagagcagaaagatgactagcccaattgctggcccagaaaaccatgagttgtaataagtgcttattttttttttctttttttttttattatttattttttttgagacggagtctggctctgttgcccaggctggagtgcagtggtgccatctcggctcactgcaagctccacctcctgggttcatgacattctcctgcctcagcctcccgagtagctgggactacaggcatgtgccaccatgcccagctaattttttgtattttttagcagagacggggttttaccgtgttagccaggatggtctcgatctcctgacctcgtgatccacccacctcggcctcccaaagtgctgggattacaggcgtgagccaccgttcccggcctattgttttaagtcactaaatttcaagggatttgttatataaatatagataactagaacatagggtaaatggcatgaatatctgaggtgacaccccattttatgattctttttcatcaaactattttagaacaattctactaactaggttacaacaagataaatatccaaataccataaaattactcacaagggtacaaagaaatattgaaactattaagtctataattccatggttaatgaaaaaatcaggattttgccagccaagtattatccagtttctatattcgttttggagatgagtcaagtctgctagcttactatctagctcactgatctaaccactatatagaactacatgacctctagatttaaaaacctttatcttaaacattaaaatcacacacacccatagtcactgtaccacacacacacacacacaccacacacacacactgcctctcttcaaatatttctctcacatcaccagattataagacattttataaggatgctgtgagattcacccaccacccacaggcagctgctctgaagaggaattaatctacaacagcaataaataaataaataaaacatggaatgaaaaacaacatacgtattttagtatccagatatacctatataaatacatggagatacttcaagcatatgcaaggttattgatttagaattcagcaggaagaggtacccaaagagttctcagaataacaatgtaaaagcacatgagaaattcttctttcatttgtttttttctaagatttaaaaatgagattagtgcaatttaagaaatgaataaaagaaatatgttagaagatgtagattctttggggattcctagcattcagtttcggggaaattttgcctttcctttaaggaagcaggtatatcttatgttggcttagcaatttaatctatttaactcctacaaagcataacttatttagaacatatactggacattttatgtatcacttctgattaagagttattaaaaataatgtgaatagcaaaacattaattttggctttgatagtgtctctgtaatatgtaagagcagtgtattggttatctattgtgaataataagttacctttttgtttagcagctcaaaacaacacacatttattagctcacagtttctgtgggtcaaggattcagggccaggtgactctgactgagtctgtcatgatgattcaggtaagccatcaccaagaagctgaaggtttaacttgggctgatctgattccatgatggctcatttgcgtggctgttggctggaggcctcagtccctcagaggctatcggcagaaagccttagctccttgccatgctgacttttctgtggagctgcttgatctccttatgacatggcagctggctttacccagagtgcacagttaggaagaaaggaggaagctgcagtgatttttacgacctagtttctgcaatcacacactaacacttgtgctttattctgttcattagcagtgagccactgcgtccaccccacactccaggagagggaaattaagctccaccacttaatggaagcagcatcaaagaatctctggacaaattttagaaccaccacaagtaggtttaaagacttgccaagaatcaacttaaatggtctgtttggttctgaattagaggtgacagtgtaactagtgaacattttgctgctatgagccacggttagtatatattttgaaggctatattcttacatttatctgaattcactatttccctgactccacctctgagtcttacaagaatcaaatatatcttctcagaatgcaaccttatattctggcagagcgggaccattataggtcaagacgatagctagatcaggagaaatagtgcaaggctgaaaacaaccagaatggaattgcagttcatggatttagaaacttcctatttcaattcaatctgtatatcttctttattttatttgttagggaaattttattttcactcctgaggaatattgtaatatgattttagtccaaaataaatcttaaaatcaactacacagagaagactttataacacagtttctttaaatatgtggcaaatattcaattatctgtattaaaagcctgtaacacttcataaaattaagacaaggaattaataagtaggtaccttggcaagattaaaatgtactgacctttctcaattgagggtcattgattcctgtgccattcactaagtttattataaggctttttttgcaaaaaaaaaaaaaaaaaaaaaaaaaaagagagagattcctgaatgcacttcacgataagggagttttatatataatgtgcatgtaagatggtagtagaaacagaaaagtaaaattgtcaaaagtgatgcagttctagccttaggttactcagtttctctctcataggctatgctctccgtttctcgaggcatctccatttttagtgcacatatgctgcgttctcttctttctcctaaccaatttcctctgcttactcatagtttctgctctgtcacaatgttagctggcatatgaaccttcttagcctctcttgcctctctttataccttgttgttagcttctaagtcactggtcagcctatggtctgtagtgtgtaatgtgggtcagggtccctcttatcctatcaaccaatcagctctagatggggtagacaggggcacggggtttacaaagcacttccttttcaggaagggctgtggtcacattcattcctttcaaatgtcagttattggtagtacaggcaatctgagtctttgtccatgtggtgcaatgataaataaataggtgcataagttaaaaactatattttggttctcttttctaattgatgatcttaagaaaacatatacataagaaatattttctcatctgtcaaacagaaactcatttgctcatttactaaatagatgtcctgaaggcctattgcctgtgaagccctgtgctggaatttgcgggtcttgaaagttgcttaaggagatttcctgccttcgaaagctttctgtaggggggtggggtagaagggttaggtattcaagcaaacaagtaaaatatgatgtagaaagtgatttttcaagaagagagaaaacttaaacatatggttactggagtccagattaaaactaagtaaatcacagataataatatcttctttcccatcttacagaactactaacgtgttaactgttacaatacaggtacaagcctagaaggatgattttggggagaacagagttctacagaaatacaagctgtcttatgagtaaataataacagaaatcgtttacagggcaatttttttaaactgacttgaatcacatatttttataagactcatatctttttcaataaaatgtggccaaatttaagttcactttcccttgtattttaacagaaatctgaacttccattcaaagagagataacatgagaagcagaatatatagtggtccaaactgtgttgctcactatttttatgatcatgtacgtgtctttgaacatccaaggcctcagtcttccttaaaaatatgagatgattagaccaaagcatcttaaaggtccctgtggccctgtgattctattgagcctgagccaattagtcaaacagttacctgtcattacacaggctgtggtgtacacatacattttagcaccaaacacaatttaataacagggcacagaggccgcaaagcctcctgattctgttccattactaatttatcaggggctgaaagcaaccaaacttaggatcccaggcagacaatggagcctttgaggggcaagggaagcatcatttaaaaggaaagcattaccattctaaaataatggcaaagcacatgaactgagtgctctgaaagagagcactacaaaaaaggtattctcagcttaaatgccccaaacacaaaagcttttagttgggacttagacgggaaaaagaaaatagctcccaataaattggttttaccagtatccttttgtgtgtgctggtgccaagggggcgagggtacaggcaaagcgtgattttccaaaacctagctgaattatgtttcttctttagaacaaaacccaacattttgctaatgaggataaagacagtaaaactgatattcctgtgctattactaacttgggtattgaaagatcattcacacaataattgtaccatgttagcactatatttgcatatcttctattgtctcctttccttgatattttgatttaaaaccagtagataaccatacagtaccatatatgcatatacaacttaataatctgatgtgcaaggcaaaatgagattaaaaactgaacacttcatgctaaccaactgttatttatatgctatttttcataaacaatgcaagatgacagtgtatttatttgaagaactaggtaagttaatggtgtgtcaatttaagacaatataaaacatgtaaaatcttttagcatccccagtcaggtaggcaaggtgtttgttcatagattcttggtactaacactctttttgaaaaattctacacaaatgccaggcatcattattagcaatacatatacgtaaaattataggtttgaagaaaaatctcatatgataaaaaagaaatgcattttataaatctttataggtggcataaactataaaaaattgaagatttagttcagaaaaacctattttccaaccatttttctattgagatttatatctttgaagaagctatgcacataatgacttcaagattcattgcacagtagttatctttatctgccatactgttagcacctccttaactgtatctatggtcactctactttttttgcttaaagcagatgtcctacatgactgaaaacattttctcatagacccattagtgtctatgagacatacataaaaaagtgaatcccgtaagaactaggagatgatcttaatgcatattgttggtttttaactatttagcaatttcacttatcttgcagaaatggctgttgccctaccatccttaagtgaaagataagtttcaattgcaaattctttctgaataatgagtttgaaaggaaaaaaaagatataaaatgtgtaggtttgcatgttgagactagagaatctatttgggggaatacatggaatagttgagtgaaaggatgcacctaataatatctgatatacccggaccaggaaatgaagacaatgtgaccaaatgtgtttgttacactattagttctgaattcattagaaagatcacagtggggtctagcatggtgactcatgcctgtaattccagcactttgggaggtggaggcaggtggatggcttgagttcaggagtttgaaaccagcgtgggcaatatggtgaaaccccaactctacaaaaaatacaaaaaattagctgggcatggtggggcaatcccgtagtcccagctactcaggaggctgaggtgggaggattgcttaagcccaggaggtggaggttgtagtgagccatgatcgtaccactgcactgcagcttgggtgacagagctagaccctatcttataaaaaataaaaaatacataaaaagaaagaaagaaaagaaaggtctgaaacaggatacatgataatatgtttggcaatctcatttcagatgtaacagtaaagatatgaaatgatgtacatatgtagtttatggattcagggtcattgttctatagtcagagccaagatatttatatcaagtactgtgggctttctgatttattacattgttgtattgacacaaggcagaagtgctagttttgagaataatttgggatattagttgaatggtaaattttcacgtgataaggttcagaaaatagattttaactgaatgacaactctacatacaaatactggctgtatctccactggctaagctcatttttcttttgaaaaggtgtcttctaaaactatacagacatgataccactcagttgttactagtaagtagctttaagttcattctttgtgtaatttacttttttaaaatttagttcatattgaggtgagtatgtatatatgtgtgcaaaaaagatgtctgaatatcagtaatttctcattgtactaacagataatcaagatgacaatacctaagtttatttacaaactttacttcaggaattactcttttgaggattttaaattattagaaacatatttgtatttcattgttttgtgggagattattctagacctcatgacaaatgtccctttttgatacacttgaggggctttggctaataggagttcataagttgctttgctcaactgcaagacggttccaggatttacagtagcaggtgattgccagtttggtcaatgaatggctgttagctcctgaatagctcctcaaaagaatgtgacagccccatgatccacatgttcctctgctcttggcactgtactcaggagattccttgaaggtgatacgcagtgatagtttcagtgtttggaaacagcctccaaattttattttattttttctctcggcaacgactaatcctaccttaatccacctggctggagttttcttactaaaatgcagacctcctcaagtcactttctactaaactcttcaatgaatcctagttaccccaaactcaaaattgttggcatggcataaaaggccctccctgcttgcttttatattatctttatcacttgatacctttccgcattaacatcagacttatagtttctcactctgtattgtttctaactttatgtgtgtcttagtttgtgctgctattaaaaaatgtcatagactgaatgacataacaataaaatattcatctcttacagtttagaaggctgggaagtccaagatcaaggtgacagtgaatttggtatctggtatttggtatctggtgagggctctcttgttggtttgcgtacactttcttcttgttgtgttctcaaatggcagaaagagggagagggctctggtctgctttttttttcttataaaggcactaatcccgtcatagaggctccaccttcattacctcatctacacttcattacctctaaaaggcctcacctctaaatcctatcacattgaggattagaaggtcaaatatgcattttttggggggtgcacttcagtccatagcagtgtgtgtgtgtgtgtgtgtgtgtgtgtgtgtttgtgtgtgcgtgttataaatgtgatttcttctgtttgaaatggccttctctgttgtcctagatgaaagtattttccttctttaaaatacagattaaacatcactttctctgaagcatctctctgtcacctctgggcagaaataattcacagtttttatgttaccattgccttgaatatacttaagttctatgtttattctcatgacattatagatttgttttgctttgtattgttttgtttttaaatgtgcatatcttctcatcttaaggcagttaccatatttcatacatctttatagtcccaactcctaatacaggccctggtatagggttgacacacaataaaaagtttttgtatgaatatttcttgaaataatattggattatgagcattcttttcaccaagaatgaaacacaaagtccttggtcacaatttgacatgagcctacttcttcaactaatccaggcttacatttaaatctttccacattttttttccttctaatagcttttcatgcagacagaggaaagcaacatttaacaagcacttaattgcaacatgtgggaatgagtcaaatagtggtcatgtgtggaacttttaatagcgccaattcacatagggtctctgctcgctagaaaggccatgcttcctctgcctcagatatttgacagaagacaagcaacagctgaaacaaatactgtctttaaacaaatcaactagcaattcttaatagtggtaggtttaacaattacataatgtcagtgatgtcccaccagtaacagattagaagaattccaagtttggaaacatctctaaaactaattcataattgccatgatatgatgatgaggccaaattttggcacaatgcaaattttaaataacagaataagctgtcatttagtcctgactttgtacagtaggtgagcgtttaattaattcttatctaattcatagagtaaagaaattactctttactaacataaagacagatttctgaaatcctcttcttgcttttagttgctagcctcacatactatagtgatagacctattcgtatacagggaatatttgggggcttttaatattcaaaaattagatggtacaaagttcatatcactatgaggcaaatcactgaagctttattctcaacttagcacagttccatgtaatctgctctgctaagaattcagcctcagtatttggtaacagaaaaatttccaatgataccacacagctctccattccctaaaaaaaggcaagtaaatctatgcatcattctcattgcagaactatatattttcttacattgtatcgacaccacgcaagccaacatcttttaatagtttaatatttcttgctattgtacttctttcaaaaagtattttctcaaccaataaagacatgataaaatatgaattaaatcaattacagtatgtctacatgatagaatactgtaatgccattgccatcatatttttaaaaacatttccgacataaaggaaatacccagagtacataagagaaaatttttgttctgcaatattatatatacatcactattctacatttttgtagactatacatcatatgcatgttagaaaaattactggaatatatatagtaaattattagagcaatcatgcctaaattgcattactatgaatggtttctaattttttggtgcttttaagtattataaaaatagtagttattgatatttagcaaatatgtgagctactttgctaagatattttatatggattatctcacttaacacaataaccacatgatgtagatactatcatgacctttaatttacagataaaggaagaaaacatttatatttttaaaattattattattgctttataattttacatcttttaatattctttttaaagaaaaattataattgtatacgtatatatgggtacaatgtgatgatttgacatatgtctacaatgtggaatgattaaatcaagctagttaacatatcttttttgtggtgagatgtttgaaatttgcttattttaaaatataagatatattattattgactatagtcactctactgtgcaatagatctcaaaattcatttctaaaaaatatctaattgaaattttataccctttgaccaacaactcgttattcctttcctatacttccatgagttcaacttttaaattttcttagtttattttattttttttgagacagagtctcactctgttgcctgggctagagtgcagtgatgtgatctcggctcactgcaacctccacctcccaggttcaagcgattcttgcacctcagcctcccaagtagctggaattacaggtgcatgccaccatgcccaggtaatttttttttctttttttgtagagacagtctttgccatattggccaggctggtctcgaacgcctggccacaagccatccacccaccttggcctcccaaagtgctgggattacaggcgtgaatcactgtgcctggcaagagttcaacttttttagattccacatacatgtgaaataatgcagtatttgtctttctttgtctggcttatttcacttatcataatgtcttccagcttcattcatgttgttactaatgtcagcgtttccctctttaaggctgaatagtattttattgtatacatttacaacattttctttatccattcatctgttgaacatttaggctgattccatatcttaaccactgtgtatagtgctacaatgaacatgaggatgcagatatccttttgacatattgatttcagttttcaatttctttggatatatacccgaggtaggattgctggatcatatagtagttctatttttatttttttgaggaatctctataccatttttccataaaggctgcactaattttcatttcccaccaacagtatacatgggttccgttttctccacatccacactaacctttgttatctttcatcttttttataaacaccattttaacagacatgaggtatctcacagtggtcttaatttgcatttccctaatgataggtaatgctgagaatgttctttgtgaatttgttggtcatttgtatgtcttcttttcagaaatgtctacagattcagtgcaattcctatgaaaatcccaatgccattttggaaacagaaaaaacactctttaaattctcatggacccacaaaagaccctgaataaccacatcaatcttgagtaaaaagaacaaaactggggcatcacatgccctgagttaaaaaatattatgaagcaattgctatcaaaaatagcatagcactggcataaaaacaggcatacagaccaatggaatgggatagaaaaactagaaataaacccatatatttatggtcaattgattttaggcaaagatgccaaaaacacacaatggggaaaggacagtatctttaatacatggtattgggaaacccggatatccacgtgcagaggaatgaaacttgatccctatctcataccatgttcaaaaaccaactcaaatggactaaacacttaaacacaagacctaaaactatacgactactagaataaaacatggggaaaatgttcatgacattggtctggcaatgatttttggggatatgacccccaaagcacagtcaacaaaaagtagacaaatgggattgcatcaaactaaaaatgttctgcatgggaaatgaaataacagagggaaaggacagcctacacaatggaagaaaatacctgcaaattatacatctgatagggagttaataagcaaaataataataatgagaataataatataaggaacacaaacaactcaataggaagaaaataaataacccaattaacagtgggtaaaatgtttattattttaagaaatgaattggaaaggaggagccaagacggccgaataggaacagctcaggtctacagctcccagcctgagcaacgcagaagacgggggatttctgcatttccatctgagatacggggttcatctcactagggagtgccagacagtgggcgcaggtcagtgggtgcacgcaccgtgagcgagccgaagcagggcgaggcattgcctcactcaggaagcgcaaggggtcagggagttccctttcctaatcaaagaaaggggtgatggacggcacctggaaaatcgggtcactcccacccgaatactgcgcttttccgatgggcttaaaaaatggcgcaccacgagattatatcccgcacgtggctcggagggtcctacccccacggagtctcgctgattgctagcacagcagtctgagatcaaactgcaaggcggcagccaggcggggggaggggcgcccaccattgcccaggcttgattaggtaaacaaagcaactgggaagctccaactgggtggagcccaccacagctcaaggaggcctgcctgcctctgtaggctccacctctgggggcagggcacagacaaacaaaaagacagcagtaacctctgcagacttaaatgtccctgtctgacagctttggagagagcggtggttctcccagtacgcagctggagatgaaattctgggttgaaaattcttttctttaagaatgttgaatattggcccccactctcttctggcttgtagggtttctgctgagagatccgctgttagtctgatgggcttccctttgagggtaacccgacctcaaaggcagactgcctcctcaagtgggtccctcacccctgacccccgagcagcctaactgggaggcaccctccagcaggggcacactgacacctcacactgcagggtactccaacagacctgcagctgagggtactgtctgtcagaaggaaaactaacaaacagaaaggacatccacaacaaaaacccatctgtacatcaccatcatcaaacaccaaaagtagataaaaccacaaagatggggaaaaaaacagaacagaaaaactggaaactctaaaaatcagagcgactctcctcctccaaaggaacgcagctcctcaccagtaacggaacaaagctggacggagaatgactttgacaagctgagagaagaaggcttcagacgatcaaattactctgagctatgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaggaatgcagaagcctcaggagctgatgcgatcaactggaagaaagggtatcagcaatggaagatgaaatgaatgaaatgaagcgagaaggaaagtttagagagaaaagaataaaaagaaacgagcaaagcctccaagaaatatgggactatgtgaaaagaccaaatctacgtctgattggtgtacctgaaagtgatggggagaatggaaccgagttggaaaacactctgcaggatgttatccaggagaatttccccaatctagcaaggcaggccaacattcagattcaggaaatacagagaacgccacaaagatactcctcgagaagagcaactccaagacacataattgtcagattcaccaaagttgaaatgaaggaaaaaatgttaagggcagccagagagaaaggtcgggttcccctcaaagggaagcccatcagactaacagcggatctctcggcagaaaccctacaagccagaagagagtgggggccaatattcaacattcttaaagaaaagaattttcaacccagaatttcatatccagccaaactaagcttcataagtgaaggagaaataaaatactttacagacaagcaaatgctgagagattttgtcaccaccaggcctgccctaaaagagctcctgaaggaagggctaaacatggaaaggaacaaccagtaccagccactgcaaaatcatgccaaaatagaaagaccatcgagactaggaagaaactgcatcaactaacgagcaaaatcaccagctaacatcataatgacagcatcaaattcacacataacactattaactttaaatgtaaatggactaaatgctccaattaaaagacacagactggcaaattggataaagagtcaagacccatcagtgtgctgtattcaggaaacccatctcatgtgcagagacacacataggctcaaaataaaaggatggaggaagatctaccaagcaaatggagaacaaaaacaggcaggggttgcaatcctagtctctgataaaacagactttaaaccaacaaagatcaaaagagacaaaaaagaccattacataatggtaaagggatcaattcaacaagaagagctaactatcctaaatatatatgcacccaatacaggagcacccagattcataaagcgagtcctgagtgacctacaaagagacttagactcccacacattaataatgggagactttaacaccccactgtcaacattagacagatcaatgagacagaaagtcaacaaggatacccaggaattgaactcagctctgcaccaagcggacctaatagacatctacagaagtctccaccccaaatcaacagaatatacatttttttcagcaccacaccacacctattccaaaattgaccacatacttggaagtaaagctctcctcagctaatgtaaaagaacagaaattataacaaactatctctcagaccacagtgcaatcaaactagaactcaggattaagaatctcactcaaaaccgctcaactacatggaaactaaacaacctgctcctgaatgactgttgggtacataacgaaatgaaggcagaaataaagatgttctttgaaaccaacgagaacaaagacacaacataccagaatctctgggacgcattcaaagcagtgtgtagagggaaatttatagcactaaatgcccacaagagaaagcaggaaagatccaaaattgacagcctaacatcacaattaaaagaactagaaaagcaagagcaaacacattcaaaagctagcagaaggcaagaaataactaaaatcagagcagaactgaaggaaatagagacacaaaaaacccttcaaaaaattaatgaatccaggagctggttttttgaaaggatcaacaaaattgatagaccgctagcaagactaataaagaaaaaaagagagaagaatcaaatagacgcaataaaaaatgataaaggggatatcaccaccgatcccacagaaatacaaactaccatcagagaatactacaaacacctctatgcaaataaactagaaaatctagaagaaatggataaattccttgacacatacactctcccaagactaaaccaggaagaagttgaatctctgaatagaccaataacaggatctgaaattgtggcaataatcaatagcttaccaaccaaaaagagtccaggaccagatggattcacagccgaattctaccagaggtacaaggaggaactggtaccattccttctgaaactattccaatcaatagaaaaagagggaatcctccctcactcatttgatgaggccagcatcattctgataccaaagccgggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggcaggttcaatatacgcaaatcaataaatgtaatccagcatataaacagagccaaagacaaaaaccacatgattatctcaatagatgcagaaaaggcctttgacaaaattcaacaacctttcatgctaaaaacgctcaataaattaggtattgatgggacatatttcaaaataataagagctatctatgacagacccacagccaatatcatactgaatgggcaaaaactggaagcattccctttgaaaactggcacaagacagggatgccctctctcaccactcctattcaacatagtgttggaagttctggccagggcaattagtcaggagaaggaaataaggggtattcaattaggaaaagaggaagttaaattgtccctgtttgcagatgacatgattatatatctagaaaaacccactgtctcagcccaaaatctccttaagctgataagcaacttcagcaaagtctcagcatacaaaatcaatgtgcaaaaatcacaagcattcctatacaccaaccacagacaaacagagagccaaatcatgagtgaactcccattcacaattgctttaaagagaataaaatacctaggaatccaacttacaagggatgtgaaggacctcttcaaggagaactacaaaccactgctcaaggaactaaaagaggatacacacaaatggaagaacattccatgctcatgggtaggaagaatcaatattgtgaaaatggccatactgcccaaggtaatttacagattcaatgccatccccatcaagctaccaatgcctttcttcacagaattggaaaaaactactttaaagttcatatggaaccaaaaaagagcccgcatcgccaagtcaatcctaagccaaaagaacaaagctggaggcatcacactacctggcttcaaactatactacaaggctacagtaaccaaaacagcatggtactggtaccaaaacagagatatagatcaatggaaaagaacagagccctgagaaataacgctgcatatctacaactatctgatgtttgacaaacctgacaaaaacaagcaatggggaaaggattccctatttaataaatggtgctgggaaaactggctagccatatgcagaaagctgaaactggatcccttccttacaccttatacaaaaatcaattcaagatggattaaagacttaaacgttagacctaaaaccataaaaaccatagaagaaaacctaggcattaccattcaggacataggcatgggcaaggacttcatgtctaaaacaccaaaagcaatggcaacaaaagacaaaattgacaaatggggtctaattaaattaaagagcttctgcacagcaaaagaaactaccatcagagtgaacaggcaacctacaaaatgggagaaaatttttgcaacctgctcatctgacaaagggctaatatccagaatctacaatgaactcaaacaaatttacaagaaaaaaacaacctcatcaaaaagtgggcgaaggacatgaacagacacttctcaaaagaagacacttatgcagccaaaaaacacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccactgtggaagtcagtgtggtgattcctcagggatctagaactagaaataccatttgacccagccatcctattactgggtatatacccaaaggactataaatcatgctgctataaagacacatgcacacgtatgtttattgtggcattattcacaatagcaaagacttggaaccaacccaaatgtccaacaatgatagactggattaagaaaatgtggcacatatacatcatggaatactatgcagccataaaaaatgatgagttcatgtcctttgtagggacatggatgaaattggaaaccatcattctcagtaaactatcacaagaacaaaaaaccaaacactgcataatctcactcataggtgggaattgaacaatgagattgcatggacacaggaaggggaacatcacactctggggactgttttggggtggggggaggggggagggatagcattgggagatatacctaatgctagatgacgagttagtgggtgaagcacaccagcatggcacatgtatatgtatgtaactaacctgcacaatgtgcacatgtaccctaaaacttaaagtataataataaaaaaataaaaaaataataaaaaaaagaaatgtattggaaaattatactgctaaaccttacttagtgagtgatattttctcactctgcatccttagagaccattatttctttacattgaatcaaaaataacatgatttactcctatttcctaatatatgcatctcattgatttgaccatataggtatactctgccctagcagggctcctaaaatatactgccattaggtgggtgctacaaagttgaaaaagacgtgcaacttactagcttgtgcagaggcaagtcactgattgagtctgccacaattactgctctaatagaggggctacaaattactattggagcaaagaggtgggaggatgtagtaagtaaatgtctcatacagaaatgcccttttcactggtgtttcagctgctcatcctgttcatctttctcaaggcattacaagtgcagaagtctgagtgaagacaaaaaagcctaaaattaaatatacactgatttagcaaaagccaataaaatattattttcagctgaaagtctcacagactacttcatggatgaagtatcagttgggctgggctcactgaaggttgtactaaactgcacctgataattcacattgtatattaattggacactaatatgtgccaaaggatagatatgaaatgctttttatatttgaaaacaattatgaaatatatttttggaaggtacatctatgtatgtaggaagatgttatataaatgatttagagaaacaaagaacacagttatgagacaaatccatatttagcatatttgagaaatccttggccttaaaatccctaatggcagtcagcatttttggagtaggttcaaatacttaaatatcacatcttctttgtgcttaaaaaaatacaaagaaaaccctgtgtttggatctaccttttctctattactagaaattgtatgcatcaatagatcagtataggtttttgttgtagttgttttctaactccctttagaaggtgacagaaattaaaggctggagatctccttgcctattgactcacaaagtttgcaatgtcagaaatcattatttataattaatgccagtgtacaaccaagcattctcctcaaccagcggctgtctgtaaccataaagaaattttagggaagccctacatgaaatctatcttatagatttcacacaacacctgtgagtcagccttgcccagggctatgtcatttcacttcctatccgtctgaaaaatgtgcctcactgagagggcataatactttggaagggcagagtatttataactgaagacacgccatatagcttcacatgttagcatggtgacgatatcaattttttggcatctaaactttgaatagtgaaagaatacagagaatgtattacttgggtactaaagtctgctctaaaggatgtaagataaatcaagatttggaattggatgttagaatctcttatggttaactatcgctattttaaaatgggaaatatgtctgaattaggaattgggtaaatagtcacataatggaaaagtttgcttgtgaacttatatctgactttgttacttatactcagtacttttctttgccctaaattctcatttttgcagtcctttaaatatgctataaaatacatgtttttcaagtctttctggataggaaactttcctaaatttatggaacattaaatgtctggataatttctgagattccagactgtgtttcaataactgtagttataaatacataagcatattataacttaacatattttggttattattagaattataaaatatgtgccaacaacctaagatggttttagaaaaatgtttcaatggacaaaaaggcatgaacaatatgacattttttcacctgcaaccaacacattcgccacttacattacctttcctattggtcacatcttcctatataaggtgatatatatacacatattaacttttacaacaaaacgtgttatttttggtgtatgtgggggtgggggaaaagcaggcccatgtgatctctaccatttctttcagcattaaaattctgtgactgtgatgtaaactacagtatttttgtccattagaaaagcagatttgtgaacttattattacagaattattaatcagaccctaaagactctagaattccaacataacagaataaaatttaggttttgagcatgttgaatatatctgattttaaaaattgaaactagagggtttaagattttattgatccctctaccatctgtccttttaaaacattttaatgggttctcgggttctacatttcagtgtatctcttctgttaagattagctttatctcaatgaaatcgggtttgtgatgctactttttcttatatctagaatttttaatagaaaatttctaggaatttctaagttgttctaaatgattttcatcatggttggcatttggtaaatgcacaatgaagatttgttgaattaatatgaacttattttcctatagttgtcttttacttatttctaccgcacggtctacatgactgataatgaaactgtgtcactataaatacaagagtagtatctgtggttaatgtgatattagaccctcaacaggaatacacagacaactgatagacttcaatcaaagctttaaagttaagcatgttcttaaactaggtgaggagtcatgaagatggaaaatagaaaagtatctctgaacacatgggtcctgaaatggagctttccagaagttggtgtccaattaccatttaatatttcatgaacatgtttagatctaagacattttaacaattttaattaatagaaggacagcctgccctcacagaagtcattgtgaagtttatctaaaaggtgagatttttaaacataattattcccttgatactgcctcatttccacattagtcctgttggaatacactggaccatataatggagaggaatgacagaaccagccaaggctatgatgcttcaggaatagtgcaaggtttctctgcaaatagcttcttgagatgcttatggttcttatattgttaaaattagaactagaagcaatggcaagtagtatcttattggagccagaaagaccatgttttcttgtatataagaaattatactttgaactacctgaactgatcaggcagaatttcagggtttctagaattcttgataatctgtttttttttttttaattttttttttttgttaaaagaaaaaaaaaaaaaaagaaacaaactaccctgagttttttttttttttttttactgatatagctctatactgctgcaacctgggagaaaaggatcacagtgtttatttttaaataaattttagtgtcatttctgtgttatatttcatatactgaattcaaattcctcaatttaaaaagaactcactcaggtattgattgcaaagatatatttctagtagttatgcctaattgacaattgctgtcatttacttctggccaacttaagagtcccaggaataaagtgcttctttcacttttaatcattcattactctctccttttcctcccttgcaaagtttttcctgattttctttgttttccccttggccatccaccttacaccccttattcctactctttgccttcatcattttgtccttgtagagtagctcaagtcagcctttgattgttagtcagactccatgggcaattccctcaatgttttcattgtttacatgaaagcatccaaatgtatagcaaatagaccagctggaaacctccccacagacagacgcatccaaacaggaggttccttgacgtgttgtggtgggtcagtctggttctgctatcagaaagaacagcccacacccatatgcactgttgctcttgagtggaaggcttgtgatagcatccacatggactgggcctcagccaaaacttagcctttagcacatacagcaatacagaatgatgtgacaacgacagagttttggaatactgtttgtagcatgctgttctttggcatactttttcagaatgtaagaacagatttctcctaattttcccaagacatattgtttattatagaatgaggctttaaaaatgactatagatttgaaggcaattgatcgacttaatattaaactcaatatttagtgtacatatcttggaaatttattttgaaatgttgcattggtgactcgtgcttgaaaaaaaccacctaattttaaatatttctccagggtgtgaaaagggcaacattagtaatgagacaaatagagtgatccttgactctaattagagaaatacagtgaaaatttatcaataaaagtaaaatgcttaaaacctaaagcaaatatatttaaagacatttcacaaatataatattggcagtttctgaacaataataacatatttgctgagtatacattcatgttatacactacactaaaatcttgtttaaaaaataagcataacatttacacattctatttagaagatgatgtatattgtctaataacacacattaaatcagtacatatttttgtcatcagtgatttgaaagaataatgtgttataaatttctacctaattcatagcactatgccataataaagaagaataatactattaaaaaataaccatcttggtttcattttttaaaagtccctttctttacttatcactattgttttaaaataaataaggcaaacataaatcagacatggaccaaaaaaaaaaaaaaaaaaacacaaaaccctaatgaaagcaattctatgggggtaaatgtggtttgagaaacatgtccttagcctattctaaacaaacaccttggtaaaggcaaacggaactttgcaaatcaaatatcatcattagtaagaggaaaaaacagtagcatatttctgcctttcatgcttgttacttcaggtggttaacctgaactacaaactcattacttgacactcaagatgtaggcaaaatcaaatgctatattccaacccaaaatatatgtagcaagtctacagatttgtcatacaacatgggcaacatgcaaccaccagtttaaagggttgcaaccaacttcttgtctatgttcacagacaaactgcaggaacctgacctcaaagcccaaccaggctctggaggaaaagctgtgtgcctcattccaagcaacttcagagtttcaatggatttaagacctagaaagagatctggaaaacaaaagagtaaaaataacatttcttatccctcttgatgaaagacatataattgaattccagagaatgactgattgaaatttttatttgttttttttccaatttgcttatctagtgtagacttcacttatagcctgaaagcctataaattatgagagagagagatacaataccactcacaaaaagctaggttatcctgcacacaaagaaccccaatgtgtttgtggtttacaaccatggagttttatttttcactgatgctcacgtccatcaaagctgagttgtcaattggcttcatctttccttccctcagactcaggctgcctcggtaccctctacctgattattgttggtggttgtgatgtggaaggaaatgacataccaaccacatgttagctcttaaagcttcttcccagaggagacactaactactcttcacatgctattaggtgaagagtctcatgccatgatgaatgtcaacaggtcatacaagcaaagataactgtctcctgtcaagaaaacatctctgtggacaataatatagtttaccacaggtagcaacaggcaccatatattctgagagttaggtagaggaatggcctgctattacggacttaagtagagaatgttggccaggcatggtggcacacgcctgtagtcccagcacttgggaggttgaggtgggtgtatcacctgagctcaggagttcgagacaagcctggccaacctggtgaaaccccatctctactaaaaatacaaaaattagccaggtgtggtggcacacgcctgtaatcccagctacttgggaggctgaggcaggagaatcacttgatcccaagaggcagaggttgcagtgagccgaggtcatgctactgcactccagcctatgcaacaaaagcaaaactccgtctcaaaaaaaaaaaaaaaaaaaaagagaatgttagactgatagatacttggatgagctatgacgtaagtaaggccaagtacaatggccatgaacagcagatccatggtgctaccattaaagtattagggaggaattggcaaagtatcatgctatctaaaaacaggcagatgctattcaaagttaagtatagggagatgaaatattaagcaacttcctttcttgcaaattcaagggatttcttcatttttgacccagatataggaaagaattttatttatgctttaagtagccatgagactgcactgcttgaagtaaaatgaggtctaaaatatcttctcagattttggctctttccttggtaatcccaaaattggtttcgttcagaaatcagtgaattctcctatctttattatagggaatctacagtttttgaggttctgaggacctgatctctaatagaagcttgaactctttctgacatttttgttttgatgggaaaatttttcaatgtaatcacttttacaggacccagacaaaagtcccaaatttaaaattttattctcagaaaatttttatagatttttacagtgaataccaggaatgcatccaacagaattattcaatgaaagcagaaaataccaccattatgagtgagatatcatgaaccctatgcggcaaagatcttgttgccctgaacattttgcttctttaatcatcagctctagttgtcattttagacaacaaggcaaacattggcatagagaagcaggaggtaatatcaggagtttcagatggggtaacttctggaagctgttagtagcttctactgtttacctccttttcaatttttttttcacaaaaaaggcacaatatctgaaggacacatgcttccttttaaagtgtgaatgttatttttagcactggtatggaaagcagcagaaaatacaacaatttatttgctctgttcatgaaaagtgattttatttttgggtttaaagaaataattgtgaatgtcttttgggaaaatacaaattttaaggtttaaattcaagtgtccctttctgtaagaacttttctcatttacgcgttttcatctatggtggatatgacatgattatttatgtcatcttttctccttcctacggggtcttctcttgcaaaatggcgctgcatggtcagcactgactcagaatgtggaacaaggtgaggctgcctttctcacagtattttatgtgtattcaagctgtgaaaagtgtcacagcaatactcccattctgtgtcagctgaactgtatctgctcatattcacatctcggattgactacaattcaaacctggttatttgtttctttatcaattgtcacaaaataaaaggcatattttagcagtgtttttgagcccccaaataggaaactaatttttatagaaatctataccattccgtctttgggagtatcaatccttaaaccagcaggtgagaccacattttattaaatggctcattctaattcagatcctggggtggtcttacttatggatgaattgtgctgctaccccaagaaaaccatttaacctatctgcacttacagagtgcctctgtgtacctgctgctgtctgatttgaagccatgaaatgagaggcttctgtttttgaaatcagtttttcagaggtgctggctttgacagtggctactctttattaaagaaagaacaagacaaataaacagaggtttgaccactacctgtttcatattggccatttctacatgatgcaaaatgccaggtcataaatgagtcattcagtattctgggcttctctggatggccaattcagagactgaggaaactaaaattactgcctgtaaatcattcttaggatgagagagagaaagagggaaaagaaagattcactggatacatattgacatatcctttgagtacatgtataaaaattatattctttatattttacttacagatattgctatttgttaaatatgaacatggtcagtttaatacatgcattatgttaacaaaatttcaattattgaataatttgggaataaagtttcttttataaattcactcacataaaagcaggaaagctctgcagaaatcatgtcaagaagaacagtttacctgaatttgcaggtgcatgataaaaatatcccagtgcccagcttctatttgtacctgcctagatgaaggtaaacaaatgcaactaagatcttccaatgacttctgttttctattgcattgctgggttattctttgtcttctttctttacaaaataggaactaacatacctgtgtctgatttattctccatatgttatgccatttattgttatttaaaaaaaaccacaatgtaaaatgtactcaataaagaaacttgtaagacagaaagaaataaataaaaaacacataaatcatctgtcatgtcatcaccaaaaataactaatggtaacatatggtttgcccttccggtaatttttctgtgtctgtgcctcatctcttccttggctgccttctcttttctatccgcattctttttctaggtgatatcctctaggcatgcctataatccatccttcacaggctagatggagtttacttttaaaaactctccagtttgaaaccctccaatggcttcctgctgcacttggaatacatttcaaagtccttatgttcttcttgctgagtcttttacaaccttcctctctgactttgtacagtctgattttcttgccctcctcatttttgtttgctttctattgctgaaataaattgctactaatttagtggcttaaagcaacacagatttcttatctttttgttctggagttcaaaagtcaacaagaggtctctctcggctaaaatcaaagtgttggcaagctccatttctttctggaggctcaatggaataatccattcctttgccttttccagcttctagtaaccatctgtattgcatggctcatggcccccttcaaaggcagcaatgtttggctcagtgtcaccctgtcatctgtctggtcctccttctgagtgtcttccacttataaagacccttaggattatattgggcccacccagatattccaggataatcttttggttagccaccttatccatctgcaacctcaattctcccttactatgtaacataatgtattcatagattctgaagattaggatgcagtcatctttggagaggggccatattctatcacattctgaagcattccttagagagtcaaagatgactatccactatccctaacttcaccaagcatggagaccctgcattggcccagtgatagccactatgatataaagattaccatacttggccaaatgaataaattgagaagtcagaactgttggaatattgcaaacagtataaggtgagagaaacattcggaggaagtgcaagtttattcagctaaagtttatagggctaataaaaatacttgtttcattgtcctgacatcagtttattgtaattaaccaaatatagactttagctttcttttctttttatagaacttcctcaaaaacagttaatacattttgttgcaacctattatctgaccactcaaagattattgaatatattatatgggatggccctggggatatagttttgaatgagactagaactgcctttcaagtgactcactagtttaatgagataatcagataagtgaccatttaaaatacagactacataggatttagcctgggttttggagagtcttgttggagttcaaaagaggctaagcagaaagagtgacctaatgcagtctaaattagaaaggttcccgaaatttttccaaatggagatgaaccaacaattgaggaagggcatccatcaacaggtatcaaacttcttcctttgttgtatttttccttcccctagaagcagctttatgaaaggctcttacttctctcacctcatcactgtttccccagcatgtagactggtttctggcacatagtaggttctctatcgatatctactgaatatgagaataatatatgtatacaaaatatgcaattttactttatagaaaggaaatcatacaaaatggcctatttggtaacatgtttgcttttagttagcaatatgtaaccatcattgtctgataaccattttgacagaaattcaatctcaaataaatgtttattcaatcagagctttctatgttagatttctttatttataattatggaagaataaacattgtttcctttagttcttaaaggagcttcgggggccaaaagtgtgtttgaattataattctccaaagcctaaaatctgcatttgtttaacaagagtctattcaaagtcctttgtactttaaatctttccttatatctgtttcctgcctgagcttggagctatggatcctggagactcacctattttttttttaatagataggttttctgtgatagtttattttcaatacaactatctcaaaattttgagcatactcttgctttccagtaaataaatatgccaaccttcaaacctccatccacctggttccaagactttttaaaaaattattattattatgttctaagttctcggatacatgtgcagaacatgcaggtttgctacataggtatacatgtgccatggtggtttgctgcacccattaacccatcatctacattaagtatttcttctgatgctatccctaccctagccccccaacccagacaggccccagtgtgtgtgatattcccctccctgtgaccatatgttcttattgttcaactcctacttatgagtgagaacatgcagtgtttggttttctattcctgtgttagtttactgagaatgatggtttccagcttcattcatgtccctgcaaaggtcatgaactcatttttttttttttttcagacaagaatctctgtcaccaggcttgagtgcagaggcacaatctcggcacactgcaacctccacctcccaggttcaagcaattatcctgcctcagactcctgagtagctgggactacaggtgtgtgccaccatgcccagctaatttttgtatttttaatagagacggggtttcaccatgttggccaggatggtctcaatctcctgaccttgtggcccacccacctcagcctcccaaagtgctggtattacaggcgtgagccaccatgcccagccaaactcattcttttttatggctgcatagtattccatggtatatttgtgccacattatctttatccaatctatcattgatgggcatttgggttggttccaaatctttgctattgtgaatagtgctgcaataaacatatgtgtgcatctgtctttatagtagaacgatttataatcctttgggtatatagccactaatgggattgctgggtcaaattgtatttctggctctagatccctgaggaattgccaaacatgagaaagcaggaaaaatctaaaatggacaccctaacttcacaattaaaagaactacagaagcaagagcaaacaaattcaaaagctagcagaagacaagaagtaactaagatcagagcagaactgaaggagatagagacacaaaaaacctttaaaaaaatcagtgaatccagggactgtttttttttttttttttttttttaaagattaacaagatagaccactagccaggctaataaagaagaaaagagagaagagtcaaatagacacaatagaaaatgataaaggggatatcattactgatcccacagaaatacaaactaccatcggaaaatactataaacacatctacgcaaataaactagaaaaactagaagaaatggataaattcctggacacatacaccctcccaagactaaaccaggaagaagtcgaatccctgaatagatcaataacaagttctgaaattgagacagtaattaataacctacaaaccaaaaaaagcccaggaccagacagattcacagctgaattctaccagaggtacaaagagatctggtaccattccttctgaagctattcctaacaatagcaaaagagggactcctccctagctcattttgtgaggccatcatcatcctgataccaaaacctggcagagacacaacaaaaaggaaaatttcaggccagtatctctgatgaatatggatgccaaaattctcagtaaaatactggcaaaccaaatccagcagcacttcaaaaagcgtattcaccacagtcaagtcagttgcatccctgggatgcaaggctggttcaacatacacaaatcaataaacgtaaaccatcacataaacagaaccaatgacaaaaaccacatgattatctcaatagatgcagaaaaggccttcaataaaattcaactccacttcatgctaaagacactcaataaagtagatattgatgaaacgtatctcaaaataataagagctgtttatgataaacccacagccaatatcatactgaatgggcaaaatctggaagcattctctttgaaaactggtgcaagacaaggatgccctctctcaccactcctagtcaacatagtattggaagctctggccagggcaatcaggcaagaggaagaaataaagggtattcagataggaagagaggaaatcaaattgtctctggctgcagacgacatgattgtttatttagaaaaccccatcatctcagccccaaatctccttaagctgaaaaacaacttcagcaaagtctcaggatacaaaatcaatgtgcaaaaatcacaagctttcctatacaccaataatagacaaacagagagccaaatcatgagttaactcccattcacaattgctacaaagggaataaaatacctaggaatacaacttacaagggatttgaaggaactcttcaaggagaactgcaaacaactgctcaaggaaagaagaaagaatacaaacaaatggaaaaacattccatgctcatggataggaagaatcaatattgtgaaaatggccatactgcccaaagtaatttatggattcagtgtgattcccaccaagctaccattgactttcttcacataattagaaaaaactacttcaaatttcatatagaaccaaaaaagagcctgtatagccaagacagtccttagcaaaaagaacaaagctggaggcatcacgctacctgacttcaaactatactacaaggctacattaaccaaaacagcatggtactggtaccaaaacagatatatagaccaatggaacagaacagaggcctcagaaataacaccacatatctataaccatctgatgtttgacaaacctgacaaaaacaagcaatggggaaaggatttcctatttaatatatgatgttgggaaaactggctaaccatacgcagaaaactgaaactggaccccttctttacacattatacaaaaactaactcaagatggattaaagcattatatgtaagacctaaagccataaaacccaggcaataccactcagggcataggcatgggcaaagactgcatgactaaaacaccaaaagcaatggcaacaaaagccaaaattaacaaatgggatctaattaaactaaagagcttctgcacagcaaaagaaactaccatcagagtaaacaggcaacctacagaatggcagaaaacttttgcaatctatccatctgacaaagggctaatatccagcatctacaaagaacttaaacaaatttacaagaaagaaacagacaactccatcaaaaagtgggtgaaggatatgaacagacaattctcaaaagaagacatttatgcaaccagcaaacatatgaaaaaaagctcatcatcactggtcattagagaaatgcaactcaaaaaccacaatgagataccatctcataccagttagaatggtgtcattaaaaagtcagaaaacaacagatgctgaagaggatgtcgagaaataggaatgcctttacactgttggtgggagtgtaaatttgttccaatactttaatgttattttatataatagtaaccaatcctcataactctattccaaatctatcaaattatagtgaggcatggcagtagaaggagagtattggaggaaaggtaagtagaagcagatagaaaaagaggcatttcataatcatttcaggttgtctataatgtatagttttcagaggaaaagtaaacataaaaatgcctagatagaaaagcctgtttaatatgtagaattacatttctgtaacaagaatcccttccccaatgtatcacaatcttctagaacagcttttgataaattttaaagactcaatatcaaatgaatggatagataaattacagaatatattagtgagaggttttgaagaaaaggcagttttgttgcaatacagaaagctaaattaacttaacactacaaagatgcttcatgcagaccaacaagaacaatagttaacagttgaaaacctgtttctgtgttttagccgcccctcacccacaatgtatacccatagtgataacattttcttaataaaaaactgaatcacatcatttgactgaatgaaaaggaaagggtatgaggggaagaggttttggaagaaagggaaagaagccacagtgcatcaactcatgaggaatgctttcacacctgccgcttccctcccactttgttacacatccctgtaaggcgtgcccttcactcctcatttctgagaagcactagccagtgagctatattaatcaaggtattatttctctgaaagttattcagcaaaaaaaaacctttaaagtaaagcaaaacacaaaaaaaatacaaaaaagcaaaaaccttgtatgtagcaccatataaaaatattttaaaatggcatgatcctctataacacgggatagatggccactatatttgtatagcaactacttccagacatacacggaagaatatgttatcatactttaatgatttctgaaagatatctaccaaaaaatagtataaaatactataaaagagctcccgtgtagtttccaaagtccaccaatattttcaaatcctacgttacataaagagtttctttaaaaattgactcgaggaatgtttcctattttagatgtcactatgattttaaatgttaacatacaatagcaaagtgcacctcatttttcctatttcatttttttccctcatcaatctgactttgtttttgtagggagtgctctaggtgaggcatgaacttacagccttggcatcataaataccgtgtactaatcaactgtgcaactggaacaaccagacttttcttaaatggttaatgatatgactcatacattgatacatacaatgatattgttaaaatcacccagtgtatcacttactctacatttaaaagccctgtgtgaaaatgactgcttatttttattagtaattaatcattataaagccatttaatggagttatgtattcttataaatctctgaatacctgcagtcaaatttaaatattctcttagttttatatttcctctctacattagatctttttgttggttttttaaagacatgccacttttgatcttaatattaagcatattgatttacttaaggacatgaagaatccagttttaacaagtgtatcgttcacaaaaatgtctcctatatggctgtactctttttccatttcctggttttgaatagtcttatttctgtcatcaacaatgaactttaaggtacctcatttcaactagagcaaatggctgttgaattcaatgactcactcagcatagaaattcattagacattggtttatcagtcaaagatgacatttgttttgagccagatgggttttcttgaggaaatcctctaactggatgcagattagattggattttagctttcctacactattaaacatcactgtttcatatggcacacacagcctgtaatatatttgtatatatttgacaggattttaatagccatggttttaataataaaagattacactttttctgaagtttatctgtttgcagtctttgatattttatgggttttaaaacatgcatcatcttataaatatatttccaaagcctaaaatcttgggatatatttttaaattaaaatgttaaacaataacaccaaagaagaaaatctcatttgactaggctacatagtaacagtgggatagaatagttgatccacagtgcaacttttcttgggcattggtgtctctatcttttctattttctatatcctacacaccctaacaattggcaagtcatgagatttctacttagaagaaaaaccattctattttcacaaataccatacccagtcaagacatcttcatgtactgcagagacaacagcaatactgatctaatttgcattccatcttcaaatcttactgtttaaattaatcctcataagagcagtcagtaatcttttaaaaagatagattagggaatgttacttattgtaataagaacttggtaatttgggccaatcctaccaatgtggacaacttgtgctgctgtatacatatacatctccagatgcatctttgtgtatatatacatgaataggtgtgtacacacacacacatacacacacatttgaaggcttagaagactaataagagagtaaaaaaatggtgttaccatctggctaaagatggagatctggagaggtgggctactcttgccttatgggttttcactcatttcaggagggttggttgatcaagtgtacagtgcttttgtcagactcatgggactgagtccagggtctaccaaagtatggggcttggcaaatgtccctggtcttgggttgggaccccaaatggcagtgctttagcaataaaagaaaatcagaatcaggcactctcacaaggaccacagctttgctttgattctctccatctctgtaatcctacagagcaaggacgatgaacaaaccaaagccaaagccaacaaaaagcaaattccacaaacatagcatggaataaatgtacctagacacaaaagaatagatactaagttattttatttatttcaacacacaatatataatgtttaggaatgtattcttaggtgttaaggtcatatgaaaaatcaagaaagtatttataataaaaggcaagataatggttcctctggtgtacagaggagagagaacataagaaaatcttctgtgttactgccaatcttcctctattttggagtgatgtgtacacatatgatcactttgtgataaatcagcaagtgtatattttattttgaaatttgtgtacctgtgtgctgtatttatactaagaatgttaaattgtaagttagatcatattactctgtattgaaaatattccagttacctgtgattgtctacctccctgttctcatctggaaacagcctgcccccggccccattgctcgttttactctaggtacatggaattccttgctcttgttcaaaaggacaaaaatcttgcccattttagtctttggacttgaactttcttctcttcctgcaatacacttttattgacttgatccataattgtttcccaatccttcagccccctattaattgtagccttcttagagacgtatttcttgaccagtcattctaaattgacaactgaaaacccaacaaatgctccatatcgccttgtttatttccttcatattggaaagcagatgatgacatttgatttgtaattaatatatcttttatccaaggtaaaatatttgctgtaatgtaagatctatgatgggaggtatacttttggtttttattctcagcactaaatgaatcataggccaacgaaaattattttgagaaaagactttgtgcaattcctaaaaattagtctattataccatgggtggtaggagaagcttaggatctcatcatataatttggttatcctagctatgctgctaagcaaaacaaatatttatttagcccagatatgtagaattatcttagacaaattttcatatgtgtccagtgccagttttcaaaatgacgtctttttatggcaacacctaagtgaagtatttctttcagggacattatacacaaaggaaagtaaatgttttagttcaggtggtaatgacaaagttttcgtaatgatacaagttatttgtaatgctaaagttattgcgtttcatttttacttgaggaattacatatgccattttagaaactttacttggatgtgtatgactgtatttcccgccgtagttagtttttaagaaagaatgtttcacctaaagccatattcacctttccagagtaaaaaatcaatatttagccttaaattaataaactatgtttttgttattattggtccttttgatactgtatctctttccatttcattaaaattaaataacttacctgccatatttattatctgaatactaatttattttcccatttaatttttttctttactctttggtgtttctttgctcagaccaaacctagtcttgatctagttgcactgtgctttctttgaagttcaaatgcatctaatgaatcatggcagtactctctatcaccttacaggcatcaaagtaaatcagccagaacagggatagaaattccaaaggtccctgccacctgtgctgcaacattcactccaagtaaacacttagtcatctctttagttgtgaacagtgatgtggcccaggagcctttcaccgaaggtggcccagcacttgctgctgagttttcatgcactttgcttgcatttatcgccaccatgaaaattacccaaggattgaaaagtctatcaagtatagaggagagaaagctaacaggttcacagatgcagataatttagtgttttaatgaaaccctggattagataatgcacttctctcttttatttaattttttaatgttacctgtctgctattatacaccatttgttcttatagaacacacacacacacacacacacacacacacacacacacacactctctctctctcacccctacctcaagcaaaggaggttgcaacactttttctcaaaaataacaaatcaacctgtaattcttcacactaacggtaaggtttatgtgtttgcttcaagttaaaattactacctttcagatggattatctttttatttttattttttattttttttgagatccacctaggctgtcagagttccacatttggcatcattacacccagttaatgtaagacagcttatttttatattgcggtgttttatagatttttttattgcaccattaagagcattttgttttctgcaatattcccagattttcttgtcataatacacaacatcccacagtcccactttgtgccaaatctcatagcattcacttacatctacttttctgcctcagaaggctaggtaatgagctgagcttcagaaaaagaaattgctggtttagtttttttgcattacagcccaaacagattgttttcttttcgataactagccaatgctcagttcacagatatttcccctggtaggtaagcattgccgatttagtgtccagtagcatgtttacagttcataaatgtcatctgattttcaatttttaacctgagaaatacaatgtttctttcaatattctgtaaattttaatggaaattttgtggaatttctcagttgttcagtgaagcaaaaatttgttcagcatgcctgttttaatcctaatgaaaactattaaggagtttatattcttgatattgactatttttgacaatatagtattacaaaaccatttcgacagaagcagttttagctttggagtttacacagattattactgtattatctatgactttcattcactcaaagtacatacatatctcataaagacaccatttgagattgccaccatttaaaaaattaataaataatagttgttcacatttatgaggtacatatgatattttcacatatgcatacaatgtgtaatgatccaatcagggtaattgggatatctgtcacctcaaacatttattgttcctttgtgtggggaacattaaaaatcttctctcctagtgattttgaaatatatgataaattattgttaactctagtcaccctactgtgctattgaacactagaacgtattccttctaactgtatttttgtacccattaaccaacctctttttgaccccttctctctgatatacttctcagcctttggtaaacaccatgctacttactacctccatgagatcaatttttttgcttctacatgtgagtgggaacatgtgatatacgtctttccgtgccttcttgcttcatttttgataatattaaataaaggtctaacacctagtggtcaagtttgaggttgacatggaggagaataagacagtcatatttaggctgaaatgattttaaagacaatgaactctctaatgtacatggatatacatttgggattcctattcagggctggaattcaaagcattctaaacatgttaacaacagcatttatttatagttctagtggcttgcgatccatcaaatggcacaattgctactggcctcagggttgacggtcttcctggcagtggtcccacagattgcaccagtgtaatttcaaggccttgatttgccaatgatcttatcattgtaatgatccctatattctctttagctttctcattttataagactgacattagaaagcaggttcatattaacatcatagcttgaccaggtcttaacagacaggatgactaaactaccagtctacttgaatttgttttttcagaggtctatatttaagcttttttccaaaagattaatgttggttagcatgagaatagaagacagtgaaagcagatgaactttcaaggaataaaaagaattcatgagacctaggttaattctagaactttgaagattagatttattcatctagttggtctgaaatctaagtgattttttttctttttttcctcagagataatattcccaaataagatttttaagttcattctaaagcagctaaaattcttgagtagctatctacttatttggactaatttaattttatcccagtgatattaaatatatacacagatacacatatacttaaatatatgaattaatattttcaataaagcaacattttagaagttaaatagactggaatcaatcagcttaataatgcataacaccgaaagaaagtaagaaaggaacaaaataaaaaaacattaggggaaaagcaggtaagttaggagagggatacatgattctacatttccttgttaaggaggagctaattgatttcacaagagccagctggggttttaaatgctcactctttttttctggtcaatattaataacaataaaatcaatgcctaatatgatattagccattaaatggttattccacgttcatatttgggctttcacaaagtcactgaagttttttttctttttttctgagaatctgtggatagtccagtcggtacagtagataattgaaataaagtgttccctgcatcctttggctctgcgcttcagaactgggccatgggttttcttttaagaggcgtaatgttgtgctggaaaccacatcagctttgacaattgagttcttattttcacttcactatacaccaactttatgagccctcatggtgcttaaagtttattaggaaagaaagaaacaaaagcttcaggggccaataattagctaatttcattgtgatttcatgctacgatgcttttggctcttcaaatgtgtcctcttgccccaccaggaacctggaataacatgagcattcctcttccccttagcttacctaatttgttcctgttcttcaggtctcagtttaatatcatgtattctcttacttccctaatcttttcaacagatttggtgcccttagtgtgcctttatcatcagtactttctcattatagcacttatcatactttattataattaccaacttaattttcttttccaccttatttctatttgaatctaccacatttcttggcatataatactagcacaataatattagtagacaatggataaataattgagggttacatttaattgtgtctggactatagtaagaatccaatgcctaataactgtgatcactatctcaaactatacctctttctaatttctaaaacaaaagaattttaatagtatagaaaatgctgatagtcatttaatattttccgacttcaattaattaaagtctttcatagaaaaggatgtggtgttataagctttcatccaagacatttaattcaagttttaacatatttctaatgtatgactaagcatattaattgaatagcgttaaataacagtaaaggttaaagattagaggatgttctaaatgaaagatgagcagttcgctgctgtatatgcatataggcaaagaacagctgggacttctcttaggataaagaaatatgctcaaaactgtacaaataaaatgcagatctttaccacatattgtattgaatgtcaatttacaaatggactaatctgtggagaaatataacatttgtagttaatatgaataaaagtaatgttagacaatttaaagcaggtaatttgtttcacttatacattgctaagtatatagtgtgattttccctgaacacagaattatatcacatagagtttttctttttcttttagaatcataatgtcttagtcaaaatctcatataagctctagctttttctgtcattcaaatattcccacattgactcccttaaattatgtggaagtttccttctccccagctcacatgtgtcaatgaatttatctaaagatcttactggcttaggacttcaagaacaaatatcagtaagaacctttttaaataaaaagttttgaaataacacattttcctgattttaaaagtaatgcaaactaatttcagaaaatctgagaaaattaaaataatgtaaaaattatattatcctgttttagagataattgcttttctttttatgtacttcaagaatgtatatattttaaaagaaaatcataaagataacccgtatagttttatagcaggatttcctcatgtaatttcatgtcataaacattttcaaatgatattaaaattatttaacctcagatttttaatggctatgccatgagtaatttaataatacccctaaatttggacattttcattatttatccttatgcaatgaagatatttgtatataatttgttttctgtacttagcaatttgtaataggtgttttctataatgattatgaaattaaaacacatacacctctaataggatatttctactatttagatactattaaatggtataaaaacatgtttaaaagaatattcaaattacaaatgaaatttttcttttatcagaaatatctttgccaaattttataatagagaaagtaatattgaggcataattatcttctttaatattatatgagtgaatggggatatgcaattagttacaagaccacaaacattaaacaacagaaagttatcagctaaacctaaaaacaagtgtgaatttgtcaatatgaaggtagataaaagggaaatgtgtgggctatattgaggacctgaaagagggactaggcactattaaacctgatgggaagcttaagtgaagaaagcccttagagattatgccaggatagaatgaggtctcctttgtaaaataagtgaaacaatgggacacatttttttcagttccacaagtaggtttctaacaatctcgatgttcttttgttacagcctttgagttaaatagtctgagtttcttcagcttcgaaaatgttaaaataggctgtgcatggtggctcacgcctgtaatcccagcactttggaaggctgaggaaggaggatcgcttgagcccaggagttccagaccagcctcggcaacatggtaaggcctcatcttacaaaaaatacaaaaaatttagccagtgtcatggtgcttgcctgtagtcccagctacttgagaggctgaggtgggagaattgcttgatcccaggaggtccaggttgcagtgagccattattgtgccactgcactccagtctgggtgacagagtgagaccctgtctcaaaagaaaaaaaaagtaaaatactgttttgtttgcaatcagagccctgtctgtctttgtcaccatgtatcagcagtggttagcacatagtagatctccaatacatttatgtgaatggttctatgtaaaagcaaacaccacactgattaatcactaattaaaagcaaaaagcaaaaagcaaaagccaaaagtcctcttatacaagattctgcagccaaagagcaaggacagcagaggaccaggctcagaatctaatcataaaagcagcagatttcaaagaattctggtttattccatgatcagaaccctgatagttgttataatgatacatgaatatctggagcaatgcaatttaaaagtttgaacttctagatttctagattttctctgggcctgcagaagttgttcacttcctcttttcacaagatagtatcttctacccacttgaagtcatacagaggctgacaaagggtagatttcttataggataattcttgttcttcagggattactctcatcactccctctgacaaccagacaaatactgaatgtcaaataccagcacaactgggacaaagatgctatgggatttctaagagagaagaagggctatcattgaagttactgaaggatctgcaggtgcaggaagagtacacagagtatgtagcctaaggggctctgacaaagggtgaaagaatatacatttggatacagtagctaatggatatggaagcactctactatgatattaagatttaaaatcctggcacataccctagatgatgttaacagctgctaggatggtacctggaaaatttatggctcacattgagtgaggtagaaattccagaactgccacggaagatgaaggaagaagggaacaaaggactcagtgtattgagcatgcctgagaaaatatatatggaaagctagaaatcccgcaagataaatataatccaaaggatggaccactggacactccatttaccaaaatataaagagtgtgttgtggagaaggacatcagtattgttgagaagctcagtggtaactgtcttctgaaggccagctggtaggagatcacattacagaacagggattcttgaataaaaatgggaacgatagaatctctaaataatagataccaagaggtgatatttcattgacagaagaaacatagatgtagatttcgcaatgagaaggaagacaggagtggcaaacatggagtctaaaatttagaaaacagtagaataataaatagagtatggagttcctataggcaagacagatggacagctaccaaggattttgattaatttatacaaccaaaaccaatcaagaatggataatcaggaggttaaggccaggcacccttcttcttcctccacaactctctatcttttgcccagtttctagacctgcattgattctcagacttttaattgaagatgactgataaagtagataacagatctttcagggaaagaacctaataataccaggaacatatgaagttgtaattttcccagtccttttccaacaggacctgagactctttactcaagtgactatgtactaggtaagaggaacatccagaacttctgaggtttgcttgattcagaatccaaactcaaattaggccaggtacggtggctgacgcctgtaatcccagcactttggggaaggtgggaggatgctttgagaccaagagtttgagactagcctggggaacacagtgagacctcgtctccacaaaaatacaaaaattagccagatgtggtggtgtgcgcctgcagttccagctacttaggaggttaaggtgggaggatcacttaagcccaggaggttgaggctacaatgagccaaggtcacgccactgcactccagcctggggaacagagcaagaccctatctccaaacagaatgaaacaaaacaaaaatactgaaattcatcctttgatatccaaactgattccatactcctaatagaatgaaggcatatgggagccagatagtaagtagagttttggctggcatttggctcacggtgtaatcactgggtccacagaccaaccagatggtgttttccaagatcttccaaggtattactggattatacatccttggtagttggcagatcccccacactggttttttgttctatatgtaacagccatcaactgtcgcttcacccacaactttattcatttttcatcatttttttttttagacaaggtttcactctgtctcccaggttggagtacaatgacatgttcatggcccactgcagcctccacctccctgggctcaggtgatcctcccacctcagtctcctgaatagctgggatgaccggtgcatgccaccatgcctggcgaacttcttttgtgttttttgtagagacagagttttgccacattgcccaggctggtttcaaactcccgggctcaagtgatgtgcccaccttggccttctaaagttgtagaattaaagtcatgagcctccatgcctggtcatttttttaatctttattgattttcctaacatttatattgtcagaaacaattttttacaatgtttccgtatttttggtgtaatatcaaaatacttctatagtaaatcatttgggttaagccattttcttcttaaagaaggcgggggaggtggtctctggaatattcctatttatgacactagtctagcaactataaaaatatggatagataatggtatatgacagtggataactgtaaacttatccagacagtaacaccaattgctgttgctgcaccagctatgttattttttttttctgaagcagattaacacagccttcagtgtgagatataaagccatcaaaatgaaaatgcatttatttccagccatttcaaaaagaaaaatcagaatcagtttagatccacatggaacaaaaagaatacacttatagagttttaacttgagttctgttaactctcttgacccctattataatgcagtatagagacctgaaacattgacacagtatgtggaacgccacactggtccattatatcagcagttctgcaaatgtggtctttgaatcttgaaggtccctgaaacactttcaagagattaatgaggtcaaaattatttttatacgcattgtgttaacatttgcactgatgaagcaaaacaatgttgtataaaattgctggatctttagcatgaaacaagtagcacctaactatacttgttattaatgccttgttcgttgctatgaattacagtttttaaacaaagctttaaaatgtccttgatgaagcagtaaaaattttattaaatatttactcttgagtacaattttttagtattgtttgtggtgaaatggggaatatgcataaagcaattgtgctgcataacaaactgtgatacttgtttaaagaaaaacacttgtgtgattgagaacaaaatcagccactttgttcatggaacaccttcaaaggtactgatggtaaaattatggttattcagacttgggtatcttggggtagttggcagatattttcttaaaaatggaaggagtttttcagtttgatggaaaacaactgacagtatttgttcccaatgataaaattcaatgttccaagtgaaaattaggaatttagaaactttttgtatttactagtcttagcttgaaatcaacaagtatgatttttgatattgtataataatctgtgtcaatatttgaaagcctgcataacagaactgatattattttcaaatgattaattcatggtattaaaaatcactcatagttaagaaatccattcaaagttcaagacatacctgtagattttaatgcaaaagagtacaaaaaattgattgatgtttctatatttcacattgcaagtaacctttaagaaactactacttgttgaattttgatataatgccaaagaataatatccaaaagtatttgaacagattattaacatatcactctttttcccaactacatatctgtgtgaggcttgattttcttcatagacttcaattaaaacaacatattgcggggaggagccaagatggccgaataggaacagctccggtctacagctcccagcctgagcgacgcagaagacgggtgatttctgcaattccatctgaggtaccgggttcatctcactagggagcgccagacagtgggcgcaggtcagtgggtgtgcgcacagtgcgcgagccgaagcagggcgaggcattgcctcactcgggaagcgcaaggggtcagggagttccctttcctaatcaaagaaaggggtgacggacggcacctggaaaatcgggaaaatcgggtcactcccacccgaatactgcgcttttccgacgggcttaaaaaacagcgcaccacgagattatatccgcacctggctcggagggtcctacgcccacggagtctcgctgattgctagcacagcagtctgagatcaaactgcaaggcggcagcgaggctgggggaggggcgcccgccattgcccaggcttgcttaggtaaacaaagcagcctggaagctccaactgggtggagcccaccacagctcaaggaggcctgcctgcctctgtaggctccacctctgggggcagggcacagacaaacaaaaagacagcagtaacctctgcagacttaaatgcccctgtctgacagctttgaagagagcagtggttctcccagtgcgcagccagagatctgagaacgggcagactgcctcctcaagtgggtccctcacccctgacccccgagcagtttaactgcgaggcaccctccagcaggggcacactgacacctcacactgcagggtactccaacagacctgcagctgagggtcctgtctgttagaaggaaaactaacaaacagaaaggacatccacaccaaaaactcatctgtacatcaccatcatcaaagaccaaaagtagataaaaccacaaagatggggaaaaaacagaacagaaaaactggaaactctaaaaatcagagcgcctctcctcctccaaaggaacgcagctcctcaccagcaacggaacaaagctggacagagaatgactttgacgagctgagagaagaaggcttcagatgatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaatgcagaaggctcaggagccgatgtgatcaactggaagaaagggtatcagcaatggaagatgaaatgaatgaaatgaagggagaaggaaagtttagagaaaaaagaataaaaagaaatgagcaaagcctccaagaactacgggactatgtgaaaagaccaaatctacgtctgactggtgtacctgaaagtgatggggagaatggaaccaagttggaaaacactctgcaggatattatccaggagaatttccccaatctagcaaggcaggccaacgttcagattcaggaaatacagagaacgccacaaagatactcctcgagaagagcaactccaagacacataattgtcagattcaccaaagatgaaatgaaggaaaaaatgttaagggcagccagagagaaaggtcgggttcccctcaaagggaagcccatcagactaacagcggatctctcggcagaaaccctacaagccagaagagagtgggggccaatattcaacattcttaaagaaaagaattttcaacccagaatttcatatgcagccaaactaagcttcaaaagtgaaggagaaataaaatactttacagacaagcaaatgctgagagattttgtcaccaccaggcctgccctaaaagagctcctgaaggaagcgctaaacatggaaaggaacaaccggtaccagccgctgcaaaatcatgccaaaatgtaaagaccgtcgagactaggaagaaactgcatcaactaacgagcaaaatcaccagctaacatcataatgacagcatcaaattcacacataacactattaactttaaatgtaaatggactaaatgctccaattaaaagacacagactggcaaattggataaagagtcaagacccatcagtgtgctgtattcaggaaacccatctcacgtgcagagacacacatgggctcaaaataaaaggatggaggaagatctaccaagcaaatggaaaacaaaaaaaggcaggggttgcaatcctagtctctgataaaacagacttgaaaccaacaaagatcaaaagacacaaagaaggccattacataatggtaaagggatcaattcaacaagaagagctaactatcctaaatatatatgcacccaatacaggagcacccagattcataaagcaagtcctgagtgacctacaaagagacttagactcccacacattaataatgggagactttaacaccccactgtcaacattagacagatcaacgggacagaaagtcaacaaggatacccaggaattgaactcagctctgcaccaagcggacctaatagacatctacagaagtctccaccccaaatcaacagaatatacatttttttcagcaccacaccacacctattccaaaattgaccacatacttggaagtaaagctctcctcagcaaatgtaaaagaacagaaattataacaaactgtctctcagaccacagtgcaatcaaactagaactcaggattaagaatttcactcaaaaccgctcaactacatggaaactgaacaacctgctcctgaatgactgttgggtacataacgaaatgaaggcagaaataaagatgttctttgaaaccaacgagaacaaagacacaacataccagaatctctgggatgcattcaaagcagtgtgtagagggaaatttatagcactaaatacccacaagagaaagcaggaaagatccaaaactgacaccctaacatcacaattaaaagaactagaaaagcaagagcaaacacattccaaagctagcagaaggcaagaaataactaaaatcagagcagaactgaaggaaatagagacacaaaaaacccttcaaaaaattaatgaatccaggagctggttttttgaaaggatcaacaaaattgatagaccgctagcaagactaataaagaaaaaaagagagaagaatcaaatagacgcaataaaaaatgataaaggggatatcaccaccgatcccacagaaatacaaactaccatcagagaatactacaaacacctctacgcaaataaactagaaaatctagaagaaatggataaattccttgacacatacactctcccaagactaaaccaggaagaagttgaatctctgaatagaccaataacaggatctgaaattgtggcaataatcaatagcttaccaaccaaaaagagtccaggaccagatggattcacagccgaattctaccagaggtacaaggaggaattggtaccattccttctgaaactattccaatcaatagaaaaagagggaatcctccctaactcatttgatgaggccagcatcattctgatatcaaagccgggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatggaaggcaggttcaatatatgcaaatcaataaatgtaatccagcatataaacagagccaaagacaaaaaccacatgattatctcaatagatgcagaaaaggcctttgacaaaattcaacaacccttcatgctaaaaactctcaataaattaggtattgatgggacatatttcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaggggtattcaattaggaaaagaggaagtcaaattgtccccgtttgcagacgacatgattgtatatctagaaaaccccactgtctcagcccaaaatctccttaagctgataagcaacttcagcaaagtctcaggatacaaaatcaatgtgcaaaaatcacaagcattcctatacaccaaccacagacaaacagagagccaaatcatgagtgaactcccattcacaattgcttcaaagagaataaaagacctaggaatccaacttacaagggatgtgaaggacctcttcaaggacaactacaaaccactgctcaaggaaataaaagaggatacacacaaatggaagaacattccatgctcatgggtaggaagaatcaatattgtgaaaatggccatactgcccaaggtaatttacagattcaatgccatccccatcaagctaccaatgcctttcttcacagaattggaaaaaactactttaaagttcatatggaaccaaaaaagagcccgcatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataatgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagacttaaatgttagacctaaaaccataaaaactctagaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctatagaatgggagaaaattttcgcaacctactcatctgacaaagggctaatatccagaatttacaatgaactcaaacaaatttacaagaaaaaaacaaacaaccccatcgaaaagtgggcgaaggacatcaacagacacttctcaaaagaagacatttatgcagccaaaagacacatgaaaaaatgctcaccatcactggccatcagagaaatgctaatcaaaaccacaatgagataccatctcacaccagttagaatggcaatcattaaaaagtcaggaaacaacaggtgctggagaggatgtggagaaataggaacacttttacactgttggtgggactgtaaactagttcacccattgtggaagtcagtgtggcgattcctcagggatctagaactagaaataccatttgacccagccatcccattactgggtatatacccaaaggactataaatcatgctgctaataaagcacatgcacacgtatgtttattgcggcattattcacaatagcaaagacttggaaccaacccaaatgtcccacaatgatagactggattaagaaaatgtggcacatatacaccatggaatactatgcagccataaaaaatgatgcgttcatgtcctttgtagggacttggatgaaattggaaaccatcattctcagtaaactgtcgcaagaacaaaaaaccaaacactgcatatgctcactcataggtgggaattgaacaatgagatcacatggacacaggaaggggaacatcacactctggggactgttgtggggtgaggggaggggggagggatagcattaggagatatacctaatgctagatgacgagttagtgggtgcagcacaccagcgtggcacatgtatacgtatgtaactaacctgcacaatgtgcacatgtaccctaaaacttaaagtataataataaaaaaaaatattgcaataaatggaatgtagaagcagatatgagaatccagctgtcttctattagaccagacattacagagatttataaaaagcaatacagtgccactcttcttactaaatttttgttttttaaatatagttatttaaaaatatatttatagtaacatgtaataggtttattaagacttttaaatgaatacatattttaataatttctcagccttaatgttttatatggtaacaatagatgtacctcacataagcaaaagttctttaggattttcaataatttttaagagtatgaagggatcctgagactaaaagtttgagaaccagtgtactctttggctaattgggctagatgagcaataaatgatatgtaggctgtagatcttataagataatgacttgccagggtgtgaaagataaatcctctaaagagtcaattcatctttgtattatgcatccagtggtctatagtatgtcaggacatgttctccaaaataaaagataaagtattgtattttatacttacagcactaagaaaaagtgcaatgttggtaccttgtccccattcctataagttcatccacaagcatcttctttggaacactttgttaagatctacaggtccatttgtattctcaccttgggctactctctatacaaaggataactgggcaggctcccagagctctgctcattgggaatttctcctttccactaccccaaaagcagcactgctggaatagcagcccttttttagaagcacactaacaaagcaagataaactattcaagaactctcattaaagcttttccttctctgacatttggtcctaagagtcataggtgggagctgagggggaggcgggggtccagcagtggtgggaacaacagacactcatgcagctttcctcgctctctggccctacatgtctgatccaggtgttctatctacttctatcttacaatgaattctgagcttatgacttggttggtctaacaaaactcagcatatggtgggccctgtgatttcattatggtcacttgctatggtcagatgatccatatttatagagtccaagtagcacgtccagagcttgttctcagttgacatatagttttctgctgccaatgccatagccttgctccacagccttagactacattgtgattctcttattgaagtgtgtcatcaactccacaaagcatcttttccacatatatatatgtaccgcatatgcggtacatatatgtactatatagtacatatatatatgtgtacatatatagtacatatatatagtacatatatgtggtacatatatatatatagtcctgtagggtctgtcctataacttaagttacagggctgcttgcatttcagattgacctataatagaatcattttatggtctgcatctgacacaaagctataagcctctgttattagataaagtagttagagccatactcacaagtgcaggtcatactgcctaccaactttgccctttctgtttgcataaccttattaaataaacctaatgatgacatgataggaaaaataattcatgaccattctcatgaacatagatgcaaaattttaaatgtaatattaataaataaaatccagtgttgtataacaagataatacaacattccaagttagatttatttaaggaatacacggttgctttaaaatttaaaaattcagcagccaggaaaggtggctcatgccagtaatcacagcactttgggaggatgaggcgggcggatgacttgagcccaggagtttgagaccattctggaaaacatggcaaatccctgtccctacaaaaaatacaaaacttagccagacatgatggcacatgccagtggtcccagccgcttgggaagctgaggtgggagaatctcttgagcccaggaggcagaggctgcagtaagccagtatcacatcactgcacttcagcctgggcaacagagtgataccctgtctcagaaaaaaaattaagcaatgtaattctccacattcacaggataaagaataaaaagtatgattctctcaatagatgaaaaacaataattttataaaaatcaacatgtatttataacaaaacatagtaaatttgaaataaagaagaaatctttaacctgaaaaggtgtatccataaaagtatacaaggaacattagagaaatggtgaactattgaaatctcccccacagcctccaatatcaagaacaagacaccaacgtccattttcaccccatgtattcagccttgcactggagactttaaacagagaaataagaaaaaaaaaaaaaaaagaaaaggattaagggtaaaaaaagaaggaatgaaccatcatcatttattgatggcatgatatttatttaaagtccaacagtctatagatacagtattagaattgataagtgattttagaaagctgtgtattttggtacaacaaaaacaattagagagtaaaagttagaaaatatattttttagaatagcactgttaaacaccaaatatctaggcataagacagctacatagaaagttataaaccattataagaaactaaaatgaaaaaaatggaaagctataccatgttcaccatttagaagactcagactgtaaaaatgccaattgtccctaaactgatcaatgtaattttattcaaaatccctgtggtatttatttatttatttattttagaggggagacattaacaaactgattaacaaaacattaattaggaaactgtagtactggcgtaaggactgatgaatcgacccatagggtagaacaggtgtcagcaaactgtggctttgtgccagatctggcctgctgcctgtttttgttggagcagagccatgcccatttatttaggtattgtttttggctgtttctgtggtacagtggcagggatgagtaggtatgacagagagtatatgacccaaagcttaaaatatctactatctgacactacagaaaaagccttctgacccctactgtggaatacagtgttcagaaataaataaactcataaacagaaacttgggattaagattatgttaccactgagtagtgggtgtaggagtcttttcaataaatactgctgggtcagttggataatgatatgaaaaaagaaattattcttgatctaaatttaaaccatgcacaaaaatcaattccatcttaatgttaaagttaagccaataaagcttctcaaaaataatatagcagatgttcaaaattatttttaaaaactacagataaaaagcaataagaaaaaagtaataaatggatacattggactttaataaaattaagacattctgatgtttaagactttgtaaactataggcaaggcacacagtgaaagaatatatttgcaacccatagagaacaaaagattctagttccttcaaatataaattatatataataccagttaaaaaataggcaaaagacttgggcagatatttcacaaaagaaaatgtccaaatgatctggtcacataaaatgatgtttcacatcattagtcatcattaaaatgcatatttacagaacaataaattaggatgcctaaattaaaaagactcatcattcaaagtgttggagaagatgtagagcagtgatagcccttgtgcactgctgatcatagcgcaaatcagtacaatcacttttagtagcgtctactatagctgaacatgcacataccttatgacccagcaatttttattactcaatttatacccagaaaaatatataatcttcaatgataatgttcatagaagtacaattagtaatagcttcccactggaaaaagctgcgtactcataaaattaatactataaaataatgaaaatatggaatttaaaaggccagatgcaaatcaatatatgccatataattctactataaaatataaaaaccagaaacatttattcatggtgaaaaaggtcagcatattgagtagggcaagtgaactaggggtttctgtggtgttggccgtgttctatttattgatcagagagagtggttacataggtgtattgactatcaaaattcattgacggtacatataagacatgtacacttttctgcacatatgttgtagtttatgacagcgttcagtttcattaaaaggataacacatagagagggagtagggaatcggaggagatggggtgatattttagacagggaatcagagaaagcttctcttaagagagcatattttaacaatgacctgttttcagtgacctgaaagaagcaagtgagaagccatgcgaagccatggaaagtcatattaagatctgagataagaatattccaggcagagagaatatcaatgcaaaggctttgagatgatgtcatgcttgatgtgtttgatgagtatccgaaagcctacttgggcttgagtagagtgagaagagttgtcataaattagattggctgacacatattaaactattgagtgaatgacttatatgaagattcacatttctggtcttggcatgattatttcttgttatctgtccattaaatatacatgaaacattgtaaaatggttttcaaaaaacctgtctattagccttagaaaacaacagatttaataccagggtaatcactttacttagttcaagaactgaattccatttcactaaattttcaaagtctagagaaaatgttttgtccatcctacacaattcctaatgaaggaaaaagacagaaaccagcagttaatcaagacattagttaagttgagggaaaaatatgttgataaaagcataatctcttcatttactgatcatttatgggaaaagagctatacgcaaattttatatatgcatatgaaagttttggcgggcacagtggctcatgcctgtaatcccagcactttgggaggtcaaggccgacagatcacttgaggtcaggagtttaagaccagtctggccaacatggtgaaattgtctctactaaaaatacaaaaattagctaggcatggtggcatgcgcctataatcctggctacttgggaggctgaggcaggagaattgcttgaccccaggaggcagagtttgtactgagccaagattgcaccaccgcactccagcctgggtgacagagtgagactctgtctcaaaaaaaaaaaaaaaagaaagaatgtcagatttaagacccgacaccagcagcaatggaaaccgaacaatagaaaatcattctttcaaggacttatttctcttaaagatataattacctaggattgtccatgaagaatgagcaatgtcatttgcggtgatggaagctcattaccaggtggcaaaaaaacaataattatactttctacattttataagaacctagacatactacattttaaccctgtgatgttttcctttttaatttaaaaatagcagcatcagcaatcaccaccaagaataaaacaataacacacgcgagaacaagatacatattcaaagtcctgagacctcacagtttccctgagagttgcaagtgtcctgcaatgagacaatggacgcttctgcctagaaagagttgctgcagaagcaggagacactaaactttaaacaaaatcatagaactctttcaacctttcttctcgtattgagtctacgttaaagtgccataaatcttgttgacagttactgccacatctattggcacacagtcagcatctgtttgaaaagagttttgcagcataggtagggcccattacctgttctctgtcttctcttagtatttattttcaccccagcaggcagcacctcacaatgtcattaatttcttagtcagcctgtactttcccttacagccacttagagagtgctcttataaacagctctgtgcatcaccagaaatgcattgcacctctagaaggaaatcagaaatttaagagcagcaggtacaacgtgaactggttgctgaggtgatgtggtctctgttgctagatcagtggggggtcatcatggtgatttggttatatggttccgagggaatcagtgctgttggccaacacaatcttaagaaagtgagcgatggtagatgtgcaactgaagggaaagcagcaagaaaatacgatattccacgattcaccatgaagaagaaagcaacaaatgagtagacaagacagcaagaaattacctgcataaagaaggcattctaatcatcccaatacctgaaaagagtgaactgtactctagtcaactttcgttgggataaatattctaataggaattgcccctttcttcagaaaggatgattaaaaaacatcatcaatcaaagctggaccagaaaagcaatcagaacctaattcttcattagaacaggtttaaagatgtccagtcatgaggactctactactttaatcataatatggtttttttacaaaaattaaaaatttccataaactaaaatatggatcacatttatttttattcttctgtggggccaggactcatttctagaagggctactggtccacggttagaaaatggccccttcacctctgtggtaaatgtgggctatatgtttggatgtgcttcaaatattctagatgggtagctttgtgcatattttaaattttatagaaaaataatacaatcttacatttctatttaatcattgtttaaaatgtattgagctgtaaaaatcacacaaggaggtagaaaagtcagaaatgtttatgtctacttatataggttatgagacagacctggcaaagataattaggtcacagatttcttttttttttttttttaaccatacaacttattgtattcatgtgcttatagtctaggaaactaaaaactaaaacctgtgtgtaagaaactcagtagccttcaatgtctatgtcaaaagtctcccctattagcagctgctaagtggaaaagaaagctgaaggaaagcagcctgggtaagttgagaattctaataaaccaattggtatgatactaatttgctctttttttttccttgcccatggaatatgataactcatttttatcatgcacctttgggaagattgaaaaccaaaaaaatgaaagaaaagtcagtacagtattagaactaatgtcttcccacccaagctactgtgttctggtgcatgagtcaggtggagcggtgctacaaggtcaaccaagagagtgggttgttcaactactgtggcaggaatcaccatagaatggacattctcacctggaggaggacttgtaatgaaatctgaagaaaacattattctcaagagataatatgtagtggaaggaaagaaaattaagacagagaagaaggaattcccttctcctgtctatacattttcaacctcctttcctttgcgggaatggcataatgatttgtttcttagagaaccttgttttgttgtttcctatcagcttcctctgcaaaacaaaaacacccctgaacccgccttcctcttgaagtaatactttggttccctgattttctgattagggctttcaaaataatttgtgttcaagtatgtttttattccaggcttcattttgatatctacatgtccattattagcctgtccccattaaccaattaagtacacatgcaaacacacacatgcacacacacatacactctctattacaacacatatacacaagacatatctgagtactcactagtaaatactcatgtgtactaaagtctaccacaggggtttcaaatgtcagttgtgttttttagtttaattcaacttttatacctatagtaattcatttatttcatttttgattattttaaatgttttggataacagaatggctcttgaattgcaacggaagttaaatttcagtatctaccataaacagcacattcatttcattcctcaagaatgaaaacacctgttatagttcctttttgattgctgacttttaaatgaacatttggatgaaaagtaatgtttacaaagataacatatataaaatattcagaagacaaacagcagaaatgagaaacaaaaaaaagcaaacagaaatttaaaatagtttgtcttaacaaaacaattacaataaagaatttattaaaaacctttggaagaaactgtttccagtaatttaaaaataaacagaaaatatattaacaaataattgaaaataatatctaactgcacaaatgtataaaatatctaactcaaaatagcactgttaatatgtcagtatattttagttaacatacttttaaaatgagacacacagattacttcattgcatatctctgagagctcctcaaatcctacacacattttaaattgttaaatttgatacaattactgtctttttaaaatcaaaagagcattttcctacttttagactgagtaaaagatgcattgactccttgcttcccactagactcactagacattctgatactgcactcgtggtgagctggccagagtgaggttgtgaaaaaaagacaacaataccgaggacatttgggcaaaaaagtatttatcaccaagtataaaaatttttgtaaagccatcactgattaatacattatttcatttttgctcaattacttactagagaaatgtataagtagcattttcagttccttgcaagagaccatggttagcttatttcatggcaaaaacatgttaaaatatgaaatgacttctcaaacctattttatatggaagtcacatttttgtgcacatgactttttaattttgaaaagacgttttatcacaaattccatgaaactttctttcagtaaatctaaaaatggaatgttctatgatactagttgactttccatctcttactattcttctaacaggatactctgaaaatttgaatatcatagacttagtaagaaaatatgttttatgtagctttttgggttaagaagcattagtaggaaaacaagtcagtgtgctaagggctttaattatccgaagagacatacatttatatattcggtaaaataaaattatttaatgttcttcgttattcaatatttttgaaaatattgttatgtttgtgttttattcacagaaattcagttttacaaatagcagctgattttttattaaaccagagccaaattactaatttcagtattaatagttagctttgacatgtttaaaaagggtagaaagtacgtaatagacctgtcttcaactctgaaatgaacagctgctcagggaaatggaattgttcaaagatacattttctttctgccaatctgtgaaatataatataattattctcttttaatgaatctctcaacgaggagcaatctttcagagcttgagcaggtaaaatataatgataatgggaacagctttgtaaataaaaggatgaaatgagattgttattttgtgccatattatgggataattaaaataacagtgcagcattcagcaggtatttgaactttctaaaaaatgctccccagggctcttttaaattagtcatgtttatccatgtagatttgtaatcttactgcaaatgtctgtcaccttataatattcagacctcaatacttaatctgattaatatctgatactgtacaacagctaacaaaccttgccgaaagcagacattaaaataataacctgagttgacaaactcgaatttattaaaagaagaacaatagaactattttcattaagccaggagaatgattactctcagtgtggtgggactcatgaactacatgagattctatgtatttccacaaaacagagtggccgcacacttccaaggagctactattcacatgataattagctctatataataaaagagtatattcatggaaactaaactcatggcaatggaactccaatggctagttgctttgtttaattcaaattcatacagctcaaatacaagtagatgatgagatctgatttttcaagaaacaagttcctttgcagttcactggaccctcctagcacccttcttagaaaaagtgtgcaagcagaatcaagtgctagagtgtggccattatatcacatccattaaagttattagaaaacaaaatataaataaagaaggtaaaataaaagtctgatatctcttctggtataactttaaattgctagtgagatatcatttcacgaaatggtacaattgaagttttattctcaattaggttgtagtttttctcagttattattctctatctggaggaacaaggaaaatggtttttaatatcaataaataagtaactgtgacttctgtttcatactttctgtagctgatttcatgtctttttaatagttctttcatgcttataattttttaaaatcctccccaactgattgtcagatatcctgatgatagaaagaaattattgtaatttcctggggagctatctaccaccttagcttcaaatcattaccctcaaagggcaagatcgctatcaggctttatatttaggaaatttgtatggatagcctcatatctggaaactttatgtgtctactattagaaggtatactctacatgtgttatttaatcacttgagcgttatattatcaggcaatatttatttagtttggaaatctgttttatatgtctaccactgggtacgttaaattgacttaaagttaagatgcagctttactctaggtaggtgatctgccactattttcaatagacagaggactggacaactgtgccacagaaacaaataagatgataattttaccactgatatcagatatcaaggtctacagaacatacccattaaagcatttgtattttctaatcttctctgcaattgcaaaaatcaatagctagaaatatagaagggttttagaatagcatgtagaattttgaaaataaacaatgtattcttcctcagaagtcatataagattaacaatctgagccttaattaaaaatcctgagtaaacacattcatttcctttttcccttgcaactattaaattgatcaataaaccatatatttttcaaaatgcgactggtactaaaaactcatttttcttgtttccctacattcattaggtgatagagagttgctcattattctgccatccctgtgtacctttttggattttgcccattttcctaatttcaatttcttttcaggaatgaacaaattgatgatcaatggtgatgatttcatttatatattagaaaataccacttttctgtttaaatgattacttacctgttatattcaatttaaaatggctttgcagtcttaccaattctaccataaaaagttatagcattatacttcttgtcagattttgtttttaaaattatactgcacaccagattttttaaattttactgttgaacaaggggaaaggtggcaataatgatggtcatgaaaaggtaatttgtataccttcagaagacatatgagaatattctaaatattgtcatctagtggctcagttcctccaaaatattattcatatttctagtttgtgctttttaaatttctaggagctaccagtgtctgcagtttctacagtactatgacaaatagaaatttcattaatgcttctcgataatgcatgtgcttttataggatagccaaacaaaggataagagtacctggtcttatatattgaaaatttttttatttttacattttagaaatatgccttatattctctaactttttattactttttacaaacttcaaaattataacttaaaaaaaatcttagtgccatcacattaagatacccaggtatatgatgtaatcttaaatttaacagcaattttgatatttagtcttattaagcatatgctattatttgcattaccattgctaaaaaatttcaaaggaggcagtttaaaaacatagttgggagacatctacttaaaggttactagatagcaaatgtttggatctatctattttcaaccaatgaaaatatcatggtattagtgtatgcatatatttttgtgaaatgcaacatctcaaacgccatactatttttcaacagttttaacaaccaggtgtaataatgctgcatgaaatccttttcttgtttccaaatttaattgatttaatcactgaaattaaatgcttggaaattcttctgcttgccggtgtttgaacgccaaatacatcatctacagttctaaaatgaatattgcatttatatttagacaacttaaaacactgctttctaaattaccctaaataacccatagaaatgtctagaaaaattcataatagtggatgacaaatgtccattgccatcaaccttcaaataagaataacttttacaaggtatacaaagtgtacaattatctgggaaatataatgtaaagcacacatagattaatcttacttcttccagcactcaccaccagtgagctcttccaaaactcatctttaaagatgaagacatgggagctagaaatcatatttatcttcagaggcaaaagaaatttaagttttgccaagctttcacagacgtcagctcatttattctctttgatcaatttggtttgtattgctttgttttgcttttcttcataatttctgggagttaaaaaattaatagtaataaagtcacttgagtagagatactccttgacagccaatcagatacacagtctctcccaacagtgcatagagagatcaaatagggtgagatgaggatatgtttggtgcaaagtatatggaaaagcttattctgggggaaataatacatagtaaattttatccaagatgatgaagaataaaaacaatgtttacagtaaagtatttccacatggggctacttatctgagtttgtttgtttgttttttgtttttttggcctgaatttttccatgaaagatagtagctagcattaactaggcatttgctacgtactggcccctattctaagcttctaatctgggcttttctcattctcacagtcaccatatgaggaaggcgccattctttgtgcccattttagagataaggagattaaagtacaaggacatgaagttacttgcccaaagttgtccagataagcagcagagttggggtttgagccagctggaatctggtgcctgcaccaagaaccacgaacactatgccgccttcgtggaatgtgtaggagtgattaagcttaagtatttccacatggggctatgcaaacactatcaaggtggtgaaaactgcagcagctgagtgtagttttctaaactttagtctttctggcttcaccttcacaattttggcaacatctaagtatcttctaaattatcacttaggtaggatgttttactctatttttacttgaattaatttttaaaagaaaattttgattaacattataaatgatagtaaaaaattcagcatttcttaccacaaagagaagacaactgtaatagtaaatataaaaccattaaacttttaaaacattcatccatgtacccactaacccatctcattttccatcagtggagtccttgctgggttttgggaaattctgcccgaagaaaagagtatcattgttaaatgtgaatgaaatcactgaaaactgtctggacaatataatatgttaattagtttttaaataaacttttgcatgatgggtacctggacagttgtatccatatgcagggtagacagtcacctattaatgaggtttcaagcagaaagtccagctgctcccttagcttctggcaaatgtttgaaactccataatttgaatataattactttcgctcagtggttatcaaactttttaaagcagtcaacaacttcattttaaacaaagcaacattttataaaccagtaagtaaaagagaaaattgaaattttatttgtgcaaatccattttagaagttctaattgctaacactctcaacacaatcaatcagtgagaggccgggggcagtggctcacacctgtaatctcagcactttgggaggccgaggatggtgaatgatgcggtcaggagatagagaccatcctggctaacacggtgaaatacccctctactaaaaatacaaaaacaaaattagccggacatggtggcgggtgcctgcagtcccagctactctggaggctgaggcaggagaatggcgtgaacccgggaggtggagcttgcagtgagccgagatcccaccactgcaatccagcctgggcaacagagtgagactccgtcttaaaaaaaaaaaaaaaaaaaaaatcaatctgtgagaataatggatctattttgaggaagacaattgcaatgcgatagtatcttatttttcatagatttctgcattttgttttggttttgtggtattggcaatatcctgatacagacatatatatataatcaaatagtatgaatgtgttgcttctcagccatgttgaaccattctgtctccactaccaaaaactggaatagacttggatcttcaaagctaaatcaattagagtaactaaaatggttcatattccttgagaggtcctcactcttggttaaaaaatacctttcaaaagtgtctttttaacagaatttttcactttcaacaaaacaaattcatgacataatgatacttgctgtatcattgaattgaattgaattgcaaagcttcaattagtcaaatatattttattctgtgtacatacctgaaaagctccaatttcattgctggctgcttacacgcagttgtgagcatgtttaaaatcttctctgataaaagtgtgcttgatatataagccagtacaaaattattattaatatttgggggagttaattaactgatacaatttctttatgaggaaaaatacatcttatggtggtctgcattttcatttaggtatcatcactttgttttcatgtccactgattgccatatgttgtttggtgcttgtgccatgcaaaagtacctgaatttgctggccttttaattgcatgtggttcccatgcactgtggtggtatttgcacaatattgtggcccatttgcacaatatttctcatgagatatgcaaagacatatttttaaatgtccattgcagatctatagactttccagtcaatgccacagttatttatttctttatatgtatatacatatgtgtgtgtgtgtgtgtgtgtgtgtgtgtgtgtgcgcgcgcgtgtatgtgggtatgtataactatctatatatgcatctacctatatagaaagaaaaaagaggaggaagagaaggaggagaagttgtttttgtctggtaacacaagttaatgatttgagaactgttaatatgacaaatatatttttattatagtttttttattgtccgcaaatctggcaatgaattttttttttttacatttattacagaactgcagaggaattgcagttataactcaatggaacacagtttgaaaaataacattttagctgaaggtctttatatcttttaaaatgcaaaaacctctactttcatctgcaatcagtcatttgtacattaatgtgaatgaatttattagacatctttctgagtttaattcagaagagggggaggaaaagatgaactcagctactgaaagacatgggaaaggtcgaatattaacgctaggagaactgaagactaatttggcctagtttacagttttgcttcaagactatgccatctatatataatacatttatttgtatttataaacacatatgcacacaaagaaaatgtctactgcattagttgagtgtgagtgtgattatgtttcagaattgcatccaactattttagaatattttgctggaataatgtaattacatgaattactcacaattttgtcaactctaaagtaagtcaacagtaaaatttccaaccaatgaacttattgaagatattctgattttattatgtgagtgtcttcaaagattgcaagcaaataaattatgcagaagtcccagattatgtacagcttaatataaataaggacttaatgctccaaacctgatctcatacctttggactatgatatttctttaaattaaaataaaagagtaaactttaaattaaaataaaagggtaaacttaaaacaaattaaatccttttattaaataaaataattacctttattacatgaatttagttacatgtgtcccccattttctccccctccaaaagaaactatctaaagtttatgaaagcaagtatctatttcaacagtgtaaaaatttagttgaaacttctgataattttttacagaggcatatgagaaacagtgttagttaatattttaagaaagaacaagaagaaaattacgttaagtttttcatttcatttcatgtattttctaacagtgaaagttattaatttgactgtaggttaaaaacgtgttggactagagccatattggccatattcattctaaagtcagtgcttataatgattttgtgtgaatttgaaatatatataaatttgaaatactcacatttaatactattgctgctttgttgtgtttttgttttgttttgttttgttttttttaagagacagagtccttgctccattgtccaggctgaggtgcagtggcgcaatcatagctcactgtagtcttgaactcctgaggtcaagggattgtccctcctcagccttctgagtagttgggactgtaggcctgtgccacccaccaggtgctattcccacttcctcctttcccagtatgttgcctaggctgggcttgaactccctgcttcaagtgatcctcctgccttggcctcccaaagtgtgaggattgcatgtgtgagccaccatgcctgccctattgctgtttttatgtcaagaaattgaaaacaaaatcaagtaatagaaatattactatttaggaaagggataaatgtaactatctcagtagtaaattttgtttttggctattaagtataacattgaagaattagcagaataaatatgaaatcaaaacttagaagcattttgagatacttttggtattctgttgcaaagtatctcaaagtgaaaacaatagtgaaatcatcactaaaaagaaaagactaatatataacaggtttttaaaaaatattcagctcaaaaggtcattcttggttctgagattatatttatcctgaaataatactaaatcaaaactataagctagtcagttaagtcagggaacagaattgagcctaacatacttctgtttttgctcatagaatgacctttgaaacctctctgagctctgctgttttttaactatttcccatctgtgtacagagaaaaatgtattactaagtcacaaggcctatatattcccacttcctcatttcccagaatttatgggaaattggttctaatagttccacagtagaaagcaagaagacagaaaggaaagagagcgcttttccaacagttacaggcactgacagcctatgacaatatttgagtctggtttgtttgtagtttcttccaaatgtgtgttcctgaaaaaaaatcatacgaaggagggtgagtgagcccaggtaaatgacatgtatgcagcagctccagagcgagtgtacagacatgtgtttgggtggagcacagtgctgtatctaagagatgttcaacaacccagtgggtgaatgtagttggcagctgagccattgagaatcaatttgtataagtatcgggaatgtgtagatgcaaaagacatatcaagtattgagatgtagtgaccaaacagaaaacttaacctggaaattattttgtatatattatttagtgaaaatatttttaaggaaggaagcaaggagtacatacgtagtacctaataatacaggctatacaattacaaaagggttttttaagcttggttttagtatggtccttaagctaattgcaatacttagaatttttcactaccctttttagaaatctactaattttacatttaaatgaatatttaaatacaaatataaattaatttcaataacttctagaaactaataattatatttattttcctcctctaattcatatagcacgaacctcattttttctatatatttctccttcaaaatattattttcctccatattttcatacagttatattttgagtatgtaattttttaattgatttgttataaacatgcttgtactaatacaattctccaagattacttacacattttaagggcatcaaaaccacctgtcattggcaggttgtgataagcatttctttcaagagaatacctaacactttctccatcaatcttttccactttcatggtaccaaattttatataaaagaagtcactgcttgttactgaaacttgaaccaggtactcaaagacaccaaaacataaagctattgcccaccaccataaagcccaccaaccatcttctcactttattctatttcattttttagtaatttatttatattagtccattaacactgaaatctcttcatattttgtccttgctacactgagctgagacaacatgttttgatttctcaatgtcatcagtagtattaggtaaattctagaaggtaaaaatgatattatagaattacatacataaactattgggacatgattagttatcagaatatcacattgatatctctagtttataaaatctctaagaattaggtatcatgtcccaatgagaactatattacaatagagttgaaaattctgacccatagttagtctagtctactttttttaggtctttgctttctgtttcccaggtctcctacttgttgttactaactttctggaaaaattcagcagacaaccaaaatttatcatgggatatttaaacattctgttatatatggtacttagaacaacagctctgtaaaatagcttcaatctcatagcctgaccaaagcagaaaaagaacaaaatctcttataacacaaccttagaaaagccttaactacgtccttattccagcaactcaaatgtcctatttaagacaatcacgtttcagaagagcttaatatacaatatcttctattttattatccatgaaataccccaaatgtattttattttctgtgggaagagctatatacgaagaagaataacgaaaaatgtagccaatttatacttgagttagaatctattgtgatataagttaatcacacatgggtatcccataatatgaaaaatacaactgtaaaaatatataaattattatagtgcaacggaagactctttacttttaaagaagcctttgaaaacaggttaacaagcaatttaacaactaattgttagaaaactgaccttgacttgcaaacttcaactctttggcatctgtgacggtggtccttttgtcagacccttttttctctattcgtcgatggcttcgtcttttcttagactctccccaaagattggatcctccatgcatgcttggtatattcaaaatagcaattccttccagagagatgtttattaaatctatctgtactccatcacactgatcggtaaaaagaaagaaacagaaacggaatattttatctttatttccctgatttcttgtttttcatttcctcatcttttaataagtgcgttgaaatccataatgttgtcatttccaaacaagcctttcaagaacacttaaacacttaccctgagtcaatataaaagataaagcagcccctaacattaaccagttatctctagaagtccttaaaaatgatcaaattaaatcaccagtatatctttgtttgtagaaaacctttgggagagactcgttagcatctgcatatatatttaaccagctgcaaatttccaatgtgttacaaaaaggttaattctggaaactatggtcaaattttaggaagaaattgtgatgattgcccctgtttagaacacactgcaaggtactattgggggaaagtacagaaagcagattgatgcctcatggtctcacacctttggggcagagaaagaagtagcttaaaagacttttgctaaaaaaaaaaaaagtaaaattcaaagcagagattctaagagatttcaatcacactgaatttaccaagggtggtttcttggactagatgaagtcctaaggagatgtcaaaggccatgagaggcacagttgtccaaatgaatatggagggccgggtagattgattgagggaaatagtagcagtcaaaagaccttcaatccagcatgactttatagctgctgcaaaaatggttaaaaaaaaaccaaggttaatcagcccaatttttcttattttcctggtgacaaaacaccctggtgattatgaaaaatataaaattcactaacaaacaatgttttgttatattcagagtggtcacttcttagttttttgaattttccattcatttccactactggacatatgtggacagtgacaagactattctgtatttttaaaattactatttatttattcatttgccttgacttctttaaaatgctagttattattatacattctagaaattattatcccattttcaattataagtgaatatgaaaagagatataagcgctttgtttttaaaagaactttgtgagggatatgcatttcctaaattgaaatatatttacagtggcgttgtttcatttgccatgtcttagtacagaaaaaattattgacactaacttcatcatttctcatggcagtcatgatttttgaactcagaagacacagtgttccatgaaaatgatgaaaaacaaacaaaacaaaacaaaaaaaagccctctctttttccacattcgcctcatcatactgaagctaggattgcatcttgttcactgaaaaataaaaactgtgaaataaagaaacacatcttgagactacttggcaggggtagaaacaaattctagagaaagtgccaagttttcatttaatttgtttcaatgagggcgaaaccaagatctggatgatgcttttttttttttttttttttttccagaaagcagtgcttttttcctccttttctggtactaaattaagatgatttctttttactaaagaattctggtcatgtgtatactcacttaccgctatatattctagataaacagatattaatttcataattaaaagtaatcttgtgtaaataccctgcaggcctcaatgaatcaaacacatactgtgtgtcaggcctcccactgtcttcaagtggaatgtactggctggataattagatagtacatattttttaaccttatttgcatgcatattatatcttttgcacactgacaagcagcagtaacaacaaaagtcagattaccacagggaattcccacaaagaagtcttcattccttataatttgcagcctaaattaaaataatttgatctttgacaaggatgaaatgtcaagcagaagggggtcctctacaagccacggcctgtggcttctgaaatctgcctaatttatgtcagtcacttcttaatacatatttaagtattacacgaaaaagatgataaatatgcaatctgacacctttggtatttccctgctgttaatttataaaggtctggcttcccccaaactgactaaaatcatttaaataacagaagaatcatgaaataagctggagtcagggcctggcttccattttcactcaatattgaacacagcaggtagtacactaagacaattatttgactaggccttagaaccccactgtgacaagttactttcagaattagtgaaggaggattcctttgttcatctgcagaaaaggagagcatgttgcaaagaggcttcttttttttttaaaaaaaagaattgaaccagctgagttacatgtgacaattgaaaaacatgagtgtatgctattattcatgttttcactcttcagagttttgtcatgtgtagttttagggaaacagagtaagtagctctctgagaagtgaaaaaaaattctcaaacagtcgcaaagaacaaggactgatgaagaacattgatgttcctttgagagcaggacaatgtacttaaataaattgctatttattaatgatttgtttccacttgttcttgaccctaggctaccttcctctgtttgctttaacgttatgttcattagtctggaaaatttcagtgctggttctgatggagaccagtaattgtagcacaccagttgagtgcatgaaagtaaaagctgaggtgaaggctatgaaatataaacaagttatagtactgtgtcagataatattttcattccctttgagatttatgacttttaaaaaggtagctacagaggaaaagaatataaaagcttaaaagctaacagcctcagttagtcaataaatcctgaatatttttattaggtagaaaaaaggtcgttaacatatagtactatgggagctatttatagagtgcaaggctgtgatgccattgtctgctcttttcagttttaaaatagaggatcttattccagagacaaatataattaaaagaaaagaagacggtttcaatttttctgccaatgtgttttaaccttcataaataaatgagtcctgggtcacaccgtacagaggtgttaaaaacaagctttatatgtgactttagtgtttcagatccacttaacatgtcagttgataggactattcaaaacatgtgaagaactttggagagctctaagtgtggatggtaaatgtgatgagatacaattaatgataaactgtaatttttttccatagtaggtctgattctatgtctatatcagataagaattatttctatttttactcaatgaaacgtaaaacattactttataggtaatttcagtattaggacacatggggcagagactatgcttgggaactctggctattgcctctaagaactctgttttccaggttactgagcaataagaatattgtcttttgaatcctgctaatttattttgtgtttttgatgctagtcatgccattcattaattcttgagatcatttaggtttctaggggtatttaatcattacaataaatcagtactttgggatggaaattcttggctttaaaatttaccatctttcccagtatccctgtcaaccaaaagactgaaatatctatagaataggctttcttattctctcattaactttgcctggtactctgagcaaactgaacattcatgaactctgtatcttcaattccaaatgctgacctgagtttcttaggcacacatttcacccctccaaatactttaatataaacattggttttaaaatattttcttgtaattttaaagaatttatttttatcttttgtaataaagttagaagataaatgaatatctttaaaaaattctacttcgtgtatcattaaatctttacatgtatgtgtaaatacatatatttttcaatcaatttgctcattagatttaaacattgtggcagcaacataattcttatttctcttaaattactgaagaaaatgtttatctctgcaatggagatataacagtatcataaggttttgataaagactaaatcaaataatatatgtgcattgtttagcatcacctgtgagacagttaataataggtaaatcttaactattattccatgatattcatatcaacccaaatatttgccctcttttgaaggtgctcactatgtgaaagagaaatattaaataaaaagacacacaaaagatagtttgattttgaaaaagctgccaataaaacatgtatctattgctggaggttctgtttttactgaagtagtttattctgttatatatttttcaaaccatagtaggtataattttaggacaaataggaagcaacaacaaacagaatcaaattttcgaatttctgtttttgttatatttaattataaaataaccttgagggtagaaaggcatattctgctaatatgatagacaggattcattaaaaagtgagcagagaagcagattttgcctagctatccacacacacacacacacacacacacacacacacacacacacaacaagatatgcaaaaatacaagggggcatgcacacagtgctggctgtgatttataaatattattttaatagctcccaaaataagccagggatgcagagctagaaggtcaggctgagagagtaagcagaaacagcactccaagaaacataacttagttctagtagcccagatttcttggagaacattctaaatagtttttctgtcagatctcaagctctgtggatcaaaaccacttaattttatcattatttagcatattacaaatcaccgttttcaaatatattttcattcaaaatcttttgctgtaaacacaacacttttcttaaagattttttttttgtactttgtgacacatagaatcttattttatagatcaacagcttttaaatctgtgctcaagggtaggataaagtaaagggaggtgcaggaggattcaggatctccacctacattcaaccaaagccatacttctaatttttctaaaacttttcagcttctgctgcaaattgtatttgagcataatttttgaggataagaaatattcaaaatctagtatataaagcagtttttttaaaaaaataatgattctaagagtaaaggggtatgtatatgttttattgaatatatatgcacataaatatgtatatgtatataacaatacatatgacacatatataaccatatatactatatatttaactatatatgtagttatatatgtcatatattattatatataatatatataactaaatatataactaaatgtagttacagatgtcatatattattatatacaataatatataactaaatatataactgtagtacatatacaattattatatagatatacatgcatatagttatatatgtgttatatatatcattttatatacagttatttgtgtgcatatatcatacatatacacagatatatcatcctaaatagtaataacagaaagtccacgttgaacccaaatccttcacctctgtaattatgttcctttcaaaggttatgatctgatcctgttatgaagggttttttcccattccatgaccatcaattctaatacttaattatatttaccaatcatgatgagataaaagtgctaaaaggttacactgagagtagtatcattttttggtattattaataacagcaaattagaaatttaggataatgaagaacttagccaggccattgtgtggtccataactacttctgtttaccaaacttattacctgaatataaggaactaatgatttaggtatcagtagcaaatttttgcatttatttttaaaatgaaaagtgttgaagccaatgtttcttaattcatatcaactagtcattaagtgttcatgtttcataattctgttcctctggttttgtctttatcatttgtcaaaatataacttttcttttttctttaacccctaaaaatctctcaatataacgaagtcattttcttttataatatttctccaaaattttgagtcctacagtgtcttttttttttacagacctatttgctccaagtctttttaaaatgtgtcttttcttgctatctttgctctctttcttggcatttccactttctataaatgtaatggggaaatggcaaccttgggaactgagaaaacctagttaatgaatgggaatggaatggaaaagtatactttttaacctttattcataaaagtaagtacaattttagcaaagtgtgttttaaaggttacaagatattgagacccgaaaataatattttttatgtattctgcaacttttttcttcccaactacttttatcttacctttctatctgcactatgcccagtaacaactgcatcaatttccaaagttgtgttccacttctcattcttttatactataataaaataacccatatctacacttaactttagtatgtcagatagtgctgtattccaaatgagtgaaaggaatgacaatttaaaatcttgagtaagtctctgtggattgctaatatatatttcattccatgggctccaatgcaaatatactaacaacaaagctcaagccatttcatcatattacaaaagagaattcatttttttcttacttctatttctacagattcatgtagcttcttgcaggtggctgagaaagtttcagatgtgccaaactcaaaataccaaaatttgttcttcattctgaaaaagaaaaggaagaagcaccttaggcaattatcaataacagagggatcttttaaaaaatggtctaactctgtcttgtgttataatagaaaaggtctgaggacatgtgacatctaaaatgtaatagatggtcatataattttcaaagcttaaatgtgggtgccaaactgtatgatggccttgagggaattataagaatgtgttgatctagcagactcaagtacacctttagttttttgtgggttcatcacattttaaaaaacggttttaatgctcatgattcttagcttgttcttaggcaaaaagtgaagaatgtacaatagtgggaaattatgatacagcataaagttttttagttctttcaagaattaactaataatatagaataaaataactaagaaagtaataacaatattatatcaataaaagttgcaaagaaatataattaaaataatttcagtatttaatcttaaagtaaaagactcaaaatttattttcttctatgacttgatatttttggctttttgtaccaggtaattaaatttattatcacttaatgtaactttacaaaggtcaaatagatttttatattatctagtattggatttgaaattttattcttgtgaaaaaaatgcagtatttgattatgcataattctaatagtgatcatgccctcaattagaagacaatacatgtaagtgacagacattttcacacatagaaatgaaacaaagaagtttttgttatggtattcgagtatgtctctcatatcaaattaaagtattctgtttgacttataaatattgatatctgcttcttacattagaatgtaaaacattttgacaattaaaaagacatttggcaaaggccttactacttaattcaagcctattattggtttggaaaatgacattaaacctaatagagtgcttattattatgctatgttaaatccaatagagtgcttattattatgcagagttctctgatataaaattataaaatacaaagcaatgttatattatctatctaaacatagtcaataatgtttaggctctcacaaggttttatttgcttaaaaaattcacaatcccttcatgaatcagtcatattcaggccagtaatctgaaggtcagtataagtttcataggattctagcaccatgaatctttattcttttccagagaatatttgacttagtttatggcctgatttcatatatgtgagcagatataaacagatgatagtgaagtaggttagaggtaaacatttaatgacaagatttgtgggcctgtatctacagatgtgtctatattaaattaatgtaaatgtctattttatagaatggttaggcttttataaatttacacactgaagtcatgtaaaattaaaatattttgctattgagatttatcattctgatgaaaaacatatcattctacagatggagagaaaaatattggtttatacaaagaggtctgaagacattcttaatgaatattttatgactattggaatagtctttctatattcagcaactttctaataacatttttgtgttattcttttctccagaccttccaggattgattcattcattcaacaaaagtttaatgagaacactctctctgttaagtactatagacacaaatataaatgcaattacctttgtccccaagaagctcagaatgttataaacttatgggcatatcagtttgttaagggaggcaggaaggtaatggagggagtatgcctggacatgtgaggcccactgggatcttggttattatggcccttatctgccaggactgagtctcttccctacactgtctcaaaaccacaattagatatcacctcctttttgttaggatggctattttcaaaatacctcagataacaagcactggcaagggtgtggacaaaagggaacatttgtatactgttagtgagaaaataaatttgtacagccgttatggaaaacagtactaagtttcctcaaaaaattaaaaaatagaacaaccatgtgatccagcaatctctcttctgtatatataccccaaagaaatgaaatcaatacctcaaagaggtattgttggaccttatgctaagtgaaggaagccagaacagaaagacaaatcttgcatgatctcacttatatgcagaatcaaaaaaagtcaaatacatagaagcaaagagtacaactgtggttatcaggggtcaagaattgggggaaataaggaaatgttggtcaaaggatgcaaacttacagttataagataagtaagttttggagacctaatgtacagtatggtggctatagttaataataatgtatggtagcaagggggaaaataatgtattatatatttgaaattaactagagtagtagattgtaagtttctatgtgaagtcatggatatgtaattagcttcattgtgataattatttcacaatatatgaaaacataatgttgcacatcttgaatatatgtataatttttaaaaatttgtaaattataccttaataaagctggggaataataaatagacattattttgcgataaatttagattcacatgcagttgtaaaaagtaacacagaggagtccaatgtgcccattacagtttcccccaatgaaaatatcttgcaaactgtagtacaacaggacaaccacaatgctgacattgatacagttaagatgcagaacagtcccgtcaccacaaggttccctcatgttgctcttttataaccacccccacttctacctgcccccactccctcctttccttcgacaaccactaatctgttctctagttctataattttgttatttcaagaatggatacaaatggactcatataataagcaaattttggcatttgaatttctcacttagattcatccaggttgtttcacatatcaacagtttcttccttttatcactgagtagtagtacatggtatgaatgcatcatagcaaaggactagtatttagaatatataaagaactctgatgattcggcagtaaaagcaacccaaacaatttaattagaaagcaagaaaagacataaacagacatttcaccaaaatagatatacagatggaaaaaaaaatgtaaagatgctcaacgacattagcgtttagagaaatacaagttaaaaccacaatgagatatcaccccacacttaacagaatgactaaaattaaaaaaagtaaaaaaaatcttgaatatatataattttcatgtgatttgtacctcaatgaagctgaacataaaaacactggtctattatgaaaaataataaattgagtttctaaatgaaatatgagccaagtattgtaggaacatacttcaatgattcagctaattttatctcaagagtcctgcaagctttagaataaaaggtagcatgtgaatggataagtagtagaaggcaagcagagaaggaagaagagacaagttctgtgcacctttgggagtgctgtatgattttagagtaggctaaataccgactaacaagtgtggtagggtctgtttcagaacatgtaaacaaagttaatggttttagacttgatcttatgattaagaagaagctgacagaagtttattagcagaggggtgacatcgtgaactttgttttatgggcaaacaaatctggcagaaacataaaaatgggctggagtgttgaaatgctggtgtcattaagagaactgtagttattgcaataattcatataaaatataattgaaggcctaaccaaatggcaacagaaatggaaaagaggggctcaattcaagagctataaatgaggtagaatcaataggaactggtgatatttgattttactgatttatgccatacctagattatctctgaatgcatagacgagaataccagagtctaaatccagcctaaaaagagatatgggtttatattttggcaggttctgtgatctaatgtacactgtatcatagtttgaaaatttaaaaaatatatatacgaggttttggcttgtatagaaatgattattccctgtatttccattatgtccatcaaagttcctcacagcgtaattagcattatgtgtgtttctatcagttatccaagatatgctcactttagcaaacatatcacaagaaacagaaattctgagaatttacattcagcccttattcaccatattagttagcattactgctcatgtgcaaaagctactttaaattctccattattacaaccattttatgtttcacttagataaatatatggaggtaataaaatgcacatggtatcagattccacatgacaaattgaaggctgttaaattttatttttttcaaccaaactggttttaggttgtagaaatgcaaaaaagcacatttaagcatttatgctatctacttttatgattcacattagaaaatgatccaaataattcaaactcaaatttgtcagtgaaaacatagctttggactttaagaatatggtaactcgacatttaacctattgtgaaatggtcacagcaaagtcaaatttatcgtattcctggacagattttgtgactccaaggaaagtaacaaaggttctgtaaacctcacaaaagttattcatgtaattattatttgaattaacgtagtaaaccctatgccaatgaatgtaattgtaaatctacaagtttctatttaatgctcaaagtgcttggctaccagatagccaggtaaagacgaagaaattggctcccatttacctggaattttcatacgaactgtaattttgcttcttttacgtatcctgagtaatgtgaactatcagagactttgttcaagcaaaatccttcttgttgctatgaaatttagttaatattcagttcttcaagtttttaactttcaaatgggtaatttaatttccagcaatatattttccttggaatttttcttcctgccttacatgtcttttattttggctttcatcggcttagtaacattaacgaagtaaacataaaacaaaacaaacaaacgaaacagtaaagtaccagtgcattttccgaaaagaataaaaagtaacctaattagacatgaaactcatttctaacaaagatgcaacatacagagggcgatgaaattatctcatttgtcttactgtggaagactcaaaagtcataagcaacaaaaaagttttgacttagtgaaactactctgagaggtcatatttttattttacaggtgcatttgttttattatttttcatgtatttagtggggatttaggtggcacaggaagataatttattatgtagaaaacagaaagacttctactagatactgaacccattttcaagcatcgttaactaagcgatttgacctatattgtatggataacatgctcaacagaggagaaaataaatctcttttgatctttgcttttcaaataaaaacaaaatcataatattttaagtagcttagttaaaatgaaattaaatatttaattactaaggatgtttcagaaatcctatcttttttattagttgttttcacttttgtcctgttattaaaatattttatgtgtcatttcaaatctggttttaaaataattttctcatggagaacatagtttttaactatgttattcagtaactttattttaatactaaaacagtctcataattctatggcatagccggaatttggacttgcttaactatgctggttaatgggaaaggttgacttatagtaatactgcagagtaagtgtttaaagtgggtacatttatgtcatagaatcaattcagttttattcactttttcattgccaagaaacattacactaaacatgggttatagggttactcatttattcctaaacgtagtgaggtattactttaaaaaatacaccacaagtcaaatggaagggccctggtgggacctgattcaccagtgaatgaggagcgtctgaaagctgcagttcagggagagaaaagcactcccagagtagctgcagcagacagaatgttggcagggcacagggagcctggtcggcaaacgagccctaggtcagtgcagagggaaagggaggatacatttgtagtttgtttttcatcacttcttgaagtcccctgggaaattaaatgtcatctgtatgaactatggccacaggtatttgttaggaactaagtcctggcccagttgaataaaatcagcaatttatttttttttgattggcaactataaattcaccaataaagagttatgaaaaaggttgctcaaagtatgtaatagtggcatgaatgggaacttttactcaaatttgtaaaaattatggtatcaaatttaagtgtataaaaagttaggtatttgcttgtagaaacttgaaactacaattttgtggcaattactattcagatgaacacattagtggtggaagtgacccgaaattctacacatgttatagaaagaactccattttatttaaaccgctaaactcaggcttttttgttcacagaaatgtgtacttttttttggagtaagagaataatgttgacaacattattttataaggaagaaacacagctataatcactgcagtggagacatttaatattcacaccgaagaaggcaaacatttttcatatttctagacaacaggtagagatataaatttattcaaatgacagataaaaatgcttgtatctaatgctcattcataagacgtgcttgttaagtcccagggagacaatgaaataagctacagaaacttcagacagaatcatatgctactccatcttagtttataaaagaaaagatggatattctaaaaccgtaatttttaacctgaattacttttacaggactaaagaaactttttttatatgtaagtgtaagaaaaggatgcacccaaagatcaaatattttagtttttaatcatttcaacaattccctatggaaaaaaaaagtggttatttaagtattttgatgtataagaattttctatcataatactaattatttcttacctaaatgttctctagttctctatttgtattgtacattagaactaattacagagcaaaaatggaaaaagtatataagcagtagtgatcccacattgcagagtcatacaaaaacgtacacaaagtaagtccctaagagcagtgataaattcataattatttgaaacgtaaaatgaaacatgtaaaatgtttaaacaataaccaatcatgttaagaattgaatacatttcaataataattaaatctttactattattggctcacaacctgtaatcccagcactttgggaggcagaggtaggcggatcacgaggtcaggagtttgagagcagcctgaccaacatggtgaaaccctgtctctactaaaaatacaaaaattagcccagcgtggtggcgcgtgcctataatcccagctactcgggaggctgaggcaggagaatcgtctgaacccgggaggcggaggctgcagtgagctgagatcgtgccattgcacttcagcctgggcaacaagagcgaaactctgtctcaaaaacaaacaaaaaaaaccaaacaaataaaaaaaataaatgtttcataataataaaagtgtccctaagaaatttattagaaagatttaatgaaatgtatgatagtaataattgctgttgttacggatcatagcactgtctcaaatgagcttagaagtgatgcttccaacatttcatgggaagtagcaaaatctaactcaagaaaccctagcttttttcccaaatgtctctcattatatacaataatgaatgcagcatcacttgaacctttttttcctgagccataaggaaaatgttataggccagaaaggtcatcattagatgacacctttgttcatatttctgtttaagtgcttttatttccctcttctgaaataagccaactaaagaagacaatgtaacctagagctgactaatggaacctgagggaagtataccgtgggcatctaggaaagatttttttctctgatcaagacacatacaaagtaaaagctttgcccctcttttcctatttttgcatgttctcaaggaaaaataactggagatgaagcagccttcttgcccctatgaaggaaaagacaagggaaacccagagatgacccagattctggacagagctgaactggctcatcagcaaccttgaaatagtctctgaatttttactcgtgagagatacataaatagaatcattatttattttgcatattctgtcacttgcagccaaagcacactcaaaacataactcactatgttttataaaagaattttcacatatattattgagatattagaaaacctaaatgaatatttttcatacaatactatttttctaaatgtgaaacttggtagtggctgaaataaaggaggtaaagtagagaatttctgttcaccataattgcttgtttttatcttgtgccaagatatgcagatatcactgaatatgctttcctcatctgacttgctgtccccctaaattttctaagagtcattttcacacttacatgcatgaaataatttttttaaaaaacatgaaacactgcttttttggagtgctcccaatttgcatcagatattttatcactgtcaatgaagtctgtatagaccagtgagtggtaagttgacacttttcttcttcccccatcccacatccaataacttaaaaatacagtcaccttgtggtgtttgaattaataaaatataccctgatgtctgagattatctgcaaaaatatttaagatatggtatttctctataatataaataggaacatgtacagcctagtgaaaattgatagcaaaatgtaataaggtatgtgttcttgtatacacaaaaagctgtagtttatttaattgaattatattcataaataaaaagtgtccaacaaacaaaaattgttttcaataagttttaaaaaataagagggcactacaaatgcagatattagcatgtttccactcctgactttgggtatcaggggaggttagcataaccctctttctggtagaatagaaattcatttattcaacaatctgagcatttactataggtccagtactgttataagaattggaattatgtttatacaagaaaagaagagatctctacataacacttactttgtattagaaaaaatacattaaattatttaatataaattgagatcaagtgctataaagaagatacacaagatggtatgtgtgtatacaataaaagcaaattgagagccttctttaaaaagaaattgaccaggccttccaaaggttcttttgctgaaattccatagttaccaagcaatctggaagttaatttggctttctatggattttgatataattaataggatgtcttaaattatggaattgtgtatctgaatccctggaaaggaattatcatcacctcccctatatattaagtggtatataaattttatagtagataaagttgagcaagtgaataagagcctgaccatttctgggtgtcatgattcaattatgtttccccatttgccaagatgagagtgagactctggactatggatgatcacataatcaaggtagtgcccactggaaaacccgaataaccttcctaggcagcagaaacaactagctggattatactagttgactatgttgagctagacagcaaatagcagaagaattgcttgttcccccatcctctttctgccattcaccagttgactttcttggctctctccctctctccccctccctccctctctctctttctccaccaaccccccatcctatttagtggtctttattgaatccattaagtcaatcaattgtttaagcacaggtgtgagaatataagaatataaagttcatttctttctcttgcctgattgccctggccagaacttccaacactatgttgaataggagtggtgagagaaggcatccctgtcttgtgctggttttcaaagggaatgcttccagtttttgctcattcagtatgatattggctgtggatgtgtcataaattgctcctactattttgagatatgttccatcaatacctagtttattgagagtttttagcatgaagggctgttgaattttgttaaaggccttttctgcatctactgagataatcatgtggtttttgtcgttggttctgtttatgtgatggattaatttattgatttgtgtatgttgaaccagccttgcatcccagggatgaagccaacttgatcatggtggataagctttttgatgtgctgctggatttggtttgccagtattttattgaggacttttgcatcgatcttcatcagggatattggtctaaaattctttttttttgttgtgtctctgccaggcttcggtatcaggatgatgctggcctcataaaatgagttagggaagactccctctttctctgttgattggaatagtttcagaaggaatggtaccagctcctcctcgtacctctggtagaattcggctgtgaatccagctggtcctggactttttttggttggtaggctattaattactgcctcaatttcagaacttgctatttgtctattcacggatttgacttattcctggtttagtcttgggagggtgcatgtgtccaggaatttatccatttcttctagattttctagtttatttgcatagaggtatttatagtattctctgatggtagtttgtatttctgtgggatcagtggtgatatcctctttatcattttttattgcatctatttgattctttcctcttttcttctttattagtctttctagcggtctatcaattttgttgatcttttcaaaatccagttcctggattcatttattttttgaggggttttttgactctctatctccttcagttctgccctgatcttagttgtttcttgccttctgttagctttccaatttgtttgctcttgcttctctagttctttttttttttttttttttttttttttgagacggagtctcgctctattgcccaggctggagtgcagtggcacgatctcggctcactgcaagctccgccttccgggtttatgccattctcttgcctcagcctcccgagtagctgggactacaggtgcctgcaaccacgcccagctaattttttgtatttttagtagagatgggtttcattgtgttagccaggatggtctcaatctcctgacctcgtgatcagcccacctcagcctcccaaagtgctgggattacaggcgtgagccaccacgcccgggcttgcttctctagttcttttaattatgatgttagggtgtggattttagatctttcctgctttctcttgtgggaatttagtgctataaatttccgtctacacactgctttaaatgtgtcccagagattctggtatgttgtgtctttgttctcattggtttcaaagaacatctttatttctgccttcattttattatttacccagtagccattcaggagcaggttgttcagtttccctgtagttgtgcagttttgagtgagtttcttaatcctgagttctaatttcattgcactgtggtctgaaagacagtttgttatttctgttcttttacatttgctgaggagtgctttacttccaactatgtggtcaattttggaataagtgcaatatggtgctgagaagaatgtatattctgttgatttggggtgcagagttctgtggatgtctattaggtctgcttggtgcagaactgagttcatgtcctggatatccttgttaaccttctgtctcactgatctgtctaatattgacagtggggtgttaatgtctcccattattattgtgtgggagtctaagtccctttgtgggtctctaaggacttgctttatgaatctgggtgctcctgtattgggtgcatatatatttaggatagttagctcttcttgttgaattgatccctttaccattacgtaatggccttctttgtctcttttgatctttgttggtttaaagtctgttttatcagagactaggattgcaacccctgctttactttgctttccatttgcttggtagatcttcctccatccctttattttgagcctatgtatatctttgcacgtgagatgggtctcctgaatacagcataccaatgggtcttgactctttatccgattttccagtctgtgtcttttaattggggcatttaaaccatttacatttaaggttaatattgttatgtgtgaatttgatcctgtcattatgatgttagctggttattttgcccgttagttgatgcagtttcttcatagcattgatggtctttataatttgacatgtttttgcagtggctgataccggttgttcctttccgtgtttagtgcttccttcaggaactcttgtaaggcaggcttggtggtggcaaaatctctcagcatttgcttgtgtgtaaaggattttatttctccttcacttatgaagcttagtttggctggatatgaaattctgggttgaaaattcttttccttaagaatattgaatattggcccctactctggcttgtagagtttctgcagagagatctgctgttagtctgatgggcttccctttgtgggtaacccgacctttctctctggctgccctttacattttttccttcatttcaaccttggtgaatctgacaattatgtgtcttggggttgctcttctcaaggagtatctttgtggtggtctctgtatttcctgaatttgaatgttggcctgccttgctagtttggggaacttctcctggataatatcctgaagaatgttttccaacttggtttcattctccccgtcactttcaggtacaccagtcaaatgtagatttggtcttttcacatagtcccatatttcttggaggctttgttcatttctttttactccttttttgtctaaacttcctgctttatttcagtaatttgatcttcaatcaccgataccctttcttccacttgatcgaatcggctattgaagcttgtgcatgcctcacgtagttctcgtgccatggttttcagctccatcaggtcatttaaagtcttctctgcattgcttattctagttagccatattcaataaggaaaataagaagtcaaattttccctgtttgcggatgacatgattgtatatttagaaaaccccatcgtctcagcccaaaatcttcttaagctgataagcaacttcagcaaagtctcatgatacaaaatcaatgcacaaaaatcacaagcattcctatacaccaataacagacaaacagagccaaatcatgagtgaactcccattaacaattgctacaaagagaataaaatgcctaggaatccaacttacaagggatgggaaggacctcttcaaggagaactacaaaccgctgttcaatgaaataaaagaggtcacaaacaaatggaagaacattccatgctcatggataagaagaatcgtgaaaatgaccacactgcccaaggtaatttatagattcaatgccatccccatcaagctaccaatgactttcttcacagaattggaaaaaaactaccttaaagttcatatgggaccaaaaaagagcctgccttgcaaagacaatccatcctaagcaaaaagaacaaagctggaagcatcaggctacctgacttcaaactatactacaaggccacagtaaccaaaacagcatggtactggtaccaaaacagatatatatatatatatgtatatagaacaacggaacagaacagaggcctgagaaataatgccacacatctacaaccaactgatctttgacaaacctgacaaaaacaagcaatggtgaaaggattccttatttaataaacggcgctgggaaaactggctagccatatggagaaagcggaaactggatcccttccttacaccttatacaaaaattaattcaagatggattaaagacttaaatgttagacctgaaaccataaaaaccctagaagaaaacctaggcaataccattctggacataggcatgggcaaggacttcatgactaaaccaccaaagcaatggcaacaaaagccaaaattgaaagtgggatctaattaaactaaagagcttctgcacagcaaaagaaactaccatcagagtgaacaggcaacctacagaatgggagaaaagttttgcaatctacccatctgacaaagggctaatattcagaatctacaaagaacttaaagaaattttcaagataaaaagcaaacaaccccatcaaaaagtgggcaaaggatatgaacagacacttctaaaaagaagacatttatacagccaacagacacatgaaaaaatgctcatcactggtcatcagagaaatgcaaatcaaaaccacaatgagataccatctcacactgttagaatagtgatcattaaaaagtcaggaaacaacagatgctggagaggacgtggagaaacaggaatgcttttacactggtggtgggagtgtaaattagttcaactcttgtggaagacagtgtggcaattcctcaaggatctagcactagaaataccgtttgatgcagcgatcccattactagatatatacccaaaggattataaatcatgctacgataaagacacatgcacaggtatgtttattgcggcactattcacaatacaaagacttggaaccaacccaaatgtccttcagtgatagactggattaagaaaatgtggcacatatacaccatggaatactatacagccataaaaaaggatgagttcatgtcctttgcagggtcatggatgaagctggaaaccatcattctcagtaaactatcacaaggacagaaaaccaaacaccacatgttctcactcacaggtgggaattgaacaatgagaacacttggacacagggagaggaatatcacacactggggcctgtcgtggggttgggggctgggggagagatagctttaggagaaataccgaatgtaagtgacgagttaatgggtgcagcaagctaacatggcacatgtatacctatgtaatacgttgtgcacatgtaccctagaacttaaagtatatatatatatatataaagaatataaagctcattagttttaatagagttcaacatatatttaaggagcacctactaagtttcagggaagttaatttaatgtaggtgttgcagtagacttcaaagacagctcagatttcccatcctgaatgatgggcaactttttacaactagaatagacattaattggtaactttgggcatctaacaaatatctgaagtggactcagattattaaactagataaccctgtttaataatatttgcttggcatattcaaatatgaatgacaccccaaatcactaggcaaagcaatctcaaaatgcaacatagggagttcaacatgtgagaaaaaaggagtatacatatattttggaaaaacacatttgctttcatcactgaaaggccagttaatacttttcaattatcttcagtggtatagaagaattttaaatcagtaattatgtaacattagaacatattacatatgtttttcctaaccaatttttagatgctatattttgtaaaacttgcaaaaatcgagaaaaaaattacacctctctagttccttcacacattatttcccttacctatattctgtgaagactaccacagcttcacaacttaaaaaaaatacttctaataaaacttgtttctattctctgaaaattagttaagtgttttttaccttttgtttttcttcacacatcagcagtctttttccaattctgtaacaagaagcataactttgcattttgaaaatgccaatcaccttaaaacttctctcatgctagaaacagaaaaaacagaacagttctcctttttctaatgctatggaagagtggttttacatacacattaattatcttgtataaaaatgataagaaataagaatcgggctacttgaattatattgaaaatattgatatttttaatcaaattgaataattctatagtttaacacataaatcagtaaatcaattattatttagattgcatttttgtcatggatttacatcttgagggactcagatgactccctgaaatatcatgatctgtttttgttgccagtcatgatgctataatttatataaaatattcaagctgacttgtacataaactaattgacagatgtaggaattgtcatttggggattaatcattttgccagtacattcaagtacatgttagataattctaagatgtacgtaaaggaaacatcccctctctttttctctccaatattatctactatttttaaaatgtgcctacctttataccattttctcctatttaaaattatgtccatataaacagataataaatggagacgaattccaattgggaatatttttacaagataaaacttgtttcaatttgcattaccatcaacaaatagccaaatcacccttttttcctatattaaaatactagcaacatgtagcattcatttaccagatttaaattttaaaaagacctgtatttttacatgagtcagaacaaagtgagactcttgtccagagaaatagtactgcagtctgaatctagatacagtattgaaatcaaattctgaatattattggatatttacggtcactcatttaggttagtgactcatttagatacgctttctatactgaacagattacagagattagggaaaatatattactgtcgttttgtaccaatcaataagaaagcaaaatctcctggaggctccgtttagtgggtgatcaaatgttcataaaataaatcataaagactgttcttacctataagttttagtgtccttacattatggcagttgattatcaagaattcattgaacaacatatgcgagcaggacctctatttcttatttagccatttctctaaaaatttggaatttaatcatttgagacagatgagaacaaatgacaacttcccaatgaacataaaagggaagaccacagaaaataatgcctattatttttgctcattaattcattcattcaacaagtatttaatgaatacctgttatgcatgaagcactattctagttgccagaaattcatcaataattgaaatatataaagtttctgccctcatattgcttataatttttatttatctaaatgtgagattagattgcttatataacttagaattaatataccactctctccacctcttctcattcttagagtgtatatacaataaaaacccaaaaaaaatgcaacaaaacatggaacagttaatctagtcaatttctggactaagttttataattaaatgacaattacattgatattattatattattttgtattgtattacatgcatattaatgtattacaatgtactgtttaatacagtggtagactgtttaacgggcacgagttcttcccattcctgtaagcttccttctatgcagtgagactgtgctgctgcttctcccttctagacatgaatctctttctaggccctcttgaatcaggaccaaccttgtgacttattttgactcatggaacattacagaagtgatgcataagctctggatcctaggcttcatggggttcataaatgccaccttccccctcttggagcattgtcatgagacctccatgttaataagcccaggatggaaaaccactaggagagggagacacagtatcctggctgggcttcgcctccagctcatccaccagattactgttgctaaaaaactgccagactaattgacagaaatatgagaaacagtaacttattgctgattaaagccactaagtgttagtctggtgtgctaagaacaaatagataaaagacacataaacgtatataccagacactgtgctaaataccacctatgcaaaattcagcaaaagctttcataatctttgcctatagtctctatcatattgtatagcagaaaagacacgaactgttcaagtattcacacaaatattgtgaaattgctatggtagcaaataaaagaaagaaaagtaaaaatattttatgagagattgtgattcctagagggaagcacatttctggtacaggtgactttaagtgcaaagtccctgtcggagaaagcagcagataccagaaaccaatagaaagaaggcatttgagcctgcgatagagggttagcttatgaagagataagattgtgctagtgggttacggttaggtatttagctgtgtagcatatttgatatatggaggatacagttagtagcagctcttatattaaaaaaagaaaaagaaaatttgggtttctttgtgtatgtgcattttatctttttgagcaattatttgctacaagagcattcaggaaatagaagcaaaacatgctccaaaatatcagcagaggcagtgcttaaatttcattactaaggcttctttcatatctacactcttagagtggaaactaagtaacctaaataaatctaataatgaaaatgaattagagagaaatgagctttggtaattgtgactgtctttcaattgaacaattagactttaacatagaagaaaagaaatatgataggtcaattaaacactgtatataaccaggcaaatcaacaagtttctatagtacaggtcagctcggtactgtgtggccaccgactttattgactcagtacaatacaaagaatatgcaaaattttgaaagtgacgaaatttttctgacactactattattctcataaatgtgccaagtgaaaaaataacaattatttccaataaaaaaaacaactaatgcatagttctgttaaaaacaagatttgctttcctctaagctccaaaaatacagacatagcaatgaacaaccctgaaattcccttcctttgcctgcaagactcacaataaaattattgcccagaagtgctggcaagtgaccaaaatgaggaggcatttttggggattactggcttaaacaataactccttcaaacagggaaagcaaaggaaaaaaaaagaaagaaggaagaaaggaaggaaggaaggaaggaacgaaggaagggagggaaaagaagagaaaatctgtattctttttgttacattcaatcgtcacaatagagtaattttctctcatcatccataaatctatcatcttgctaatacttaggtaaaatcattttcattgtagcacataatatatattaataagctactagactttttctaatattctactttcctttccactttagatttaacaatcatataataatcactgttctgcttgcaaatgaatcatatgcaatagtaaggaaatagctaagagggagatgccgcccatgagagatttaatcataggaaatggctgactttttatttccaataaccatctgcactcatggtaaatcaggtgctaatgaagctcaggcccagactgcacaggagcataaatctcaagaaccaaaagtcgtggagcaacagacctcagaaaaacagaattttctaaggaaatgcaccaaaattatcatatagaaggtcaccatctgcaaacgtgtcacataagtgaatatatttggtaggcctaataccacattatgacactggctgtaaacatcaaatctctacttttcttttgaaacttaccactttcaaatattatgatcacttatggttttttacgtcctcctagatagtcaacatcttgggggtaggggctcttcattccagtttaatttttatcgcctccacagtggtttgtccttataagtacttgatatttggagaatgaataatgagaataaatttattaattgtggaatcctacttttagggcagaaaagttttgcagaatttttttctccagtggaggaggaagccaagtcttaatgcagtagaatttgtaccagaatttgtcttctgagagtcaataaatgtacctatatcttctaagagtttttgtctctcagtaattataatccttaacttcacgtcttgctcactcattgttggagtgatatatgtaaaagaatcagaacagagttagaaggagaagggacagcccagaaccgacagtataaattcaaatcctgtcacaaaatgatgcaagtctaaggacttgacaaaataatttcctttttctatacgctagtataatacatagatcatatctatctcgtaattattaatcattatatttttagccactggcaaatcatatcaaagcaaagacctggtaaagaagaggtatgatatctctattaactcttgaaccaacctaagttctataccatgccacacttcacttagcctcattattctctacttgtttccatgaatgcagaaatcttagtcaagtgttaataagccttttattttcatttgttttctgtaaaaaaatataattagcacaaaaaagaaatctggttgctagagccaattagtctgtaaatagctttataaattgtattaggtaaatattaatacttagagcagcagtttttaattttctgtggatcacagatacttgaagaatttgatgacaggtgtgaaccgtctgccctgatataaacacatgatatatatgtgcagaaatatggctaaaatttcaggagttttacagtcttgaaatccattaatagtacccaggactgtgtaaatccaggtcagaatttctgactatagttgtatttgcaaactgagaaattaacaaagatcttaggtggaattcatcatacataacagactttagatgtagactgttttttatttcttatccaaaaagttaatcaataccagagtttatcatgctagattacaattttaaactgtgttttcatatatccacatgaaatccacataaaacaaaataatgaatcttttcatttaaaactgagaagacagacaaattttaccattcagtgtatatttctggacatgatatatagagttgtattcaggtaatgttatgcagtactaatcagaattcacaaaattagagttgcttacatctgatgagtgggttttaaccctcagaagctagttaatgcatactcctgccccaggcaaactgacattgctgtatcctgaatgtgttggcatttgacctatgggaagctaacatgctgttagtgagaggaacatgtgtatgcgcatcctacaacacattactttcacatttactgctttcttctctttcatttatcttaatacatgacaaaaaaattgacaaatctttgtttcgtaatgcaaattattgcacctgaagccaaatccaatcgattctcaattcaacacataagatgaactgagaagggattttatggcatctaatattataattaggcatgtttttaaagaaaaattaatattaaatatagatgctagtaaaagctaagtatcagatttgagcttcaattttcttcaaagattttctctgcaaaggaacatacgttcttaattatatactttattgtgtcaaaattgtagaaaattaattaataacaaaatacgaagaaacctataacttgcgttatagcctgtagtgtaaggacaatggtctccaatttacatggctcaacttgtgattttcatagtctacaatggtgtgaaagcagtgcacattcaacaaacactacacttcaggttttgaattttgatcctttcccaggctagagacatgcggtgcaatactctcttgcgatgccaggcagtagcagtgaacctcagctcccagccacgctatcttgagggtaaacaaatgatagtctatagtgtactgtgtttccagataatcttgcccaactgtaggctaatgtaagtgttctgagcatgtttaaggcaggctaggtgatatggtttggctgtgtcctcacccaaatctcatcttgaattgtagctcccgtaattcccatgtgtggtgagagggatccagtgacaggcaattgaatcatgagggcgggttttttcccatgctgttctcctgttaatgaataagtctcacgagatctgatggtttcataaaggggagatcccctgcacacactcttgcctgatgccatgtaagatgttcctttgctcttccttcactttccgccacggtcgtgaggcctccccagccacatggaactgtgagtccattaaacctctttcctttgtaaattacccagtctcaggtatgtctttattagcagtatgagaatggactaatacactaggctaagctacgatgcttatatgatgttaggtatattatattagtctgttttcacactgctcttaagaaatacccaagactgggtaatttataaaggaaagaggtttaatggactcacagttccacatggcttggaagaaacttataatcatggtggaaaggtgaaagggaagcaagcacctttgtcacagggtggcaggagagacagaacaggggaaactgccaaacactgttaaaacttcagatctcgtgaggactcactatcaccagaacagcatgggagaaaccaccagcatgatccattcaccgcccaccaggttcctacttgatacgtggggattatggggattacaatttgagatgagatttgggtggggacacagagcaaaaccatatcatatattaaatgcatttttgacatgatattttctttttttaattttaatttttaaatagaattcattttatttggagcagttctaggttcacagcaaaattgtgcagaacatatatagagttcccatatactccctacccccacatatgcacagtccccccaccatcaaaaccttataccagagtggtacgtttattataattgatggacctacactgacacataattatcaccccaaatccagagttttcattagagttcactcttggtgttatacattctgtgggttttgataactgtataatgacaggtattcacctttatagtatcacacagaataatttcactgctttaaaaatcctctgtgttccaccaactcatccagatttttttagggtgattttatgaatcaaatgagatataggtaaagtatttagcactaggcgtggcacacagaaagtgcccactaacaatagccaacattagcattaatcatcagcttgagttgactggtaagagctaaaagtaaatggttgcaacagaaatgaagaaacagatgcaaacggtattttctctgtgtgtgtgtgtgtgtgtgtgtgtatgaaaaaggtagtgtatgtaaatacacaaacagatataaagaaaaagaggtaacacagaaaacactacgacaaagttactgaatacatgtgggagagagagaaaaaaagctaagtgcaaagaatcaagccttgtatgttagtttttactcaatgagatgcaacccaaatgtgattagatacgcaagataatttattagggaaaacgcttgtgagggaaaagtaggtaggcacaggaagagcccgggagagccctcagaccatcatgcagatccgatttctgtgaaagagaaagagaaagaagttctggacagtggtgctgtgttttgttgttgtttttgtttttcaatttctgggatacatgtgcagaaggtgcaggtttgttacataggtatacatgtgccatggtggtttgctgcactcatcaaccccccatctacatttggtatttctcctaatgctatccctcccctagcaccccacccccgacagaccccagtgtgtgatgtttccctccctgtgtccatgtattctcattgtttaactcccaattatgagtgagaacatgcggtgtttgattttctgttcctgtgttagttttctgagaatgatgatttccagcttcatccatgtccctgcaaaggacataaactcatcctttttcgtggctgcatagtattccatggtgtatatgggccatattttctttatccagtctatcattgatgggcatttgggttggtttcaagtctttgctattgtgaacagtgctgcaataaacatatgtgtgcatgtgtgtttatagtagaatgatttataatcctttgagtatatacctagtagtgggattactgggtcaaatggtatttctggttctagatcgttgaggaattgccacattgtcttccacagtggttgaactaatttacactcccaccaatattgtaaaagtgttcctatttctccacatcctctccagcatctgttgcttcctgactatttaatgatcgccattctaactggcatgagatggtatcccattgtggttttgatttgcatttctgtaatgaccagtgatgattatctttttttatatgtttgttggccacataaatgtcctcttttgagaagtgtctgttcatatccttcatccactttttgatgtggttgtttgtttttttctagtaaattcgtttaagttccttgtagattctggatatcagccatttgtcagatggatagactgcagaaattttatcccattctgtaaaattatgtaaatgcacacatatctatctgaaaagaactatctgattatagtttcttttgctgtgcagaagctgtttcatttcattagatcccatttgtcaattttggcttctgttgccattgcttttggtgttttagtcgtgaaggctttgtccatgcctatgttctgaatggtattgcctaggttttcttctagggcttttatggttttaggtcttatgtttaagtctttaatccatcttgagttaatttttgtataaggtgtaaggaaggggtccagtttcagttttctgcatatgaccagccagctttcccaacaccatatattaaatagggaatcctttccccattccttgtttttgtcaggtttgtcaaagatcagatggttgtagatgtgtggcattatttccgaggcctctgttgtgttccattggtctatatatgctgttttggttactgtagccttgtagtatagtttgaagtcaggtagtgtgatgcctctagctttgttatttttgcttagaattgtctgggctataggggctctttttggttccatatgaaatttaaagtgtttttttctaattctgtgaagaaagtcagcggtagcttgatggagataacactgaatctataaattactttgggcagtatggccattttcatgatattgattcttcctatccgtgagcatggaatgtttttccatttgtttgtgtcttctcttattttcttgagcagtagtttgtaattatccttgaagaggtccttcacttcccttgtaagtgagttttaaaagataatttcaacttttattttagattcagggagggcacgtggatgtctgttacatgggtatattgcatgaagctgaagtttgagataaaaatgatcctgtcacccaggtagtgagcatagtactcaatagtttttcaactcttgtccctgatcttctctccatgttctagtagtctccaatgtctattgttgccatgtttgtccatgggtacccaatgtttagctcttacttataagtgagaacatgtggtatttggttttctgttcctcagttaatttagttaggacaatgacctccagctacatatatattgctgcaaatgacatgatttcattctttttatcactgcatagtattccttggcatatatatatataacacattttcttgatccaatccaccacagatgggcacctaggttgattccatgtcttggctagtgtgaatagtgctacaacgaacatatgagtgcaggtgtctttttggtagaatcatttattttcttttggatatatacccagtaatgagattgctgggttgaatggtattctgttttaagttctttgagaaatctccaagctgctttccacagtggatgaactaatttacattcccaccagcagtgtataagcaagcattcccttttctctgcagcctcaccagcatctgttgctttttgactttttaattatagccattctgattggtgtgaaatagtatctcactgtggttttgatttgcatttctctgatgattagtgatgttgagtaatttttcatgtttgttggcagcttatatggtttcttttgagaagtgtttgttcatgtcttttgcttgttaaatagttttgttttttacttgttaaattgttttgtttccttatgtgttcaaaatattagacctttgtcagatgcatagtttgtaaatattttctcccatcctgtatgttgtctatttactcccatcctgtaggttgatagtttcttttgctaggcagaagctctttagtttaattaggtcccacttgataatttttgcttttgttgccatcacctttgaggactgagtcataaattctttcccaaggccgatgtttcctagatttccttctaggattcttatagtttgaaattttacattgacattacttagcaatgagggagagcacaattccagcacctactgctgaggtattttccacagttctggctgtggaggctcctacttcactccagagcaggcatgccaatctctggcatgagactaaaatgcctccatggccatgctgctgggtctccaaagaatgactgactttgtatgcacctggattaaaaatggcctcctgctcttggtcccaagtctgggaaaatgtctgcagcttttccaagtgcctttctctttcagcgcctccaagcctctctccaaggcagttccagtgctcaggagaaacaaaatgctcttccttggtctaggttgctcagatcttcagtggaaatgtgagtcacagagggagactctctgtccctctcacctacccgggcttcaatcacgtttatcagccagatgctaccacgggagctgtctgccaacaaccccgggaactggggtgtccttcatggttctggttgattccttttttccttcttgaattaaagctcacatagttgatctttatgtactatcctgctacctccaagtggctgaggcaagctacctctaatctgccatcttgggagtgcgtagtggggggaactatatttttaatttatggtgggtttatggtgaacttaacctcatcataagttgaggagcacatgtacatcacttgtgacaacaagtagctgacaagtgaaagaaacacatggcaaagtaccaccttgataaatatctttacatcctttgacttggctgctacttgctttttgatatctttatcattatgagagatgtgtataacagaaagaattacagatgatgatttcttaaagtgattagttactaaatataaattatatttatatttattaatctatactcttatctactcaccttgttttaggggctcatatactttcctggaaaactatatataaatagtataaatggctattttttcaaacattttagctctagaaggatttattcaagtttatccattgaatctgcccatccatatctgttttacttctttagtcctactaattatccagtttattattaccttgattattgaatcaatgcaatctgacaaatatttccattttccccttctgggagcaaggtgggagtatatctcctggccattttatggaggggataaggccacaactctacgtttgatccataaggtgttaggaaacatgatgtgggtaatttcaagtctggaatagttaattgcccacatgagattcactggaattctctttccttcttgcacattgaatgacaaaattcgagttaacggccactgtgtcatcttggacccttgaataaatacagaaacagagctctgcaacccctgcaaataatttggaacatgacagagaataattctttgtggatttaagtcattgttattttggggctgtttgttaccttggtgtaacgcttcctaacatgtttaaaacattcactaatgtgtcttttcaaatacagttgttccacttccaaattattcttcagaaaggaaccacatttttgtttgtttctatttgtgaaacagtaactgttgtattgcataaaaatgacagaaagatgccatcataaagtaaataaaattttaaaatttgtcttacatttattccgtacagtgagttctttgccaaaaataaaatctgagttcagtaattaaaatgctagtctcatcaaagctctgaatctaatttaaagttgagattacttccctgccttagctattggctgatgcaagaataaagcccatgaaaaagaaagggaagggacaacttcttcactcatttctcacctaggacttcttttctcctgctctatcttggctatccatattctctgactcctccaattcagaacaagcagtagaagaggtaaggagagaagggatagttcttccttgagtggtaccatggtagatgactcccactagtattttctactttttccatattttaaaattcattttctgatgggcccgtgctttcattttttcatttttcattttttcatttttctgagatttctccctatcctttacacccaaccagtccgctgacatagtcaagtgcatgttttgagtttatccttatcccctaggcatctgccaatttaattctcatttcctctgctgaggtccccttgcccttcctgaaagatctaagacagtcacagagcagctcatgctctcctcttctcttctcctcttccaatctctctctctagcccacatgctgaatttcaccctggcaaactcagggtccacaacacttcccgaactgcaatcccctactctactatcaatagctccccaacctttacttgctcatatgtgactcatacttgatgacctacaaagcagtggatactaagacctccaagcgagacattaaacctcctcttttgactttggtttaggaggggttaccccactgggagcgatgaagtggacctgacagcatatctccctccagagacacctcttaaaaacctttcccctctccccatgggcgctcttccatatttttggtttgatagagtgctttaacagtcctcaaactggttctgcattagcatctctctttgcaatgtgcctcagctgaaacttccattagaatcatttgcaaacagaaatcaagtcttgccaactccacctgtctcctataccctcaccaccagcccccgcacacattctgataaaaagccttcagagacttcatttgaatttaggattaaaatctaattaaatcctacatgatctaaattctgcctgtcttaacaaccctttggtatgataataagagctagtcgcatgagtctcctgtttctcttatgaaagaactctcttgccgtacagcagggtttctcaatctcaatactatttacattgattgggcagatacctctttgttataaggcactgtcctgtgcattgtaggatgtttagcagtatccctggcctctatcaactatatgtgattactacccccaaccttgtcgtgacaatcaaaaatgcctccagatattgccgaatgtctcctgaggagggcacagattgtccgtctgttgccttagaaacttcatatgtgatattccctctgtctcaaagtctatcttgctcattctctacctaaaaatttcctactcatctttatccctgaatgagtttccaaaactaagtcagttcttctggtgataaagcatctcaacattacttttcctttgtagctacacaggtggtttacaacctccctctctccgcctcccacagagatacttttggagcattggtttatggcatatgccacatacccaggccactacaacaggatgaggcctttataatgcaactgaaggctgaggaaacacccagacctcgttggagaagcttccaggcagtgtaacagttttaattttctcttttctcttttagatatgtcattggctgaatcaaaagcctttgctgatgtttcttttgtgagtagaatggatgaaactgagtgagagataataataagagctaagaggtaatgaacatgtactatgtgctttacataaaataatacattcagtcctcacaatgaattagcactagctagcttcatctgacaaaagacaaaatcacaattcagagagaataaagtattcatttcagatcaggtattggcttcatagatctgccttgattcttcataactgctgttccctctgctgggaagtttcttccccctattaaccacatgcctttcctcctcaccttccaggtctctcttcgaatgtcaccttctcaggtaggatttcttgagtgctctatttaaaattataaatagatgcctcacgctggcatttcctgctttgctttcttcgatagcacttcctgccatctgaaatgctgctgttttactttgattgcctctctcctctgaaagactggaagttcttcgagggcagtgattttcttgcaaggctaaatcctcagtacctgaaacatgcttcacacttggtgagttcaccataaacatttgttgaataaaggatgagtaaatttcaatcctctacatgaaggtcttagtatttgaactaggcatacagtcttggggtgaaatgttggttcaaacttgtttcaagaatgctttcattttagttttctagaaacaagaatactgaccatgcaaattgtatacaggtaatccagggtacatacagataatccagggtaaaagagactagaagtgactctctcctgcctccatagttaatttctagagaggaaggccctgaggcagaaagcaggtagacaaccagcttgcacttgtgttggtggcctgtcagccagggttgagtttgacctggcccgaggcacccacagcagctgtggccaaaatcagactgggccaagagaatttttcatggttcaccaagatcacctgctgtgataatctaccctggtaacattttatatttctgaaaattcgccttaatttatataagtaacctaaatccatcatgctgtttttaaaatacattttctatccttcttgtctcagaaattatagaaacagatgtatactctcatcacaaaaataaccttacatcagatgaaaattttactaggtcatgcccccaaaattaacaaagttactaactatgcaatttttcattttatattaaatcatacgaataattttcctatctccctaaacccattaaaagtccagtactttatagcagagatgacattgaatgattcacaaattaatgaaaccattgttacagtgctttaaattttaggaactagaattataaaaaccttataaaaccatgactccccccagccccttcagtagcacatgtgttgcctgtttgaatactaaacgtgtgagaagccattttatgaacactttgcactaaataacttttctaggatgaataagggtgcctagatatttccacagaggcagattagtgacattcaaattgtaatcttgttcctcgaagcagaagtaagcttttctataaaggacccaacttgaaagggaaattttgctgacagtgagagtttgagtttcagtccctaaagccaggggcaagtttttcaagagacccatactgcaaggccacattgtggactatgtaacttcagctaatttcttggaaatgtgagtataattgtctctgcattttacatatttaagtgatatgatgtgacagcatctgggttataggatggggggttctgaaccatgagaacccctaaatttgagaccgttttgtgtcaggatattctgagctctgtctcaagggattttttcctctgacccacagtgcagaattgtttcctgattaggctgtttcaaagctaaaagggacaaaaatagggctgagcagccagccagccaaatgtaccttttataaatctatctctaaacttgtagagaactctaacaatggtttcattaatttaacaatcactcaatgtcatatctattataatgtactaagctcttaagagagaaagaaaaaagaaaattgttttattcccgtgatttaatttaaaatgaaaaattgcattgatggtagtcttgttaaactttttttgatttgctttatgatttaaagtatggactttcttttcttgagggccatgcttctgtcttctattttaaaacttctaaataatcattcttatcttctaggacaggtatgaaaacacttgataagtgattttaataaaaacatatactgtgtacttgtaacttggtaacaaacgcagccaaaaaggttgcatattgaaacagtgtatatccaaaccgtatacctagcttggcccccaagatgcctgtgggaacaatgaaataccctgactgatccccattgctcaccatgtagcttactttggctagatcactttcctgggtccctgggatcttcctgggattcttgccaaatccagtttccagttcccagggtaggttatactccttttgcacagttcttcacagccgtggtttgggattgtcccatcaaagactctttgtggacaatataatactctccctttctcagagagctcctttgataatgtcctaaaacttctgtctttctaatccacaaaggatttttcctaggttcagaattttctggatctgctagcctactaaaatccccctgtgattctggagtatagtagaaacatcagagttacttagtcagacattcttgaaatagattagactttaccaggggtgactgagccaaaattgttacatttcgtaaccatgaaaatgaaagacttccactgaaagcaggacatattggaagacaaatgcatttgattctaggctcatggggtcccttttttctgctactaattttgaagttgacctctttacgaacattgattctcttttgagatccagtcatttcaaggggaagagaagatgatattctaatccatttgcccacataaacagagtcaaaaagcacgataatattaatttcttggttttgaatattcatttttagtttgaaaagtgtatcatgattatgtaagatgctaactttagggaaaagtagataaaatggattcagtttatctatggaacatctttgtaaactttctgtaaatctaaagttattccaaaataaaaaatttatttaaaaaatttgtggatgatagaaggggacctcagtgattcaaaaagtcacttaaatcccagagaatgatacaatcaatatttgtagaggatagaaaatgatccaacacctctcctagctacattgataattaatttgcattagagactgacatcaaatgcctcagcctatatatgtttctgtgtaaaacactcagaattagaaggaggtctgcagcaggacatatactgaaaacttaaaattcaaaatgtgcagaaagtcccttattttaaatcaacagtgtacttaaaaatatttacctactcattttcttcaggcttcctttatactagatgattatgcaaatagaatttaaaagggaaaaaacaatctatgtttttgctcttgtccattataaatatttacgcattttggtgaagcaggaaagtggttgttagcaaaactgatttggatggataggaggaaattttgattaaaaataaagtaaagcataatgagattggggaaaatgtcatctgaggaaaaaaatctcattttttttttcagtttttaccaacatccttttttgagagtactgcagacaattatgtcacatacacatttttaagactttttcccattacactagacttcttcattttctaaatttgttatttgtaaatggaattcatttctctggcttcattttcttgtctcattatgctgaattcagcgagtgtttgttttgaaaccctctttaaataagagctcccatttcttttcatcatctgtaagttcttaaccatgtacaaaatcatttttgttgaaccaactttccagttcacgcaccactgctactagaaattctaggatgaaatccatcattaggcgactcaaagaaattatggagtttttttttttttttttttccactttctgtttcttgctagttattgagaaatttggtgattcagagaataaggaaagagagtggggagcgctctgactagtgtctagtaaccccttagtggatgacttcagctggctttaagcaattgctttttttattttattttttattgttttttgagatggagtcttactctgcggcccaggctggagtgcagtggcacgatctcggctcactgcaacctccgcctcccaggttcaagcaattctcctctctcagcctcctgagtagctgggattacaggcacgtgccaccacgccagctaattttttgtatttttagtagtgacggggtttcaccgtgttagcgaggatggtcttgatctcctgacctcgtgatctgcccgcctcggcctcccaaagtgttgggattacaggcgtgagcgagcgggcccggccttaagcagttgcttttaatacaataattcctctcccaaagtgttgggattacaggcgtgagcgagcgggcccggccttaagcagttgcttttaatacaataattcctcttctaaattcactgtgaggctgcagtcaggaattggttttggtaattgtaaagtccagctgaagtgctggtggaaactctatactaataagtgcttggcaattatagttatgtccccattgaagtgatccaatacatgttgcgtacttcgctatatccaaaactggcagaaatttgtcttcagtgattaaaacagttatcactgcccagccctaaaagatttataaacactgtatacatttagaaaccccttttcaatctaaaaataaatatataaataaataaataataaaaataaaaataaacaatggcagcatgtttttaattatgcctaattgaaaaaggaataaaatcatttggaagttaggtgaagaaaagaggatgaaaagtctgataatcagtggttattctaaagaaaataaaattcttctcaatgtaaatcatataaacataccagagtgctttaaaaatacagttaaataatcacattgttttactgttttggcaaaagttccatttagcatagaaaataaatatcactcatattgttttcattttgctttatgtgttcaaataggatatataccagctctacacatcatccaaatatataattatgtggttaattatcacaacatagtgttattcttattaactttaaatattttgtgattattagaaaacaaatttaataataaggagtattcattgctttcatcacacattgattaaatatgtttttctgagggtctgttgagtgcaaagaattgtgctgtaatagtatatattttttccaatttttctttctaactgttgatttcttatttccttagcaatcaaagcatatggactatattttaattctacagacattgcgttaggcagaacagctaccaacacccaatccctgaaatttgtgattatgttttgatacatggcaaaaggaactatgcagatgtaattaaggttaagaactttaaaataggaagattaaatccaaggagttcttcaaagtaaagaactactacatgcagaaggtatgtgctgcctggggcacctcgtagttggaaggaaggctcctcacagtgcatgatggagctgtgggcgggaaaacaagagagaaggccattggctgagagctcaggggctcgttctctctgtgctgccatctctaggtgagaaactccagtgttggaacctggccttcaatgttgtcatgccaaggtaatcaataaggtagagcctcttttatttaatgccaataagcaagtaggtcagggtgatttaaaactttttaaaatacataggaatgtgctatgtgggtctccatttgtacttttgctccaggtcctgacaatttcagtcataggcctgagataataatttgaataacggacttattgaaggcttagtgaatgtcctctgtgtgttggatatcatgcagactgcttggcatgtactatttttttaagttcagataacaattctttgaggtaggaataatgtgtgtacatattttagagatgagtaaatgacattacaggagtagagtgatctaactaatgaatcttaccaaagaaaagcattcctgtgaaatctgtgtgactaaagggagggtagaaatagttgtcttccccagtttcctcttgctttgtctattttctttagagatgcccaggctggagtgcagtggctatccacaggcgtgatcatattgaactgcagccttgcactcgtgggctcaagtgcatctacctgcctcagcttctccagtagctggaactacaggtgcaggccactgtgcccagcttcctcctgtctctagccacactgtaatcacaaatcacaaaagttttcttaaattatattggtcccagaggaatagtaatgatatttgctacagtttcagtttccatctgtacttaaggaggaatagcacccaaactcagcaagcaacccagagctctagttcttgattctgcaaagtttttgttatagtaaaatcttttgttttgtcagtatgacttctttttggagtctgagttatgcatttgacatgaattcaagttcagttatcattcatctcctttgtatttacacaaatcaattaagtctaaactgcaaatagtttttgtctcaggttcacctctgataggctggtagcagctgtctggatagtcccgccaagaaggatcgagtagctgcatgtagatgcagtaagaaagagcacaattagaagaggagactggggatatgcctaccatgaatttcttatccgtaatcagtagagcccagcccttgtgcacagatatacaaacagtggcaatttttttttttgtccaccaaaggattattcaacaaggcacatacaacctatagagaggaagatgcctctctattcactcaaatacatagtttttttttttttgcatttccaattatctattgctaataatcttttcagtgcttacatatgtgcatgcctgtacacacacacacacacagacacatacacacatatatcctaaagtttgtgaaactatagtttgccttatggaaggaaaacacttgatcctattcacaggggtaatttttagacatctctattcataggtataaccagcttagaaaatttactgctgtattaagggtcagaatagcaactcacaggaaattgaacatttggagaacccaataggtaacttttaagagagaagtatttatgatatgaaggaacataaaagttttgtttttactccctttggttttcttctgtaattctagattgggaagaaataacagagagtgcttgaagaatagatgtggctaggacaatatctctgaatctctgaatggcccatggtggtgacccccagccagagtgaactgtgcagcagcaatggtgcccagtgggcagcaacagtggaacagaaggtgaggaaggggccagaaggaatcctttaggaaattaagaaaaggataaaaatatgataaaaatgtggtgtccaggcgagaaacggaataacctcatccctgttctgactaacaatttggtaatattttgacagttttgaacaagaacttccttctccttttcttttggagtacaccatagtgaaagacctatggtaaaaaacaaggtacaactggaatactgctttttgtttttctattttcaatagtatctcctgtttataatggattgttttaatctcagggaagaacatctgaggagatcaccgggtctctaaataccagttcttgtctctgcacaccttttttaggggggactgatgcctggttatatctgcggtacaccagttcctaaagcaatacctaagaaagtcaatgtttcctagataaacttgactttcatcaaatgatatttagaatcagttttaaacttgtagagtattgcaatcaattatgatcatattttgcagcatatatcatgaagtccaaatcattttagcttaaagaaaacagacgtctattattttttcacttagagtaagtcaggaagtgtgtagtcttatgtgttggctttccagtgtcatcaggggcccagattcctgtctttctgctctgccatctccaatgtgtggtttctaacctcatgatccaaagtgggttcttttgctccagcccgcgtatcaatgtaccaggccagtagaatgaagaaactaaggagagcaaaaggaggctccttcctaactgagtcaactttctttaagcatttgtcctgaaggtctcacacaatatttttgcatacgtctcacaggtcaaaacttagttatgtgtccacacaaaatttcagaagaggctggaaggtgttgtcttttagctgaatgcattatcatcctggaattcaaatctgggttctaatagtaagcgagaaagagagcgtggttattaagtggtgtcatttggcacagcctgtcaacagaggacatgttaattggcattcatactgatgttttaataaagcatgtagtgtgcttatgaggaccaagattgaccatactttggtcatcatcaatcatggactgaaaggcttttaaacatgaggtatgtaccgcctagcattcagtaacaacccacttagtcattcctaccttaattttaggtgcatgataccaaaatgttaacatatttgagaaacagtccaagctaatttaatttacgtaagtacatttttagataagacaatgataaatttgaaaatcagtttggtttaatgattggttagttaaaaatatatcaaataaataactttttctaccttagcatttttaaaattctggacctaaaattattacattctatttagggcaaggattagcaaaatacagcttacaggccaagtttgtcttgacttccttttttgtaaataaagtttttttgaaacacagttactctcatatggttacatattgtcagtggctgctttcactctatatcggcagaaccgagtaattgtattagatacccccaccactaaacccaatgtgtttactatctggattcatacagacaatgtttgctgacccctggcataggcaaagcaaaatacatgacacaatgaatttccctcatacttagaagttagggcccacagaactcacctgaaaagttgcttaatagttacttaattatatagcagattaatcagtttttaacttgattctgacgttcctaaagaatggcaaattccttcctaacacaaactaaacctttacctccgtggttctcaactggggtcaattgtgtctgccagagacatctggtaatatgtagagacctttttagttgtcacaagttggggttgggaggtggctgccactggcatttgataggcagaggccaggggtgctgccaaacgtcctacaatgcacaggaccgccactcaacacaaggaactatctggcacaaaagtcactagtgctaagactgagaaactccatggtaagtgagaactccctaggaccgaataggtagttgtcaataacaaaaaggaggaattactttccttaaaggtaaaaataattgtggcattcggtaaaaataattgtggcattctttcttggtggtggaggttttgctgtactccttccttgtttttattctccgaatgaaaacaccatttttatctgaattagtagctcaaagttttccattaatcacctcaaacggactgacacagtgtttcacacacaatgtcacgcatgctgtatgctaactcctgagttttgttctgagggagaaaaatgaattccatggccaaaagtactagaggaagaacactcatcatatcatcatctgggaggttcactgtttacctccaggatattaatggcactcagaagactggtggtgaagaaacctaggaactgtagaaatgtaaaacctgatgaggctgctatttgtagactaggtccagggaagatgtactaggtcagaggagaagatatcatggcagaatcttctaaacagtttttcatggatgacttattcatacatggtcctcagacatggtcctcagagtgaaaaataaaagaattcctaagtaaatgaatttggagattactaccttttacagagtttaacaagttcaattatagcaaaggcttttaaccctctttttctgtgtgtgataaatcccattggcagtcgcagatctcttctcaaattaatgtgatcaaatgcataaagcaaaatgtatagggtatcaaataaattgcattgaagtgtaattaacaaaacaaaaataaactggtgatatatgaatgtaagcatctctttattatcacattaaataataagatctagcagtaggtctactaactaccatacttttaaagtagtagtgagtacaaataatatttcaagacagctgcaataacggtgatgtgatatgaaaacatctgtcatttttgttggggacaaagtcacaagtactgccaatattactacagcttgttgtcttcattcaaacggaagaaaatgctaaatttcagtgaagtgaaaactaaggtttaaaccatcgtagagcctttaaaatgttatgttacttgtgagtttccagaagtaatggttgtgggacttgtttgaacttatttgaacatagaaactttaatatattttgaaaagataatttcacatgccatgtgggaaatgttgccttgagctagtgctgtacgcctgaaagcttctaatgtaatgatgcagtattgcatttataatcattgttttaagctagcgttttcaaatccagttcagctccatgataacagctgttgttttctttaccgatgtatttcactttcagatatgattttttaaaaatttctttgaacttcatacttttcttagcaaatatctccatttaaattctcagaatgaaaataaaaatgagttgtctcacacctctacacttagaaaatctaggctgcctgtggccctttgccctaacacgtgactcctgtatcatgtatgtataactcccttctaattaagcaacctcattcatcaagaaagccctgcagcgataaggtaatttttgccacaggaatgtgacactaccatgtgccagttgctgaaatagttgcacagattttagtgaaatgcaagagataagtgagtaagaaagtgaaaattgtcagcccataaattactgctgccctcagtctacagtaattacagcaaagctgtagataactgtccctctgatgaactctagcaaaatggtcttttaagtttatcagcatattcaggtacaactctctcaggaggcttggcctcttctaaatgatcaaatattctgagggtgggtggcagaaggacaaaagatgaggaaaaaggaaagagaaacattatttacatcaattaaagtaatttttaagtttattcttttaaaattatctagtagaagccttctttctcacttatgattcctttaaatgacacttgctattttaatgactattaaaatagtcattaaaatattaagtactaaatggtacttgctatttttattaatggatgccgaaagcagtcagggagctaattattatattgtgaaagtaaaaatatatatgaggctcatgtaaaacagttttgtttgtttcttttgattatttatttatttatttatttatttatttaaagacagtgtcttggctgggcgcggtggctcacgcctgtaatcccagcactttgggaggccaagttgcgtggatcacgaggtcaggagatcgagacaagcctggccaacatggtgaaactccgtctctactaaaattagctgggcgaggtagcatgtgcctgtaatcccacctactcaggaggctgaggcaggagaattgcttgaatcagggagtcggaggctgcagtcagctgagacggcaccattgcactccagccttgtgacagagtgagactccatctcaaaaaaaaaaaaaaaaaaaaagacagggtctcattctgttgcccaggctggagtgcagtggcataatctgggttcactgaagcctcaatttcctgggctaaagcaatcctcccacctaagccttcagagtagctgggactataggtctgtgccaacatgctcagctaattgttttgtttgttttctgtagagacggggtctcactatgttgcccatcctggtcttgaactactgggcttaagtgatcttcctgactcagcctcctaaagtgctgagattacagttgtgagccaccatgcctagcctcatgtaagtttagagctataaacttaaatgatgggtcatcagtcatattactttttttccttttcaacatttttattatctcaataatcttataaggtgtggaatctactattattcccattttataggttagtacaggtatcatcagttgaagtgtccttttcttttttttttttttttttgacacagtttcactctgtcacccaggctagagtacagtggtgccatcttggttcactgcaacctccaccccccgggttaaagtgattctcctgcctcagcctcccaagtagctgggattacaggcgcctgccactgcgcccggctaatttttgtatttttagtagagacgggtttcaccttcttggccaggctggtcttgaactcctgaccttgtgatccactcgccttggcctcccaaagtgctaggattacagacgtgagatgtccttttcactctcactgctagaaaatggtggtgccataatttggaaaaaaaaaaaaatcttctgcagatttggtaaaatgatcctgaaataatgtgaagccaaaaaaaaaaagtggatatgcagttgttctatgtttaaaactattaagcaaatatatacatatattcatttaaatatatatacatattttaatatatacatatatttaagtgtatatacatacttaaatatatatgtatgtagatgtgtgtttgtatatgtgtatatatattatatataaaatatatatatctaagtaaaaaagacaaattaaaaatactaaaaagacaacagtgctgattctagtctgaggagataataagtcatcatttcaacacttaaaattttatgtattgtcgaaattttctgcagtaggtaactatacttttattggcaggaagagaaattcttatgaaaaatgattgatattatatcttttaaaattgtaagaataagtaaattagtaaattccaaagttcaaacattaacttctattgataatagagttttaaaaattctttcaggaagatggagaaaaaagaagactgacaactctcccaagcagcaccatttccaaaaacatttacaagatagtggatgtggtggtgacaactgaggaaagagcacagagacaaaatcagaagcttgttgaactccttctctctctcctaccaacctggaacagagggcttttatatagaatttcaagtgctgtcctttacccctttgttaactcattctaagcatgaagacaagcactcttggaatgatcatttaaaacagtcactgccctttcatgatagcctcctcagaccttgccagcttgaacaataaattacaaatcatttttttgctgctattgctgaggtatagctttcaatattatcactgatttaagagttgatgtattttgaaaagtcagactaatatggcagcatttcggatgaggcctcttttgtgtgtctgctttattcctttgttggagttccacattttctttgtgtgggaccgaggaatcatggaaaattgccacttgtgtgataaattactgttttcacccatcaaacatagaaaatgctccatgtgagccttgcacaccattatgttgtcccatctaggaccctttgaaagtcagcagggtgcatctggctgaaattcagtcaggcgattaaatttattcaagcttggtgaacttgagagctttcaaaagaagagtagctgaagggatgagattatagtcctgacagggctctggaaagggtgtctgacacctgacggctcacagcgagccatggtacctgttcccattgatttgcaacaaagtctttctcaataagtatttccacttaacatttcctctcagggaacctgtgccgttgaagatatttacaagttgctttcagcttaaaaataaatcacctctaattcctctaagcgaaatcaatcaaaaacctgtaaaaaatggactggttgtttggtcgattctggcagaaaagtaaacagcacttcagcttttctccgccattaaggcctaaatggcctagaaagtaaatcaatatttctagtcagccttctggctattgtttagccagtagatatggatttctctggcttactgaactcctttgggactagcctataatcctctgagaggaataataagttcgttatctagttcagctctctgttgtacatttaaatggactacatccatcagcagcccttgttaaagttaaagggtgagggcatcccattcaaccccctttagagtgagacacttccaacacagtgagggggaaattataattcaaagttctactggttggcaaatggcctaaaaaccctaagtaagggtgaggcagtaatttgagtatgaggaggcatatcatactgctgtttcaagctaggaaatgctacttgcccatttctgagtatactatgatacatacataagggtatttgctagagagtctctcattattcctactagtccttcttgaatgtttttatttaaatactcctgtgattctgaacagtaaaagctatcagaactttcctgatgtagcaaaccaacatgcttccacctctccttgtcagcaaatggagaatctcatacttctactaattttactttaataatttaaaaatgactgtactaacagcttggcaatgcagtttttgagggttttagaagataagaatcctggataaaagaccattccttgaagaaattaatttccccttgcctttcaacttgataaactaaaattctcctttaaattccatccatgtattctggcttcatatgaagaagtgataatgtaggaataatttattttgagctattttatacacttaatttttatattattttgttgatttcttaacaagagccacaaagacaaaaatgaattatgattacttgaaactttcaaatgtaggtatttatggtatccaagacatttctttaacaaaacaaaaacaatagtgtttccaaaggtcccaggtgtctcttattaagtcttggcatgtatttcatttagagattgttttcataattttttaaagtaaaattatcacaacagaattaataaagggaaatataattatttagataaaatagtcacaatagaatttagaaggtagaatatgtatgcaacatatactcatttaggaatgaaagttattatattaatgcctaatattgagctagcctatgaagctgacttgttctgtagagatttttactgctgccttcttcaaggactcacctcttcaattgccagaaagtttgttttagagagaatacttaattatttggaaatcttttatggggaaaaattaaattcagtaaaaatcaacctaaaagtttgtattcaatttgatacgtttgttaactacacttgctagaggtattttgtgattaaataataactttaccgattattaatgccacattaaattcacttttaagaattcagttaacaactatttttgcatggaaatgtagaattttatctattttggtttttgctgtattttgaagaagtctatgctgagaatctgactgtgacagattttgctcctcataagccaagtcaactttctcactatcacctttcatattctccaacttatttgatggctgatgttcttcccaggaggagataaaaaggtgacttgaatgataagggaggccagacatggtggcttatgcctgtaatcccagattttgagaggctgaggcaggtggatcgcttgagcccaggcaagaccagcctaagcaacatggccggtctacaaaagaaaaaaaaataaaaaaaaaaaaaggaaaaattagcccggtgtggtggcagatgcctatagtcccatagtcccagctactcaggaagctgaggtgagaggatcacttgagcctggcaggttgaggctgcagtaatcacaccactgaactctggcctgggcaacagaatgagaccctgtgtcaggaaaaataaaagaaagaatggtaaagacaaagggctcttctccgtcttttagatatattgacacttgattttcatacttttaattcttcagtagtgttcacatgcttaaagttaaaataaatgcaaaatgctcactgtattctcattctaaaattgcgttggaatgatataatattgagagactttactaatcatatgaaatgagaatcagatagaaatgatagaatttatttgcaaaattgagttgatttttcatgtttgattatacttcaacatccctattaaagttttacttaaatggtgtgaaaatttacataagaactataactcttagtacatttataatatacatttcatgtgttttccaaaacaatttggaaatcaggttatgtctgcataacctgacaataccaaaatgtatctatctcttacttgtcaggaaacatttcttaccaactgacttggaggtatgaatgcatgtaaattttctctgtattagcttcatttttattctgatgtttgagaaacactaacatatatagagaaatattattatatcaataaggtttaatttgccagtcaaaacctttcaagattataaggttatagcctttatctgggagttgtcagtactggatgaggttgccaacacaaaaaggtagtgagaatctagttgtttattttgttttgtattgcgttaacatgatataatcacttttctgagaaacataagttatttctgcatcctcataattatcagtgaatggaacgtactatttattcaacacatgattgttaaaagaacatataaataaatgaatatgtaaatgaatatatatgactataaattaagactactattttgtttctgcagcagaagcttagacaatttattaatgtgtgtccctggggtcttaccagggcatgcagtggcattgacagaatgaattaactgagtgaagctgttttggtgctgttgtctaaactcagaaagtggagagtagttgacaacaaaagagtttggtcaaatcctattggaaattccaaatcccattcgcaaaaagtggctataacaaacaattacaatgaataaaataagaatttgatcagtcacattcgactgactagaagacatttattctatataccaagatagctttggaataagaatttctctaacatcctttcacataggagataaaacttctacagaaatagctctgtgctacatcaaaagcatttcagggaagggctcagccaattataacctgagggccaaaacagacctgttttttgtttttgtttttttttttttgagacggagtctcgctatcgcccaggctggagtgcagtggcacgatctcggctcactgcaagctctgccccctggggttcacgccattctcctgcctcagcctcccgcgtagctgggactacaggcgcccgccaccttgccaggctaattttttgtatttttagtagagacggggtttcaccgtgtaagccaggatggtctcgatctcctgacctcgtgatccgcccgcctcggcctcccaaagtgctgggattacaggcgtgagccaccgcgcccggtcaacagacctgtttttatacagcttgtgtatgtgtaactgatttgatgacaacgaacaccaattttgaaccactattaagcaaaatgttacttccccaaaacaaataaccatctttctcattagtataccatatgatttaaaaaagcactcaatattatatttttaatgttattaatgcatactatgtagaaatttattctttcttttgatgtaataatctacataaatatctttaattttgcatcttggactgcaaagtatgagaattcattatctggcctttacaggaaaagtttgccaatcccagtgccagtgtatcacactgctctcgaaggatcatgaaatatttacattgctaatttagctgatacaacatctttaggcctttatcttctcttccttcatctcaccatctatttaactatcttattaatccaccttggttagagaaccctcaaggataatgtttttatagtgtctaacgatttctttgttctaaatctgaacgagaaactctgtgtctactatttggtctagaaaaaccataagcaacctctctgaactgatgttacatataacatgaagattgtgtatatcaccttagagccatgcaactaagaacaacatgagtctggtgacacagatccaatctgaggggagctagctggacatggctgtatggtgaatttttaaaaagaaaaaaaaaaagtaagcacttagttcagttcatttctttttatcttaaatagcacaaaattatccttttgtcatttaattcacagtggtatctagaaatcagtgatggaaaagatcaattaggtcatttagctcctttccaaggttccaattttctctttcagcatattaacttttgcctgtccaaatttaagtgactaaagagatgggtttccacaacttacttgggagatatttctaaatcaaatttatctgtaccaaagcatcgttaaagactttgctattagagttatactaaattgttctctgcttaattgcatctcatttttccttcattcctcttggctactcaaagcaaactttgtttttctttgaatagatttattttagaccagctcatcctcatatattattgacaaagaatatatcattaattgtttctgttcattacatgaattgttgcttaaatatttttgttcttttgctcagaaaccacagtggaaaggaggccactttgtattaaaaataacaatatttcataggaaattctcttaaattcatcaagggatccagtggctgtgcataaccttttctagcttcaacccatcgaacatgaatgccatgtaagttgttgttatatcttcacctttcttcctgctattcatttccccatcaatgaccattttttttttattttctgaaacttcaatcacattaagcttttcttttttctgccataaaacatggctcccatacccctcattgattaagtctaactcaagatattctaaggatgctaggttcaacagcatattgttctcttcttcctgcccaattgatggatatcctgtaacacaatcttgaatccaaaaatgagctgattaaagaagtattaagaaaatccatatatatgactaagtcaatccatcagtgttttgctcagtagggtcaacttttctgtatgtagaaaataccactgccaggagatagtaatgaactacgacctctgagagtgttgcaacaggaactaacaacaaggaaacttttgctattagagcaaatagactcctaatcaacatattatcgatccttcatttttgtcaaggttattttgtgctttaaaaaatgatcctacagcaaggctttaataggaaaagtagactaatttgatttaaagagtaaatgctattaattatgaaagacagtcaataaaaagcttgttcttccaaacataaaggcaaatcttatagtgcctttgatttatggtaatgaatacaatgatgaaatattttgactagtatctcttactctcaccctaccttttgctgtttttcttgctcacacattagaaatacttaaaataatctcttccaagccatttttggaacaaaataatttttataatttagtaaatatactttttaaatagataaacctgttacacaatattttgatattatttccagaagaaatgtaacaaaaaggaaaaatttcattttatgtttaaagatatgggtaaacatttatagttgcttattataagttgatgttcaaacaccatatagtgatgagatttaaacaagaattttagcattctaaaatccagataagtaaaaaatttcagagaactaccatgtttaaatgatatattactatatgtaaaaatatgtgcaaataccaaacatgtaatattctgtattctgacatattaaatctgttaaagccatttttaggttccattaatttattattcacattattttatctgaaagaaattaagatatacattatttcacaataataaaaaacagtgaatttaagaaaaaattcttgaacatctatatataacctattggattactagtttctctaagaaaaagggttaatgctttatttccctaaaatgatctaattatatgcattgcaagttattttatgtctcacttcaataaggtaaaatttattggttataaattatacatttgaaggactgctttcaatataactttcctcattatgagtcatcaatatatgaattgtttagtcttctagactgtaattatatgactatatcactggagaatggtagggcaggttaaccttacatgttggttaggatgagatttccttctgttatgaaagggtatatttataggttaggaattaatatattttaaatatattaactgtgaatagatgcaaagtctgttacctgaaaaatttcacatttttttctaaattttactgaagatttgtttatttgatacaacaattaatttcaaggtgaaataaagtagcatatcttgtaagaaacaagaggcacagtagcctagccttgcatagtgactaaattatcaaaacttacatggaacaaatagtttgggccattcatttaattactaacagattatattttctacaaaaagaaagctgtgttggcttaccatcagggactccattaattttagattcatatcagtctttgttagaccttacatactgagatttaatgcaaagatgatactcaagttcacctcaaagctgaaaactccacatctgtgtggccatggaccaaaaggctgttttgagcttggatttgttgatgggcttcttcaaaaagcatgatattcaacaaccttaatgacatgtaggttaaagcagatggcatatttaaacagaaccagtatttatttttaaaattgctataagcagtatgttttaaagtgctctggacacatttcacaccagggtgacaatatgcttcaatccacaccaagctctcttttagctaaagctgccatgctatgtgactatctactgagtttatagagtaataaaactctgaagactgaagccagatctctgaataaaagaggcagaatagttgctgtagtctctgtatcttactaattcagaggaagacgaatttctaactttgaataaggttgagaagatggctacgatttcatttccatggtttttattacaaaaattatgttatatggaaatattgaagagattaaattattccggtcaataagtttttcaagctttctgggagagagagagagagagaaatttacatacagaagaaattgcggggcatgaaaatctgctaagggttacatgttttctcgcaattttacataggtagacaggacatgatctaaatgttcttgaagatagaaaattagattattagtatgaataattgtgttgtactatatgaagagctaaagttacaaataccagtttcactagtacaagaccgggcaggggataagaattgtgagtgcgctgacctgtgggagtttgccgttctctgtttaagcgtagtggttggcctactgttaacatgtggactattttaggagaatagaagtactagtgcatatttgcacctttccctttttccatagtccagttgttagaaatattctgtaagtatattctcaggttctactgtggaaagtgagttcttttcttctttactccttttaagatagtaaagatcacctctctgagagtctagaactgctgtgtccttctagtcaaaaagttgctttgttcattgcgtttcttcattgctcattttctttagccttacagagtctctttaccacttctatcactatgtgtgacctgcatgttcaccaccagggtccagtggacacttctttgtcatatatttctccttttgattacttatttttcacttttgtttggttacgttttgtttcatgttgcttctcttgtacttcttagctttcatgcaaaaaaaagtggattgtgcttgttaggtaatttaagcatttttcattatgaatgctttcttatgtcaagtatagtatttgggttttctccttttagataaattaattgttcccgggtgctcaacaattcggctttattttcaaggaactgggagtcttctcttttgtttgttatttcaaaatgaatagtggtacaaaacagtggtgcaaaaaatagtgttgcaaaaaatctgatttcagatggccacaattttactgaaatatctgaacactcagcatcaatataaacattggaatcacttcaaaggatgttttacgcattggagaaatgcaagatagataaatgctcacctattgcaactatctaaatatctactttgatctcatcctcttgaatgatttcgatcaatggtaatgactgggtgaagagaataaagataggaaaaatgaagaaatgccaagttttacagtagccattgtgaaacattatgttaaaccacatttaccaataaataaatggtcttctatgtttccttgagctgaggccttgagactgtccttgtgaatacaaaatgaaaattagaaaaacagacactttataatgaacatcagtaggatctgtatatggtactaaaggcataattcattcaaaaggctgagcaactgacaatcaatgctttgagcacaaattcacattatgattttgacaaattcacactatcattttcaaaagaaatagcgaggcaaagctataaaattcttttataaaaaagaaaacttactgggatgtgtgaaggcaaaatcttggactctgtttttattatcattttgctcttccaaaatgagcaaatcatctacagaagtaaaagatttagtagtaactttattctgatgagctagaatgagagtagagccagaatagagattagaagctcatcaaggggatggaatcagagtgaacagttgttggcatttgttatctggagtcatctatgaagtaatatgagctcaggatgctaacacatggtctatgactaaaaaaaaaaagttgcagaaacaagagggaggcaagatattgacttgcagaaggttatgattttgaaattcattaaggttttcaggttggttgtgggcccagactaatgcttaggaaagatctaggggctgctcgaatgcaaccccaacaagttatgtgcctgtaaaatttgcagatctgaatatctcacatttacaacccgcagacgtgaagagaaagtatagtgaaattagtaagagatttggactcaagagatatgagttcaggagtttcctcggcgacttagaaaacatatgtatccgagttgaatttttaacttctccaacgctcattttctgattggcaaaatggcaataccactattaccaccatcattactactactagaataaaagtggtctaaagctattgagaatatatcaaaaatatatttgaaagcatttggtacagaaaacaaaatgttagtattcattattataaatatataataatggttaaatagccacaactttttgtatatggagctatttatgtgagaaaaataacttaccatatttgagttttcagttattttataatcaatagctccagttaatgccctaaaacctaaatattagtgagacagaagtatgtaacttgtttgatattagttaaatttagaaaaattatattttattaataacaatacttacaaagccattcatcctgaaacaatagtacctataatacaaataacccttaactaattttataactaagtgctaagattaaaggaaaaaaatgtgaattgattactatgtatagtgactgtcctatatatttacttgtataaaaaagcaagttttgattttagcctgagataaaagaaaacttagagttgatagtactttaattgagaaagactatgggatgacatccaaattatgtgtttctagaatggcaatgaaaatctacttcaacagggtgttctttgaaaaagtcattcctcttgaagttctcaaaaagagacagaatagggaacagactattctgaagcctttgaatctaacaaaatgacaaaatgaaagttttttttaaacagtcttcatagactgccagatttttctcttttgatagaagagatacacgaaggacaatattaacaagaaatttagaatattacaaaaaacaccataaattttgacgataagaatattttcaaattattttaaaagaagttctaaagtatttaacagactatccataaaaaagcatttgtatgctgaagtgcgtgtaaaaatagttactaaaaatccattttgaagcatcatataaatctcttcaattaaattgcaaatcaaagaggaaaacaccctttatggtctcctttagagtaaggaccatgatttcatttccttgtgactctcagtaatgccaaacataatgcatgttcagtaaatagtcagaataacccacagacttccttacattatgtttaataatttgtgactcctagagaagttaagcagtgattcctcagagaaatcactgagctaatccaataaaaattcgagtatttcaggtctcttctgctgtttctacactagccaagtacaagtatatactctggcatttggacatatacttgtgcctctacagaaagcaccatattctccagagatctggcaagtaacagacttcatcttgccagtgtagaaatagcattagagcaagactaattgctggaaagcctgttcagaaagatttgtcattcaggatggtaaaaataatcctgcttttcagcgtacattcaaacttttttttatttccagtatttaatggagatcaaaacattaccatttccacaagtgaatgcgttttatgtaatgcagctatttcctttgatttgagttcaagcagaaaggctaaaatgaaaaaaaaaattctgtctagacgtatcatgtttgtttcttgtgtgagatgaaatttattaatcctgaaatgtggcttaaggacatatttatatgtgttataagtatcttattgaaaaacagaaatgccaagagggagagacctcttagatatacccttgaaaacatagtcaagtttaagcaggtcacattcagtggggggtccagagatttatattcagggaatctaccgagctatccttgactgcctccccactcaatttgctgtcctgtactagatatgttgtcttgttgactacaaaatcaccaccaaatatgtctgcttatagtagcagcagccaacaccttgcatgactttattaacctgattctgccagtgacaacatctctaataaaatccaatgtctctgattattttaacttttggctcaaggtttccacttttaaaagaatattacctactagattttcaatcataatccaaaatgtcttccattgtgcatggccaaattgccatagtcttatctaaacagttcagatcaagccaatttcttaactctcaacctttaatagtaatgtgaacatagctgttggatttctagcaccttgttcccttatctaccatctcataagcctgagaaagcatatctgtgatttgtaacacaagagagccaacataaccacagtaaataaaagagaaacatgttatgatgttaagccagtgcactgcttggcatgcattaagttcactgtagctgaaaaaataactgtgaggctctatatcccattaacactgtgttaattattgtcattgtctcatcaatgttttgtttatgacagctctggctgacaggaatagtgggatgttctgtcaaggccatcacctgatgagattttattggcaaaagatctttcttccctttactatgttaggggtatcagtgcttcattaactctaaacataatcgcttgcaataggcccagtttttaaatgtttcaaataattgatataatagtccctttccagcattatagttaaccaattcaccctctaaaaatgagagacatccctcaatctctctcaactcaaaagaccactcaatggcagtcaaatatgaaaggaaaatactgtctcactggggaagactttttaatacggataggatgttttattcctttatgtatgatacctgtgaataaagaaagcctccatagaggaggaaatctatctcaagaaaaaaataaaacacaataatttgtacacacacacacacacacacacacccgctattcagctatgatgaatcattgccctctcccttttaaatcttgctcaatgagagggctgtggggtactacagattcttgggcaggggctaataattaccattctctttttaattatttatttctatatatagaaatagattatatgagatagatctatttcatttcatatatgacactcaatccttattttttaaaagaaagaaggaagattgcatcattcttaccattaaactgtcttatcacagcttagctatttctgtaagtgaaaatatttcaagctaaatgaaagttccctgcaatttcaaattcacagaataattctaatttaatgataaagatgatactcctacccatatcaatgcctaattttaattccaggaacatagtttcttactaacattgcttttgcttttttttccttattgactgctaatacaattctttatgacactgggtgtgcgctctagtctacaatttaggaattgcatattttaaaaatgactcagtttcctcacttatgtcattagagtcaaatttgctactctgtttaacctgcaatactgttatgacaatatgaaatttatgagtatgacagtatgtaaaaatagctatcaaaatgtgaaaagttattatctatagcactgacctgaaccataagtaggtactataagagtgatcattaattttatgtgtcaatttggtaagggtatgatacccagtttggccacataccagtctagatgttgctgtgaagatgttttatagatatgattaacatgtaaatcagtagattttgaataaagcagataatcctccctaacataggcgggccttcatctaatcaggtgaaagccttaagaaaagagatcaaaggctccagactgtaacctgaaaattctgtctgagttcctagcctttggactatgcactgcaacatcaattcttagaggaatttctagccagctgtcttgccctgcagttttcggacatttcagctccacaatagcatgatccaattccttaaaataaaccttgccttctttctctctctgtgtatcattctcaaccccatctatctgtatatgtatatacatacatagatacacacacattctattggttctgcttctctggagaatactaatacagtgtttgttagaagaaattacatatatatacatacccctcccataaattgaacacagactctctcttttaatttaaaaaaaaaagcctgatattctggaacaggatgttctctctgtatcagaatcagtttctgctcctagacagcagtcaagttctgccagtagataccagcccctccttcctctagcttatacaggcatgagagtaattaatcctcatgcttattggagtttagtttggctttggcacagtatgctttccctagcaaaccataattgattctgaataattgatcagcaacgaacattcaattttctttatcttctcttcctctcattctcctatgatatatgttttctttggggaaccattttccattttaaaaaaaaccccaaatgcaaggccttttagtgatcaaatcaattcatgctgctttctgccaattcgcatcaactccaatgcaactcctgttggagaactcttagggaaccctaattagtgtcccattgtatccattagttttcaataaggaagtaaacttcttatgtaaaaacctcggaaactatttacatgtgactgctttgccatttatcaaccaccacactagcttgcttttttcaaaaatcctttgatgaggactgttattgaaaccactaaaccctacatgagtcatggaatctggctagacaaagacacctaaaatcagaacctgtgatactcatctaagctttgttaattcacctaaggatgatgtccctcacttttctcttatgtaaaagtaagattataatgataccccacttaaataattattataattccttaggcaccagaataaaacctcttagcaaaacagaagtaaaaagttctttgaggaaagtagtcttcaaaaagtcaaggcattttatcacatcaaagagaagtgggtcactttcaggccaaaggcatgcttagtgtaaggtgcaaaattaagcttacttatttagtgaggttggatatctactttcttctaataatcaaacatagatggatactagatgaaaagtaacagaatgtgagaaactgttggatgctgatattttgagatgaatcatacatatgtctcggatatccccatttaacctcctattcaatttagatgcaatgcccttttatttctttcaacctctgaaacaagaaatgttatcatgaccttttttttattgaatattatgctgttacatacacacctttccaactctcgtgggagtcaaatgcttagaagaacaaatctacaagtggactttctctcattgtccattctacccaacagcaaattagatgcacactcaactgcctaccctgctatacactgttccttaaaacaaattataactcagcatcccatttaatccagttgcatgaaattaacatttaccgagtagccactctgtgccagaatctaagcctaattatggaaatagagctgcagcctcgttttgaaacaaaacttcccaaggccatggtctctagtcactttctgcatcacctcatcttgcttctcactcaatccctcccttcagtcccctcctctataccagaagtgttcttttctgctctgcttgtcttactgggccttcaccactgtgtcttcttgaattgctcctcctgctcatgtctgggaacctacactctctgcttttccttgtctttcgttggctgctcttcttctacttccttagtcactcccacttctcacctcagccattaaacactaatgaaacccaagcttcagaccagtgctgtgtccccatcctctccctggttaatctctgggtaatctcatatagtgctactgctgaaagcatcacatagaacttgatcatttccagatttatatctaaaatttcaaactccaataggatactagattccaccatttagagctcatatttaatatatctaaattgaaattcttgatttccacatttcaaattattctgcctcaagtttctcaagactagaaattgtgtacagtgttgcatatgtggataactgagacataatctagtcaacagaagaatgggtaatattcttctacataaccttgtcagtatcattctcatgattttttaaaaaaataaattacagtaaagagtatcagctggggaatcacaagaacctgctttttaaatacagaatctaccatgttattagctttttaataagttacttaatcttatgacttctgaaataattcatgacaagctacttaatctctataaatgtcagttccctcaactgttaaatttggataataatagccattatgaaatcagcttgtagtaagaattaaatgagataggcttcttaaaggatataatcagattttatgcattcattttttcttttactcatttaagaaatctgtataatgaatctaacatgtttcattctaggtgttgaggatgcagaaacaatcaagacagacaaggttctagccacccttgagctataaccaagttggagaaaaaagtcagcatgcaagtaaacaataatcattcaagctatataggttgtgcctcatgaaacaaaaggactttgtatgtgagagagtaatggaaaccaggcacagcttttaagagatgatgtctagaatgggacctaaagaagaaggagctctccatgcaaaaatataagaaaagcccattctaagcgagagacatcaggaaggacaaaggaaccgaggcaggaaagagtttggtgtcttttaggaatagatgagaatccaatcttgggctaatgaagcaacacaagattcgcaacagcagggagttgctactatctttagcttgaaggagaaaaaggaggaggttgtattaccagagcccaggggtggagtgacccagcataacatagaatcttagttggtatattcaagagaagttggatccaaagaagagatacagccattattagagatgctgccccagagggagaaggagagataccttgaaaatttcccttaatccctccattcgttatatcaccaatgacttccagtgactgaaccaaatcagatgccagatgacacaatagcctagcaaatgcagtctaagaattcaatctccaacacacccagtagaaagagcaaagggtaagaaattgacttgagagcaagttggctcagaacagtagacccttaaattcattaagggtcaactactttaatactttgggaaaataatcccactatgcagggaaagaggatgaattttaaaatgtcatattttaggtatataaagaaaaatcctgcctgaccctgatataaagaaatgaagatattagaaaaaagtgttggctctacatgtccaggtactactgatcacgacagcacttacaggctctaaatggttaacttcctgaaaagtggctgttatatggaaaaccataaaacaatcattggtgatccttgtttctatttaaaaaaacatgctcttaggttcaagtagactgacccactttaggactatctatccctagggatcttgtaaaatgcagagaatgagaaaaacctttagaagatgctaaactctccgcttttaagctaactagcatgttgaacaatttatttgtacaatatgagatatgaccatattgcatctcatcttatggaattactcaagttatatacaattttctcaagtgctattgctagtctggatgtaggagtgaagagaataaattgagggcttgatctatgtttggggttttcagagaagacatagaaatgaaagaagaacagattggttgagaatataatcaagtgattatgggttctgtattgagcagataatttagtccaagaagatgcttatagttatgaaagaaaattcaggatcaagtacatgaggtctatagaaggtcaaacagtagttaagaaggagtgaagaagtgtgagagctaaaggatgtaaagtagaagtcagaaagtgagggcaatgaggcattctagtgcatgaatgtgacagggagcagctgaagagaatggaagtgatagttctagttcaacggttccaggaactgccatgttagggagttagaaagttgcccacatggatttgaaatttgtccttaatttattcatcaaatgtagttagtgctattatgtctattgttcaacgttgctgagtaacaaacaacctcaaaaatcctatcggcttccaataacattgtgtctcgtgcttatcagactgtggtttgactattttcagttgatctaggctggaccatgttgctccacggtgtgagactggagaactttgctccaggatttcagtcttttctatgtgtgtttattttagagggcaggctgatggagaagaagctacctgggtatgctcttcttattgagagtgacagtacaggaggcaaaagcctaaccacacaagcaaattaaaacctcaactcacttcatagctgctaaaatttcgttggccaaaacaattcatgttttattaaaataaactgaaaactgaaattaataagaggtttttcttttctaatgagttgtattataaaatcatacggcaaaatctttggttaagacagagtaaatatttcaaatgaagatgcaataagaatgaagacaaatgctgtaaatcatgtgcttcagtggactttgagactcttggcaagtgaatggaagtcaacagagatcagcaacaagagagatagaatagacagaactagggactaatgttcaaaaaaaaccatgatcctctccatgcccctacacagaagaccttagaagaataacagtctggatagggcataaggcagtgaaaaacagaaactaccctcccccaatcctcacaaaccataaatagcaggttgtgggggcatactgataattactagtcattagaagctaactgtggaacacacactgtaagaagacaaaacatattttatcaaacacagttatgaagaaaaaacatggtggctcctgacaaagtaggcacatccctctttcacggtttaatgatcaattactcagttgaagttttggtctctgaggatatcagagtaagtgtgattgattgggattttatagaacttgtcattaataaaccctaggtgttggaggcaggaaaaacgcccatagcctggttaattatcatggaagtacttcggatttttgtcttggagggagtaagaacagaataaggacatttctgaaatcaataagcaattgtttatgtgaccggtatggttctagcaatatggggaatacagaaggcttgtaagacaaagcaatcattttcacagggtaaaattaaccacaatattaatgctacctgattgtaggctgaactggaaaagtctgaataatttatatattgaggtgcaggcaaaatgccattggaggatacatttaacaaccttccaaatacatagaacaattgccatttctaagttatgttataatcctattcttctagctcactgattcttctaaatttcaaatatagtattttaaatttcatatttttggttctttacttgataatgaatccaagctttaaaaacaagctaaaaaatgagtaaatacagttggcccttgaacaacatgaggttgaactgcatgggtctacttgtacgtggattttttttcaacaaatatattgtaaaacttattgaagatttgggacaatttgaaaaaactcacagatgagccctataacctagaaatatggaaaaacatgaagaaaaagttagatatgtcatgagcgcataaaagatatgtagatgctagtttagtttatcatttactaccataaagtatacatacatttattattaaaagtgaaaatgtattgaaacatacacacacgaacacttgcaaacaatacatggcaccatttgcagctgagagaaatgtaaacaaacataaagatccagtagcaaatcggacttgcataaaattaactgtagtacataaggtactactgaaataattttgtcactatctcttattgccattgtggtgggctcaagtgttgtgagtatctgcttaaaactccacgtgatgctaatcatcccgagggagcagttcctttctctagtaaattccgtagcacagtaaaaagccatcattctcagtccttgtgtacttttcatcgtgtttagcgcaataccataaaccttgaataatatcatgagacccacatgaaatgctactaaggatgcttgatgtgttcctgagaagcagaaaaatgtcacgacattaaagaaaaagttgaggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgctgtggcgggcgcctgtagtcccagctactcgggaggctgaggcaggagaatggcgtgaacccgggaagcggagcttgcagtgagccgagattgcgccactgcagtccgcagtctggcctgggcgacagagcgagactccgtctcaaaaaaaaaaaaaaaaaaaaaaaaaaaagttgaattgtttgatatgtaccgtagattgaagtctgcagttgtgtttgtccccatttcagacaaaaacgattcatcttataaacagacaagtactgtaaatgtattttctcctccttatgattttcttaataacactatcttttctctagcttaccttgttgtaagaaaacagtgtagtagtacacacaacatacaaaatatgtgtaaatcaactgtttatgttatcagtaaggcttctacttaacaacaggctattaacagttaaatttgggagggattcaaaagttaaagatagatttttgactgtgtaggaagttggtatccctaactcttgcaatgttgaagggtcaactataagccaaaacactctgataccacaactaacaaaatctgtattcacactcaaatgtctcaggtattcttccatcaatttttctgaccttttaattacactaaatatatatatatacacatatatatacatatacatgcacacatgtatatatatactctttttataatcttccttcagataagcttaacacattttaaaattttaatatagttgtatatttttataaagtctggttctgtgtaactttctattcatttttctccaaattcatctcatgtgtatattcattctatttctaaaccttttgctattcctatctctaagacatttttattcagcaagacacatctaaaatagattttatctgcattcacttatataaccaaacgtatttatatttccaagcacatttctttcaagaattatttaacatttatccattgttaatatgttttcaaatgtcaaatcttgtatatgacaaaaggtatgactgaataaatctggctacataaaaacgttaaaatgactgtaacactaaaagtacacatatatgtgcacatacgtatcccacaaataaaattaaaagaaatttgacaaaatgagtaaatagttaccacatctgagctacataaatatctttaagataaaaagagctctgaggaatcaatgatattttaaaaattgtatcaaatcaaaatgataaaagataagactagataacccacagaaaaatgaaaatgtgttgaatttctattgaaatataaatatatacaattttattaaagtgaatgcctctacagatggtcccaacctatgctcgtttgacttaaaatgattgttttgactttacaatggtgtgaaggtgatacacattcaatagaaaccttacttgaagtcttgaattttgctcttctcccgggttagtgatatgcaatacccctgagatgctgcgcagtggcaggtttctgcagctcccagtcagccacaccatcgggagggtaaacaaccagtactgtagtctacagtgtatggtattcaatatattgcatgagatattcaacaccgttataaaataagctttgtgttcgatgattttcccaactgttaatgtaagtgttctgagtgcgtctaagttaggctagactaacctataatgtttggtcagttcgatgtattaagtgcactgtttatttatttgacattttgttgtagttttcaagttacaatggatttgtcaggacgtaaacccattgtaagtcaaggagcatttgtatcttctaatggccaaaatatttttctttaataagttggtaatggcccagatacgggagtaaagaactataaattaatataaaatctctggagaatgtctgacaacaaacatcaaaatatttaaagtgtattatttaacaagtcttatggtaatcagagttctgggttcaaattgttggtctaccacttggttgctatgtaatctcagtaatttattttactccatgagttttagcttaaattcctgcataataggatcataacaaccatctttcaaggtggctgtaagataaacagtataatacacacatcttaacacattttctgacaatgataactgttcttcagacaaaaacttctatcctaatagtttctcatctttctcccctacctctttcttttttttctggaaataattatagatacaaagaaagctctgtatacaaagatgttaaccaaagtatcatctctaacagtaaaatataggggcattggtttaatacattatgtcatattaatatagtagaataatatgtgaccatttaaaccatgttatagaaaaattaatgagattgtttagtaaaatgcttaagtgatattgatataccagaaaatcaagttgtataagtaataagtgttttattatcacaattttgtttacttgtgtggttatgcccttataaagggcaggtatttctgtgtatgggtcatgcatgagcatgatatgatgtatatgcatgtgtgattgtgtatgtgtatgcataggcacagagaaagaccagaagtctataaacattcacctattcagaaaaaatttgctgaattgctgctataaagcagataccatactaacttctggtgataaaaagtaagagaagacaaacacaaatttgtacagcaaacaatatattgggaagctagatgttgttagaataatctctaaaatagatttcaaattctgattgggataatgctacaaagggacaatgtgatgtggaagaatgtaacaggcacattgacttttgaaagcaggtcagaattccctgctcaagacccagttgaactgaaatctgcaaaaagtgcaagacatacatagcaaaaaggggaggaaagagagcccggggaaaggagcaaaggaatttggtgtggctttaatagatgagcctgaggctcagggagtctggaaaggcaggtgacagatcaaaccaggtttaaaatacactgttaaggagagttgaggaggtgatcgtataagaaaaatgatcagagatctgttaggaaaacatcactttaactatagactgagggagagcaaaagtcagcgaggaaggccaggcacggtggctcacgcctgtaatcccagaactttgagaagctgagggaagtggatcacctgaggtcaggagttcgagaccagcctggccaacacagcaaaaccccatctctactaaaagtacaaaaattagaaggcgtgatggtgcgtgcctgtaatcccagctactcaggaggctgagacaggagaatcgcttgaacccaggaggcagaggttgcagtgaactgagatcatgccattgcactgcagcccaggtgacagagcaagactccagctcaaaaaaaaaaaaaagtcagtgagatgaggagtaccgtgaagtcatttgagtaattcaagtgagagatgacagcagcctggactaggatggagtgaaatggaatgaagtgatggatttaggagctacttacagggcaaaactaaagtgatatagcaatggattggatatggagagtgcaacatggagaaaataataatatcaaccacacaaggacatgagaatgaaaaaaacaatacgccatttcagcatcccagatggggccaggcacagaaacagactgatgttgagtgagaagcagctgatgaagatgacatagaacttttacttgcataacaaaatggatagcattgccattcatggagatgggagatagggaacactattaattttgagggggacagtcataaattcagttttacatgtaaaaatttaaattattttcaaaatattcaagaggagatgccaatgtggtagttgggaaaatgagcctggatctcagaggagaggtctgggttgtatataaaagttacgaggttacatatgtggtcaataaagctaaaggtgaaagggcctagtaacaagtcttgaggtattccaggtaaaggagaagaagcctgaagcgggatagagtaggagatataatgtcacagaaaccaagggaaaaagggggtttcaggtatctaactgtaatacatcttgctaagaactcatttaagatgcagataacagaaatctccctgaagaaagagagatggaagtcattggcacccagggcaagagtgatgaatgtgtagacagtattggatcagacttgagctgtgaaaatagaaaatatgaaaaacatcttcagtattttggctataaagaggaggaacaacaaaggatattcaccagaaagacatgtgcaaggcaaattagtatagaatttgcttcttaatgggagagatttgagcacattaagagtagagatttgctcttggaagttaaaggctaaatccacactaagtccttttattcaatatttatgcggttttaacaaattgttgtacattttttaagtttacaagttgtgatattatacagataattcaagaaaagaaatattaaatagattacagcaaaagatgtaaagtttcaaaatatatcaataaaaatataaagtagatgaattagagggatctatataccctttacaaatgtctggagcttagaaggtgaacaatcagtgtgagagactgggatagaacaagttcgagataagtgagtataaagaatctagagggggtcaggaaaatttaccctccaaaagtaaaacagagcaggctctgggaagattttaaaacttgctcgagcaactaaaaatgagagttgaaaagactcctgtgatagtaagaaggttatttcaatattatatgacatacaaattgttttggagatggcatagtgtggtacagctgcagaacagcccttccctagaagccaggcaccgggtttggttttgtctgtgtcaataataaaaggcagtagcttggagaagtcatttaattaatcagagctttagtttcttaacctgtgtatttaaagagtttccctacattttctgtaagtttcttacaacattaaaattctttgtctctgtaactaacagaataggtatgctgtaagaaaaaaatatatacattgaggtaaacttaagtgtctctagagcataacattatcaaactttttttgtaggtcctgtgtaagtgagaataaaagctccacacagtccttgacttcattctaaataggttgacacgggtgtgaaatgacattctccagtcttagggatgtgtgaagggcacttaacatttctgacaagctgagtcatttgacattattccctgtgtaacttatccattaaaattttatctgttgtgaacataatttttaacaactacataaaatttaaatactctgaagaaagcacctagtcatttcaagactttctgatgtgatctatgttgaaacaaacaaacaaaaaataaaaaaaaaccctcctatagagtctcaccagagtacaggtttaaaagttaaaatatgtatttctaaaagtaaatacattatataagcatatgaaataatgaatatataatacatattatataaagtgattacatataaatatatttctattcctttttggaatttgactattttctggtgaatattaagattagcttagttttatgtatcaaattaatgattaacattgagtcaaatgacattcatatatatacatatttttaaattttagtattattatactttaaaagctttagtgtacatgtgcacaacgtgcaggtttgttacatatgtatacatgtgccatgttggtgtgctgcacccattaactcgtcatttagcattaggtatatctcctaatgctatccctccccactccccccaccccacaacaggccccagtgtgtgatgttccccttcctgtgtccatgtgttctcattgttcaattcccacctatgagtgagaacatgcggtgtttggttttttgttcttgcgatagtttgctgagaatgatggtttccagcttcatccatgtccctacaaaggacatgaactcatccttttttatggctgcatagtattccatggtgtatatgtgccacattttcttaatccagtctatcattattggacatttgggttggttccaagtctttgctatggtgaatggtgctgcaataaacctacatgtgcatgtgtctttatagcagcatgatttataatcctttgggtatatacccagtaatgggatggctgggtcaaatgatatttctagttctagatccctgaggaatcgccacactgacttccacaatggttgaactagtttacagtcccacctacagtgtaaaagtgttcctatttctccacatcctctccagcacctgttgtttcctgactttttaatgattgtcattctaactggtgtgagatggtatctcattgtggttttgatttgcatttctctgatggccagtgatgatgagcattttttcatgtgttttttggctgcataaatgtcttcttttgagaagtgtctgttcatatacttcgcccactttttgatggggttgtttgtttttttcttgtaaatttgtttgagttcattgtagattctggatattagccctttgtcagatgagtaggtggcaaacattttctcccattctgtaggttgcatatatttttatatagggtttagcttttgatgtcaatatatttaagaaaaatttctatgtttttttcagttatgtttcatagaatcaggataacttctgaaattttggaaggtaagaggatgtccctcccactcttactcattgctaagaactttgtaaaatgtatgctgtttaaaaacatatatacccttcaaattgatttatattatgggttatgaccaaaatcttacctttggcctcaagtcctggtacggtttggctgcatccccacccaaatctcatcttgaattgtagctcccataattcccacgtggtgtgggagggacccagtgggaggtaattgaatcatgggggtggtttcccccatactgttctcatggtagtaaataagtctcacgagatctgattgttttttaaggggaaacacctttcacttggctctcattctttcttgtgtgctgccacgtaaggccttcccagccccgtggaactgtgagtccattaaacctctttttctttataaattaccaagtctcgggtatgtctttatcagcagtgtgaaaacggactaatacaagtccctttttactgggtttaaattagttagtttctacatgcacaggtaattttactcaacgctccctttgtctggcaatccattcgaaaactttttcgaattgtaaccattgccttcaatgaacaagattgtcgtctgctccccaggcatcactgaccgggcaatttcttccttagtgtaagcaatccaacaatgaaatattctcacagttactgtacatgttcttgattataaagatacacatatttaatggaaagaactaggaccataggaacagatttggtattttattgtttctaataaattaacttgtgaccttcagaacgacacttaagttctctgcaccctgctggtttccataatgattaggtgttttccaagattacatttcctctaaagttttaggcttctacatttttaaatatattataattatgattaatttcacaatttcaaagatttagtgtaaacttgttctgagattgttatatgcagatgctgtattagaacaaaataaaaactgtgaaataactagcaactttaatgttcacatataagacttcaagaaatataacaaaaagtggagttatcctggctcagtgaactaagctataaaatttttgaatggtaagagctgttagaattatgaggtatccactaattcagaatattaaatttgagatatactttatgaataattttcttttttatctcaactgggaaaaattattcttgaacctcaacagagaagtttgataaatgacatttaaaatgattaaaaatcattcacccaatttaagaaactccctaaataataatctgcagctcaattttggttaagtttttgcatggacatgtgaaaattggaaagtaaaataaattgcttctggtgattttttacttttttttttaacttgtacagtatacatttatttaactatgactgctagtaaataattaaatataaacctctgtaaagctttctgctgtaatattttggatgagaaggatagtttaaacagcaaggtcttcaggatatttgagggtttataccttgcagtaaaaaaggagagaaaataaaacaaaaaacttttacctagtttggatggaaaccttctagaattcattatacactaatttgcttctttcaaaaaatgtcagagttataaacataagtaaacttgagtttgctgatgcctggtcatcatttgcttattaataaatgcagctttctgtatctcactggtgtttgtaggactctgtacatctctatattgctgcattacacagcctctgattataatgcttctagagttagagtttttaaaaatatatattttatatataaatttatatttttatattttatattttataaatataaatataaaaaattttatatttataaatgtatatattatatatgtacatatattttatatatgtgtgtatatattatatatgtatatatattttatatatgtgtgtatatatacatatatgtatgtatatatgtatgtatatatgtatatatatacacacacatatattcacatatatatgtgtgtgtgtatatatatatatatatatatacacacacacatatattcatgtgagtatacatatttcctttatggcagagtgtaaaatagcaattccttctaattataataatacagcatacaatacaaagtgaaccatagtgtctcctacaaagtaactatcctacaaatgttagctgtcattagtactattaaatagctattgaaaccctgatggtttgtatcagtccatttatttctttttaacaggctatcattctgatgcaaacataaataacaaacaatcttggactatgttgaaaaatgggttaggcttgcagtcaaaacatctaggtttaatcctggatatgttgcttcatagctaggttaatttcattagcattgttacccttaagcttgttgtcttagattttaaaagcaggacaataatggttatcttgcagattcgttatgagtagcagtttaaaaatagatgtgacaaaaaggtgagaaattcattatcacaaaactgtcacacagaaggcattcagtaagggttaactgaatctgaaatcaggaaataaggttgcttctaaaatataaacatttataaacattcacaatattccaggccataggttctgcatagcacattagggagacaagactcactattaagaaacctgtcattgaatatgattattgtgattgagagagcagagaaaggagaataatagaatccttactctgggacagcggaatgtttgtcctattaaaaaaattctttacacaattataatttattttattcaaaaaataaattcactgtaattacgtatgaagaaaataaacctctgcaaaattatctatactatgggaaaaagaaaaggagtgagaaagtaattgagtgaattcaactgttaatatgatatataacacatttttaaatttagagtagaaactataaataaagctatgctgtaatcaaaattgtactaggaaatacacatgtaaagatacttctgaatatttctttgtccaattctcagtcaactgtaaaactgctgagttttggagatataaactttgcaaaactcagatcattactccttttgggcttttagttacaattaaggaaattatgattatctatttgtttatatttgctgtgtggcaaaagacaatatgaaaaatgttacttagtgagggtttggtgatcgttaccagcttccacattatccttaaagttgtgttgaaatgattgaagataaatgcacttaatttgaaaaaaaaaaaaatgttggactggaactgatagtgttccaggaaagttgaaagaaatcatgagcaggaaacagtgaacaatcttacgagacatagagacatacaggctctcagttagctctgaatggcctttacaatcaagatataaactatgtgacaaatgagtgtaaaataccaaagcactggcttgtttcatgaagataagaacagtctcaaagtccttgtgttccatatggtccatggatttccaaagaggaatatgcttgaacagatcaaaaagcaaaatagacattgtgtctggctggtatttgggacatggaagagcgacatctaatttcttaaataatgtcaacttatactgctgtgcttttattggacagatatgtgtgaggctttgaatacatccaaactgaaacttcaagaacaaacatcaatattattgattattttaactttttttagaagttctaactaaaatgcagccctgggcatagaaaactggtgtttaaaagaaatagtcttattctaaacaatatatatacattgtttatattttatataaacaaaattttttgtttatatatgtattctgtttatattttgtattataatacatttactctgtattaaagatgaattcaagtggtaatattttcattgtgatatggctcaaaaatatgtttacattttgtgaagttctcttgtctcattgatccttaggctcctaaagctaatctgcaagagggttttcagatttcaattttaattcatttgccaatataactgctagaaaatcacatttagagtaagttttggtaaaatatctaccttattacaaactgagcagatttgggtggggagcagtatctatcctatttatattaataaatatatttcagaatctattttttctctgtacttctgaagtgaaaaataaatcatcagagtagacttaaaagtgaaagtggctgctattgtcctaaatctatcccatttgtgatatgaactcagaagcttcagtttctttggaaattattatagacacggactactgcatgaagtttcatttaccttaaacttctaattgaagtttcacctatatgtggctgagatgctgattcagttcaattcaaatattaactaactaaatccttatctggctgatgagaaagaaagagtagcccacatgaagcaggagaatagggtctggaggcagggaagctaaggtcaattcatgctgacgtcctagaactggatcaaaaggaaaaccccacctctccatgcccaagtgacaaaggatcaaatgctactccttccacaacccccacccccttccactgcgtcacagatggaaaatggaaagtacctctgattggacgtgggccaagcgtgggccaatccttcatttgcataaggtgccaatccatttcagcctctgattggccagagtcaaacctccacttccatcctttattacatagcgtataagcaatgggaaatctttaaagggtacttaaaccccagaatattttgtaaccagggctcctgagctgcttgcttgagcccgctccaattctgtagagggtattttcaccttaataaatctatgtttctgttgccttttgtgtcaataaatctatgcttttgttgcttgttcatgcatgctgttcaaatccttgttcaatacatcaagagcctagatgactcacgatcagaaccctttatctagtaacactttacaaacatatatgctcattttaatttttaaaataactttttgaataaaataatgtatgtttataaagtgcatagtaaactgtaaactaatatgtaataaatgagttattgttgtcatccttatctttttctaatcaaagtagataatatctattctaaaacaagttattcaaatgtcttttgccctttgtcttattcaaatgtcaattgcctctagaagttttgattttaagaaaaggaaatgttttgcctttcaatctttatcaatggaaaacatttcactcagtctcaaaatgcaatttccacagatattttattgggtagagtacttttaaaaagctctaaaataagaaagtgatgataatggaaagcaatatttagtatcaactttgaataggcacaaagagcactgatgtaattagagatacttagacatgtagctaaagaaaatatacctctgggagaaaatgtaactgctgttactattttcaaacaaatatggggctcagaagtatctatttaagtgccaatattaaatatctcaccatgtttccattataaacccttcttttaggagtttataactgggccataaaaattcacttcaggcactccttagtatccaaaaaagctattacagccttctgggaaaataataagcatatttatagaaggtatatataaaaatattgatatgtttacctatttttaaaaatgcacttgtgacaactaatctcctttatcaatttgctgaatcatattaccttcttcagttccattaacctaaaaggaaaaatacaattaaatttagtctcctttcaattgtttctaaatatgattaatctggtgtcaacaaagtatcgctgtacttcagaatttgcctgctggcctctaaaaagccaaggaaggggtaataacttttaatggagtaaatacttgtttatttttctgaagttaacttttttgttgttattgttgagatttttctgttgcaaacattgtgtacagtcaaaaactctgcgaataaagaaacagagacacttataaatacatgtgtactttttgattatttctttagaatcagaaagacttaaacccatgtacattttattttggcagaagatcatgtaatttttccacaattactcacataccgcagcagaggacacaaaatcattccaggctttattaatttcaaatacccaaaactgtcttgagaagaaaatacctttatattattttatttgatagtgaagtcttaaagttctatttctctcataggttttttgtttgttttagcagttagctaaaaagtttcccaattaaaacattttagtacttaatcctatggttgtcatgcatgagactggttcattaacaaggtggaaggtagaatagtgaatagatttttcacaatataatgagcatgataataataatagtagtagtaataagaaataacaacaatacaaagaatactaacagcaaacattctttttgagtactttccacctcactggtatgcggttaagttctttacatacattattccccaattaaatctacgagatcagcgcctgttttgctagggaaactaggctgtaaggaatgaaatcactaacgcaatattatatagctaactattggcagtgctgggactcaaattacattctgaagatgaagcctgtgtttaataatcaagttctaccactctttctactttagaagaaaatcagtatgatttggttaaattagatgctctaacaagaaggaaatagctgacccaaattatagatggaaaactatacggtaagatagctggattgctagacaatagtcagcataatatcactattattaaaaattcataaatatttttgccatcctaggaactagtctttaaacttactacataccttgctattcaattgcaaaatgtaagatttaaaaaatggctcttctttaaaataaatgtcaaaaagaatggtgttatttatctttgaagttagcaatattaattacttgaaaattagtaaaattgtctgacgtttaagaggttttaaacggtctcctaactattatacttttagattttacaaaatgagtgttcaaatatcatctggtttataattaatacataaaagccagtgaatctaagtgcacgtacatttttatttaactgtgtaattactgattagtagttcataaaattggttttgatatattttgagagcctttacaataactttgcaacttttaactcatgcaaaagtgattcagtataaagttggactaaaattcagaacagaacttcttttacgaagttaacagagataattgatatttcactcaatgatgactgcattaaaatcattgacacacatttaacattcataactgctctaacccttgaatttggtatatggcaatatattgaatctaaaactcttaattgctttctcatcaatctatttctcccctggtcttttcctctttgtaaatggtaactctattcttgtagttgctcaggcccaaatctttatcatttagttgtcttctacatgtcatttaaatcaaccagtaaaactcattaatgtcaacttcaaaatatatccagaatgcagccatatttcatcactttcaacaccatcaccttagttcaaccagtattactccctacctggtcttgggcaataggttcctaactggtttcaccatttaaatccttactctctacgtcttccatgcaaaaaccaggattggtcactgttcatctagccaaatcctaccattcagtaaaaccaaatcatcatcactatctctggggtcatgtgtggcctgaacctctgctctttttctgtcctcattctccctgcccagttttgtttgtttatttatttgtttcaatcactcagctcttgctacattggtctttccttgagtacacctaatgtggatctgtccttgatgcttcgtgactattttcctccctgttcaaaatattcttcctccagatttccacctgtcccattttcttcatcttttttttttaagtctgtgctcaaataccatttagcaaaaagccttctctgaccaccctatataaaagagttaggtctatcactctctggaagcttttttatattaataataaccatcccttatattctaggcattctgctaaatgtattatatctgctatttcataatcttcaagacactactgagaggtaggttttattatttctcttaaataactgaataaaatttaaataaaacactaaaggtatggttaagcttcaaaccgggtctccggattcctcagtccttgttctccatgaactgcataatcccatttatgcttcaaaactctcccaatttaacaaatagggaatgtgaggctcaagggtttgaaataattgcccagatcacacagcaagtaagtagtagaacaggaattcaaatgtaggttgatcaaatctgatgtttactcccctgcaccacactgccttcctgtggacaaggtcatatccttattgccaattgccagccaaagatagataagatgagttcactctccattcttctgggctttatttttgcttacttactcaagtctcacataaatacatattcatcttagatctataacttggttgatgtagaaatataagaaaagtgcacatatgatatagaacattaacaatattgacattatcccagaaattatataattaagaattgaaatttatatgattttcattgatttttttcttcttttatttgctaatattctatcctctcaacaacatactgctaaactttgctttgttcaatgtccatgcttgatcattgaattaaaatccctctaaaataataagtaggacatatctcaaatatatgtatccataatataaaacatattcatttagaatctttgcaatgtaccattatactaaggccataataaaaattctcacttgtctgtatacttggtgaaagaataagatcaactgaaccatatagttgctttatatagaaatcagcctgtacatatctaattgaatttactaattgtcacaggtgaaaaaaaatgccattttcatactgaaatcaaatataatcctgacataaaggtcataaatttaaaaatttatgcaaagatacctcaagctactactggaacacctatatccaacatacagaaagaatcaatacaagcattaatctgatagtcagtattagacataaagtgactgaaatagagcttgattacaagagcaatgtctcctgctttgagaataaacatttcagttttgtctcagcatttatgtaacagcaggagagagaagacaagttatcttgtgacaacatcctgcagtatgtcattgacattatcttataattagacttgcattaaagatgattaatagtatcttctttggtgcctaatcagtgcagtctcatagcatatacaaaaatgagtattttagatcactttaagtcagtattacagcagtaaaatcgttatgttccttttccctcaaagccatctcaaacaaaataacaatattttcattcaatttttgttggtaacagtttgaaagaaaatgccacaagtatttagagtgttgaaattcaaattttatctaattaacctgaaactcctgtattttttgaatccagatttaaaccactattgtggctaccgctaatagctatatatgaattaacagaaaatgaaagatttacttctaagagaaacataacacaagctagtttcatgtgtagtcaattcaaagttttatgaattattggactcagattacctacaggcctggaagacagtggctctgtctactattggagatgctggctcattgcactgaaaatttgctatttatgtataaaggataagattggacttagaaatctgtaaattaagctaagtgatttaaagccatgcagcgtacatgtgagacacaagaatcaaacccttaagctttatttgtgaggaagtagcattcatgtgtgcttagcctaccaagggggatcagcaaatgtttgctgaatggatgcatgaatggatggagtggcttcatagcacaataaagtcatgtaccacaatagttagggggtacagctggaaataacaagtctttataaagtgaccagactaaaacagctttaatgctgtcccactgctacctatttgcctactgggatctgagtgatttgttgagaatgaagtatcctaggcaaccatgctaaaattatgagttcagaaaaggcgaactatttaacaggctagacatactgatggaagctattgtggggccttcaatttaaaatttgttgaatttgtgtacttagttccactgactctgtattattaagaaattccactatgggccaagcgtggcagctcatgcctgtaatccaagcactttgggaggccaaggcaggtggatcacttgaggtcaggggtttgagaccagcctggccaacatgaggaaaccccatctctactaaaaaaaaaatacaaacattagccaggcacggtggagtgtgcctgtaatcccagctacttaagaggctgaggcatgaaaatcacctgaacccaggagacggaggttacagtgagccaagatagtgtcactgcactccagcctgggtgacagagtgaaacactctcaaaaaatacaagggggaacacacactggggcctgtcagggagtggggggtgggagagcatcaggataaatagctaatgcatatggggcttaatacctaggtaataggttgataggagcagcaaaccaccatggcacatgtttacgtatgtaacaaacctgtacgtcctgaacaggggcaaaatgccaccagtcattttgctaaaatgcaacaagagtcacctatgcttcacttcccaacaagttcttcatctccatcagcctcagcctcaatttcattgcccatatcactatcagcagtttggtcaaagccattcaacaagtctctagggagttccaaattgtctcacattttcctgtcttcttctgagccctccaaaccgttccaacctctgcccagttacccagttccaaagttgcttccacatttttgggtatcttttcagcagtgacccactctactggtactaatttactgtattagtccattttcacgctgctgatagagacatatctgagacagggtgatttacaaaagaaagagttttctttacagttccacatggctggggaggactcacaatcatggcagaaggtgaaaggcacatctcacatggtggcagacaagagaagagagcttgtgcggggaaattcccgtttttaaaaccatcagatcttgtgagacttattcactatcatgagaacagcacaggaaagaactgcccccatgattcagttacctcccaccaggtctctcccacaacatgtgggaattcaaggtgagatttgggtggggacacaaccataccacaatgttttagaatacatttggccctataaaactgtagattcaagtctacaataatttctcaaaagttttcttaaattatatctttctctatgttttaaattttcctgtttatacagtttgtttctaccagcacatcaattttctattgatggttcatttatttttcaatattttcaatattgaaaattttattgaatattcaataaaaaatattctgattctggcaatcagaaataataggcaattatttaatgcctattgtatgctagacagtgttctatactttgtttcataactttttctgtgatatatatatataattttctttacaatcatcttccaatattctttcattttgactcattttgcttactttatcagttctgttctctgagccccttattactctcatcagtgactttttactgcttctattttgactttcacttctgtaactgctttatatttacctttaacatcttccttagtctctcctggtttgggttttatctttgtgtcactatacattctgaggtattgaaatactgatttgttgttttgcatcgaggttgtttgggggtatgaggaagtgagaggttcataaaataaaacagtgtgatttccttctgctcataccaatatttttcttgttgcttttctcagcctgctccttcctccctttctttttctctttttgttttcccacattattgtatagagcctatacttgttcattttcttcattattgctcttaaatgaagtgagtacaacaaaaattgggactgttaagtgcagagtatcagaggtttcctctaattaatgggaagtttcttaggattaaaaataggtgcacatgtgattgtgtaagtgtgtatgtttttgcattacattgtatacccctctccctttaattttgccactcactgattcagctaatggcaagatctgagaacaaaaaaacccatgctcattcagatgctaggaaaacaggctgaaaagagcagagaacattccccaagcccctattttactaaggactctttgtaatataaaaaatataaattttttatctgaacaaatgaccattttatatttctatataaaagttggtggtttaataatacaggactagaataatgtagatttttaattttcatagaaattaaactctgtagccaaaggccctcagagattactaaacacagaaggcatattgaaaacagaagattctattttgacagaaggattagacatatttttgttactgagaaaatactatttattttcatagactgaatgtttgagtccccccaaaatgttaaaatcctaatctcccgtgtgatggtgttaggaaatgtggcctttaggagataattaggtcttgaggatggagccctcatgatgggattagtggtgccataagaagagaggagataacttgctctctctttctctttttttctaccttgtgaggatacaaggagaagatgtacatctgtgaattagaaaaagggtcctcaccagaaccaaatgtgcagacatcatgatcttggacttccaagcctccagaactgtgagtaataaatgtttgttgtttaagccactcaacctatggaaatttaatacagcactctgagctaagacattcatgatcacttttaggtgcctttagttctggtagtcacatggaagatatatctgaagagtctgatctcctcttcactctgcgccctttccactttatagtggatgcacatgaaaatgtattttgggggccaggcacggtggttcatgcctgtaatcccagcactttgagaggccaaggtgggcagatcacgaggtcaggagttcaagaccagcctggccaacatggcaaaaccctgtctctactaaaaatacaaaaattagctgggcatggtggtgtgtgcctgtaatcccagctactcggaagcctgaggcaggagaattgcttgaaccaggacccggaaggcggaggttgtagtgagctgagatcaggccactggactccagcctgggctacagagtgagactctgtccccccccccaaaaaaaaggcaaaatgtatttcggggaaattcctgcaagcatactagtcttagcaagtattggtgtggcttcacttgggaaatgattgctttttactgattgtttgctctttctagactttttagttacattctttcacaggaaatatgtttgacttgttgttattaaagtacatagtgtttctctgtggcccgttttgggtcctagcaagtggctgatggcttccttgcactttcacacactcgtggcaacattcaaaagaaaatgaagtcagacttggaccaagatatacgcctttagatgatgctatgagatggtcttttaaaaatatttcatcaaagttctttgtcttgaaagactaacaatgcttgttagattgttaatttttgagatccatgtgacttatatctatattttcatatcattaaaatatttcactggctgttgagatataagtcacaatctgccaatttgtcattcttttcaatgacatctggatccaaaatcatgattggttaacatgtgaagttggtccattaattttatccaggaaaaagttattggaagctacatacatagttttaagatttaaaatttcaaatttctatgactaataaactacagaatccctcatgccacatctctaacacattgattccgtaaatgtttcttaaattatgttcagtgctaagatgccaataaagtttcattttagatgaatacaatataaattgatttattagttgaatatttgttgtatatttgggccaactgtccaagtgaatttattcagatatccacattttatatataactactttcacatttctgagtaatttcattggcacatttttatgtgttacagaagtactttatgatttggtgaaaataatatttactttgattttcatatcgtaccatagctatctaagaatctacctttattatctaattataaccatcctgccaacaattctacctctagatttgttctattctgcatagacatatctacctagaagagcctacctcagagaggaatttccctctgaagtatcattttcctgtggcctgttttcttgccttcttgttttgatctttcaggcgatgtgactttcctggctatagttgctctcctgagtctctgacctcccaacataaaaaggcctcttctcccttgtgttgcctccgggttttctctttcattgttatgtgtgtaagccttccttctgcatgactgattgactttcttccctgatctcctgttttggaagctggatcatcatgaccacttacctgaccgctgaaccatcagccattctgcagtgtaacttttaacaccttttagggttccttaaacctcacatttttatctactgagactgtgatataactttaagcagtaatattaaaacttgtaatattcatttacaacagacattttttctgcttttttaagtgaaaagttgaatattagcaatttaattggatcaacctaatattaagtgtaaacataaactgtgctgctgaaaatgttcagaaattcaaactcctctacttcaaagctctgacaccatgtcacgaaccaaagaaacaatttagtagctcttacataatagactaagtatcatcaaacaacactgtttactttctaaaggcaatactctaggtgccttaatgaataaattttatctataaaaagtacttttaaaattatattttattgtggtaagtcattaaggagcaaattttctgacaatattttaactagttttgcacttaatccaataatcaaattaagttttatctatgttattatagaactgatacattcttgagaaagatgtatatattgattcatatgagatttttcataaaaaatatattaaagaaaaatagcccctcatatgcaataatgggaaagccacatggatttatattgtagctatggtataagagatcatgtccttattataatcttcacatctatgtttacatatgttatttataaatgtacattttgcaatgtcttgacatttgttagctgtgaaagactatgccaggtatgtttcaggggaaaatgaaagtgcttgcccagaaatataaaaacaatgttgtctcgtctcctaatatttacatttttatttctgttgataaaatagacttcagtgtaacagcatctatacagaataaattcctgatttacaaaatcttctgcaaacaattattggtttctcactgcaaagtatagaagttgctactgtcaaatcagaaatatttccctttgtaactgtctgtacttgctgttgccctatcatcgctataaagggattttttaccttgagtaagaattgagcaatttgcaaaacaggcaaaaatgaggagtagacataacccttctaagagctatgtactcaagccccatcatcactccctccgtgcaaaacaataggctgtaaacaccatccatgtctgtagcacttttccacatgtctttattctttcaggatatactcctaaattaattccagctcaaactacttttagctcttcactctgtttctcatttattatcctacttctacttcctcagatttagttctcccctctctaaatagtgactgtcagttagtcttcatggcctctggcttgaattgtatccacaaggttttctggcttgcaactactttttaaaatttatagacaggaattgatctctaagagtggatccatcaaccataatcccaaaaggagaacaatttgagatgtggtttccatgttggccttcatcctgtgccttagtttagatttctttagctttatttcagtttttattttatctcctctatttccctcatttcatgcttctctctctttcccttgtctttctttccgctatttaaatgctccagaacctttttattttaatgtcaagtaacacgctccaaaggtatcacctgggaggaatgaggaaatatgaaggcctagaaacctagggaagaaaatcaaatgcaatgaatggaaggaattgtaataaacacacatggtaagagcatggtggagtggatgctttggtgatattcccagatcccctcccttaaagactaaagtattcattcttcccagctgctgtaaatgctgacaacagacaacagctgggcaaggggagcctccttgtctgaggtcacacactctccctgggagcacgtcgtatctattgactggctagcaggaagataaaagacttggttcctttgcttcagggattactgtcaagagtcattccaattctagagctccccatgagattagctgatgcctttttttgagacttcattgcagttcaactcttctcaatccaatttcctccactgctttgcaggtattgatctcaacaaaattcttgcatgcaaatttccatatcagaatcttttatctaataaacttgaccagaaataataggctttgggggtcagagagatctgggtttgaattcaactgcacttttacttgctagctgtgttactttggggtttattttctctataggcaaaaatgggtaataagaaagcggaagtattctacggtggtgacatccttgaagttgtacaacataattccctgaaaaaaaccactacataagtgaaagattaaatcatatatttaaagcagttactgttttgcagagtagacacttaatacattttttgttccccccttttaactttggacagattgaggaaaacaagaaggaaaccaagcaaaatagtcaattaaggatctaattaagggtagagtattccttatctaaaacgtttgggactggaagtgttttggatttcacatttttttctgcctttgtaatatttgcatatatacaatgagatatcttggggatgggacccaagtctaaacatgaaatgaatttatgtcttatatacaccttacactcatagcccaaagataattttataaaatattttaatgattttgtgcatgcaacaaagtcttgactgtatttttactatgacttgtcacatgaggttaggtgtgaaaatttccacttgtggagttacatcagtgctcagaaaattttggattttggaacatttagcacttcagagtttaagattagtgatggtcaatctctttcatttttggagtataagatagttatcttagaatcaaagagatttttcagttactttaatgggatgaagacaaattaagatggacaagcaaactgtttgccactgctgagttatctttattttgacttgaacctattaaaccctttgtgttaggcagaaagtccttctctgtcccaactatgtccacgtctcaatctctacaacctataaatatgtttccctatatagtaaagtgggctttgaagatgcgattaaattttaggatttggggagggattattctgaattttccaggtgagccaaatgtaatcacaagggtcctcaaaaatgagaggcagaagagaattagagagagagatgactacaaaagaggttagagttatgcaatgtgagatgagttcagcctggcgttgctggctttgcagatagaagaaaaggagccatgctggaaaacatacaaaagtagctcctcccatagagccccagaaaggaaagcagctcattggacactttgattcttgttcagtgagacctgtgttgaatatctgacctatagaaccataagataatacatttaacaaatgtgtatgttgttttaagttactaaattttaattgatttattacagcagaaatataaaatgagtacacttttcataactcatggaaaagttatcaaccagtaggccgtgtctagcgaccaaagagcctcaaccacgtggaaagaaagggaacaagatgggaaaccagtaagagtatgacgttaatcattggaataaaatatatttggcatataccaatggttgatcgtatgtttacaatatgtttctttcacactaagcttgttttgccagtaccatctcttgaccttctaagatgcaccttctcttccccatttcctttcaattgcatccataaccagaaaagttatatttcccatcacattgagaaatagctgaaaactttctttccttatttttgcctactgctcaccttattttgcttaatattaacactctgttaattcaaactagctcttgatctggatttttatctctcaacctctacctaaattaacttttttcctactatttctccagaaataagcattgctctcacttgttttgttgtcatagtttatttgtatcacaaggaaagactataatcacaactaaacatccattgattcatcaaaatagaagaaagggaatccctgagtttttatgtgatttgaacaaaatacagagttcaggagaagaacgcagtatgtagaggactaattaaaatcacacaggctccagttcagttcctgctcctccaattggtcagtatctcatgtcaaggaaattatttaaatgtctaaatcacactttatcccctatgaaagatgggctatactgacccaacagagttatgtgagtatagtaaatgatcataaagtactctagcaagataacagataataaacttcaaataaatgttattatttttactacaagaaccattgacattaataaatattgtcctgaaaaagctcccaacattatattcaatgccatgttatctttgatggcttttgtgcccatgtccacatactcttctaatttatagtctgttcttcatgcaacaataatcaagaaaaaagtgaaattgaatagttggttttatcaacttgaaactttgtttttgaaaattatatttaaatttctattataaattatgttagaaagcaagtttattatttacaaaactatttttggaaatatgttctgagcttccaacaactgtctataacttgaattttggcacctattattgtaatattctttcctggatgtctatggcacgtagatattctaatagactatgacttagaataatatcaaagggaaattcaatagaaattatcagtctttttggcacaaaatatttcaaatggaatctaatgcctaatttttcccattgtatgtgttggcatattaacttagatactatagacttttacaattggcataaagtcttgattatgccagataaaaaaatttgagagatctgctgcataacattgtctctgtaattaaaaatactgtagtgtacatttaaaatgttgttaatacactggatctcatgttaagtgttatactacagtaaaagaaaataaatcagagaactttaaaaattaatttcccataccaaagattattgtctatttatttttaatagtattgaatgtttagctctttgaccaaatagcattattaaataaatacaggcaaatactaacttcatcaaagtcatatttaacaagactttgattgacttgccaacactatgggtgttgtttttcctctgggccatggctgagactgagaattcctgccctctctcttcgtaagcatttctgaccccctggacatttattttggtatgctgtccacttggggacaagttgctatagttgtgaccactctctggcctctttccctagaaaaagcagatcaacacccttctttccaaaatgcagcattttgtttttaacctaaattcagtaattagatatttaaatgctattagatgtaagtaaattgctttgattttttatttcactcttagtgattttccagtggttcatttgcaagaggtacacatgtttctaccacaaaactcattacagatagtctagccttagctcaaattttaagagtttgacctttgttttaattaatgaagtggcaatattaaattattaaaagtactggaaccaaaaaaagtgagaatcatcctcaaaaatattttaatgaaccccagagtaaaattagctaggtgaattattaaaaactatattatagttaaaatgctttcctagtatccattaattaacacaattaatttcacctttcttaatgaacataactccattggcatttggcattttttcctctttcttgggtttctttctgcttatttatgtgttttagcagtaaagaactgcaacctcagcaaactataaattttatttttggaacacaaaatattttcctgggagccacgacttaacgatttatggagaggtattttatttttaaatatatagaggatctgcaagaacaacaacaataagaaaaaactttatatcagtcccagaaaaagtggttctaattaaaaattaaggtagagtttattaatttagtaaccaagtccataagaatagagaacaactttttctttattcagtaatgcagaattaacattaaatctctttgataattctaaaactatccgtgcttttgtattttagttttctacacacttaccagctcattggtttctggattagaaaaataaagttaaacacaaattgaggagcagtactgactgtgcggaaaatatgctccactcttaaaagtatgctaaatatattttttaaagtttctaattaaaaattatttacttaccaaatgtgattgcacatgtcggctttatttaactgatttaatattttgattgcatacctcctaaatatgttttcaactaagataattgtgttaatttgcatcttgaaagggaatctttcaagacagagaattgtcttcaaggtaatctctggtgaattaaaaatatattttttcaacaatttatgatataatttttaaacattaattccctacttactctataacccccgaagttctccctagggttatctcgtaagcccttcttaggaaatgactataagattgtgccttagagaattctagagaaagctttttaaagacaggacttattggtctttacataactgaaaaacacgtcaaagaaatagaagctcagagttcaatattttttctttagcataggatagataaaattacaaaaattctttcattgctgcgttacagaatgacaagaataatgttatagtacataaatgacaaagccttattatctacactgctatactgaagtttgagaaattctgaagtttccaagcaagtctccccacaccacaacccccagaacaagtatctatctaaatcaaataaaaactcagggatactaggagaaattaattcaaacttgacagatttctgaccccagttgttagtgtaacactagaatagttaggattaagaaaatggggctcaagctctctgcctcgttatcaggttctatattgttactgcttcttagtgaggctgatggagtcgaattagtaggtcaagagagcaaagctagtcagttttttaacagtgctaccaagcacgtcacatttggaggactcagcacagaatccaccgaaaacattttgttaattttgtactcatgttctaaacattatttaaaaaggatcaaacacagactctctcattaaagagatattgtcaagcctgagtttgattatgtgttaactgagaacaatttactgcccaaagcccctatacagttaacacaataatttagatacaaacagaaagaaaagtgctatgaatcttgcttcctggagtgacagaggttggagcgtgggtgagatttcaatgaactacatttatgagtggccaggaactatagataacagcatagttagatgcaatattttatctcaaattagacccagacattgtgaagcaagatgtccttctagcaatcttagtaagtgttggcagcaagaataggtttcaatccaacaatacatttctaaaagaagcagataattaagtatcacctaattatcttccctatatcttttgaaaggttaacactttcatgttttaaaatcaaagtaataaggggaaaaaatgtagtgacctgaatatactccctaacctttaaatttctaagactttttttttttaacatttcaaatcctatatgtgggaaaattatattataatgggggaagcctccttttttttttcttttagttcaagttttttccaagtttcttgtatttcactggaaacaacatagccagatgaaatatctccaactaaagtgtctttacaaaacagacaaacaaaagtacattaagggggtttggatttttaaaggaggagttactttcattacacgtactaatccccaaactctcccctttacatttgacagtggcctcattcctggtattagctaatgtcatcagtgttaacttctatttcagtagagaagaaaatgtatcttctcaagatacttttaaatctttgtttaggcaaattctcaatatacagtaaaggaaatacaaatagaaatatttctaaagtatctaaagtctttgcttgaataacgatgaatagaaataatacacaaaaagacctgtgttctcttcaccccttgatgaaatgaaatgccacaaataacaagtgaagctccctgtattggcctccttacttcctctcccatcctctctcctcatagataaccactttcttcagtctggcattcatcatgtccatgaatttatgctttctttatgtatgtataggtctctaaaacataaacattagaggcacagtggctcatgcctgtaattccagcactttgggaggccgaagtggatggatcatttgaggtcaggagtttgagaccagccttgccaacatgatgaaaccccatctctactaaaagtgcaaaaaatagccaggcatggtggcaggtgcctgtaatcccagctacttgggaagctgaggcaggagaattgcttgagcctgggagacagaagtttcagtgagcctgagatcatgccactgcactccagcctggacgacagagtgagactctgtttccaaaaaaaaaaaaaaaaaaagtaatgaataaatgtggcagactgccacagttactacttgagattgtcactacaacagttactactgttactacttgagaccatcattacaagactgaatgaaggaggaggaatgcagagatgctaacaaaaaacaaaagaaactgttttcaaaaaagggtccagggaagaagaagatagctccctgcttctagtgagcaaaggcagcagccctgagcttctacagcccttcatatttgttgggtagaaagagcagggaggaggaggtaacgattggtcagctgcttgattgatcacaggttaacattatcactaacaggcttcagatttgcctaatcacaagaaacacttgtgcctgggttctgactgccctcagcattccttcttggcagcagatgcagtttgtcaatttgccaacatcctgctttcatgagaacagtttgctgtttactaatgtagcctccagtgatttactgagttgatcaggaccctcactcatgtagcctccagtgatatactgagttgatcacgactcactcatgtagcctccagtgatatactgagttgatcatgaccctcattctttcggccttcaataaataaaggtatgtatttattttgtagtctgttcttttaaaagccaaaatgtgggtctgtgagatacattcagattgataaaggtaactcaaattccttcattgtcactgctgactgatattctattgcttgaatttgctaacacagtctacttactcatccactgttgatagtacagtaggtggctccaataaattttatataagtaatgcaaataatgtttaacactcttaaacaagtatccttatacatacctacgaaggaaattgctgagtgttggcatgagcatgtctttaaatttatgtctactgacaagttgctcttcaaagtgtttacatcaatgtatatacaaatgggcattgtttaacatttgcttttgctacctgattcatgccaacacttggtatggtaagataccatttttagtattctgatagctgtgaagtatcagctcttatttttatatgatttttcctaattgaaaccagttgaatagttttccttctgtttattgagcattcatttttcttcttttagaattcttttttttcttttgacagagtcttgctctgtcgcccaggctggagtacagcggcatgatcctgcaacctccacctccagagttcaagtgattctcctacctcagactctctagcggctgggattacaggtgtgcacaaacacacccagctaattttttgtatttttagtagaggcggggtttcaccatgttggctaggctggtcttgaactgaactcaactgatctgcccatctcagcctcccgaagtgctgggattacaggcatgagccaccacgcccgacccatatcttttgcctatcagactgcagattggcttgtcttcctcttcatattcacagaagttcttttcatattccaaataataatcatttgtcaattatagaccttgaactttctcaataaagtttatctttagtctttcattttgtgtttgtttgatgcacaattatcaattttgataaagtcaaaaaattttttaactatgaaaatatttatgattttgtcttgcttaagacattattttttactctggactcataaattgttctcctatatatttttgtaaaagtgttaaaattttgtttattacatttagatcttgaatgcagtacaaattattttgtgtaatttacagaaataataattgtgagcattttggatcattcctgaatcaaaggaatggttctaattttcatcattatgtgtctggtttgctaaagtttttttgtactgttatatgttttttgctctcttatcaactgcctttattttttgcttttaatgacacatttaacaaattatttttatatatgttctcctttgatagatttattctattataaatatcctgatattgagtcatccttgtatatttgagatatcatacaactttgtcataatgcagtagatatacatacatatcaggatatgatttcctagtatttgcttataattttacatctatgctagtacttgatattagcttttaatttccttcctcattctgtcttagattcaaatgtcataaaatgagtgggaaacagttcctttctttgtaacttctttactttgtaacaaatttaaatttgtaagtatgcttcagaatatttgctaaaattgcttttgaaaatatcaatgaatgaaggggtgaactgattcttaattactgactgaatttccttcatgggttttttcttttaaggttttcatttcttttgttatcagttttgtaaatagcatttctctatttgttctagttttcaagtacactgaaataaatttctttataatattctttttttgttacttgggtttctatattttaattcttgatattcttaatattgattcttaaaattcttcatgatcacttttgttgtttcaacctgtattggtagaatatttgtctttcagtaaacaaatatctaattttgtttactctctctaggtttttattctataactttaatatcatctcttacaaatgtgtttaactctcctcaaatttttggagttcatcctggctttaaagttgataatttggtcattaattttttggtcttcctcccacaaaataaattgtttgcagatataaatttcctgtaaatttctataataattctgttgtaagagttttaatatgtaatattttaccacatattatttctaacttttttctaatgtccaatatgattctttcttttttgggataagatcatgctatggtgcccaggctggactcaaactccctggctgaagccatcctcctgcctctgcctcccatgtgtctgggatttcaggtatgtgccactgtgccccactctatgccatatgattttttaaatctataatgtacatatgattttgaatgtctaagtaaacatctttttacatattttctttctgtagttgctaaaaattcaccttaacattacctttcatgcaaaaatgtggtttacctgataattcttgaaacatagcatcacttacataaattttataaatccaaactgccaatcttgttttataattgttttataactgtctagtttactgcataataatatgttggatgtgtacttattttgtcttctctatttttattgccttttctaagcatttttacaaatattttcttatttcttttgcattacttgagatttgcttcctcatgttttccttttaccggtttggaagaatagagtaaccttagaaccatcagatcccatcacttctctccaaagttacacgttcgaattttactttgttgttgacctctcaatcagacaccattaatttattcagccaatttattttgatttacctacttttatacaagctgcttttcttctcgtaagcaaaaccttttattctgggcaaaaataaattttagcacttccttaagtgaaaattaattagaaataagctctcttgctttgtgtagaaacatattttcatttcctatttggcctccaaatgataggttagcttattttcaaatcatgggttgacaattatttgtttcagaactttaaaaatattattctcctgtactctgacttctattgtcgatgttgaataatcagttgtcactttagttgtgttccttggaagataatttgtcctttccctctggaactttaaaggttctctcattctctctttttctctccactttgtagctttactaagacaaatttgaaaattttgttggcttgtttgagtgtttgttgttgttgtagtttttgaggtggtgtgattctgcataggatttattatgatccctggattcaaaatttgtgttctttgtaaattcagcaacattttttatgcactgttactttaaatattagctctctcaccttctatttatcatttacttctggattctaatcgcatgcttctctacttaatatttaatttcttttcattttttaaagctctttccctcatgttttactctatcttctgtttcattaatactccttttagctgtgtttaatatttatcagtcctctattgtggattttttctaatttaaatattcatattttacatttatatacattgaatttggcttgtttttcaaataaattggttttgtaaacaatagtgagaccttgtcaaaaatattggtataatatcacctgagttttataaatcctctttatatctacaactgcaacatttttattttccttccctaaaaattctaacatttttgtgtacaattttgacattgtatatgatagttattatcttagttttattcagttggtacctacatgcattattttatcttattgataattgtatatatgagtttttttcttagtaaattttcacttaatattatagcaatatcctgtatgacaaaatgataaactatgtgttcattagaaacattatataatagttgacaagtgtacagacttttcaggtggatgaataagaattcatatgcggtctccaacagttacaagttttgtaacttatttgatttctctaaacttcagtttcctaatctagaatatttggatagtaaattggtagcattaaatgctaaaatataaaatagtaacaatataaataacatctgatgtttattgaaaattacactaagcctttgatatcagtcagacatttttatcctcaaaggagaatatgatggtagtcctattactatccccactttacaaatatatgtaatgcatgtaaagcttttagcatattgcctattacattataaattctccgacaaataatggttattattatgtttacaacccttcaatttctgaactcatgaatattgtattattaagagtggtataaaagagcataaaatataaataatatactgtcaaaaccaagattcactgggccactaataagtatttctgttaattccttgcagtaagtatatttgagaaatattataactatttagttactagttcaaagtgccattttttcagttgctaagtaatagaaatatggcattaattcttaaagtatttcagattctctacctgtaccactattgttcccacctcggtcacttatatattctcattctttctttgagaaaatagttgtaaagactttcatcttttctctctcttgttcctttattcttgctctttcttttctttgtagctcctcaccataatgtatagagtaaaaactttcaagtcttctaggatgacaaaccctgaaggaaatggaagagtgaagtttctaatttcttgatttcccttttcccactatatattttaaatatataatccaagagctgctacattgctttgatttattatgtggaagaggaaacttgtaattattaccaagcaaaagtcaattgatattgaggaaaaaatccaaatagaactatcccccaaactttgcaatagcccctttctttatttgtcagccatgtttctttttatttgcctaaattatttcaaaatgttttaccaggatataaaattcagaaatgtatttaaagaagaagaaacagcagaaaggagataatgaagaggtaataacacgaaggtaaaatgcataatctgaagttctgtgtacatggtcacaatttgcatttaatcaacagtgattataagataaattgaaggaactgctcaataatgattacagtttctgatcttaacaggtagaaatttttcccaaggatcataaagtaaaatctgtatatcaaaaaatagtgtccctaataacttatatccattaaacacgggtataagtttcatgttttttataagccatcagcatcttatgaaaatgctatatccttctttaataattttgatattctgaaacatagacgtaaagttgccttccatgaaagtctacttgtttatgctgtaggaaataactagaagttctaccaaaagtgaatatctacactgaagggctcacagatattttttacttttaaattaaatttcactaactataatttataacataaggaaaacccgtgctttcttgacttaattgaatatctagttcccctttcacacatatcccaactaaaactttctccaaatacttcttgcaatctcttgtttagtcaatgtattaggtacttcatgaaggcaattccctttgaagtcaatttgtcctctaaaagacttaagagaaaatccgggcgatagtagacccaagagccagacaaacttactgtgttttaaaaagcagctacttaaccaatgtttcattcaatcgaaagtggttcttttcttggatagttatgtgcacatccttaaaatctcttctgagatcctcatcaaagcttcctgagaatttaggtaaattgatttacttagtctttcatcaattgctctgtttactctttaggagtgatacaatagggcaaagagcagttaaacagaaattcaccttgttaatttttaccacctttcatatattacttaggcacatgacatacagacagacactcagtgggatcattaatggcaacttaaaaaacaattcaactaaaccttgacttatgatcacatttttgaatggtaatgtactcaacaaaatacaataaaactcaactttataagccatgttttctgagctttctctaagttttcctcttacttagctcaatatttgctcaatttgtatgaaaagaagtgtttaaagtacctggtacagggttctgtcaaaaagacttttgtccagggacacatagaggctcatataaaaacaaattcataaacttggcctcattaatgccatgctctaatccaatagtgagagaggaggcagttagaggctggctaggcagatagagagggagagtttcaagagagagacggtgcctatgggaatgcacctgtatcgcccctgtggtgtaactagcaggtggaaatgtggttaagaacttcctcttataccaggatgtctgctcagaagggactgtcccaacttaggcacaggcacaataaattaactatgtttccttaacttgacccactgctaattgtaatatcattatcattgtagttttggcaaaccctgtgggtttcacttagggtagtaaccaaggtggagtcactatggccaaccccaggtatgcacggatgcatcacccctagggggaactttagctcccccatcagggtggaacccacagaagacttccttgtttttgccacatgaaagaaatagaactcagccccttactggcagccctcttttggggcccctctactgctgagagcttttctgttgcttaataaatcctactctgtcttactcattttctggtgtctgtgtgccttattcttcttggtcataggacaataacttggacctcactaaactaaagaataaggagacagcaacaatagcttccacatgtggatcaggaatagggtacattaatttattgatatgggtctgaaaattcacatatgcagagttacttatgtatagaaatagctttgtgttgatatacactgataatttgtgaagatatttatttttaagttagattataagataaatttaatttaaagcatggtatattcatgtttagtttgcatcgttttatcattttttaaattttctccatcattgcatcctaaaagtagagctaggaacatgtccggatctcacagatgaaaatgttcaaaacacttctagataccaaaatacctgtgataataatcatacagtgtatcacagccaagttgtcacagcacacttactggttataaccactgactttttctaagctccttttgtgtatcagaagctttttcttgactttgacggtgtcgggaaatcctaatttccgcagttcactgggaattttagatgatttaatctgatttttagacggtgcttggtcaaaataaaactatctaaaaactcacagagtgacatttaaatgccaagaaacttagacatttcaatctctttaaaacacaataaatctctttgttgaatactccagtttatgcatgcattcactaatctgctcattagttttctcattctccataaatttattgagcagttttgtgtgcaagacagtatgctgagtgctggtgtgatgttttccaggaatttaacaatatagtgggagagagattatgaattacaaaaataatagaagagccacataatgctgttacagcctcctctatgagtactgggaacatttggaagagaaagatacttaggaaaatggggtggagaaagaaagcattatgcagaaagtggaattaaagaaggatgctgaaagttgtggttgatctcatgtgtaatttgggggtagagatgggtgtggtgttgggaagataatcagcatcctagtttgaggaaaactacaggttaaaagatacaagcaagaaaacacaacatgcactgaacactgattagaatgtctgcctgtagttttgataagactggaaagtggaaggcagatggtagtaaagaccttgaatgtctggctaagaattctgaatgctgtgttatgcaacagggaatcctaaatattcctgagtatgaccatgacattgtaagttaaacacttacaaatgcacttgtgatgtacactgtttaaaatacttttgcaaaaaacaagtaatttacttttcataacaactttctaagatgcttagttttattatccaggtatttcatacttggagaactaaaaaacggatacgttaagtaagttgcttaaggtcacaattaggaagtggtagagctgggattcaaatccagacaagtctgtttcaaattctgtgttattaactattacactatcaaagtgagggaaccgagtcagattttaagattaatttgagtgcaaatatgggtgtgttcaaagaactggaaagactaagaacagaattcaataagaagaattttcagcagtatgagcatgagataatgttatttaaaccagagtggtggctgtaggaaacggatgggtgcaatagatacaagtgtccttaggaactcacaactacatataaaaactacagagtaagttaaaccatgtcatttctcaaagaatctatgtctaccaaatatacatagaaaatattagaacttaataatcacatattttaaatgcttgataagatctgttctttttacatacaaactcagcaagtaattttagtaagtaatttttcctaattagggaattattattttttgttgatgagcaatagccgagtgttaaatgtggaaaacattgactatggtttgtcatgttctgttttacgtggtgttaactttctgtttgtgtacctttgcattttactgattccctacagacgaaactgtgtctttgagaattgtctgtaagccttctgggatataaattccaggttattttgaagttatgcctgtttgtatcattcgcccactcaagacatcacacattcttccaaacaccccctacacttggaacaggcacccaattaatatacgccatgcaggccaccttgctcttctccttcaaaaactcctaaaaaaccatctgctctgggaggcattccagctacaataaccacctactactttcaattgcctataatatctgcattcactttcctgaacactgcttacatcttttaccattataaaatccataagacaagataatttctaaatatcttgcagagatatgtaacctcctctccaacatctacattcctttagagtagtagtatattcttgcaaagatttctgccatgacagattaaagaaatatcagctttaaaagaataagagcattaacattgtctcttgtatcaaaatgttcagccaacccagttaggtattctgattaggatttaatgccaaactctcacggagaatgttgagtgacactatctaattagttctttatgaacatatgatagtgtggaaagtaaacaaagtagtgaattgtttttaaattagtgtactttgcttctcaaagttcattatgtattacttgctaggcgacaggaactaattttgattttatgatattttggataaattgttccctgggattaaaaaaaaataagctatgacaagaacacaatttatcaatatgcaaaatagatgaaaccaagacaatttctttttaatttttgaaattgtaagtccatatattgccatgctggttaacaccaaattcctgaatgcctgtgaatctcctaccaattatgtcaacaacatgaatatcttcatagggatgccactgtccaggtaataatctaaagacatgtatcttttactcttgcaagtgttaggccttgctaaatgataaagcgtttttctttgtatttccacagcagagatttcagatcaacagacaagtcccagaggactgaggacaaaataattaatatgccaaagttatataataagaaggcacagtgggagatttctgccaaactaagagggcaaagccctacagtggctgagtggaggaggtgggtggcaaagcccaaatcatgggattagagagacaagagattggatatcaggattggtccccttattcttcaggtcaacacctaagagtagaaaaaaaattcctaagtaaaatatggcaatcaaagaatcctaggggtaatcttgggagatccttctgtgactgagaagaatgatgcccattttcatcattctgtgccatggactgcatggaagtagaaagtagcaaagagcagaaggaggtgtcctatcaagtggatctgaggaaagtcctcgccaagtcacatagaccttattaggttggaggaaaaaagcaccttagaatgacaagactcttgaacaatgtggactcaaaaatgctgagagaatgaactaggaggaaacagaggtcaggacaagtagttggtgggatgttgagaatgaaggtaattacacagtctacaaccatcaggaatagctatcagtcagatgcccaaaatatcagatgggtctccacagcggataccagtgtaagatgcccagagaccaggtggcttctgctacctttcagcagaagtagagaccatctgccatctgggagacagaatcttcccctattgtgactattaatattatatgtcaacttggctgagccatgaggtacccagatatttggttaaacattactctgtgtgtgcctgtgaaggtgtctatgaatgagatcaccatttgaattggtagacagagtaaagcagattgcccttcacaatatgggtaggactcatctaatgtgttgaatgtctaaatagagcaaaaaggctgggtaaaggagaattttttctctctgactgatacatttaagctgggagattggttttctgccttcaggtttggactccactaaaaccgttaccctgtcctacttctcaggctattggactcagactggaactatagcatcagctctccttgatctccagcttactgactgtggatcttgcagcttcttagcctccacaatcatgtgagccaattccttataataaatctctctatctgtctctctctctctctctctctctctctctccatctaatctccaattagttctgtttctctggaatacgctaaaatactcctatgttataagaaactgtgctatgccctttgtacttaaacattgttctgagaaagaggaaagtaaagtcaaagccagtgagttgagaaagatacccagaacaactgggtagttacatcaatgagaaaatgtgttaaaccagagaagactgaactgcttttaatgaacaagatcagctatttacttaatcagtgagatgccccaaactcttacttcaccagtaagagtggccactcaaaaacaaaatgggatcaattaaagaaattaatgaaactcactcttttgcacagtcagacttatgattgtttaatattttactgcttgtattaaagttgttattgctaacatattcctaatctgaagcccatcaagagaatttttgactcttttctgaagtcattcaacaagtttgttttgaattttatttagatttatttggaaaggtacacctgtttttgactgtttagaaaatattaattatcaccatcgatatgcttgcaatatttcctgcccaatagaaaagaacatgcatgacatacatatgtgggcttaaatatctcaagagcaaataaaataatttatacaaaagcaattatttaaaactataaatcagtaagcatatgttattttattactgaagcaataataatacggatcaataggtttctcagaatgtaaaacaaccagggtaattacctagaatctattaacaaccttattctcatataaattccaaattatttgaaaatatattttaaaataatatttactttgcaattgagaaaaatacctgagatcctagaattgcaaattgtatcatttagaatgaaatatttatgcttcatttcatctattaagtctctgaaaaaatatgtggatagcagctaacatttggataactactcctggcaaatcatttcatagtgtaacttgataagggcatttcttactgaaatttttaataagagtcacctgaatgtgaatttaactcagaagactataaagacaaaaatgggtcaagtgaaactgactgaatttatattatataataaaaatcataggtagaatgcaaaaaggaaacaactaatataagctaatttacaatcatgtgtcactttacagaaataccttctgagaaatgcattgtttggaaattttgttattgtgcaaatatcatagagtgtacttacacaaacctagatatttttatttatatatattatatggaaaaccaagtgtcccagcaccattactgaatatcaatcatttcctctacttgatttgcaaaaccaatatcacatgccctatattaagtttctataaaggctccattaaatcttacagaacgtatgtgttccatcactggcttaaacattgtaacgtggtccatgactgcatgcgtgtgcatggaaatggaaatagcaatggcttacacatatagtgattactacgctccaggcactgttcttagtgctttagatgcattaactcatttactcttttgtactctatggagtaagaaccattattgggtcattttacagaggaggaaagtgaggcacagaaagggttaagctgcttgttcagggtcacccagttactaagtggaggagcctggatttggacatgggttgtcaggttccagagccaccacagtcatttcttgtcaccaccacagccatttcaagcatccggttacgtggttctggtagatattgccttttctaataaagaaataagcaaaatcgacacagataagggactagtttgctccagagtctctattccatgcattttgtgtagcacatatggttctggactagaaagcattacactttgcagagaatctcagtttctccaccaaggctcaaaattcccatgctacttaaaataagtctccttaagttccccattcactgcatttctaaccatctccattgtatcgttctctgtatgacagaacatgaagtttttactccttttatctgttctgaaatttatctgtaatttttcgaacactttctctcagagctacagtttttcatctatcacaggagtagtaaactttctttgtaaaggcccagatagtaaataatttaggctatatggatcatatggtctctgtcacaactcagctctgcccttgtagttcaaatgcagccaaagatagcagaaaaacaagtgaccttggttgtgttccacaaaacattccttttataaagtaagcagagggccagaactggcatatgggccatagtttgctgacccctgatctgtcttattacttatcagtgggaagtatgtatatcttgctttgtcttttttgaagggagtacaattaagggttttcttggaagtgtttcattaatattatttttgtattatatcttattgatatatcatagttacacacattgcagatacatgtgctattttgagacatgtatataatgtgtaatgatcaagtcagcctaattggaatatccatcacctcaaacattcaacttttctagtgttagaacattacacttcttctcttctacctgttttgaaatataccacacattattgttaactatacttttcctactgtagtattgaatactacaacttattccatctatctaagtatatttttgtacccattgatccacttctaatttgaaaatacttccctattttaaaaaatcacttaattctatggtatttcctgtatgtctctagcagacctatgttcttttattgactaggattttgactgcaaacacattttaaggcaattatttagtagcctatgtttttacaaacattcatgttcaatagttgcagtaactctgtgagattgtcttaagaaaaccattccaatttacaaaggtagcttccacgttcaggaattataatatggcttttaaatctaaattttgtgctcttgtgattatgtgacacgatctttgcattatatagaaatcatatatgattgctatcagatgcacgttaacttttaaataataaagctttcaatgaactttcaactccatttttcactttctaagaatcacctaatatttctgacacatctttgtaaatcccagagagttactggacccctgcattatagcatcaatatcctgcatacacttgagtcacatgatagttttgatagtaaattctgatgggaataaaaacaaaagaaatggtattactctagctaacatgacatgtattattcaatttaatttaatagtataacaatcctgagaactaagaatcactattctactctcataggtgatgaaatggatgctactaaattctaaataatttaccctaggcttcagaactggtaagaggcagaagtagaattcagacacagatagaaccgaaggtttgtctttttcatatgacatcagaagtgtctcctggttatctatggaacccaatatcacgtttgaacttcccaaccatcaatatactttttaattttctataaactctgtttagaattctctgtatttctttatgacaaccaggaaaacttgcttataccatttgagcagtgaagttaaaaatcacagacataacttcaatatgaattttattactggttatctgctagagagcttggaacattctgaatggaattaaaatgcatttcattggtgtggaatcatgaacatttgttaaaattgttttgtaaaaaactccctaggttttcacagctgtagaaatgctccctcaaagaaataagtgcagaatgaataaaaacagatgtggcatttttgcatattatcaacaaaaatctctttttattttatcttgtcaatgtcttaccataacattatttatgccattattctgttcacaacaagtgcaaagaaattacatgacatttccagtacatatactggtcttcagtagggttttctggttacttatatttctctagagagtacctttgcacaggaagtaattttctatgttttctaactaaaacccaacctttctggctgtgcactctgagaaacagcaaacattctccactctattaaaagtaattgagtcggaacatttaaaggtattttaaatgaatgtgcactgaacattcttcaacttggttcaggaaatagatataagaaagtttttaataccctgaaatttttaagaagaggaaattacctttggttatttaaagctagaaaagattgggtttaagaactttaagacaacgggctaaaatcaactccaaggcaatgaaagcgtcttcctttaaaaagtcactagtgttttgtgtttataaatttgtgccttcactgttgaatttgtgccttcactatttaaaatgtatacaccgtatacaggtttagcatttctaatccaaaaatccaaaatccgaaatgttacaaaatctaaaatttttgagggccaacgggatgccacatgtggaaaattcaacacgtaagtacttaactcaaactctgttccatgcacaatattattaagaatattgcatgaaattattttcaggttatgtgtataaggtatatatgaaacataagtgagttttgtgttttgtgatagacttgggtcatatcaccaaaatacctcattatgtatatggaaatatcccaaaatataaaaaagtctgaaatctgaaatagttaggatcccaagcatttcacataagagctgctgaacctgtagtactcttttaggcactcagatgtagagtgaagttaattctgtataatataagctaaaaaacataatcattggcagtacctagtggtaactcaagctttcaacatcattagaatttgaggatgttaatatacctgcacaaaacaatcctatgtgacttttcaaagatgaaattgcactcagtgtggtcaaatgaagaaattaaatcatgctatgaataagtgatgttttattaggtagatgttctagcaaaacctaatgctttacctgagaagttaatcacttcttacattatttttccaattgtttgtcttcccaagagttgtgctaacttaatattaatttgatatattagctgtattcacttaaaagtttacacaaaaatattttaccatttgtaattgtttcaagtttatataaagaattaaatatattttaacaagcatctacataattgacatgatttttttctaacctgaaaacctaattatcaccttcttatagaggacaaggaacagctttgcaggcaaattaatgtatcctatcagtgggacagtttgtcacttgcttaaataatcatcatctttgttataagctttacagaatgaagaaaagagataggacccctctcatactattacacattaaaattaacttcccacaggtttttcaacagtttcctacactttcactgtgctgaatcataaagtagaaatgacagcattaactgcttttcaagagataagaagcaaatatatttcatatcagctttgtcaaataaagtcttcagtcaccacacagatacatcatatatttaattgtacacaagttaaaaagtatgccgcatgttaaaataatatgatatcatagtgcactagtaaagagggtatgtaaaaaggactgcgttattaacaattagttgatattattaagtaattacctaaaatggacacctgccattaatttctgtacaataaagagctggcacatgctaaaactggtttccttattttcttatctaactgggtaaagttattaaaattacggtaataaaggcacctaaaatacacaagatttgttaaaatgctcttaaagtaaatatagtattgcttgcattttggaaactttaaaaaataatattcttgctattaattgctatattaaagctattatttctaaactgaattacttataaataaaaaagatttttttaaagactgatctcagttccaactagcaaattatttcagacattttgcatttatttaatttccaatgctgcaattaagaaagaacatcaacactttgacttttagttggtctgaagcaaagtcccttccacgtgagattaaaacttgtcttgttcatcaaatgggatcaaaagctccttaattagtaggctggactaaggtacacagatgccctttgacctcctatgacagattgctaacattttagcatttacaacagactctcaagtatgccggctgacattcaaatataactcaaattacacttggttaaaagaattgtatacatctacatgagaaggactactggtgtaaaaaatctaagtcccggcaacgcaacacaaatcaaaacaatgactttgccagtatgcttaatagggaaggactcatccagtgttctctggattgcgggaagtgcggcaaggctgagtgcatgtgggctagcgccctctgctggttagattcttcaacgtctttaaatcaagaatcttcaagccttgattaaaaaaaacgatgctctaaagattctttctctttctggaattaggaatctatgggaagccttctaaaaatttaaattttaattcgatttcaggtattctaaccacctgaatatttatgtgaggatcacaataaaattagatccccaaatttcttttaaaatttaaattaaaaatttaataaattcttatgactacataataagtgaaccatctgataaaatagtgtaacaataaataaaataagttaaataatttaaatttaaataaattctgaataaatacctctgataaaactaatcgttaataatatagtgtgcccagcggtggctggcaagatggctgagtaggaacagctcctgtctgcagctcccagcgaaatcaatgcagaaggtgggtgatttctgcatttccaactgaggcacccagctcctctcatttggactggttagacagtgggtgcagcccacagagggtgagccgaagcagggtagggcgttgcctcacccaggaagcacaaggggtcagagaactccctcccatagccaagggaagccctgagggactgtgccatgagggatggtgcatcccggcccagatactaagcttttcccacagtctttgcaacctgcacaccaggatattcactccagtgcctacaccaccagggccatgggtttcaagtacaaaattgggctgccatttgtttgggcagacaacgagctagctgcaggatttgttttcataccctggtggcgcctggaataccagcaagacagaaccgttcactctcctggaaagggagctgaagccagggagccaagtggtttagctcaggggatcccatccccacagagcccagcaagctaagatccactggcttgaaattctcgctgtcagcacagcagtctgaagtcaacctgggatgctccagcttggtggggggaggggcgtccgccattactgaagcttgagtaggcggttttaccctcacagtgtaaacaaagccactgggaagttcaaactggacagagcccaccgcagcttggcaaagccgctgtagccagactgcctctctcaattcctcctctctgggcaaggcatctctgaaagaaaggcagcagccctagtcagaggcttgtagataaaactccaatctccctggagcagagcacccgggggaaggggtagctgtgggtgcagcttcagcaacttaaaccttcctgcttgctggctctgaagagcatgttctaacccaatgcaaggaagcaaagaaccttgaaaaaaggttagatgaattgctaactaaaataaccagtttagagaagaacataaatgacctgatggagctgaaaaacacagcacaagaacttcgtgaagcatacgcaagtatcagtagttgaactgatcaagtggaagaaaggatatcagagactgaagatcaacttaacaaaagaaagcatgaagacaagattagagaaaaaagaatgaaaaggaatgaacaaagcctccaagaaatgcgggactatgtaaaaagaccaaacctacgtttgaatggtgtacatgaaagtgacagggagaccaagttgaaaaacactcttcaggatattatccagaagaacttcaccaacctagcaagacaggccaacattcaaattcaggaaatacggagaacaccacaaagatactcgttgagaagagcaaccccaagacacataatcttcagattcaccaaggttgaaatgaaggaaaaaatgttaagggcagccagagagacaggtgaggttacccacaaagggaaccctatcagactaacagcagatctctctgcagaaaccctacaagccagaagagagaggggggccaataatcaacattcttaaagaaatgaattttcaacccagaattccatatccaggcaaactaagcttcgtaagggaaggagaaataaaatactttacaggcaagcaaatgctgagagattttgtcaccaccaggcctgccttataagagctcctgaagaaagcactaaatatggaaaggaaaaactggtaccagccaatgcaaaagcataccaaattgtaaagaccatcaatgctatgaagaaactgcatcaactaacaggcaaaatatcaagctagcattatcatgacaggatcaaattcacacataacaatattaaccttaaatgtaaatgggggaaatgccctaatcaaaagacacaggctggcaaattggataaagagtcaagacccattggtgtgctgtattcaggagacccacctcacatgcaaagacacacataggctcaaaataaagggatggaggaagatttaccaagcaaatggaaagcaaagaaaaaaaaaaccagggattgcaatcctagtctctgataaaacagactttaaatcaacaaagataaaaaaagacaaagaagggcatgacataatggtaaaggaatcaatccaccaagaagagctaactctcctaaatatatatgcatccaatacagggggacgcagattcataaagcaagctcttagagacctacaaagagacttagactcccacacaataataatgggagacttgaacaccccactgtcaatatcagacagatcaacaagacaggaaattaacaagagtattcaggacttgaactcagctccagaccaagtggacctaatagacatctacagaattctccaccccaaatcaacagaaatacattcttctcagcaccacatcacacttattctaaaactgaccacataattggaagtaaaacattcctcagcacatgcaaaagaacggaaatcataacagtctctcagaccacagtgcaatcaaattaaaactcatgattaagaaactcacccaaaactacacaactacagggaaattgaacaaccagatcctgaatgagtacggggtaaaaaagcaaattaaggcagaaataaataatttctttgaaatcaattagaacaaagacacaatgtaccagaatttctgggactcagctaaagcattgtttacagggaaacttatagcactgaatgcccacaggaaagagcaggaaaggtctaaaatcaacaccctaacatcacaattaaaagcactggagcagcaagagcaaacacattcaaaagctagcagaagacaagaaatagctaagatgagagcagaactgaaggagatagagacacacatacacaaaaacccttcaaaaaatcaatgaatccaggagctgttttttttttttaaagataaacaaaatagaccactagccagatgaataaagaaaagagagaagaatcaaatagacagagtaaaaaatggtaaaggggatatcagcactgatctcacagaaatacaaactaccatcagagaatactataaataccactatgtaaataaactagaaaatctagaagaaacggataaattcctggacacatacaccctcccaagactaaaccaggaagaagtcgaatccctgaatagaccaataacaagttctgtaactgaggctgtaattaatagcctacaaaccaaaaaaaagcctaggaccagacagattcacagccgaattctaccagaggtatgaagaggagttggtatcatgccttctgaaactattccaggtgatagaaaaaaagggactcctccctaactcattttatgaggccagcatcatcctgataccaaaacctggcagagacacaacaaaaaaagaaaatttcaggccaatatccctgatgaacactgatgaaaaaatcctcagtaaaatactggcaaagcaaatccagcaggacgtcaaaaagcttatctgcaacgatcaccttgacctcatccctgggatgcaaggctggttcaacatatgcaaatcagtaactgtaatccatcacataaacagaaccaaggacaaaacccacatgattatctcaatagatgcagaaaaggcctttgataaaattcaacagcccttcacgctaaaaactctcaataaactgggtattgatggaatgtatctcaaaataataagagctatttatgacaaacccacagccaatatcctactgaatgggcaaaagctggaactattccctttgaaaactggcacaagacaaggatgccctctctcaccactcctattcaatatagtattggaagttctggccagggcaatcaggcaagagaaagaaataaagggtattcaaataggaagagaggaagtcaaattgtctctgtttgcagatgacatgactgtatatttagaaaaccccatcatctcagccccaaatctccttaagctgataagcaacttcagcagtctcaggagaaaaaaatcaatgtgcaaaaatcacaagcattcctatacaccaataatagaccaagagccaagtcatgagtgaactcccattcacaactgctacaaaaagaataaaatacctaggaatacaacttacaagggatgtgaaggacctcttcaaggagaactgctcagggaaataggagaggacaccaacaaatggaaaaacattccatgctcttggacaggaagaatcaatatcatgaaaatggccatactgcccaaagtaatttagagattcaatgctatccccatcaagcaaccattgacttttctcacagaattagaaaaaactactttaaatttcatatggagccaaaaaggaggctgtatagccaagacaatcctaagccaaaagaacaaagctggaggcatcatgctacctgactgcaaactatatgacaaggctacagtaaccaaaacagcatggtactggtaccaaaacagatatataaaccaatggaacagaacataggcctcaggaataatgccacacatttacaaccatctgatctttgacaaacttgacaaaaacaagcaatggggaaaggattccctatttaaaaaaaggtgttgggaaaactggccagccatatgcaggaaactgaaactggacccctaccttacactttatacaaaaattaactcaggatggattaaagctggaaaccatcattctcagcaaactaatacaagaacagaaaaccaaacaccgcatgttctcactcataagtgggagttgaacaatgagaagacatggaaacagggaggggaacatcacatattggggcctgtcagggggtggggggcctagggaagggatagcactgggcataatacctaatgtaggtgacggatcgatgggtgcagcaaactaccgtggcacatgtatacctatgtaacaaaactacatgttctgcacatgtaccccagattggctccaaagtcatttgtaaaacttctctttatcttttaaaataatgtatcaggttttatgcaaaaccttcctaatcagcactatcccatcactgcataagaagtattttctcctttgcatcctctgtgtatgatactccaaccactgcactcatcttacagtattatatatgtgtttgcatgtatcttttccccactaagctataaactctaagtggttggaatggtgttaaactcatcttctaccctgagcaaaagaagtcttttctggaacatattagccttgcatcaaatgagtatttatctagacagaatgtttagtaaattgctacatatgtaaactagagcaagttatacttctgaatttgttttctaatatgtgaagtaaaaataataattgtaactatctcctaagattgtgtgtggattaaataaaataatccagaaaaatcatttagtagagtatctggaacataccccagcctttaagaaatataaatgatgagttttattgtagtctattgccacaaggacacacaacttacacgttaggtttacaactgtttattaggctataataactgagaataaaaataagattgggactaacgattagtgatattagcttaagttttcatggtaaccaagcttttttttttttcccctagtaagatgtatagatctagaaaaagcaatagaatttttttgtaactttgtgttcttttctgtatgtcatatgatactttaaattactttagttatatttgaaaataatttttatcattaggtgagtagaaaacaggctaaagcatccaggttgaaatgtaaaacagccaaaataattaaagtaattgaatttgaacataaatgaattttatattcataaatttgcaaactacatgaatcacagtacatgaaactttctggtattttagaagttattgccaaaattccaaatgacttttgtaatttaaatatgccttaaagattaaagcaaaatgaattaaataagacaaagttagtaaaagtaagatgaaaagtaagtaaacaaaatattaaaagaatatgtataaagaacaaactgtgtctacatattaaaaaccaaacaaattatgacatcacagtgactactaaacatcagtaagtaagaagagtgcatagtggcatgtgctctgcatagacataaatgtacatgtaaagatttattctttaaaagcatataaatgtagagatgcttgcttgcacagcaaatggttttgttacatcaggatttctccgtgtacttgttagtatttttatcacatcattaaaaagtttcagtagaagatgaggatcatagaaattcagatttaagtgacctccttaaagctgagaaatgaactgccaaacccaaagtctttgcaaagcccaactcatttttaaaatatatgaaggttttggcagagaatgctttttgacccgttattcatttttctttcttcctgtgtacacaagaacctctcagactttatgtgagcacatgacaccaccatgcccctgccagagatcacattttcctgagctcttgcctttaagggtggctaggtcactaagttgtgatatgagtagcagcgacaggggcgactctcagtggaaaaacttggtgaagatgctgtgggcattggacatgggtatgagaagaatactttttggggatgtcttctccagtcctcagacagaaagaggcacctcctcctggtagcatatcgtactccattttgcatttacctcactgatagtctttaccacatgttactgtgattccatgtttggcttttgtcttccctgtaggcccaaaggctttacaagagcagagaggatatttcatattaacattactcattctccaagtactttcacattatagaactataataaatatttctcaagctatacaaaataacgaaaagaaaacataagagtctgcaggtatgatcctgatgatgaattctgactttgaaagaacaatcaaggcaaaatgaggaaagcttggaagagagtcagaatgtcctgggaataggtatagaatgaatccaaggaaatgccagatggtgagacttggaggcaataagtgataagatgatcaatcataattgctagtatttgggggaacacaatatttgctagacactgttaaaatgttcttcatccagtgttaatttagttttgcaacacagcccccaggttgatgccattagtatcaatcctcattacactgattagaaaattggggcatggagagaggagaaattttcctaaagtcacacagttaggaggtggaagagccactatttgaagccagggagccctaactagcacattataaatatctgggggaaagaagaggtaaattgaggagacccaagcatgactccgcaataacatcccctgcttattagcgttgtcttaattcttcatagtgaagtatggcccataggtcacacttgctcacatgtgatatatgtagtgtgagccttactcctagctgctggtgtacacaattattgagactttctgtgatgcattatccatcggatttgcatgagttggaagtagacgtttgcatgtgcacacaagctggcctaagaacagaaatgagccatcaacagggagggggaattatcatataaatcctaaacatttcaagtgtacatctacttccagggatcataaacataaaaaggttaaataaggcaggagttgtcagtggtttggtgactatgaaacaggaatgaggtaatcaaactggtcttatctttcattgaaaaatacgaacaagcgctcattgagtgcctaggagcactcaacaagctttgatcaacagagctttggaccatacttaaaatagcaacattaaggccaggtgtggtggctcatgcctgtaatcccagcactttgggaggccaaggcaggtggatcacgaggtcaagagatcgagacaatcctggctaacatggtgaaaccctgtcctgttaaaaatgtaccaaagaaagttaaagtcgattttagtaccagcaagaccagttaacaccttagaaatgttttttaaacacagtgacaggcctaaacagttgcagccagtcaacactgcaaaataggggcaagaaccttggaccaagattcactagagtgtaatttactaatcacaaggagggtttcttgtttactactgtatcctcagtgttccataaatacattcaataaatctttgttgaatgaataaaccaaaaaaaaaaaaaaacacaaaaattagctgggcatggtggtgcacatctgtagtcccagctacttaggaggctgaggcaatagaatcgcttgaacctgggaggcggaggttgcagtgagctgagatcgcgccactgcactgcagcctggcgacagagcaagactcgtctcaaaataaataaatagcaacattaataacgatggcgtttatatagagaggctagatggattcagcctgatgactttgtcagtctcttattttgaccagtcaagctactaaagttcctatctagggagtgatgtggagctgtgcttgtcaaagcacatttcttggactatgtccatcagagtttctggaggacatggtcaaaaatgaaaatttctggactatgccttgaaccaattaaatcaaagcataaaaggacagaaagttgtatatacatgtaccatatttatgcttaatgagtttttgtatgttatgtatataactattatatgtttatataagctaattgtcataaatatatttatttatataattattttattacttactgtttttaaatattttattacatacttatttatataactattaactatattatttatataaaattgctagaaattttctaaaagaaattttaaatgttaattccacaaaagtatatgagttaatgcatgtgtgaaatatcttgatttagccattccacaatgtatacaaacatcaaagaatcctattgaacatcataactaaatacaacttatgtttttaataaaaataaaatataaaatataagtaacagacaaatatatgtacgcatattatatatatacttatataaaacataacacacatttttaattctgtatgatgtaattattatgctgactgaagtttgggaaccatggcattacatatcccaatatgaaaacactgttaatgcagaaaatacaaatttcaaaatgctgcatatgtgagaatattatttttctcttcaaagagcaatgtttatgagtgaaccattttttaaaaaataaatcattcaagggtaatattttagaattaactttgttcagtcagaaaataatgttgaacattttcacataactacatgtattccaaaagaaatgcatgagtaactaatgcttatgtggagggagaagcaacgcagaggatataattagttccaattagccatgccaggggattactttctaggtaagattacctataatgaggtgattaacctctttggaaaaagttcaagccaggcttaccttctacttaatatgtcctgtaaagaagtgttacaacgagggtcctcacaattgttccctgggataattgccaccaagaatcaattgattctattccagaagaatcaaaaagcattcttattatattattgatagaatgaatcctaacacatctatatattagaaattaagtatttaaatttcatatcaaattaactaaattatatggcacggattttatttatactaacaaaacagcaattgaactctagtcaattccaaatacagatctatcggctatctatgaacatcaaaggggaagaaaattctatcattgatattggttaacgtcacaggcttatttccaaaagtagactgtccattgtctaattagtttagagggtctcttctgtctccagcacacaattgaattttgttgcagttggagaggctgatgctaacctaggtggcagggctgaacacaagggaacagaagcttcagtgttttcaccataaaacacgagataaattgaggatagggattttggaaataatagatttaactgttgtccaagcttatctgcagtttcttccctttaaactaaattgatagtttacttattatggactaattaaaattattatatataatattatctatgtaatatatctgttacatatatatattgttgtcagcttataaggaacaataaataattttctttgtgttttaatttaacaaatacttcctgaaagtttgcgtgtaggcatacaagctacaacaatgagtagaaattttttctaaaagtggttttttactgtttaatactcttccctataagaaaatacttaaacttgaattattcttgtaatcttgtggacatctctgaattaattactgttactttacaaatcttgtttctttatttgttatcctagaagtatttgtatgtgtgtgtatataaaatttttgcatagaccacatgcaaattcatgtaaagtaataatacaaaccctaggaatcgaaaggcaaaatcaaggggaaaatatttaaaatatttgcatggaaatgataataataaaatgtaagtgtcttgcaaacagaaactagaaataaatatttctgttttatttaaattagagcatatacaatcaagccttacttcagcatgtatctgttagagctcaatggtcaccttaatttgggagccccaggaaatatcttccctctgtaaagttacaaagtagaatttttctctggtttatattcttctgtggaatttacgattatctaagctctctctgatcccaagttccatttcttcatttatcttagattctaaaaatctaggccttagctgaatgcccatcaaacaaacagggctccttagtaaatgtttgcagacaaaggaaacaaccaaatcaatagcagataagcagtattttatccaagcttcagaaactttattaatattttttgttacttcactgcagtggcaaaaataaaaaatgaacaggagaataaaaaatgtggtgtgaaagaagaaagagagtgaggggcaaaaaaggaagggagaaaagttattcccttctttattcatcctccagtcctcactcactctattccaaagagccatcttacaaacatgattttaaacagcctggatacagaagtaagtgttctggttttattaatggtgccaagaaatgatgcaggaagcttcaggtgaattgaaaccccctgcatgagaacacacacagtcctgactcatttaaccattctcatttctacctgctcagatccaacaaagtatttaagcaagtctcaacatacaaataaaaatatatgaatcgaggagcatagtaaattattttaaaagctttacattaggaatacacacatagaagagcacatataattgtaagagatttatataaatatgataaaatgaaaactcttagcaaatatatatgtatacaaatatataaatcgatgcatcacaaatacatatatgtatacacatatatacatctatatatttacctatttatctgtacactatatggtttataggcaaaccgtaatttagtcatatggaaaaactggcctcatgataatgcttacacacacaaatttcaaaaatttcatttaaatgatatagcaaagtattctaagttagaatgaaaaatgagtatgtttcttctttaaaaacacatcaattcattctagtacacagaaactaaagacataaaagtgctttaggacatgaaactctcatgaagatatgattctcttcaaaaggtccctgcacaacaccactatttctaataaaactgattttattcaaaacactaaaaatgacaaacatttaacttttaatttcagtagtcctgtttacctagttggctaataaaagatagtgacatatacacaaggtagaagtgtgccttaaaacatgataataatttacatttttaaatgaaaaaaattcagtctacaataatgaacttgtcttgactgaggcaaaagtgaggtcaaatacctgaatgatgacattgtgatatacttcatcctttctttactttcactgtttttaatagattgtgaatgtcagtaatttaaaaatcaattgtactcctgaaataacagtttaattcctaaaagtttaaagtgaaagaaaacatgaattcctacaaatgtgattctacaaagatacatgttaaaagccttcagaggaaaataaatacaaatatctcctatattctatttgctatgtcatacctgactcaaaaatatatgtaagatacacatttaagagaatatctcatgaaattgattggatgccaattttcaattggcttttttcatttgtacattaaagattcttacagaagatcaagaaaattataaatatgaatacatcaacagaatatatcatcatgatgtaagacaatttgaattgctctggaacttcaaaagcattttgttgaattcacagaaataatttctcaatggtactttatatggtaagtaaaaatatttggctttgatatagcatttttctgtcactactgaaatattatatttttaacttctcattatattctagaactttaatggaatttttatctctagataacaaatggcaattttgtgttctattactctagtctgtgggcttttctttgtctctatagcaaaatagaaaaaaaatacacaggtttgatttttctattcttagaaatgataattttccatatatatggaatatatgtatatatacatatatgtatggaatatatgtatatatacatatatatgtatggaatatatgtatacatacatatatgtgtatggaatatatgtgtatacatacatatatgtatggaatatatgtgtatacatacatatatgtatggaatatatgtgtatacatacatatatgtatggaatatatgtgtatacatacatatatacacacacatatatgtataagcatacatatatgtataaggagagtgatattttatatttagtcttcagttcaataccatcaacacataaagaataataatttgaaaattgtatactgctgacatataaattgataagaagaagcacaaactaatctataagtaatctcatattatttatttgtaggacacagtgctcagggatttatgttaaagaatttttgtttgttttgcattgctggttcttgaaggttatgtacgtaaaggctgagaaaactaaaaggtattaatacctcaaataatagttatgtagaatgaagactcactctacatatcacagttcaatctttattgcattttttgcactataaaagcataaactataaaggtagtaagatatatagaaaaatatagagaagataaatataccatgaaatagtaaataacttacagaataaatacctattgagtacacagtatgttccacaaactgtgtagttactaaagcccaagaaagaaaaagcagaaagtagtacagaaataaatcacatacttctgaccagggggctgagaacctatctttgtttcattccaaaaattagagaccagatactttgaaataagctgcgtggatttaaacagtattattgtgatcgctggccataagtgcttactagctaacttcttttagtttattctagtaaaatggttttaggtgttacacattaagaatttgaattgaatcactgaaatcatgctatgactagatttttaagaaatctttgtaagaccacctgatacggtttggctgtttccccaccaaatctcatcttgaatttccacatgttgtgtgaggtacccagtgggaagtaactgaatcatggaggcaggtctttcccatgctgttctcatgataatgaataagcctcacaagatcggatagttctgtaaggaggagtttccctgcacaagctagctctctcattgcctgccaccatccacgtacaatgtgacttgttcctccttgccttccaccatgattgtgaggctttcccagccatgtggaactgtaagtccaataaacctttcttttgtaaattgtccaatctctaattaatgtctatcagcagcatgaaaacggactaatgcaataaattggtaccagtagaatggggcactgctgaaaagatacccaaaaatgtgagagcaactttggaactgggtaacaggcagaggttggaacactttggaggactcaaaagaaggcaggaaaatgagggaaagtttggagctatctagagacttgttgaatggctttgaccaaaatgctgatattgatacggacaatgatatccaggctgaggtggtctcaggtggagatgaggaactggttgggaactggagcaaagatgacttgttatgttttagcaaagagactggtggcactttgtccctgccctagagatttgtggaactcaagagagatgatttagggtatctggaggaagaaatttctaaacagcaaaccattcaagaggtgacttgggtgctgttaaaggcattcagttttataagggaagtagaacataaaagttcggaaaatttgcagcctggcaatgctatagaaaagaaaatcccattttctgaggagaaattcaagcaggctgcagaagtttgcataagtaatgaggagtcaaacgttaatccccaagacaatgggggaaaatgtctccagggcatgtcagagacctttgcagtaggccctcccatgataggcccagaggcataagaggaaaaaatggttttgtgagccaagcccagggtgcccatgctgcgtgaagccaagggacttggtgtcctgtgtcccagctgcaccatccatggctgaaaggggccaacatagagctcaaaccatagcttcagagggtgcaaggctcaagcctcagcagctcccacatggtgttgagcctgagagtgcatagcagtaaagaactggggtttgagaacctctgcctggatttcaaagtatgtatggaaacgcctggatgcccaggaagcagtttgctgcaggggcaggactctcacagagaacctctgctagggcaatgaggaagggaaatgtggggtcagaacccccacaatgcatccctactggggcaccacctagtggagctgtgagaagagggccaccatcctccagaccccagaatgatagatccaccgacagcttgcaccatgtacctggagaagccccagacactcaatgccagcccgtgaaagcagccaggatgggggactataccctgcaaagccacaggggcagagctgctcaaggtcatggaagcctacttcttgcatcagcttgacctggatgtgagacatagagtcaaaaggagatcattttggggctttaagattttactgccccactggattttgcagttgtgtgggggcatgtagcccctttgttttggccaatgtctcccatttggaatggctgtatttactcaatgtctgtactcccattgtatctaggaagtaactaacttgcttttgattttgtaggctcataggcaaaagggacttgccttgtctcaaatgagactttggactgtggacttttgagttaatgctgaaatgaattaagactttgggggactattgggaaggcatgattggttttgaaatatgaggacatgagatttgggaggggccatgggcagaatgatatggtttggccatattcccactcaaatatcatcttgaatttccatttgttgtgggaaggacctggtgggtggtaattggatcatgggggtaagtttttcccatgctgttcttatgatagtgagtaagtctcatgagatctgatggttctacacgggggagtttccctgcacaagctctctctctctttgcctgctgccatccacataagatgtgacttgctcctccttgccttctgccatgattgtgaggccttctcagccatgtggaactgtaagtccaataaacctttcttttgtaaattgtccagtctcagatatgtctttatcagcagcgtgaaaacagagtaatacactgccaatacttttcctataactggttccattttgcaagttacttggaagtccttttcaatgttacatagttttacacaaggaattccacactgctttgcatgtttttctaaaatcattatacgcctttataattgccctttttaatgttgcttattttagtatggtaataaataattattaatatcctttttttcaaaaaaggaagtatttaaagtcatctctctaaatagcaccatgagaagtattatgtatgtgaattatgaatgtaaatatgtttatgaatactaattgacaatttatataaatattttaaataccaatattatgtaataaatagtttaaaattctagtagcataaatatttagtttttttttttcttgagtctaaaggactggaagtttttattcaaattccgtttgttggaagaatatcttaaagtttagaaagttaaacagcatgctttcttttaacagttaacttagatttatatagaaatttggaaagaatatgatataaacctttcaactagcactctcttaagcaacggaaaaatcattacctttccctgttctttcaatttctgtcataagaagcatagagaacagaactatatattgtggtaattaatttccttaagataatgttagaaacatcatgttctttaaaatataaatgaatttcaaggtgagcatgctagaggataatattaatggcatgtgatttattgtgacaagagatctgatctgaaataccattattaggagtacttaaaaaaatccatttgcaaattcctgaaaatatgaaagtgtgctatggctgagcctgtcgcaatgttgaaatctgaactatctgccattgtaagtatgaaattgcttgggtacaatatgtcttcctcacagaaattcatcagaaaatgttcatatcctgaatatatcacattatggtttagggaattgcctaaatgcttgaaatgataactgtagacttaatctgcaaatgtatagattgaaacatacatgcctaattgacgtggtaatatatggaattctgtggctgatcattatcttaaaaaatatttggccaataatacattgaacatctactctatacctggttcttgaactcgcaatagaaacctgtgactttgtgtcattttagagagcattttctatgttattatctctagcaaagactccctataagctatttataagcgaggttcattcatgactcaaatttgcaaagaagttttaatacagttagttttacatcttataaaaaacattgaagtttacaaacacattgttataaatggcatctaatcacatactgagcagtgaggaatgtcacaaattagtagagctattagtaataaaagattaaatagatatgtgaataataggagtctttatgagtaagaagacttaaaaattattctgcagaaagaaattcattagcctctgatgcttgagagagggtaataaatattggcattcttacacataggttgtcaaatatgattagcacataaatatattgatatatctctctataaagcctttaatgaacttttttatgttaaactctctaagaggtacactccaaaaggtattatccaaacacactttcgttttttgcttgaaacctattttaatatatgaatataaacttctttatgaatataacttaaataatatatatgaatataaatatgaatgcttcatagaatgacatgtgggaaagcatagactactctatcttataatatgttttgtacacattaatagctatattcatttccaggatatttgaggtgtataatcaagtgctgaaatctatacagtacatatactttcactgttatgtcaatttatttttacatgtgtttcatgaactgaaactaaatcttgtaaaataaaaatgtctattctaggtacaaaggcaacttatagtgcaaaattttaattagattactttgatttaattttgaaatgcacctggagaaaaattcaaacagtacaataaagaaaaatacagttgtcaccacaaccactttgttcccatctccagaagcaaccagagttataaaatttgtgtgaattattctgaaaatatatgtacacatatatatccatatatgcatttatttcattttctttacgataaaaagtatagttttctgaactataagaaaaaagcaaatcataaggtcatgatttatttgtagggtaaaaaacaaatcaaggaaatacccaacataggtattagattatgtttttagttactaaaaacatttttttttttttttttgagacggaatctcactctgttgcccaggctggagtgcaatggtgcaatctcagctcactgcaacctccgcctccagggttcaaacgattctcctgcctcagcctcttgagtagcttgggttacaggcacccaccaccacgccctcatttttgtatttttagtagagacatggtttcctcatgttggtcaggctggtctcgaactcccgacctcatgatctgcccgccttggcctcccaaagtgctgggattacaggcgtgagccaccgtgcccggcctactaaaaagatctcaataggtaaatttaaggaaaaattagatacaaactcatgaaacatttgctgtgatgatttatgcataaagtagtgcaattttaatatttagaaaactataaaacaattttgaaatagtttttaacagcattttatttattgtgaacctacatgggagaagattacatcaatgtactcatgagtgacaaaactgaaataaatttaagaatgtccaggtgcaggtatctaataaatggtctataacatttatggcaagatgtcagccaaatgcagcgacaataaagcccttggctttgaatattaatagataaagtcacttaaatatctatacagaaatgctagttatggttttgtagctttgtgagctgaatagagtggaaatgagtataattgaagcaaaagataattcacttcttctgccccacttttctaggggagtgaggtggagagagccatatttccttctagaaatggggaagatacggaaccaaggctttcctgtttccctgagtaactgtgaaggtcaatgtctacatttttgaagaaaaaatgtttgcctattgctcttatgaggaaagaaattttgttcgtcaagtcttttctccttgaagaaatgtctctaaaaataatttatattggtattgatattactataatttcttttgatttagtttaggccaatttgaagctgatagtccaaagatatataatccctatgtaatatacacttagcattatcaaatcagaaccctgtgtttttccttgggatcaaggttgattgctgttcatatacgtcatgaaaacttccagtgtgtcttaaaactattaatttcatgttttacttgaaatctttctttataatacatgagaatgaaatagagatgacccattgcattcctcattatagtttcatcacaacctaagaaaaatttaattcatttatcctaccatcttaatatttacacacacacacacacacacgcacacaaagcctcataaagccagtagattataaaatattctgtaccatctagtgatctttttatggcaaaattcagcaactatatctataatttcatctcttttgtcaccttacctactgttgaatttctctgggtgtttttctctcatgatgtggaatctgtgtgcaatggaggcatcctaaggggagaaaatagaaaacaaaaacaggatggtttatgatcctattattttatgaaaatgtagactaaataaaaaaataacatttcaaaatgaacttttatttacaatattattgccaagaaggttatgtaaaattaggcaaaaatgtgtgatccatatgcagaagtgatttatgtaattctatgcagaagtgatttacgtaataatttcacaattgattatttgttacatttacatctaagactttattgctatttaatttctatatctcctttaatgactggctttggcctcatgttcaacgtatgttgaagatagcacatatgagtgtaaatgtcaaatagtaatggaaaatactgttaaacaagagttagaaggatgccctaagtggagaaatgatcagtacagaggctcctaattatttgagataattatgagtaaaaggatggtgtgagtgtgcatgtctagtaaagataagtgcaatacttgacttcagaatttgctcaggttgtcttgatgtgtaattaataacagtttggaccacaagcaactttctggcatagctcgttgaatagaaaaaaaaaacaacaacaaagagaaacatttatttttggggaattggtgacaaatacaatttgtttctgagaccccaagtgcatcggttctgaccctaatggatgtttcttacttttagcaaatacagaatttttccatgagatagaaatcatactcaatgtgtgagactgctgaaatactgctatccaagcttttcaagcacggactgctccaactgactctaaacaattatctctgttattccaagtgtggagatattttcccattcttcaaccacacatgattaatcactcaaatgaggaactaatatatttaccagtcatctcaacagaaaagggctattgttgacattcactgttaattttgtttcaaagtggagataaaagaaaaagaaaaccaaactcaaggaaataaagaagttgtgtatttgagagaatcttgaaaacactaatcaaggattaaaagtctaatgaatgaaatgaaaggctaatgtgcttactcatgcataacaaagcatgaagcacaaaaagagagggaccaatgcccactgcagatggcagagagttgcaggatacagctaactgtaattttttttctgtataaacatttgataccctaaaatttgtcaagtaattgaatgaatccatgaatgaaaatcacccagacatatagatagaggtgtatagaaacaatgcttataataaaggttacaaaaatccccctctacggtttaatatttaagacgttattttgttatatatacatggccaacttcctggtttgctaggaagtacaaatatcaagatggttcacttttattcgtccaacgataactctctaatctagtcacagagttcctttttataaatttaattctattaagtcataaacatattatactttataatatgaagttgtcttactgtggtatgagattacaggaaaaacacctgaactgggctatttatggtatatgtagcatgatcaattaattaattttgaaatgcacttacttttactttatccctaatctggtacaaaatcaacttggaataccttccaattaaaggcatacattcagcagactagttaaacaaagcaaaggaatatgaatcaaacactaagaatgaataatcaatattgcttcccatagggagagtatcattgaatttacttctgcttgaattgtttctgctaagttggggagactgagacttttaaaaatagattgtgtagtacaattttttttacaggtgtatatttttgtaatgacaaatttcttcctttacaaagcaacataaacagaatagagaaagggagagaggcaagaagacaggagggagaagagaggggagagacagcaaaagaccatttaagtagactagactataattgggtaaactcctagaaacacaggactacatagccaaagatagaactaatattagcttatttatcttcaagatacttgggcaatggatcatttagttaagaggggaaaaaataaaacttagtgtcaaacactagcaggtcttttccttgtgttgaataggttccaccataaaaagagaactggcattgccaactacaggattgataaggaacaatgacagcaggtgttcatttggatgagaattcagatccaattcacatgggaccctgtccctttggcataaccccaaagggcttgatagagtactgccaaaatctgcaacactatccagcagccatttttcaagagacaccaaaggttctctaaagacagccaaataagaaaaagctaaaatgccattttaaaataaattttaccatttctgtctgaatgcattacagtttttagacaacagaaataaatcagcattacttccgcttcctagaaggcacaaactctgaattcagactttctacttccaagccttgtgacttcaaacaaattatttattcattgagaaccacaacttccttatctttaaaagaggatactgacatcccttcaaagtaccttggtggagatttaatatcattctctatagcaattggaacagtattctatatagctcatattttcatacatcttatatacaaaccagtattttcttaaagttaaatgagaatgctaaatatggttaaatgacatatttttgaaatatatttttaaagacttacattgctttttattatttccttaacctatatagctttatttttaattaattaaaaaaatctaagaaatgaaaataagtcaatcttattaaagcaaaacaaatttaaacctcattgtgttattcaaacagtaaaaatgtaattagcaacttttcttgctacgtgtacatatataagtatatgcaaatatatgtatatagaataatcagcttattagccatatgtgtctcaaatacttgatcactagtatttttctgaaatgtatttttcctttttctgtataggcttatttatgttttaagtaaaattgccctaaatctccaaatttgcattttatgatattaatttgaaaagctgaatattttctatggatcataacattttcaattgagagaatgttctatatgtattgagatcccagagcctatagcaaattctgctgaggagaatattgtctttataaaatgtaaaatagaggtacccaaatattgtcatcaatattatcttttattctgtttaaataatctttctctcacaaatagtttctaaaatttgtcgagtaaattgttcatttttgatgatttgaccattgcaccacattaaatatcttttcaatttttttccattttagaatagaatataaatttagccaattagaaatgagtgtcatcaagagttattccaaaatctaattttagaattaaaagtaatcttgcatactatatgggtttttattgttgaaataatttagttcttccttgtttttggaggaatgaattccaatctctccctgtgtgcaaacttttctttttctcaaaaattgtaatttactaaaaagtttcaaaagctggttttcggtgctgtatttgttgaatattttgttaaagatttccagtaatatttttggagtgttactgcaaacaagaaaattgccaattttaagtgtatacttcaaaaagttttgtcaaaggtacacaataacaacaatcttttcctatgcttttgttcattcatatttcttcttatgtggactacatattgaagtctgtgtccatttatctctgtatattaaattgactgggttcaagacccagctctaaattttactgaatattttactttgaaaagtttgcttagattttcattattgtcattttcctatattaaaataagaataattttaataatacctgccttgctttgaagatctggtgttctaatacctggaagataactagaattgtgcctggtgtatagaaagcaagaaaataaatgttaactattactattactgaaaaatattcatgattttgagattcataataccttctcctttggtttattgagatggttaattaaataaattgcataatctttaagatgaagtatatgaggaaatttttgctttggtattcagaattttttgggttatgcattcatatatgataaattatctaacaaactcaaaagggtgaggaatatcacactatacttaaacttcacataaatatttctgcactagtacatatgaatattaactcaaggaaagataaattaacaatgtgagatagagctaactgtaattacagttatactagaaacactacactttgtaataccacaaagagcagcttagttcaggttatagttctcactaagaaactataaaaatctgggttttcaaagctttgttagattgagcttttaggtaagagattgtggttctgtatttcccatctggaataaaacaatgtttgctctcctgatagtgtttacctgaatgtactatgctctcctgacaatcattacctgaatatactatgtatataaggcactattttcacctgttaatatttttaaagaaaattacaataatagccacaagtgggattatttcccaggcagactgtatcagatattgatatctgtagtgctgggttgattaaatagagccagaaggttttcttctttatgctgcagaatagttaataatgcatgggaattatttgttctttaatcatctgtgaaatgttggcctggcatttttttttttggagaagttaacgttttggttttcttaatttctctgctatattagtttttctatctcttcataaattatgttttttattacatcatctgtagtgggctcaatggtgccccccaaaaagatatcagatcctaataactggaacctggtaactttttttacagaagtgaccaagttgatgattgatatcgattggaaccagtgacccctctctacattgcactttctttttgcgggaataggaatgcgtacaactgtgatactatgcttttttgccactgtattttgaaagcacataacttgttttctactttaacatgtccacaaatggagagatattttacctgaagatggatgatactaagtgtcatctgtatctgatttaggttatttacatgatgagctttgagacttggagctgaagatatttagatcagattttctacttaagttgatgacgtaaaggactgagccatttggggatatcaagaagaggtaaatgtattttgcacacagacatgaatctttgggggccagaggacagttagcagtgggatgactgtgatccctaaacatatcaggtcctaatctctagaaccttgaaatgttacctttgatggtaaaggtttttgaaaatatgattaataatttggtgatgagaagattatccaggtgggacgtaattcccttcacaatttccttatgagagagagacagagattagacaggaggagacgatgcgactacaaaggcagacattggagtggtgcagccacaacttaaagaatgctgaaagccaccagaagccaagagccacaagaaatgttttgttctccatcacctctggagggagcataaacctaggagcacctcgattttagtccaaggatattaaatttggatttatcatctcttgaactgtgagacaatacatttctgttgttataagtcaacaggtttgtggtaatttgttacagcaggcatgggaaacttatacttcatctgttcatgtagggtttttttttttttgagaaaaacattattctataatattttaattctttcttgaatccatggttattttgatcctcttaatttgaatttgcattatttttgtatttaacacacagtttagaatctataacttagcaaaaaggcataagagcacattagaataggcatagcaaagcctatatatatgtcaactccacaaagttgacacacaacaaccaaacagtaaaactctagaggtaaaaattgttgttttgaaaagaaggatttattttaacgcgacaatatagtgtagatgttttcccctctgaacatcatgttgaattgtggtacccagtgttggaggtggggcctcgtgggaggaaattagatcatgggggcagatttcttatgagtgcttcagcaccgtctccttggtgttgccacaatgggtgagttctcatgagatctggcttcctaaagtgtgtggcatctccccccacctcttgctcctgctattgccatgtgaggcacctgttgcccctttgctttccgccatgattgtaagcttcctcaggcttcaacagaagcttaagctggtgctatgcttgctgtacagtctgcagaaccttgagccaattaaatctcttttcttagaaattacccagcctcaggtgtttctttacagcaagcaagaatggcctaacacaccccagatagcactgctgagtatctatttaagattgtatgtgcgatctttagaaatataacacatcaagaattagacaataaaagttacatgtatcataaagaaaaagaaaggctatcattatttatacatgatataatgttatatacagcaaattcaaagaaataaactgaaatccacataaattgggagaagagtttaaagtttcccagatataggagtagtatataacaattagtggaattgacaacattaaaacaaagtaacagaaaaataataccatttacaatggcaaaagtaattataaatatataggtaaaaagtctgttaatctgagtcctatggggaaaaatgataattactgaaagacacacacacaccacacacacacacacacacacacacacacacacacacacaatcagtggagatacacactatcctgagttacaaagatttagggagttgatgttacagtgtctgaggaatgatacaagctcttctaaatgcgagcacaggtagcagcacctggactttactctgctagattgcattttttgtcttttagaactaatgctcatgaggtgtgtgtgtgtgtgtgtgtgtgtgtgtgtgtgtgattcgacaggaactcagatgcattatgatgcacatctgcaattttgcctgctgtgaatacttcagatggaacccattgtagatttctgttacttagttttggattacactgctggaacaaccagggcatttttctagaatgaaataacttagagacttggagaaatacatgattgagagcaagttaatgggatttagaataaagcaaatccctagagtaggatataggatttgctgaatggtacatgaaaattcaaaagcagattttaaatagggacacctggccgggtgcggtggctcacgcctgtaatcccagcactttgggagactgagacaggcagatcacttgagaccagcctggccaacatggtgaaaccccatctctactaaaaatacagaaaaaaaaaaatacccgggcatggtagtgggcacctgtaatcccagctactgggaggctgaggcaggagaatcatttgaacccaggaggcggaggttgcagtgggctaagactgcgccattgcactctggcctgggtaacaagaataaaactccatctcaaaaaaaaaaaaaaaatagggacacctttgtatgaaggtggctgcacccgtgagcaggttccaagtgaattatttaatttcttgggtatttgatattaggtgatggcaaaatttataattagaatccagttcaagttattaatctcaaactttacaatccacttcattcttttttttaaaaaataattattccataaagttggacatggtcatatcactcttgtgattatgttgcagagggcagtgatacctgggttatctgtgagataaggcctgccttacttcagcattttcccattgtccctcccattcaggaagggccccttgggaaagtagtagctatacactgggagaaggggcagcatcattgttccatcaaaaacagatggtggcctctaatctgaagaagtgccctattgtaattggaggaaagtttactctttttaaatgactaccaaaaagtctgtgggaaaccacataggatcatgcagaatactggggtaggtaaaacactcgtatgtccaaagggacaatgtgaggagctagttaccagacccagagggaaagagttatatagagaaaacggccttgggaggaaaagacatccagccccaggtgacattttcaccgaggtatccaggaacgtaagaacctgaaccctgctttatatcctctcatctactgtggggatctcaactggccaactccactagaagaaagagggcaagggaactttgctgtcttctatacaggacatttctcaggcagacagcagaacgaacaagggcagagagaatatctagagaggcaaacagaagcacccagaacacagggaccacagtccttgagattcaatgcttatggtagaatggagagctgtgtgtgcacagaagtctaaaaagcaccagtaccaaatctatggtaaagtattgacaattattaattaaggtgaccaccggagtatcagtataaattgttttatattttccactatacattatgcattaaacatttacatttaaacttcaacaatttagattaaaaatatttcattaaatctatagatttaatttaactgaagtaaaagattaatcttttgtcttattaaaattgatacgtagcatcacctttaaccttttcataatggcaagagtcatcttgttaagtaacacatgccacgtaccgtggtgggcagagtgtgtagggctattcactttccatgaaatgactccagactgccgagtggtagttgtgccttgtaatcgtttctggatttttaacttatttcctcttccaccacattagactgttaacattctaatatgttaaattctaacatgctgcaaacaacacgcctgtccctagcagtttcctccggtttgcttgattttaattttcatgtgttgaaaagaaatgaaaccttagaattttaaatttagaattgaccttaaataatgctcataggttagactagtaaagtggttttaaaaaagccaagatgaatctagaataggaccaataagcataaaaggagctggattaaatctctgtggacttctaccataagtgaatgttagtaattttctatgtgaactttaagttaatcattgtaactatttctaaatatttaattatgcctactgcctagatttccattttactccaaaaagtcaaagttcttaagaaaattccttttttttttttttttttggagacagaatctctccctgtcaccaaggctggagtgcagtggtgacattggctgcagtgcagtgcaatagctcactgcagccttgaactcctgggctccagtgatcctcttgccttgacccctcgagtaagctgggattacaggcattagctatcatgcctgactaacttttttttttttttctttagagatgagagatgaggtcaagctatgttgtccaggctactctccaactcctggcctcaagtgattctcctacttcagcctccaaaagtgttggaattaacaggtgtgaggcaatgtgcctggcaaaaatgacctttgacaaatcaattattattggaaataaaatatatttctcatctgctgtaaataaaaacttatgaacattgtaatggaatatgacaggattgaaagcaaatgtacaaatgattactatgagtctcaattccaaaacagaaacccatgactacagctagggaaccagatgaagagattttaattaagttttaataatcttactgagaatttctctaggttacaaatatttcatacagaagagttcatgaaattgggcagactaattcaaaatatgaaaaaaattgacctcagagaatctagagacaacttccaagaagagaatataaattataaatcccactcttgctctttcctgcgtacaatatgtagcattagcaatgccagaaaacgtctgtaatggtcttttcacataattaactgtaagcttcagaaacaaacttgtagaaagaataaacttactatacacttactataaccacagatatatcatttctgtgattaaaatgctcccttaaatacaaagtttcttctaccaagcaaattccagactcatttttaatggattaaagagatggaatttctctcaaggcgtttattttaaatctctagatttaggccaggtgcagtggctcacgcctgttatcccagcactttgggaggctgaggtgggcagatcacctgaggtcaggagttcgagaccaacatggtgaagccccatttccactaaaaaaaaaaaaaaaagtatatatataaaattagctcggtgtggtggcacgcacctgtagtcccagctactcgggaggctgaggcaggagaatcgcttgaactcaggaggaggagattgcagtgagccgagactgcgccactgcactccatccaaacggggtgacagagcaagactccgtctccaaaaaaaaacaaaaaaaaacaaaaaaaacccaacaacaacaacaacaacaacaaaaattattttctagaaatctaaacaacaaaaattaggtctagaaatctaaaatgaagaaaattgtaaagagcatacaatcagcaactgaattaaaagtgtaatccaacatgtcactgaagaaacaaatcatctgtgtcttaacatagaattaatctacttccctaagtgtcacctgacaagaaaatacttaacaaaaatctttactaagatgatcataggcctagaatatttcacaaactctgcctgtatctattgaataatgtagggttccagtgtgttttggtctccctctaatagaatccttatttcatagtttccattcctctttcccaattagaaaacaatgacaggtatataaacttatatagctaagatatttactataatcatttgattgagattttgaattgagaaatcaagtcaatgtaatatatttaaaactgttcatttcacagtaaattagatatttaactctgttttagtttctggaaaccctaagtgtttttgctgatatatattattttcaataatcaagatatctttctcagttaaggcacaaaggttgtatccatcaattacatttatatgtctcaggttgattggtcattacagtattcattcaatctgataaaagctgcaaatgtgttcagtgatttgatataatttccgaaaatctgcaaagaaagacttatcatctttgaatacccaagggtttgaaatgtgacagcataatacttaattttgcaaaataaatccaagtcaaaacctcatgtgcgtttgcaatcattaaactgaagtggggaatgaccaaagcggtatgagtggtcaccagtaacttgggatgagatgggagagtaagaggtagggatacaggcagcagtggagcctgaagtggacacaaaggaggaggggaaatgagatagaagaaaaatcatgtttactatctacaagtaggaatgagaatagatctcaaaggcgcgggaggatataagcctgcaattgaggctaaggggtcccttgagaattatactgggacagagagaagggagctggatagtgtggtggaaccagaactagaaataatataactttcacggcaaaagtctgaaagtaaggttctctataacattcattaactcaagaacgccaacagtatcgatgctgcaccaagaacagagtgcaaagtacaattatatagtttttaatcccatttaatttccttagtgagtcaatgaggtaaatattgttctagagaaaaagctgaaacttaattggtttacataactcagcaaaaatcaagttaaggtagccaaaacttaaaccagaatatatgtaactatatgtaaatagcacatagttacatagtctactatctcaaaaggctttagcttatgaattccaaagagaatcaagctttattataagaataatttccaaaatataattattttctttatacctgaaagacaattatcttaataatttggttaatttcaattagatatctcaaagtgacagcatagtttatttatttgcatctcatttcatctaggcagccacgtgcccagctaataaacaaatacattctgattttcctgggtacctttgtaactagaaatggttatctagacagaggtccattccacccttcattaccaccaccttactcacagaaatgtggatttaattcctgaaagttgaaaagggggacaaaaaggagtccagtcctttaaaacaacttgaagctgtcctactggctttgaactaacttcttccagttgtcctgggaaaagaagcctatgacttagaactttgttattgttccataaagccaattacgatcctaattgaaacaaaggtaatcatttattcagcgcttcattcctgtgagaacataaaattagggagtcagtgaattctgtaatggcgatttctacaaaatatttcactcaattatttttctttagagacaaaatgacaaaactttgtatttatatagagctgtgtgatttccaaaggattttctggtaaattattcattttgacctgattaattgtggtaattttttttttttaatgcagaaacaggagagatgctaatgtttgccctttagaaagaatagatctgagtttaaggggctttctagagattatgcagctccctagaagtgagaatgagtttagtctttaaactctcaatccatgactcatggtgctacttccatattgatatggtttggctgtgtccccacccaaatctcatcctgaattttagttcccataattcccatgtgttatgagagggagcagatgggagataatttaatcatgggggctttttcccctatattgtcctcatgtagtgaataaatctcatgagatctgatggttttttaaggggaaactcctttcacttggctctcatattctctctcttgtctgctgccatgtaagatgtgccttttaccttctgtcatgattgtgagatcttcccaggcacgtggaactgtgaatccattaaatctctttttctttataaattacccagtctcaggtatgtctttatttgcagcatggaaatggactaatacccatcttgtcaagcaatatggattactggataattcacttgatgttaattttcatgaagaaccacttctgcttttctctaaggtatttcatcatttattgttgctaatgccattagcatccaatatttcctaaaagaacacatattattcagaaatttagaggctgcttgtgtccataattctattcttaacataatggtaggttttatttaattaacgatttagttcctggaggatgttaaaaaacaaaatatcgttgattgattctttttaaatgataaataacatttgtcctcattctttgttctcaagaataatattattttaactgtcctttattgtaatcatagtaattaaagagaatcaaatcagtaaattaatagcttaaaaccatgagagactcataatttatctaacttgttagaaaaattgagtccaacatccctcagcaaaaatatctcatacctcagtgctacaaagaacattgtaaaaagtgactgcagaactcccataacactaaactagtatttgaaagagaatataggcctattacattatccttataaatgattaatttttaattcataaaagtttacagagataaaagtgttttgtttataatgtaatataaaaattaaaatctattgtgtatctagaaaaaaattctagacataaaacctataaggggaaattgctcctgttaatctttgcttttattaccccaaaacagggctataactagtctattgaggactttcctatgggcagtagagaaaggaacaataatgtgaacaggttttatgtactgcagaaggatcaaatcttgttgagggagtgaggaggtagctattgtctagggtggggggtgatggctggagttgaaagccctgagggaaaatttaaaaataccaataaaagaacatatataagatattgcattggtggcacttaaaatatttgctcatgtttttccaacctaaaaacaaaggtctagtcttcatgcaaggaaaattatccatattttggattgtttgaagaaaagaaaatacaattgacacatttgttagtgaggtacagcttacagggattcacagaattaatgggtattagatgtaatactttaatctctgttttctgcaaatcatgaacccccgccatgatgggtttctacagttctagacctgatgtatttctaggtctgacctttatgccaccataaagtaatttaacaaacacctctaaaaataaaagacatggttcacctcaaaaataataagggccaagaaatttaaatccttttgatagcttacattcaatagcaataacaactcaatacaattacacatttaaagtacatgacaaaaaagggttaaactttaatggattgaaagaaatattttaattatactgtttgtaggctgtcataaatagtaatagccatagtcaaattttgcaaacatggaactatccctgtatgcttacatagacataaccatttttcaatacatctactttgaatgcttaatctatgcaaactttcagaggcatatttgcctagtgttagtatttctgataaaatagttttatgttagtttccagcaaaatggttctctaattaggcaagtatatgtggtcaattatgtttatttgaataaactatggattgaaaatggagttttatgttctactctgctatttgaagactaaaaggaagagatggtgatgcttgatgaaacaatggatgctaataccatgttttccccttatctacagggtatacattctaagactctcagtagatgcctgaaactgcagatagtacagaaccgtgtatataagtatatatatggttttcccttacatatgtacatacctatgataaagtttaaattagaaattaggtacagtaaataataacaataactaataataaaatagaacaattatcacatatactgtaataaaagttacgtgaatgtggtgtttatctctcccaaaatattttcttgtactgtagtcaccctacttcttgggatgaaacaagatgatatgaagcttacaggatgagacaaagtgaagtgaataggcactgtgaatgtagcattaggctacgagtgacctaagtggcaggtagcatattcaacgtggattccctggacaaagggatgattcaagacctgggtggggaggtccagggacggtccaagatttcatcatgctactagaacagtgtgcaatttaaaacatataaattgtttatttctggaatatttgattaatatttcagactatggttgactgcagtaactgaaaccgtggaaagcacaaccacagataaaggggactactgtaatattaagcattctacatttctggacttatccagcatgtaaacttctcacatataaaaaagtcatcataaaataccatggctatcatggtatcatacacacacacacacacacacacacacacacacacacatctatgtacacatcatagcaattaaactgaaatgtgatgttaatcatatgccatatccaatataaaatctataattacatgtatggccaaaatgctccacgttattttggcaccgatgtattagcttcaatgtttcaagctctttgaaggtttaaaatatatgaaaatgctctgcatattaaattcttttaaaggcccccttgttcaggaaagtacataatcaaaatatattgtcttatggaagtattccttaaaagagtatattttctatgatattaacttagtagtcaagtattagtattagttcatttcttatctagcattttatcttttatattcatatagtattttaattttagaattttataaaatgagattttagatgcctaacaaaatgtataagcatcttgagacaatctacacttagtgattcaaacgggacacttttttctgtattgtgctaatcttaatttgtgaccctacccaccaaaagaaataaaaagcagtctttgcaaatataagaatacaaatttagcctaccatttttcatcttttcaaataagcagtatttatgggttaaccacacttatggcttaatatggcattcacttattaagaatgataaccaccttaaattagtctcacaaacaaaatattatgggacaccttgtattgcaatgttttgccaggcaaaaacatcactcattctctgacatcaaatatgcaaagtgaatagaaggttgaaagcgcctatgactttttaaaggtattcaaaattacacatttgtaaaacactgctttgcttccatgatttagttaaatcattttatgtatttcaaattgtatgtctttgtttcactctaacgtgaaatttaaaaaaatacatacacttgaccagtatctagtcctactaatatatacaatccacgtggatctgcatgttatatggcttcatgataaaacagtaaactatcttcacaagattagtaatactattttttaaatgtcttcaagaaagacaaaggtttaataggctaaatttgatagtattgttgatatccagcagaatcaaattatttattttctgttgcttaaatgaaaagtacaaatatattcctattgtatttcaagttgacccatgattctctagatgtagtccccactaatcagtggcaccactgaattcagagacaaatccttcctgatacacacaatggaaaatactttaataagtgaacacataagaatctataatactattgcacaaagagaataatggtcaacaaatggctcttttaaaatgcattatttgtcactaaatacactgccattataacaagaaaccttttgtgctttaaaagggtatgtttctcagtaaaatatttatgcttttagaaattaccagactatatagcccctgcacaacaatttcactgttattacacaaaattgtaaattatttctttttaaattattaatgcaattgaaaaaagaagttttcaggcttatagtcttttgaaaggacagcaaaatagacgaaacaaaaccaagatgacaatttcagcatttaaaatctacacatgataattcaaacaaatgttatgacatttaagataatgaaacccttcatttattctactatctggtatgagttttatttcacatataaggagtcagaacagatgtccaaatattgtaatgccaaaagaaagttagggcatatcttgattaataccctcagagctgcctgtagtgtctctttaaaactggcatggtttacttcaaaacaactattcaaaatccattctaggaagcctagctagacaaagattcccaagacaaaacgaaaacaataaagcttagtataacccttttagcaatgtgagttgcgtattattgacagaacattcattgcaatcagtaaatgattaattgcaaatttgttgctaaattgaccacacaaaaaaaagagacaagcttcaggctactgttaaagaggaaaaacttatgttaaaaattattggaggcttcttgtagtgaattaattctaatcaatatactttttgactacacagtggaataatgacttccttaaatatcagaggtacccattattgtagacattcaaattaataattaacatactgacttgcatttttaaaaaatttacggaagtagctttttcttttgccttacctttaacaaataaatagttcatgtttcatcaaacatgtgcataagatttgtttttgaatttcaaatgtagattgtagaagtaatgcccatatggtcaaacttataataattgcctgaagcaatttgttcttgggtttttatgaagataaacctcagtggcatattaaaaatataaaagtttaaaaggtggtaagatagatggatgggtatttgtttctcagttacaaatggctatgctttacaaaaatggtgccttttgggttcttttattcatatcagaatgatcaagcaaaaatgagtggtataagggtacaatataatattttgcacaaaagcaacattttcatcaaaataacctgcaaagtcattttcagaatatttattgagcacctattgtatgccaaacactgtgctaggttctgaaaagacaaaaattaaataaaacatagaacttctgttaggcaaataatatttgtaaatctcttcttcccttaactactcatttttctttgaaacttattggaaatgcatcagtgacaaagaggcagaaacattattctaaagtttttgaaaacagaagcaataacttttgctacaaagatgaaaacagaggataaataaagctgcttcagatatttataataatttgatgactaaaaaattatgtcagtgattatgtagtcctatttctaggtaaggtatccaaagtcactacagctaataaggatatatttctaaaaattatgtgagggtgcttcaaggtctatattgaaggaggtggggaagtggtaagaaaagtgcacatctttaaaatgtggtataatatatacaatggaatactactcagccataaacaaatgaaataatgtcttttgcagcaacttggatggaactgcaggccactattctaagtgaagtaactcagaaatcaaaaaccaaatacgcatgttcttatttataagtgggaggtaagctatgggtacacaaaggcatacagagtagtatattggacattggagactcagaagcggggagaaagaaagggggaaaaggaatgaaaaaatgcctattgcatatgatgtaaactattagggtgatgggtgcactaaaatcctagacttcaccactgtacaattcacccacataacgaaaaactacttgtacttctaaagagattaaaataaaaattttaaaataaaacataagaaatgttttaaaaaaagaaaagtgaacatctttggtttctacagtagccctctatattgagactgtgttatacttttgggatgactttacaaagaactatgaagtccatccccccatatcataagatgccttccttagctctatgttcctaggctctcctaatggtattaaacaatcatgtccctatattcctcagtgtgctttcagccaggcataaatgaccataaatagcctctgctgcataatccagagcaccaaatggcctggagctagcagacaagaattcgaactttgctgcatcaccccaaataacaataattcactaagttattgaatgttgtatgttattatgcagagagtgaacaaactgacattcagcaatgctagataatttgtgcaatactgcaaaaccaataggtgggttcagctggtatttgaacacagctcaattgcttccttctgttctaggagatggcttgttatcttatttccacaatacccactgaatattgaaaaaaattcctttatataaccaagtgacactcatggaaggacagctcattttctagcactcaaagcatacgttttgttgtacatttaactttattgacacaaagatgcatttaatatattcttatttatggattatgttccatttttgagttagattcttaactgttataatacatggggaatatccatgctttattgtatctgagagttttaagtatagaaatatttttcacttaaaaaggtatgtaatttatatctatttctgcttaatttgtgaaaacaatcttttaaagcaaacaataattgtcctagtgaagcaaatttgccaccttacacattctccttaatagcatttgttgatttgttgaagatgcttaccttgctcaaatctgtttaaatctcattaaaatatattcacaaacaagtgctccatttttaaaattgctctgctaaggatacattaatacagtcaacttaattaacacaaagtattatacaatcataatgatacaaatttaaaaggaaaatggaataggtaaaaagtcatcaaattttaaaaacttgagtgatctgtagaaagtcaagaccagagattcagagaataaaataacctgtctaaatgttaatgctgaacaggagtagaactaaagtgttctgaattaaaatgcaggcatccttttcgattttatgattaatcatcagaattaaagtcaattgaaggtaattttggggaattgctaatttagttgatttttttgccttgaagtttacagcattctgtcaaagcatgctataatgtatccagtagtagtagtacactttttgttaggaaggaaaagagaatccaactaatttgtattttgcaatgagtaaatattaattccaacagaataacaatgtcaaaattaccaattaccttatacagcaatatagtttatttacttgcggtaagtttaccaattgctcacataagggaaatagattatatttggtaaggaaggtcaagagagaggaatcacttggagatgggctggaaactgggttttgaggatgaagaaaagacattgtgtgtaaacatgaaggattttgaaagtatgaaggtaaagagttttaatttcatttcattgggaagtttagtcctctgaattaaaaattcttgaacagaggtagagaaaaggtgtttcttagagatgggcatcattctaaaaagataactctgtggttcggtttttgagttattattattattttataaatgataaattttgcactggttgcttgagtagtaaaatgtagcaaatagtcccaaacttctatatgtttaaaattattttctgccccttttactgctttttgcccagaaagataactaagtttgttctgggctggtatctaggagttaatatcatttattattattgcttgaggctgagacttaacaactttggcaggaagcaagtcttcatttgatttgaaaaatatggttaattttgcagtatgttttgctcattcagaataattcttcaaaagaaatatgggtgagtatttgctagcatgatccacaaaaacattattggctatcacccccgaaagattagttttggtttgatttctctcccttctggcttaagtcttcttgaataccaaaagttagaaggaagacatggcagatcagtgatagattatcataatcataaaatcacaaaggtggagcctcacagatcatcttgtttgaaaattctttttacaagcaaggaaactgaggcaacaccttaaatggaatgatttacaaataatgagctggtggcagagctatggctcatgattcctagtacataacctttatactacataaactaacgttaatatcaagtagtggagaaatcaaatattcttctgaaacgtaaatgacagaaattgctcaaagcatagcctagtgtagtaagataaaggaaagaatgattaaatattttccaaatgtggaaacaaaaaacataagaactgtcatagtgaatcagacccgtggctcatcccagcgttttcttttaggcattggctttgagaagagaatacatttcttttcccacaggtcaacttcaaatgttagaaattcaaataagttgaaccaggactactataacctaaacaggttattttcccttgtggagttaatattcacaaattcgttctggcctttttcaatactttacatatttttatgttccctaattttatatgctccataacattttaaaacttttaaatattttatttgctgtaaatccatgctaacttttaaaaataaaacaatatcctccttttctcgtagtctaaattttattaacatctttgccctttaactgtattgatccagactataagttttcttaaacttcacctttttgataaaagaacaaagtgttttcaaattatttttattgatcagccttttaaataaaattattttacctttatcagcatttaaaaataggtattttttattatgaatttgtttattcattgaacccttattctatgtttagtactggagtaagggtttaagataagaaaatgaaccaaactaaaaagtttctttatttttttttttgctatcatctttcctaaaatagtacaatcaagagtacaagtttatttcaagtagcatttccatatatttggtaaaaatctttctacctccatgtttttaatttcactattattattaaccataaaaaataaaaagtaaataatacctacaggtattactcctacaggtaagcagtctcgtggtgttttaagcatggtgcctggtagttgggtgtgaaattggattcggtactaggtgattgatagaagctcaaaggaccttatggagtctactggtgaagatttgaaggacagtgagaaaagtgttatcgagggctagaagaaacaggacaactgttgtatagcggtgaaatatttagcaacattcttgcttctttttacatgaaaaatataaaagatatctataaatatgacaacggctgtaaacatttctaggcaaaatgtagaaaagtgttcagacatattctagctgcatataataataaacgggacaagaataaaggaatttaaagttttaaggcaaaatttacagaaaatattaataagcttgatgagtttgaggataaaactatttctcatcctgagatactcccagaaaaaatattctcaagataagaattggcttcagggaaaaaatcaaatccagtgtactaccaataacatggtgggatctagggttataggaatcacaaggttgtgactgtatgatttttgttaaaaccttaaaaatatttaagggcctgcccaggaaggcttctagaactcttaagagaatgctttatagacggattcaattaatagggatcttcttaaggacagtgtcccaaagtagcatctcaagttaaagaaatatcatcaggaggaggtatatggttatggcttttgtctgattgagcaacttataatttaatacataagaaacatacaaagtttttaaaggaatgcttatagtttggctaaaagtgatagaaacagtacaaaatgaaaagaggttgttgaacctccaacctactgtgagaaggcagcaggtggagaaacttgcttaatgaaaaacacaaatatgtgtctctggaaaagaggtaatgactcaaacagaagaatcaagagctcagagaatcatctccaggaagctgaactgagttaaaaacaagaaactggcaatacgtgttctgctggatttcataattgctatgaacaaatgactgctgtgtattttgtgtttccttacttttcgaatgggagtgtctattgccattatcctatgtcattttatgttggatgtatatatggggtgcagataatttgtttctttagttaataggtttttatttcaagatgaactatattcaaggagctgtacctgaggaagtacactcaggaaccccatctatatcctgacccgatttaaataatggggtctggacttcgaacaaataccataatgggatgaggtttttgagggtcttggaagatggtgagtatattttgcatgtgggattgcaatatatttttgggttaagagggtggacattgtagcttgtctcaatagtagctgccattatttttttccctacttgttcacacatgtcataccccagtgaaagaggaagtctatttatcttaatgtcttggatgtgggcttgactaacagaatgtgatgaaagtgacattctaggcattgaagctttcacctgtttctcttggaaagcttgttttggaaaaaaccagctttcacataagaagtccaactaatctgttaccttcatgttttgagatgagaaagaagccttctcctggagagagagaagtcaggtagaaccaaggtactaggcatgtgagttaagaaaatattttagaattttatccccaaccccagctgccagagctaatgcccatgaatcaaagaaaaaaacatccagctatgcactttccaaattctccccctacaaaattgtgagtaaaataaaatggctgtttaaagccattacactttgaagtcacatgttacacaatatacaactcttaagtaaaccaaacacaactatactatcatttcaggattcatttataattctgaagtacttttggcaataattagttttctggtgggaaaatattatgtttacaagttggagtcttaaatgtagttgatagaaatatagagatcgcaaattttgacattagattggaaacttaaattgaggcctgatttagattatacataaagtatctatatgcataatccttaaaaatatgatgtaatctatataacactattctcttcacagagcaccccaactgcaaaagcactcttgctgtatgcactgatcattcaaatcccatcacaatttctatctcctttgaaataaacatagctaggattctggctttcaacattcctttcccattcacctactcctctcatcttcaacactttccaatcttcccctaaaggatcagtttacttacagaaaactggaatcaacaaaagaaccactagacagcttaacatttgagaggactagctctttctttgactttctgccttcactccagtaactgtttttctcccttgtgatttatgcctctccagaatctaatttctgtaaaatatctgcgtgcttgtgcttctaccattttttgttgctcaattgctcaaaaaatatgtttcttacctatttcaacatgtgtgtaagatctactgctgaatctacctgatattaatttttcttacagagacaataaagctttaagtttgtaagtttttagacagtttggtaagacgttattcttaaaactcttttgaaaaactaactccacatttgtgtgtctgtcatctccaagactagtcaatccctgcctatcacattttcccaaagaggagatggtcatttgaacagactgctttctctcttctataacactgcatgaattacttctattaccttattttttacctattttaaatttatatcatgatctatattttgactcatctttacttaatataaaatgttaatcatttaattatattgggagtacccttgaggcaataatagattcttatctttttatggaagtggttttaaaaaattgtagaaataaaaaggtggttttcaacaaatagtataaataagattaactccgagatttattctatgggtctgagatgaggctaagaatctgcatttcacttactttaggattccaattgtttctggtgcagatggccaaagactatacaacaaaatgctgctttagacaatagggatgtgatttaagacaatttcctatagtaatgtaaggcagcgagtgactaaagggcagagtccagttagaaaacctttgcagaagtccagagaagatatcaggagagggctgatctacacagaagcattagcaatagaaaggaggggacagatggaagctaaactagctattaacaagttcctgaaactgttttctattaaagctgccttagaaaatgaaaatgtactgtgtaagcactaaaacaaacacaaccaaaaagatgttttcttaactgggaaattatgatgtgcagttatgtttggtatctaaatgcaaattttgcatgtaggctgcatttatggaagaactgaaaacaaccacaatacactatatcatagtagaaacaaaacagactagctgtacttggcatagtaatgataagccctttaaattaaatctttatgcagattctattttatactccaaacttttcatggagccttgtgtaattctgatgtgtaaaccaacaaacagagaggctctgtgtatggagtagctggtttggataccagctggcttggctgtgcgcctttctaatggtaatgaagtcacacagctgctaggacaatcagctggagttcagattgtcactagctaaatggatatccattgactagcttcttatccggactcattaaagtttagtattgacaaatagtggctggaggtttacaactaagaggcatgtagaaatgaacttgttgactattttttccctatagcttttgctttgtgattcacagaatgtcattcatctgcttgagatgcatgattactaatgcactgtaaaattttaagcactcttctgcttataattttcaaagtgaatgaatgttctgaagcaagtagtcacaggcatcaataagttgtcagtatatgaaaacacaaagaacaatcagaaagtactatttttctttaaaacaaataaaaagaaggtatgatttgcacaaaaagtttataacttgaggttgatttttattttaaatattcttataggtattttactggataatttctaagagttgactgcatctacactagtcaacatgccactaaatactagatgatttcttttaaccaagcaaattggatagataagaatagtcactggtaattttgttaattcgatagtcatctcttgaacatgctaacacttttccaaatcctcaaaggaacaagagccagaaatcaacacctgttgggtcagaagtgaagaataagccttcatgttgataaagctctacggtgctatctcttaacccctggcctcactgaaggcatagagcttagatataatgttccattccttgtcctcatatcctatgcagtttgtgttcttaagaacatgttttgtcttgtttcaagaatagactaaacttggccagctgcagtggcttacacctgtaatcctaccactttggtaggccaaggctggcagatcaactgaaatcaggagtttgagactagcctggccaacacagtgaaaccccatctctactaaaaatacaaaaattagctgggcgtgttggcacacatgctaatcccagctactcaggaggctgaggccagagaattggttgagcccaggaggcagaggttgcagtgagcagagattgtgccactgcagcccagtctgggagacagagtgagactccgtctcgaaaaaaaaaaaaagaaaaagaaaaaataaattcaaacttacttccccactcattgtcattacagactcacttctacctttcacaactttgctgccttgtgaaggttttgaaaacactggatccatgctacccatgttttgcctccaaagaccaatgtaaaattgcctcctgactgtgtgtgtgtataattatctgccttagactatgatgacacctttaggctctttgtgaactagaaaaataaaaagttagcagaccttcctcaagaagatatggaagtagaaaatgctagagcaatacaaaatgtgaatgacgctcaaacgccagtaatttgcttctttaccatgtcctcatgtgtaaattctctttccctttccttgatctacaggacacttgcttactttccaggtctctttcctgtggattccaaaggcagggcaacattcttccattgtcagtagtgtaataaaaaatgttctcatttttattcatacccagatttttttttataattctgcctaatatcgtcaagtgtaagtaatacaaagcaggcctatggcattcattgttaaatgtatactctctagctcacaatgtgaaccacaaaaaataatccagttgtggattccagctgtttctagtgcaaatggccaaagactacaacaaaacacttcactagacacgatgactaaccactcttcctggtaactcagaataaagattttggcaaaattttctgattagagtataaaatttcatgcctcccacaaatcaatagatgtaaactcacccacataaaggatgttgtcttgactcaacagagcaagcttagtgcaagtccagaccttcatatgatgtaaaagtttttgtaaggcaaaatggaaaattcctacagttaaaaacttttgcttaatcatgttttaaacttcttaaagagaaaaaaatagactatgtagctataaaacatttattaaaaaaaggtagacaatatgcaaataaagtttctgtacactggcagagaactgtaccaggatttagacggcctggctaactctgggaactcaagcaagtcatttaatctctcttgatttgataagcaaaataagagttttgatttcatgaattcattcattcattcacaaaacaaagatgtgccatagattcagcaaggcactggaaaattggagagccacgcactaacctctgagggcagcatacctggaatccctagagtccctgccagtccaggatactataagtgggtgaatagagatatcattccttggaattttccacacaaaaaagaacaatgactgctgatattctctgctatggctaaggctgctggtactccttgataccctgtaatttgctgtcttttccagcaagttgaccattgattagctctggccagtggattgtaagtagaagtcatatatatcaattctggcccacagtagttatgtatcaagagttccattttttgccctcttttctattccatgtgcaggctggatgatgccaaggtgacatacaaatttgtattcacattgtgaggacaaatatggcagaggcactagctgcaagtgcctgatgtctgggttatttaaaagagagcagcctgactgatagacaagatataacacaataacttctattgtgttaagccatagagatttgaaggcctgcttgttgttgcagcataacctagcctagtgtgcttaactcaaacaactatatattattataaacctcactcaatgacatctaaaattaagagcaatgtattttttgatgctttttatggcaattcagaatctagtatcttattcactgggcatcataaattaaaattagtatttagattctgatattttctatagggcatattgccagttttaatgaaatacttaactcccctgagcatactgtcagaaatgctccaaaaattctttaatgtgccgtgtgaaagtctcaatggtctcttactaatcaacattataatggaaaatacacatactagttaataattaaatatgtcaaaccataaagtatatgaagatattttcattttgtattacactttgcacagaaaatttcacagtgttctcattttttactgctgttaggaggtatctgtgatttccatttcttctttcaccctttcttttcaggtatccagggagggccatatgttgaaccaatgtgataccccctgaagcaggctttcctcattagtatgctacgtcttgcagcattctatgtactatctatcgaaattccactatgttggcacaggtctgaccaacttgcaagtaggcacaatgccaaacatgcagatggcaggaggggaaagagccaaaaaaacacgtgagtcaactgtgggtactgatggcaaaattcccagaaatgcaggtccaaacacttgtccatcctaagcttatagtacatacttacagagacacagatttgtcaacaataatctagcactgagttagatcaattatttaaaatattttaaatctacttttggctactgtgggtaacaacaaggcaatgattcaacaaaggttggtgtttagtctttcgtctttacccagatgacttctcaatagacaatcaggcggcatatttaaacaattatttctacctatattagttatgaataaaggagaaacgtgcatcttgtctttatttatataaactatataattaaaacacaagaaaaatattaagacactatacactgagactaaatactgttagcacagtagggctcaaattgtggctctattaaatattcttccttgacctcttctgcctgcttgatcaaaaaaatttattgtgttttataaactagtaaacttcattatcaggactggatctgtgaacgcataaaatgaatagtacctgatttgaagatctttaaaaggctcattcatttaaataacccattttctgctgttttggcagtttgcctgaaatgtctcaaattattgccacttaggttaagctattgtatctcctgaaggtgttgattttagaaggaaaacattttattgagaaaagaataaaattaggttttgaatatataggtaggatgaagtttaatcattgcagtaaatgctccttagcaactactgtaaaaggctcccagaatctctacaccttacttttgagctttaataaggacaattcctattaaatcagttttagggagagcatctgttagataagttgatactgaacttctagaggtaaggttgaaaatactttgaaaattaatttgtggtatagatgacctatttaatatgtttctcaatgagtcatataatttagtcatgtctcttgaccccagatctagtgtttttgttactatactatcattctgacgttttacagaattgaattggttcatttatataagcattttcagtttaaggtatatgtaggaacatcacattcattcttcaagtgagtattttatgaacaatgtcatataaatttagaattttaatctagcatgaagaaaacaatttgccctttcaaaagtgagtctttacatcctgccacatttccagaaattacttaaattccagcatttagtacacatgacatttggtctctcttttgattggacaccatactgccatttatgttttgattcctggtcaatttatgtctattgcctacaggtatagcttgtataccaaacactgaaggcatataggaatacctcagagatattgagggttcagttctagaacaccacaataaagctaatactgtgggaaagagagtttctggggtgccagttgagttggtctcccctgtgtgagacacccatggggagccatgggtggcctctgaagagaaaagtctccctattgccttcatgtctttatgcccggagagaataaccactcagcggcatgccacaggttgctcagggagataacactcccttgaagcagtggagtataatcaaacatcttggctcctcctgaaacccactcccacccatttcagtcctgataagttaaagatcttaagtagtttagacacatgcctttgctcaaggaaattcacagaaaccgccactgctatacatcttattgaatgactcacgagttctccttcacatattaatccttttcctcatcggttcctccccctctcatctgccctaagaacaaagggcttataaaccaataaatcgggcagagcccgagagctctgggccgtgagcaagcctccgacgctctggtcccctggacccgccttttaaaagcttattctgtctctttctaactcctttgtctccgccagactcggggtacctgctgggtggtgtggggctggtttccccaacaaatccagtaggaaagtgagtcacacaaaattttctatttcccactgcaaataaaagttataatcacttggccaggcatggtggctcgcctataatccccgcacattgggaggccgaggcgggctggtcatgaggtcaggagatggagaccatcctggctgacacggtgaaaccccgtctctactaaaaaatagaaaaaattagcccggcgtggcggcgggcgcctgtagtcccagctactcgggaggctgaggcggggatcttgtctcaatgctgaggctgttgaccaatcagggtggtggttgctgaaggctggggtggctgtggcaatttcttaaagtaagacaacaatcaagtttgccacatccattgccacctcctttcaaaaatgatttctctgcagcatttgatgctgtgtgatagcattttatccacaggagatctttcaaaactggggtcagtcttcttaaatcttgctgctgctttaccaactaagttttcgtaatagtctacatcctttgttggcatttcaacaatgttcacagtatctttactaggagtgcattccatcccaagaaaccactttttttggctcatccataagaaccaactccccattcattcattttttcatgacattgcagttattcagtcacatcttcaggctccatttcttattcttgctatttctaccacgtatgcagttacttcctccactgaagtcttgagcccctcagagtcatacatgagggttggcatcaacttcttacaaactcctgttactgtcagtattttgacctcctcccaagaatcataaatgtccttaatagcatctagaatggcaaatcctttccagaaaggtgtacttttcccaggtccatttgatgaatcactatctatgacagctatagccttacaaaatgtatttcttaaataataagatgtgaaagtaaaattactccttgatccatggcttgcagaatgaatgttgtgttagcaggcataaaaacattaatctccttgtatacctccatcagagctcttgggtaactaggtacattgcaaatgaatcataatattttgaaaggaatcttattttctgagcagtaggtctcaacagtaggatgaaaatattcagtaaacaatgctgtaaacaaacgtgcttctattctggctttgttattccatttatattgcacagttagagtagattttgagatgattattaagggtcctaggatcttcagaatggtcaatgagcactggcttcatcttaaagtcaccaactgcattagctcctaacaaaagtcagccagtcctttgaagctttgaagccatgtactggcctcttttctctagccatgaaagtcctagatagcatcttcttcagtaaaagtctgttttgtctacattgaaaatctgttgcttagtgtacaccttcatcaatttagctaaatcgccaaatcttctggataacttgctgcagcttctctgtcagcacttgcttgctgtgtcaccttgtactttaaagctctggagatggcttctttccttaaaactcaagaaccaacctatgctagcttccaacttttcttctgcagcttcctcacctctcttagccttcatagaactgaagagagttagggtcttgctctgaattaggatttgacttaaggaaatgtagctagtttgatcttctgtccagaccactaaaacttgctccatatcagtaataaggctgtttcactttcacttcatagttcatgggagtaacccttttaattcctttcaagaacatttccttttcattcacaacttgaataactgtttggctcaagcggcttagctttcagtatctcttggctttcaaaatgccttcctcactcagcttaatcatttttagcttttgatagaaagtgacagatatgcaactcttcctttcacttgaatacttagaggccacggtagggttattaatagcctaatttcaatattgtgtctcagggaacagggaggcccgagaagaaggcgaaacagaggaatggctgcagcttctccatcagcagtcagcgaagaagtcagaatgcagaattgatgaggttcactctcttttatgggtgcatttgtggtattcccaaacaatgacaacagtaacatcaaagattacttatcacaaatcaccaaagcagatataataatgaaaatatttgaaatattgcaagaattaccaaaaagtgacagaaacataaagtgatcacatgcatttaaaaaaatggtgctgatagatttgctcaaaatagggttgccatagaccttcaatttataaaaagcacagtgtctgtaaagtgcaataaagcagagcacaataaaatgaggtatgcttgtacttcagaacaacaccagcatacttatgtttgcaaaacatgaaacacaatcatagaagctgatgtttgagaaatccacgttatttttaccttctttacaagatggaattattgggtttcatttgattaccaagaaggattttaataagttatacataatcaatgactatccaaagagtagaattttctctatcagaactatgtttttcttgtagtatattaacatgttaagagatagccttactcttaaagttcaacttgtacatcagatagattaaaatgtcattagcttgctggaatgctctttctataatctcttcctgacaactcagtcttttattttcttttttaatttttcttaaatcattcctatagacgtctcaggttttagaatctgacttccagccattgagaaaacaaagaaactagtatggtagtgtatggttttctcaaattataattaaggtgtacatataaaaattttaacacctttttttctctactaaatgtgattagaaggctccctgtcccttatatattatagaactcaattataacacagcttattattatacaggttttgaaacaccagaaattataaaatctccctcagacaaagtttacacaccaaaacctgaaagagcttatttgaactaaacgaggaggttttgctttatgatcattcattttactctcttctatattccttccttccttcaatcatgtggtcatttattcattcaccaagtaattgttgaaaatttactacatgtcaagaactggggcagatacaaagaagatatggcatgtagccaaaagaaaattcctccttggtacaaggttcagaattgaaaagattatataatttctgtaatgaatacgtgaaaggagatgaggttttcattcaaggtagaaaatgacatccattataaaagtgctattaataacagccttttaatatttaaaagagaagagtgattaagacagaacccatactttattattctatcttctacatgtattaagtaggtttgaccatattcaggtgtattacatataattaagaataaagctaaaagttctctttttttaatccatatgggacacagtagatggctgtgcctattttaagctatcatatttatgtaaacagcttaacttgccttttctgagtgtaaatttgttgtgtattttgcactttctcatcaaattaaaatgacttagttatgtgagctcaatcacataatacctttgagagtttattcattcaactttaagacagtcaaacagtctcattctgggagcaattagcactcagataattattacctatattttcatactatgtcaacagaatgattttattaaaacaaaattttttaatacatctattgcattttgggcactatagttgaaggtcatttttaaacaagagcagtgtcaaattttacactaaaatataaataaaacaatattttattactagattgtgaatgtctttatatgtaggaactatatgttgttcatctttgtatactccctaggatgtagaataatgtttagttaaagcagaaagttaaaaagtgtagaattaaattaaaataatgagcatatggattgttttctaaatataaaaatgttttatctagttgtaatgttctactagttactaactagttaaaatgttctaccttttattttataccaaaatttgctggtattgcttttggtctactgacatttctagcatttaattaccacaaaagcaatctgattcttttttaacatgttactttttttatcaatgtaaattaaaatcttaaaatccataagataaatgataaatgttaaacatctataaaatgccaatggaaaccctactaattaacttgagaactgatttgattttgggtaccacttaaatcacaaggcttttatagttctatccaatgaaattatttttataatctctttctaaattgtgatatacatttttaaaaatatttgattttcttgttgaaccatgatgatacatttccccccaaaatacataaaaagttgaatagactgctgtcttcaaaattaaacatttagttcagaattgacaatgaaagcatatatatgaggatcatttttccaccttgaaataatcttttgaaaaataggatattaacttgactttcctcaaagctacttacaagtagaactctagaataatcagttgcattatttggacaatatgtagatattttcagcttttacttttacttgcacccaatagaattttattgtaactgcaaataattgtttattgacagatttgaatatataatttaatatggatgggtaacttaattataaaaccagcatggaattaaatatttctgttattaagacagatgctcatcagaatcacatatattgagatcttatttgtatcaaatacagatatttttatttttatcttgtatcaaatatagtaataaaatgaatgttctcaattaattgtttcaacaaccttatgagaaagatgccattagtgtcccattttaaaaaaaggaggccaggtacagtggctcacacctgtaatctcaacacattgggaggctgagacaggaggactgcttgagcccaggagtttaagatcagcctgagcaacatagggagaccacaactctagggaaaaaaagaaattggccagtggtagtccgcagtcctagttactcaggagcctgaggtgggaggatcacttgaacccaggaggtcaaggctatagtgagcctgcatgacagagtgagaacctgtctcaaaacaaaaacaaaaacaaataacaaataaaagaaaaggaaactaagggttagtggcctcaagatctccaactcagagctgagacgttctctgaataatgcatatttcttaactaacaattgttaggtttagagggttagaaagagttgattaacaaatatcaaaatcaaataaaaataaaaagtagaaacacattatgacatcaatatattatttcattatttttcctaaattagcaattgtagaaaaattacacaatatctctgaggaaatggattatggcagattctgtgattatttgccaggaaaacatgaaatcagtgataactgtatttgagatctcataataaggaaaaaagttgtttgcattgagatggattgtatctctgatgtccttgactggcagaccaaacactttttccctgctgttacaaataagtcagaaactgaatcaaacaatctaacatgtttaataattaaaatatattaaactacgttttcatttgcctactaaagttggatatcaacagatttcaaaaagagatttaggcacctcatccaaaaatgtataaatcaaggaaaagaaaaaatcaataaatttcacattttaagtgttcaataccaaagtatttattcagcactgttgtaatctgacaaactcaaccttctgtctttgtcatctagaaatagaaccttcatcactaaattatttgaataatcaccttgactatttttcttaaaactacttggattatacgtaaataatgtagttattacagaactataagaggacttctcattccaaattgctactttagaagagttagattttatttattttttgagagaaaggtcttgctctgttgcctaggctggagtgcagtggcaagctcatgactctctgcagccttgacctcctaagctcaagcgatcctcctgcctcagcctcttcagtagctggaactacaggtatgtaccaccaccaccacctggctaatttgtttatttttggggggatggggttttgccatgttgcccaggctggtctcatactcctgagctcaagcaatctgcccaccttggcctcccaaagtgctaggattacaggcatgagccactgtgctcagccatatttttaaagaaaaacaatttttcatatctcaagtaaactaaacaatgtattactctagttatgagtaatatgttgttggaattctcagcaaatgaaacaaaaaagtaaactttaaagaagtacatatttaaacaaagtcattgaacaaagacaaaaaatatgtctataaaaatcaaatatccactctctcccagtgccatttgtaacaatactgttaatactttcttgcctagttgaagggttcaatgtactttccaaaatctgtaatttgcattcataatttggaattaagttgaagatctgatctggaataagccattcacatagtaaagatgagtgaagaaagctgtgtggttcagaggcacactgaagaagagcccatcctctctcaagggaaatctggtgccctgcttcagttcaacactgccatgcaagaaagatgtgagggaagttatatttctaggcattttattctttttgtggccattatgaatgggattgcattcttgatttggcttcagcttgaacgttgttggtgtatgggaatgctactaatttttatacattgattttgtatcctgaaacttagccgaagtagtatatcagatcaaggagcttttaggcagagactatgcaatggaaatcacacaatactgctcaaagaaatcagagataacacatccatgctcatggacaggaagagacaatattgttcagatggccatactgcccaaagcaacttacagattcaatactattcctatcaaactaactatgaattcttcatggaattagaaaaaaaaaattttaaattcatacagaaccaaaaaagaaccttaatagtcaagttgatcctaagcaaaaggaacaaagctggaggtgtcacattacccaactttaaactattctacaaagccacagtaacccaatccgcatggtactgctacaaaaacgaacacatatagaaatggaatgaaaatagagatctcagaaataaggccatgcacctacaaccgtctgatcttcaacaaagctgacaaaaacaagcgatagggaaagaattccccattcaataaatggtgctggaataactgactagccatatgcagaagatcgaaactggaccctttccttataccacatacaaaaatcaactcaagatagattaaagacttaaatgcaaaacctaaaactataaaaaccatggaagacagcctagggaataccattctggacataagatttggcaaagatttcacaacgaagacaccacaagcaattgcaaaaagaaaaaaaaaacccaaaaattaacaaatgggacctaatcaaactaaagagcttctgcacagcaaaagaaactatcaatagagtaacaacctacagattggaaaaagcttttgtaaactatgcatctgaaaaaagtctaatttccagaatctaccagaaatttaaacaaatttacaaggaaaaaacaaaacacctcattaaaaagtgggcaaaaaacatgaatggacactgcaaaagaagacatacacacagccaacaagcatataaaaaaggcccaaaatcaataatcattaaagaaatgaaaatcaaaatcacaatgagataccatcccataccagtcagaatggctatcattaaaaagtaaaaaaaagtaacagatgctggcgaggttgtggagaaaagggaacacttatacactgcaggtgggaatgtaaatgagttcagccattgtggaaagcagtttggcaatttctaaaagaacttaaagcagaattatcacttgacccagcaatcccattctggggtatacgcccaaagggatattaataattctgccataaagacacatgcacgcatatgttcattacagcactattcacaatagcaaagacatggaatcaacctaaatgcctatcagtggtagtctgggtaaacaaaatgtggtacatatacactatggaatactatgcagccataaaaaagaatgggattatgtcctttgcagcagcatggatggaactagaggccattatcctcagcaaactaacacatgaccagaaaacaaaataatgcttgttttcacttataagtgggactaaacatcaagtacgtatgaacacagagaaaagaataacagacactgggaactctttgagggtgaagattaagaggagggtaaggatcgcaaaactacctattgggtactgtgcttattacctgggtagcaaaataatctgtatatcaaacccccatgacacacaacacataatttacctatatagcaaacctgcccatgtacccctgaacctaaaagttaaaaaaaaaagatgagaggagtactgccacatcttgtgattctttaagagatacgtgaactttaaaactttgtgtgtaatatataatacttctatttaaaaatatttgccaatctcacattaaaaaataagtttttggcttctgaggactcaggagataagagttgttccccagaaaagagagaattctactactataggaatttataggaatgtggctcttaaattttagcatatacctccatcacccagggcatttggctcctggggactcaggagataagaattgttcccaagaacagagagaattctattactataggaatttataggaatgtggctcttcaattttagcacataccacaatcacccagagcttgttaaaatacagattctttgggtcctttccttgacatttggattcagtaggtatgggatagggtcagagaatttgcatttccaagttcccaggtgattgtgatgctgctgttccaggggccatactttgagaatcactgacccactttggtcataatttgaaaaaccctacacacggagttttttcatttaaataaaaggaataaattatgagccactattaactttttaaacaattttattgatgttaatgtatgtatcataaaattcactcattgaaaatacacaattcaatattttttggtaaatattttatagagttgtgtaactataccaaaattccattttagagctaaaattcagagctacaattttttttccaaatctgtttgcaatcaatctctcctctgaccaccagcctcaggcaacctctgatataaatttttttctgtataaatgggtttgttctgctttgttttacataaatggaacatacatgcaatctttccatccagcttccttcacttactatgatgcttgtgaggttctaccatgttatagcacatagcaatattttgtttcttttaactgcaaactaaattttacaggtaaactgcattttgtttgtccattcaccagtttatgggcttatgaattttcccagtttttggctataaagaataatgtcgatatgaatattacatacaactatttcaatgagcataaattttcatttttgggaggtatatttctaggtgtagaattaacttcttaagaaacttccaaactgctaaagtagttgtttcattttatctactggaaactagtggaggttccaggtattggacatactcaccaacactgggtactgtatggttttttgattacagccttctcagtgggcatgtagtgatatatctttgtaattttaatttgcatttctttaattattaataatgttgatcacatcttcattttcttattagcatttataaaaaatcttttgtgaaatgtctgtttaagtaattagtctactttttaaattggattgtttctcattattattattggagagagatatttatataatctgggttcaagtcctttatcagatatatgatttacaaatacttttccactctggcttatctttccattttcttaatggtatcttttaaagaacaaatagttttaattttatcagattccaatttatcttattttttatttatgggtctttcaatataatgtctaaagacaccccgcctaacccaaagacacaaaagatttcctcatattttttccagaagtgttatagttttagaacttattagtattattgacttttatcttttttcctattttttttttttttttgcaggaggcagcctaactggattttgtcggttttcttatcttataaaaaaactagtctttggtttcattcattttctctactatttttcaactttatatttcattgatttgtgttctaatgtttattattttcttccttctgctttagatttagtttgcttttctttttatgatttttaaggtataaacttaggttactaaggcctttttttctcttctactacaggcatttacatctataaatgttcctctaaaccctgctttagctaccttgcataaagttttgtatgttagagttaaattttcattcaggtaaaaatatgttttattcttctttgtggttttttttgatccatgagagattcaaagtatatttatttaatttttactctttgttgttttcccagatttttttctgttgtgaatttttaataaaattttgtcatggtcagagcaacacctagtatgatgtcagtctttttatattcattgagacttgttttgtgaaacagtaaatggtttctaatagaaaatgttccacaagtgcttgaacagaatgtgcgttctgcattcatttggtagggtgtttaatagaagtcgataaatgccagcaatggaatatttgtcattttttaatctgggaaggtctgtcctcagagatcttcattattaaatgattctattgatgaccacactattatgttcatccaatttcatcatcattagaccataatattgctgaacatactattcctatatgagaggggttttttctttcagccctttgaatatgttattccactatcttttggcctttgttgtttctgattagatgtcaggaatttttttgtattgtcctttacctgtatgtaaagagttatttttatgttgctgccttcaaactctgtgtgttgtatgtaatattttcgtttaacaacatttgccaaatgcacattaaaacaatgtactggtacaaaaatagaagcatagaccaatggaacagaatagagagcccagaagtaaggctgcacacctacaaccatttgacctttacaaaaattgacaaaaacaagcaatagagaaacaactcactattcaaaaaatggtgctggaataactggctagccattttcactttctctttgtctttccacagtttgactcagcgtatcctggtgcagatcacttgatatttatcttatttgtggttggttgattttagagtgctgtagattaatgtattacatcaagtttgagaaactttcaaacattatattctttttttctgacaccgcagacctgctgttgagccactctagtgaatttttatatttttccgttattgtactttttcatttccataattcccagttgtttaatttaaagtaattgttatatcttttttgaaattatctcttcagtgagttattttcatggatccctttaattctttgaacaatttttatttttaaaacacatttataatgactgttttgataacaacatctatgttttaacatctgggaaaattcagaaactatttatactgactgcttttgttcctcagtatgagtcacacgttcttatttctttgcatatctcataattttctgttgaatattgaactttttatgcaacataacaactcttgatttttactttctcttcttaagatgtatattttttttggcttgttatttattttgtaattttgcctggactaaatctgtgaagtctgccttttcactgtgtatgacctgcaatgcagacctcttctacttttgctttttcttattctttatttttaagctttgcgtcctaagggtgtggtagtgtgttgctgttacacatagcttagcgttcacccaaagattggtcagagttgtgcttaccaccttggttattaagtgtttcattttttgctgatagatatatatgtggcctaaacagaacatttacattttagattacatttgaagtttttccaggcttttactttacataaggctttctgacatctttgtcgcacatgcatagataggctttaaaggcccaggaggtgtgggtagcttgggcctgttgtgttctctgttgttcatgcacataaactccagtcaacctgagatatatgcggcgtttatcaagccatctttgactgtccaacctcccaaaaatgtctgtcaaatccttggctagtccactgatgcactgaatgcaccatataaatgtgcacactcatactaacgaaattgccacccttcctgttctcttgcaactgagatggccacttaaactggtgatactccaaatcaaacgagccctttcggcagtggcagcaagccctgccctgtcctggttgaactaccatattgacacaactggaaagggggtggatgggagcatgcccaggaaaaaatgccatggtcttacaactgaagttcatgcattttattcataaacacttagttggttttatgcctttggttgaattctggagcaaagaattacttgtttttgacaagtttgtccagctttacagttttttggggaaagaatttgtcagcttctcactttgtcatgccttccattgactttcgactgcttgatttatacaaaattatttaaaaataacaaaagtttagatagagaaatatatggtattcttatacagataaaagaactgagacaagaaagcatacggaattggcctagtttttcactaaaagttaatgaccaagttgaatgtaaacccaactttttgattaacagtcccatattatctatggcctgatattttctgaggccagaggattcaaaagtatacttcacagttcatagctgttggttataaaataaaaggtaaatattaataacaggaagctgtgaaccaagattaaatggatgttagatatatttttaaactatggttttaagtagatttccttcctaaataataacttctctttgaaagcatatttaaaagtgaaaacttttctcggcagtcataatttatctaaaaaccactttattttgacaccatctcctttgaagaaggcatcatggagaccacctatgaaaagagactaccttttccttgttcatgaaagctgtttcaaaatgaaatgactacattatttccaatagctggtatgagccatagccatgcatgctccctcaggtgcagccttcttaactggctgaaaaataggtcagtgctctacattgaagaactgtttccttcttatagttcagtcaacagcctacagtatagtcttccatacagtaagctcaggatctcaggatatttgtgctaaaattatactccaatcaaggccacacataaaacataaatgcttttatattgtaacataatctgaataatatcaataaaatagtcatatattatcttgtttggaaattgttatataatacaaacgtatataatacaatgtattctattataaatataatattatctgtaaacaataatgaggtatatggaatcaaattgctgctgaatatgtttcatggggaacattgtgtgttgtagtagaaagagcttaagttttagagtcagacatatcagtgtttgaatcctaactctattacttaatagctatgtgatttaatgttatttactctctctttgctaaaccctagtcatcttattgaggggttacagtgttatgtttctgcaatgactaaatggttatactatatagagaacaccaatctgacctatagaccagtgctaatactgctcattgctgtgcatttcccagctctggatcgagacacacgggcatatcaaatcagctgataattttggatcttctccaactgatgttttagaaatgtttgtttaacatatatttaacgaatactgagaaactcattgtctaatgtttgtattttatatttattgtgttatattcagaatataagacatatttcatattctaaaaatttcttagatgatacaccaagagtttaaatttgaaaaaaaaatctactgctcctggaaaagagtattcataaggaattggtttcagcttctttctctctccgggattaggtaactgctaccattccttgcttcagatcaatagagtggtagaagaataccttttcctagatacttgccaggctactgaactatcccccgtctcttgggctatcttcaaaccctgcttacaccttgagacatagtctgttcattaaactattctttaaataatcctaattcaggccaggcgcagtggctcatgcctgtaatcccaggactttgggaggccaaggcgggtggagcacctgaggtcaggagtttgagaccagcctgaacaatatgacaaaaccctgtccctactaaaaatagaaaagtcagctgggcatggtggtatgtgcctgtagtcccagccattcgggaggctgaggtggtagaatctcttgagcctgggaggcagaagttgcagtgagtggagatcgcaccactgcactccagcatggatgacagagtgaagactctgtctcaaaaaaaaaaaaaaaaagattctaatttaaatgtgccatctctttcctgataagaccacgaaaatactaaaaaattactgttaattttgtgagatatgatgaaagatggtcatatatcatgtataatgaataaaaagccccatcactgaaatacatacacactaaaatatttgtaggaaaaatggcctaatttctgcaatatatataaaaacttggggtgggaagaataaaattgacacactgttgatcatgattgaagctgtgtgatgagtacatgtagtcatcctagatttctctccatcttgtggcatcattgaaggcttccataataaaaagtttgggatttttttttgaactattggtactttgaacccctttgataaattatttttaattatgatctctggtttggtaaccctgtcatgaacccaaatggaacaaccatttctacgataagtaagtcactgttttctcttttatccattctgtagccctgatctgaacaatgctctccctattccagttgaaaacttctttgtgcatgatcccaaacttcatcttcatttgtcccagggaagctgaaagatgcatatgtgaccttagttgcagattaaaaatgaaatattcttagtttgagttagacttttctggaaacaagaatgactgttctggaaattatactcttttgtcatatttataccatcttgaaaagagtgttatcaagttgtccccactaagcagcaaggaaagaatcattctgcccaacaagggattctctcttgttagactaatgattgggtacatgtccttagcaggtcacttaagtaacttgctctaatgacctttaaattagagacataacactgttgacagtagtcaagatatgatgatccagttactgacaattaaatacttgacaagtagtcaagatatgatgccagttacattgacaataaaaaaaaagtagaaaaagtaaaagttttatttgtgtaatagaaaaattttgttttggtcttttttattatttgttcgggtaactagaaattcaaaatattttccagtacttattaatgcgttgtcatcattacattggacccacaaagttaaattgtgaagtaaaggaacaatatttgaagaaatatagcattggaaatggaaggcttaaaatttttaagtcagtaatgatttagtatgacattttacatatgctgaaaaatatgtgcacattctcaaaaagctaaacaaactaatttctatattatattttatgtaacattagtttttcaaattcaatcacatgtaaatattttcccaaaagagtattttcttcacttgtctgtggtttaaataatttcaaggaaaaaaatgaacattctactggaattccatgtgattaattatatactatcaaggtcaattcagtgtgcactcattcatttaaatcaggttttttaaaacctcactgcaatggacagtctgagccggattcttcgttgttgtggggggctatacagtattgcacattacaagatgtttggcaatatccctggtctgtactcataagataccagtagcactcccaccctcaagttgtgacaataaaaaatgtctctgaacattgccagagatctccctgggggcgaaatcaactccactgagaacctgtgtttcaaagcaatgagttctgtattacatctgcctaaattttaattactttccaaaagattacagctcaaacaatgggaagagtcaacaaataaaaagaaataaaagattttgagaaaggcattgtgataagagatagcttttccaaataaaaacacctttaagagtaaatattttaaaaaataatatgtggttaatgtaaagatatgtaagagagtgccatagtgaactgatatttaaaaactcaagttgcttacaaaatcgtggacatgataggatatcaaacaatgcattttcatcagactgattttgatctgtgcatctaatgcagttcgtaatagagaaagaatgaattctaaacctccatacatacaaaccaaaattacacacacgccacacacagacacacacacattgatgtgagtgtgtgaacttagcagttcacctatttcggccaccattttccatcaaatcttcatgttaaatctggttgtgtgaagatctaattgggtttacacctatatgcttacaaatcctactagtaatatgtttaattcatttatttagctttcaggaacctctattttatgctaaatatcctcagcatttatattcaatggtggtgtaacactactttgaatttactgtcatatttcagcatcgatttctggttgctttctttcatctctgcaactgcatagttagtccagttgggtcaccaggtcttgcctactattaagtgttatgcctataattgaaaagtcattaaagcaagttacttaaatgatttgccaaggatatgtatccaatcattagtccaatgacagataatcttttattggaaacagttcatgggttggcattatccactgtatacagaacagaattgggaatttatttagtaatttgtttagtaaacctagataaatatttgaaaacttatattgagctttcctctgttttgtggtcattttggtagctctatcaaaagctgtgggtattatttttctcattcactggtgaaaaaaggagaaaaatagaataaacatccaaatttctggcataatagcaattctgcaattattatactgaagaacacaccaagaacattagagttagaatggatttcaactgaaaatattctccagatccttatgcatacttgactctatataaatcatttttggaaggttcaaaagaagtgtaggataagattatcctgaagagctataatttttgtcgggtttaagatctatttttccctgttaacatgaatacttccaattttttaatgaaatagaattataatgtttataaaatacaacattgtagaatgaaattacatattttagtaggaaaatagaatcacagaaaaatgatttctaaagcagcaacttttatttaactcccagagtaaaaaactatcaattcttgccatgcaacaactcaataaaaagaaaacgcgctaactatgatcttttgtggaggtgccgagtactggcactaaaaacttctgctatatggaagtaagatggaaatttttagtgtgtgaaccctataccatgtaattttaaatggtttgttagtacccaaaaaagcatctttgggtaaagtgaaataaataccttagagaaaaataacttgctgaaaagtacaagttgatgaatttcataaaatttcaacagtcaatgtaagctctggatcttctgtttttatacatattttgtattcatttgccaagtcaaaaatcttaaaagccagtcaccacaacctccatctaacaggtctttccactgcactgacagctgctctcacctttataaaatagcccattctctcatggagtttttgccctgatgcagactgcagtgacctttctataactgagtcatgaatccctaaacacagagacgaaatcacccacgatgccttacatatggtggtgtgaatgtctacaataattgctctgtaattacatggtaattattgaccatttaagtacatttaagaacagggtgactatgtaatcaaagactaattatctgattatttctgtcttttaaactgtgggcttataagatataaaaattgcaagtaacatggtgattagtcattgaactacatagtaacttgcagcagaattatgaagtaatctgtagaaaatgtatttgtattgtcgtactcctggacagtaattgaagagtagttatatggtaatacacattctatggagtgaaaacagaaaaaaaactatcaagacattatgctaatagagcataaatatgttaaccaaaatattacatgattcattagagcaatatatgaatgggatatatctttcgcaagacaggtaattggtaccttaaattagaatttctatggtttctctataaaatacagaagtgccactgtgccttttaatagttcttataaaattccgttgcatatttctttaaaaaattgctgtgatatgacaaataacttgggcacggacagataaaaggaaggtcaaaaaagatggagttcagaatttggtctactgcactgggattcagtggctaaacccaatcaagggggtagtttaacttcattagcaattactgggacccaagttggagtcgtttacaaaccctcaacattttcttcctaaaataatgaagtaacatgagaagtatatgggtaagtatttacaatgattctgaaacacactaaaaatatttacctaaaatattttaaaagcttctactttaaattagaaaaggagataataaagaagtttcccctaagaattcatttgatgtaggctgaatgtagaaatttcctgaagaaatacagaaatggtggagttttgaagatgggcaagaagagaagggtttggagaaactatggcttaacatgtgtttgttataaaagttgaaaatcaactattttgttgagcagtgatgctaaaaatgagtaacctttaatctttaaagtctatttaaataaataactacttttttcttggtaatatgattaaaaacattaatatgagccctgaaataaagatcatgttgattccatcatgaagtaattataataatattttgtacataataaaggtatggaactctaaaatgaaaaatggattctacatgaaaaatatatcactctacatgaaaaatgtattggagcaatagttataaatcccttacctaaggaatatgaataatttgaccacatctaaagaaatgataatgctctcaaaactaaacttgattactttcaaattctgattatttgacatagtgttaatatcataattttttagtgattttctactttctccaacaggtccatgaaacaaaatacacttttgagtattgttgcatggcttattttggattgtcaatttacattgtttgcctggtatgttccttctctttggaattctacactataataaagtatgaaatcttctcaaatattctcttgtccaattagttagatacaaatacttagtcaagtgaaatgctataagtagtaacttataaagttgttactcttttgacctgagcagctactcataaagtgaaatcaaaatggactggagtagatttatttgatcaggatcgattaattcatgtatcattactgaagtatttcctttgattgagagctcattaaaggtgtctgctttacatcaaaatgtcaataatgcttctaaaatggaaatgccattttattaaggctgtgttttttaaagtaataacttaaaattatttacaattgcttttcaaaaaataaaatttacagtcctaatttttttaaaaaaattatatacactgttttacgaagcatacaaaaagagaaaataatgaaaaactatcatgttctgagttatgcctttggtcatcctgagaaaaggagttaataagtaattaacaaggcttgtcattctgtatatacaataactcatctcaaattgccttctcccttgatcccttttcagaaaaaaaccctgtatggaagtatgattgacctataaatagttttacatgcctcccttgatttcttcttaacttatataaccttcaatttaaaatttatacctcctttataaagaggtgaggcttgaaaattggatcacatatattaaacatgaaacaatgttttaattgagtttaccatacgatattgggatttccatgaaaatacagatgagataaagctacccattatatcgaattcctgaggagatatgtgccatatacaagatatagcaaggtagttcaaactgacttcttgccaatctcacaaagaataattcatgtaacttacaattagactaaatctttcctttgtctctcatttctcccactaattcgttgttcttgtatagaatgtcattttctataagacaaagatgctagcagaaaatgtcatgaatgaatacaaactttatttcccggttcattttatctaggctattttctttacaaaataacttcagaatatatacaatgtaatcaaataacttaaatttaaaccaaaaaaatctataaaatatgaaataccatgataactttagaccatttaatatcatctccaaatattgtcacagacatgttataattacttctacatttctatattagaaaatacacataaagtgcagcttgtttctccaaatacacttatctattccttaaaaatctggtacaccaaagggaatgctgacttttaccacatataatcagtctttcagtagaggctatttcattggacgctataactaaagcaataaagaaaaagagaaataaactgaaagtatctaaattgaaagagaagaaaaaaaacaatgttttctttgaagacaaaaatgatcttgtgtgtagaatattccaattttagagcccaacaaaaacatcactggaatttataaataagtttggcaagggcacaagattcaaaatcaatacagaaaaattaactatttctatatactagcaagtaataatcatacagtaaagtcaaaaaattattccacgtatggtagtttctaagactaaaatatttagaaatgcatttaaccaaagaatggaaacttgcattataagaactaagaaacgttgctgcgagtattgaagaaggactaaatgaagtaagagacagtttatgttcatagattggaaaataaaaatgccaagatagtaattgtgaaaaataaatgtaataaaatccttatcaaaatgacagcagattttttttttgagaaatcaacaagatgattctatgtggagagaaagaacccagaaaagccaaaagattttgaaaaggaagaagaaaattggaaaagttacactatctgatttagaaactttctacagaagctatagaaatcaggattgtggtattggtataagaataggcatataaataaatgaaaaattaaagaaaaaatactcaatatttatggtcaatagatttttgagaagggcatcaaacaattcaatagagaaaataatagaacttttatcatgctagtgagataattagataccaatatgcaaaaaaaaaatgaagttaggccttccctttaaaccatatacaaaaattgcaatgaatcctacatccaaataaatggatcatgttctcagaactatatccatatcgttctcataactcagaacactgtagtacttttagaataaaatataggagaaattcttcacgacctttgggttagggaaaatgttcccagatataacaccaaaagaatagctcagaaaaataaattaaacttcacaaggaacaacaagaaacctaaaatgtcatgagacctacaaaaaaaaaaagacaaaatggtagatggaaaaccaaccatatcaataatttcataaatatgaatggactaacacatgaatcaaatgtcagagattgtcagctaggatacaaaacaagatctaactatacatactgtctacaagaattatgctttagaaccaaatatatatatggattaagtgtgaaagactggaaaacagctattccacataaatagtaaaactaagagagctggagtggatttattaatatatgagaaaataaactttaagtaaaaatagtgttagagatgcacagttatgtttcatattgataaaacagtgaatatataagaaatacataataataataaatgtatatacatatagcaataaatcaccaaaatgcatgaagtgaaaagtgacaaaattgaaatgaaaaatagacaatttaacacatatgcagatgtataaatgccattctcttaatatttgataagaccgttagaaaatcggtaaagacatggagtcctaaacattatcaagcatatacactagaactgacatagaacaccccacctaccaacaggagctacatgctgttttagagtgtccatagaatattaccaaggaaataaaatatattaggcaattaaaattataagtgaaagtctttccttgacaaagtcagtctgtaaactattctgcaaatgggcagacaccattgcaagaataaaaggatcacaaagaataagggttacatgacactactaaaggaaactaataaaattcccataaccaactctaacgaaatgaaagtctacaaagtacctgtcaaagaattcaaactaattatctttaataaactcagtgaactaaaagagaacacagatagacaactaaacaactgactataaacagaaagttcagcaaataaacataaaccataaaatatagaaatcctacagctgaagaagacaataagtcaactaaaactttcaacagacagcctctatagtagactcagtcaatagtagattcaatcagaacaaagaacagtagattcaattaatcaggtgaatgaatgaacttgaaaacaggtcatttgaaattctccgatcataaaagcaaaaagaacaagaataaatagactgaataaagcttacaagacttttgagataccaccgtgtgaaacaatatatgcattatataagtttcaaaatgagaagagataagaaaagggaagaaaacttatttaaaagttattatttttaaaagttattatttaaaaaaataatagctaaaaactttctaattctgggaatggaaatggacatccagattcatgatccacaagtaaccgaaatagttttaaacctaaagaagtctacaatgagaaacattataattaaattgtgaaaaggcaaagacaaagagagaattttgaaagcaataactcatcacagaaaaaaggcaacacctataaactatcagcagatttctcagcagaaatgtttcagtccaggagcgggtggagtgatacattcaaagtactgaaagcaaaaaattgtcaaccaaaagtactcagcaaaactgtccttcaaaaatcaaagatagataatttcccagataaacaataactaagggaaatccttatcactagatatatcctgcaagaagtactaaggaagttcttcaagttcaaatgaatacatgctattcagcaacatgaaagcctatgatagtacaaatctcacttgtaaaggtaaatatgtaggcaaatatacaatgttctaatactgaaatgttatataaatcattttaaatactagtaaaaaattaagagacaaaattattacttataactatcaccacaaattttgtttaataaataaacaatagaaaaataataagtaaactctgataacaataacaaactacacgtggaggagaataaaagtatagagggctcatatacagttaaagaaaagttgttatcagctaaaagtagactgttataattacaagaggttagtccaggcttatggtaactataaaataaacaaaggtagtagatatgcaaaagacaaagaggaaaaaatcaaagcataccactacaataaaattaccaaaccacaaagaaagccaggagaagaggaggggaacaatataactacaaaacagacaaaaaacaatggacaaagtgggaacagtaaaaccttagccaacaatattcactttaaatgtaaatgaattaaacggtttaatcaaaagacatagagtagatgaatggacaaaaacaaagaaccaactagatgctttctcccaaaacaggacccaactagattctctctataagagactcaccttagatttgaagacacacataggctgaaagtgaatcaatagaagaaagataatcttggaaatggaaaccaaaagagttgggatgactatacttagacaaaaatagacaaagtaaaaaaaagaaaaaatacaagagacaaaaagtagaatacattttcttttaaagcacacacagaatattctctgggataaagcacatattagtcacgaaacaaatctgaaaatttaagaagattgattatttcaagtatgtttcctgaccataaaggaacaaatatagaaatcaattgcagaaagaaaactgaacaatcacaaatgcatgtgaataaaataaactctcgaaaagtcactgggtgagaaaagaaatcaaaaaggaaattagagaatatcatgagacaaaaatgaaaacaacatatcaaagcttatgggatacagcaaaagcagtatgaagagggaagtttatggcaataaatatctcttttaaaaagaataaatggcaaggcacagtggctcacacttgtaatcccaaaattttggaaggccaaagtagcaggattgttaagacaaggagttcaagattagccttgtcaacacagtgagaactgtctcaacaaaaaaacaaaataattagccaggcatgatcgtgtgagtctgtagttccagctactcaggaggctgaggcagcaggattgcttgagcctaggagttcaaggcagtagcaagctatgaatgtgccataaaactctggcctgggtgacagagtaaggccctgtctcttaaaaaaagaaaaaaaaaaaaaaaagaaagaaagaaagaaaaattaaaaagaagaagtatctcaaatcaacaacctaactttatacctcaagtaactacaaaaagaacacgctaaagccatagttagcagaagaaagaaaatgctgaagattagaacagaaaaaaatgaaataaagaatagaaaatgatcaacaaaactaagagttgctttttatttattttttaaaattcatttggagacggagtcttgctctgtcacccaggctggcgtgcaatggtgtgatctcagcttactgcaacctccgcctcccatgttcaagcaattctcctgcctcagcctcctgagtaactgggattacaggcacccgccaccacgcccagctgattttaatatttttagtagagacggggtttcaccatgttggcaggatggtctcgaactcttgccctcgtgatccacccccctcagcctcccatcgtactgggattataggcatgagccactgcacctggcctgttttttttaagataaacaaaattgatgaattcttatcgatagacgtactaagaaaaaaagagagaagacccaaataatgaaacaggagtgaatacaaccaacgccacagaaataaaaataacaaaaaggactgttatgaacaattatatgctaacaaattggacaatcaagaaatgaataaatccataggaatatacaagctactaagacagaaagaagaaatagaaacactttaaagatcggtaatgaataaagagttccaattagcaataaaaacctatcaataaagaaaatctcaggaccagatggcttcacaggtgaattttaccaaacatttaaaaaagaattaataccaatccttttaaaagtcttccaaaaatatagaagggataaggaatacttccaaactcatatgaggtcagcatcaccttgataacaaagtaatgacactacaagaaaagaaaatcatatccctgatgaacatgaatgcaatatccctaattaacctggatgcaaaaatcatcaataaaatatttagcaaatcaagttcaacagcatattaaaacaattttgtaccatgaccaagtgatatttatctctgggatgcaaggacaatttaacacatgcaaatcaattaatgggatacatgaccttagcaaacaaaagaaggagaataaccacaaaacaatctcaaaagatgttggaaaagcatttgataaaattcaacactctctcatgctaaaccactcaacaaattagttatatattagatatagaaggaagctgtctcaacacaataatggtcacatatgaatatcctacaactaaaatcatactcaacagagaaatgctgaaagcttttcctctaagatgtgaaagaaggcaaggatgctcattctcaccacttctattcagcatagtcctggaagtgccagcaagagcaattaagaaaggaaaaaaacaacaacaaggcatccaaattagataagaagaaataaaataatatctgtttgctggtggcattatataagaaaactgtaaaaacctcaaaactgagggaattaaaaatcaaaatgaatcaagttacaagataggtagtaaacacagaaaaagcagttgcatttctatccacaaactatgaactatcccaaaatgaaatcagaaataccgtcccatttacaatatcaccaaaaagaaaaatacacccaagaataaatataaccaagaaggtgaaagactagtaagttgaaaaatttaaaaccctcataaaagaaataaaacaagacacaaacaaatggatagtgatccttgagtatggattggaaaatttaatattattaaaatattcattctagctaaaattcatctatatattcagtgcaatccctatcaaaatatcaaagatatttttatacagaaatagaaaaataattctaaaattcatacagaaccacaaaagaccacaaatagccagagcaattttgaacaaagctgaaggaatcacacttcctacagtaatcacgatagtctagtactgacataaagacagatctatagagcaatggaacacaatagagagcccagaagtgaagccacaaatatacagtcaactgatatttgatgaagatgccaagaatacacaacagagtaaagagagtatcttcaatacatggtgtttgtaaaattagatatccccctccaaaagaatgaaatcagacacttatcccatagacaaaaattaactcaaaacggattaaagacttaaatgcacaatttgaaacaacaacaacaaaacaaaactttcagaagaaaacataggtaaaaaccttgttaacattgatcttgacaatgattacttcgatgtggcaccaaaagcacaggcaacaaaaacaaaaataaatacgtgggactgggctgggcgcggtggctcacgcctgtaatcccagcactttgggaggccaaggcgggtggatcacctgaggttggaagtttgagaccaggctgaccaacatggagaaaccccgtctctactaataatacaaaattagccaggcgtggcggcgcatgcctgtaataccagctactcaggaggctgaggcaggagaatcccttgaacctagaaggcggagtttgtggtgagctgagatcatgcgtttgctggaagctccagtctgggcaacaagagcaaatctctgtctcaaaaaaaaaaaaaaaaaaaaaaaaaatgggactacatcaaaccaaaaagcttctgcacaacaaagaaacaagcaacaaaatgaaatggtactctatgcagtgggagaaaacatttgcaaaccatgtatttgaaaagtggttaatttccaaaatatataaggaactcctacacctcaatagcaaaacaaaacaaaataaacaaaaaacaacaaaataacccagttacaaaatggggaaaggacttgaacagacatttttccaaaaaagatacaatgatgctcaacagttgtataaaaagatgctcaatattgctaaccctcaaggaaatgcaaatcaaagccacaatgagatatcgccttattcctgtcaggatggctatcacccaaaaacataagataataactgttggtaaagttatggagaaatcggaatgcttgtatacttttggtaagaatgaaaatgttgcagccactatgataaaatagtatagagattcctcaaaaaaaaaattgaactaccatatgttctagtgatcccacttttgaatatgtatctgaaataatggaaatcagaatgtcaaagacatatcttaacaccatgtttattgcagcattattcacaatagccaagacatgaaaacaacccaaatcttcatcagcagatgaatggataaagaaaatttggcattttatgcattggaaggttattcaccctttaaaaagatggaaatcctagcatttgtgacaacacggatggacctggacattatactaagtgaaataagccagtcacagaaggacaaacactgcatgattcctcttacatgatgcatctgaaacagtctcatgtatagaaatagatagtaaaatggtagttaccaagcaacggtggaggtgggatatggggagctgttgcttagtgagtgtaaagtttgttatacaaaatgagtaaatcattttgtaattggaccaattacaaaattgagcactatggtgctcatagttaataataaattactcacacttaaaaattgatcagagtagatatcctgttaattgttcttactccaaaacaaaaacaaaacaaagggacaccagggaacttttggatgtaatgtatatgtttgttaccttgattatggtgatagtagtgagaatgtatacatatgtctaaactcaccaaatttcattaattatgtgtggtttcatatttttgtataccaattattcctcaaagctggggaaaaataatgaaccaaatcccacactgtcatgttttccttgcactaatacatgaaataagatacatgaagtattgtaaagatgaataaagcttaatcaatatggcaaaaataaaatagcattcataaaagtgattgtataacttcataaatttactaaaaacatcaataaacttcacccctagaatgggttaatcatgtggtatgcaaattatatttcctaaccctgttttaatgctgaaacatgaaagttaagcaagggtttttaaaaatctcatttgtaatttcaaatcttacataacatacagtcttcttgatagccatgttaactcagtaatgaaaagcacagtcctagaatggctattcagttcctcagacagcacactataaaggcttacacttagtatatgacctttgctcaccttcacattgttgatttgctttaattcttaatcaaaatccagaggtgtgtattttatcacaaactaaatattcatagtatgtggactgacttccaggggtaaccacttcagggtataatactcaggtttttattactgatcacaatataccttttttattctctataataatttgaaaaataattttaattaatctcgtgtagcatgaattttcatgtgatatgcagaaaaacatcattgagcatgtttttctcatttatatactactcatttgtggacttatcacatcatttatttaatatttcacttaagtaaaatatttattaacatgcacagaccctgtacttagtcttccaaggaagaagctaatgatattatgccagaatcaatagtatcatttaataaaggaacattcccatacatcattttgggaggtataatatttgttattaactttgcaattgttgctataatactatcagcaaacatgtgacatatttactataaagatgcaattttaatgatgccttggaagcgctggtcttttccttgcctttggcaaaaataataataatttatattgtaaacattgtattatgtatgttctgacataactcaattggtttaccagagaggtgattgtgctttgtttgaaaattaaacaaaagttcatggcccaaattggcagggatgtctaacctaaaaagctctggggtaagttaaaaaaatcatcaatccaattaaatctcattttaaaagacttttatcttcataattcctatcatacttttctgttttgactgcttgtgcaaagtcatcacagttgctaattcgtttatctgagaatatacagatttaccttctacattggtaatatagtttagtttactatttgagttacaaatttatgagtggttttattttttcattactttcctattgcagtgatttatttcaagttttgtttcattttctacaaattgtggaaagaactcaacgtaatagtaacaatgccaactacatatttaaaacacataagcagtaacaggcaaatgatatgaatatattggctgaggggaaatgtagcctgttagctgaacatgttctgagacaaactgatcaacactgtcttctttttagccttgatagaaccttttgaattcaatgatttatagtatggtaggatatctatgaaaatggtaatcttccttttcaaatgtatgcaatgtatatgaatgcaactatttcattgtggctgcatctgaagccaccagactccttcttgatagaccacaatgatccactagtagcaggtagttgacaccttgagaaacactgcattaagaatattgttggtctccttttttttttttctagacacattcatatgacaagtgatgccatgtccaaagatctgtgggattccttcactagtgggagcagagaatagcccaagcaagtggcagctgtagtattatggttatacaaatgatgctacactaataaaaatgaaaataaacatcatttacaaacattaggtcagctatcaatatcacttcatttgtgagcacactgaagtgcttctaaactgcatgaaaatatttggcaatgcgaaagaaccaaaaagaaaaagtggttttgtagttgatacagcctgctctcacgtagcacagcaaatggaacaggaatgaactgagcctattgagaataagcaagtcataaacagataaaatatcactgaaatgccaccacaaacacctgtatagaacagcacatctaaaagttaatttctctgtttatattggatcacatacataggtcatatttagaaacaatagattgatagttatttttagagaaccacatagaagcaacctaatccaaaaccttcccaaagcatattgtgactaattcactatgtcctaggctatgccattgtaccttctataggcttttctgagcaatcacatccacatcaatctactccttaatttttactgctgaaaccctttcttccatgttccagacctgcattcccaatttgacgtcagtaagtcagacaatgttgtaatgtaataatattttaatagagatttcaatttcaatgccaaattcattaccagatgctatcaatagtctcttttgttctcagcacatttagatttctagtatttccatcccagttatcctacccaatttccttacatatcatctcatagcattgtgattgtgctagactccatacttgttattggcctccctgccttcatttttgtcaaatgtaaatagattttttgtctgcagtcagagtactcttcttaaaacaccattccttttaagtgatcaattgcctttacaaaattctacaatggttcctcatgggccattcttaacctccacactctttttaaataaattaatatatctatttattatcattattattattatttgtagaaacacagtcttgctagttgcccaggctggtctcaaactcttggcctcaagtgatcacatcatcctgtctcgtctttccaaagtgctggtgcaagccaggtgctccctgctgctttttcctaacttttaggatcatctccttctcctctgcatctacttatcttctgttaagccacaacagtcaccttccctaaacatgacttgtactacccgtattctctactttaaagctttactcacaacattcttcttgtccagaaaactctcacacattagattttcctatttaatccctacactcccttacatgatcctagagaagaagattttctatataatttcactagttttgcatttcactgctttgcctggtcacctgaaccatcctgtagctgccactccccagcagaggcaaaagattcagacattcaaacgttaagtataatatttctgctttccaggggtccaagcacagaattcaagggtctctgatgctaagggtttcaagaaggaatatctgcctgagatttttaaccatgtgtctcctgtcccggcagattgccactcacttagcaatcgcatccagaggacttttggagattttatctgttgttactcaaataaaatgccctatctctatctaaagccacactgctctcaaatctgtgtttacggagatcccagggagtgttgcttcagctgactttgctgtgatgattttgaaaaacggagatgggttcatttaggccaattaaggattttgagataaagggaaagatatggatatgtcagtgtgtgagctagtgttacactctgggttgtaacatattacttgtccatgtcatttttcattctatctgaaaactgttagaaattgaaataatgtatacacaatgataagcaagtgtccattttattaatactacagtatatgaaaaggatatgtttgtcaagaaagaccatggccaggcatagtggctcacacctgtaatccccacactttcggaggtgggaggatcgcttgaggccaggagttggagaccagcctgggcaacatggcaagaccccatctctacaaaaaatagaaaaattagccaggcatggtggcatgcgcctatggtcccagctactcaggaggctaaggtgggaggatcacctgaacttagggaggttgaggctgtggtaagccataattgcaccactgcactccagcgtggacgacagagtgacaccccatctcaaaaaaaacaaaaacaaaaaaaaagaaagaaagacctaaatacaatagagttagaagttctatctgaaagaatgaaaataaaacactgtttgcattttgatagtgccctctcaataccagctgcacgaacttgagaaaatctccctgaacttcacttctcttcagtggaatgagacaataatagtaacttgctcacagtagtgtgcagataattaaattaaaaactatttgtaaagaatttagcacaatgttactctcacacatagaaactcaataaataatagccagaaattttgttatggccacaaatttaaaaatcaagacactgctagctcagaaggtactgattggttataattcttacagagaaagctccaaaaatcttttccagacacctgcatacaccacagggatttcaaaaggagcagaatgataatataatataacaagggacaggtagagtatttttaaaatgaagtatataatgtgcatttaagaataaatttgtgataacacatgaataggtgcactaaaatttcattttcatgtcttattaaataaattgtattgctattagtatatgatttttatttccgtagaattaagggattatttctgagaatccaaatcaggagataactgaaaatattccttgagttatagatataagacaatcatttgatatgcaaaaattgcatatatttagaaaacctcagcagaacatcacaataaagctgttgtcattgttctgtttataagataaaggaagaaaaatgttctcgcttttgtaggcctttaaaaatgaagtagatgcagttattggaaatatgaactgactaagccatctaataggaattacacagtgtgaatttctctgacattttgtttgcagattcttagtagaaaagtagtggtttgtattagccttgaagatgttttaatcaaaggacacactgcttgtagaacaaagtgaataaatgtaaaatacagtttcattcaaataatgaaaaacctgtgctatagaaatttaaatctcatttaacttaaattacttattaagttacatatttataaattcactcatttttgtatataaaaatgtcaatgacatctccttttattctcacagggtttctaacattgctgatacacaagtcaaacttcagtgtctaatggaaaacaatttaggttattatttttcaaagaaaaaattctcaattatattagtcacatttataattacatggctagtcaaaaacattggagtctggataatagtaatgataataaaaacttgacatgttgttttttgacaggaaaagtcttctaggacagggtgttaaattccttaggagtgtctttttctcttttatagatctccatctttgctttccaggcccatcacactgtgtttttcccctgtaagtcagttcttcctctatctctgctttctaggctttctcccaaatgtcaattttcccctttactcactcccacttgtatttttactgtcagatgcttcttcacgttgatgccaaaatgtttttttttttaaaaaacagattttaaacattcccattttctttatacttgctaccatatcctcttttctatcactgtcttcagcctccctttttatgttttatctctttgtcaatttttttctaaaattttgttttctttttctactcatttctatgcatctatgctgtgataacgattaaggcaccctaaaaaaatgttaggctaataacatgatacacagtacattttttcagttgcaaaagacaactcgggggaaaaatgattaagggtgagagactcccactgaagtctatatgatgaaagtaacctcagatacaattaactatgagtatgagtgttcgaccatgttcctgactgaaatcaaacaggtaagaatccaatgaagtttgtgaaatatattgccaaaagcatggacgcaaagagattgggactctttcagacttgcaataagccatgaaacctcaacagtctgtgagcagaaagcatactgagaaaacatctctcaaaaatgacatgtattacgagatgtctacatcagatgtggccaaagaggataataaaacagactagagcaaaggaactatgaagaacaagtgaccatggagcccagactaaaggcttaatcagcttccgccacaaatctcacacttggaatcctcacaatagctgctcagcaggatttaagaattgctacactgggatctgctgggcaatgcccactcttccctttctgggaacgtttatttttgttaacttgttcctgatctgacatcgtatactgggtgagaaagagggcaggaaacttgttatttttgattctaggtctctacctctagaaaggccatatgaagaactaaagtagaccacttttatcacctcttgaagaagagacaattatcatgaggccagagcatctggactttgaccagtctgcacagaactcacagggactttaaagttaacaatcttgttaagggaacgagagtattggctgtcgtgtagagattaaactgaatgttttctaagcaaaggagctgactgataatcattagacatgttctccaatctccaataatctggtttttcttctaatgatttgtcaaatcttttcagttacattgcaaacatctttggaggaaatattatttattatgatacttatgtgattcacatcaccaaggaaaattccttgcataaatatggaacccaaccaatcccaatttaatttcatttgaatttcttttttaattttttttttctcaaatgactgcccaagtttttgagtaagttctagtgaagaacttcttgactttgcctgtcaagcaacacagaactctctttactatgcagaacatattccctgtggctcaagtagaaatatcctcatcaacattatctctcctcttctttcgcgtgactgtaactcaggccatttctgaaacaactgagacttgagtacatgcagggctggcttcatgggcatggaactggtgcagtgcaggtcttagccttcagcagggcctcctcacaatttaatgctcaactactgcattttaaacatccccctaggtttttctggtggaactggaaggtaagattgtgtctttccactacggatctggaatttcaggcagcaaatttccactaggtcgggagcatctgaggcaagcagatccaaaagtggaaagagaaattgaatccagaccatactgttgggacccagctagaaaagaatggactcaactgacctgaaagatgcaacaagtgatatggcattaatgatgttgttaagtttctaaatccagcctgatgccagaaacactcctggaccagtgaaatgagtgaatatagtctcatttcagtttaaagttacataagtgggattctggccatttgaatcccaagcaatcctgatcaaaacacattttctttctgtacttagtctaatatttttcccaactttccaaaactattcttgaatatgcctaaaaccaccatactttgcacaaaataggctctttcttagttaactcatattaaaaggaatcattaagcttgccataaattcactgctcaatacagaatgagcaatatgaaattaaaattgttgatatgtgttttaaaggtcaaaatccttttctccttttcttttgagtttttttatacttaatgttactcagagctatgcctctgcttttggctcaatattgattacgtacacctccacatcctcaaagaaaacaaaataaacctgctacatcctgtgccagggataactaatctaataataagaaatcagctttattttcaaatttttaatttctgtacataccacataaaggatatagttacttctgtctttccaatagtaagtaaatggaataaaatgaaaatgtatgacaattatattatgataatatgactaaagtattaagatgaattgttaatcattacttagcaaattacaactttcatatggagaaaataataccttacatatataatgaataatattacacttgggctaatatggttttgtaagttaattatagactacacagctgatttagtttcatttacctaaggagctgttctgaccctgttgcagattaattacatcttcaggaatacactctcatttatcattgtcacttggagcattatagctcttagcaagagtgtagaacttttttttaatgttaaaaaaattccttagctgtgatacattttgcaagtttagtcattaaaaacacatgacagctaaaagcaggtaagattaaattagctatggaacattgagaaagttcatgtcctagaaattaaatgactgaaagaaaataaaaattctgttaaaatcattcatgtcagacagaggcttcatctacatcctggagcattttttagaagatcccttgctttgaaatatgggtatgaaaaatgtttgccacattctaaattcttcagcacacattacacagctttttactattcccattttctataattgttagaagtatttaaaagaataacatcgttacctttatctatacctagaaagtattatttaaattatgatgggaaatttataccatttgcttttacctaatgatggtcatgtccttaattgtgaacatgagaaagagctaaagaagtctgtctagctttgaatactgtagaatatttatttacatgtgagtgatcatttaacatctgtttgagaactacgtgtcaatgtatgtgcagattaggcacacttgaataacttacattccttcacctggaggagctcagattataggggaaaatagaccaacaggtgcaactgagaaacaatgtgtaaaatgtgattaagattacataaagatatgcaacagttaatacggagtgccccaaatgagtggcaagcccagtttggtaggtcagaaaaggcttttggagggaagagaggcttccactaattattcaaaaatggacaggagctagccttgtaactcctgaatgaggaaaaggtggatgtaaagaggaaattggaggaaggagatgggaatggtcagtttcatccaaacagaattgatgataggagcaaaggaatagagtaaagtaaaagcatcttagaaactacaggcagtttctggagatgagattggagattgaggcaggcccagaacatgataggaagcttggaattcatctgtatgcaacagcagggccactggagccatgactagctatggggagcatgggtttgagaaatcaagactggaagcagagagagcaattaggaggcacggtgattgcaacagtaagaggtaatgagagttccagatacccaggggactatataaataaaaacagaaaagatttagagaagattgaatgataaaatgacaggatttcttggtcagtagtggggatttgtgaaatgctaagatcagttctagatgagtgatctagggcatgctgtcttctgcacagatggtggttgaaatcaatgaggaggagtgaaataacccagggcaatgcagagaggaaagagtagaacagaaaaacaatcctggtgatcatcagcaattaaaggaaaagtaaagttagaaaatctcttgaaagtgacataaaaccagcaaggtggtcagagaattataagacttgagagagtgtaaggtcatggatgcccaaggaagtaagaaaaacatttcaaaaaacagaaagtgagtcaagtgctgcaaaacactcagaaagatggtactattgaactggttaatgtgacatcaagggtgaccatagccaaagaagttttaggcatgtgataggggtacaagtaagtctgagaaaccagtttgcactggttctgcaaatggtgaagtggtaacataaaagaagttgttttacccccagaaattacctaggaataaatatttttttttaaaaaattgatatatattttctgttttcttctttcaccaaataacctatatagttattttaaaatattctatttaatactttgtattttttagaatactttatattaaatacaacatttactattcttcagaaatcagaaattctggttcagtattcaaaacccattttaaactttgttgagcgataaagagaatgcagggaacaataacactgaaaattatatttaagtctgaacatttaaaaacacagaaaagttatctggtgaaaggaaagacgattaaaatctctagctggctggacatggtggctcacgcctgtaatcccagcactttgggaggccaaggtgggtggatcacaaggtcaagagatcgagaccatcctggccaacatagtgaaaccccgtctctactaaaaaatataaaaattagctgggcgtggtggcgtgtgcctgtagtcccagctggttgagaggctgagggaggagaatcacttgaaccctgggaggtggaggttgcagtgagccaagatcacgccactgcactctagcctgctgacagagctagactgtctaaaaaaaaaaaacaaaaaactttagccattagttgcttaatgaacaagcaatttttgaaaatttattaataaaactaaaacagtaattttgttttattctgtcatttaaaattctagtttggggttttaagtattacagataaaaacaaattattcattattggttattatattatggatctgttttgaaaaaatcctattatattcaatttgctgcttaacatacaacttatttatcattcattagagattaggttaatttttttctaaaatacttatttactaaggagtttagtgtgacttacttaataaaacagaaacaaaatgtaattgaaagaaaatagctgaaattacatttgcaatgaaattttatgagtaaaataaattgctctgaggtaaaattatcaaatatttgagattaagaatctttttgtgattggtaatttactcaactaatctaagtcattctggagataaataacctgtttcagaagccaatgtcctattagaaagcatcttccaaaaggatatgaagttgattttccaagaaaaacattacagcagtatagcattaacatcattaaaaatttctttatgtcacaaaacaataaaaaatacaactgaggacattttctttctttcatgtgctttatagtcttcatttggttgctatgatcatccataacttgtcaatttctcaaatgtaaactccaatctcacttaagaaccaaataacaatgattgtcatgaacatgatgacggaattatctgcagaccaacagaattttatcaaaccaaatataaatcaaactaataaaaaatgacagcttctaaaattatatcacagtttcactaaagaggtagataatgtagaaataaaagaaaatgaaatttaaaaaagactttgatcattttcaaagcccaattatattcatctcacgactagacaaaaaattcttcctttttaatcagtctgtgagcattgctaaatttctttggttaaaatatttcctttgtgttttcagtaaagatataggagaatgtgttacaaagggctgaaaactggagaaattctgttaactatttccactaacttgaaatttatggttatgagaattaagtagtcatatttttcctacactggcagaataagaggctcttagtgactgactaaggctgaaggatattaaatcacaaccatgcaaatatctatttgataggacatttgggtggtaatatatatgtgtagtaaaagtccacttgtctttgtcagatttcttccagacttagaagatttctacagttaacatagacccaattctgatttcagaagaactaatgtggataaggttttcattttcatgttggctttcactttttacacagcatgtgatactaatttgtttctggatatgttctacaaaaactggaggacctttccagaagcctttacaattcttattgccttgcttgtttcttctcgcagtgctgacttctgtgttgaagagtgtccaaattggaacttactgggatgattaacagctgctacaaaatcaatactctatgtagggaaaacagaattgggctaagatagtcttacatgagcactattttgtggctgaatatctgttgatgtcagcaagccaaatacaatttatcttggtggaagcatttccatggatataatacaagagcttttcagacttggcctcagagacataagaggtggggaagataattcataggtcttaattgtgcataattatgcatattctcagttgcaaagatgatcactgttatactcagtaagaaatgggtttgcttaaatctttcattattttaacatttattatggttgaaacactaagtcatattactattgttactgcaatctgtctcacagtgagtcttaaattttttttcttcacaaattaaattgaaagataatacagatgtttgtggatttggtttattaagccctaatgttctaattacagaaccataaggtggtcactaacatatgacctaaaaatcttttgtatctctttttggagggctaaatatgctttataatattatatttaatattaaacaacaggataaatatgctaacagtttaaaaggtaataaacaattccctgagcccttacttatttgtatcacctctagccacatgcaagggaatatgcttgtgtgtaatgttttacctccaatatactagaattcacacttctttctggcaacatgttcatctttgtatccactataatgtctatgtcagcaattagacaatacgcatttgtggaataaactaataaatgaacttctctgtgattaaaatatcaaggagctaaatgctaaatgcccatgataactcaatattttagatttttatactaatgtaagtacactgtcagaagtagttaagaaatgtttattcaacaatgccatttgtaaagcccagtaagtgacccataaagagtatattttgcaaatctgtttaactggattatccactgggaataatattgtgtgctaaccctcctccctccctgtctcatgatactctccctatttcattgttgcacatgttgcttggataaggaatatgtcaccatgttttttatgtttttaaacacgaaaagctatcaggtttaaaaagacttaaaataattgttttccggggcagctaccatgaatttgactacacttttagcacattaagtaaggaatctgttttcctttctctccactaggaaaaattaaatgttttccaatagggagctatcacaaaatatggattctatagttctcagatgtgtggactttctaccaacatgttaaccagaaattgatcctgtagctcaaagccacaaggacaagaacatgataaggcagggtcagcgttgttatggaccgggaaagccacagctatcaataaaccagaaacctagaaagtcaaattaaagagccagtggtcttaaggctgatagtgacggctttgagatctttgggatgcttaaggcctaatccccaaaggggaaatcaaagataaagtcaaatgttaagaagcaaatgggaagaacaatacatgaaccagaagaatttgccacggtcagctcaagcagctcagcacagatgaattcattctacaaaatgaatctaataatgtattgcaaggcaaaaattattttccatctaacagtgaaataaagaccccataacatatgcacatgctttgtcactttcctttatagtaccctgtatcttttccttcaaaatactgagggctgtttgaaattcacttgtttattgtgtcccattcctaagaaaatgtagactaaatgagaactggttttccctcttgtgttctccaatactaattccgtttatcttctagtgctctgaagagtatccagcacatagtgattagtcacataaataaacaaaattgctatataagtaagtgaaggaaaggaaaagacacaagagtgtgtgaaatgaaaaagaatcagtagaacagcagctatagttatatctatccagttaaaatgtgatctaagcaaataaaaccacatccaatcgcaaatcattattaaaacaattcaataaaaggcagcactgtagaacaggttgaaagtgaatatttgaatgggaatgttagcatcatggtatgtatgggtttacaaacgtttaaatacattgaataatgctatgaaactttaaagattacccacagtcccaccacattttaaatttacattaagaagttttatttctctctgtctcctcacatgctggaggtatatatatttgcagattaatttatatgttttcatatacatattttgatatatatatttgtgtgctcctttacatgctttttttttttttttttttttttttgagacggagtctcgctctgtcgcccaggctggagtgcagtggcgggatctcggctcactgcaagctccgcctcccgggttcacgccattctcctgcctcagcctcccgagtagctgggactacaggcaaccgtcaccacgcccggctaatttttgtattttttagtagagacggggtttcactgtgttagccaggatgatctcgatctcctgacctcgtgatctgcccacctcggcctcccaaagtgctgggattacaggtgtgagccaccacacccggccttcctttacatgttttaggagacagctaggtaaagacatttatgtttgatcaccactgtgttccctaacatttcttgagcactactgttgagtgttgtaagagctttaaaagtcccgaacaactccttaagatagtttctgtattgtcttccttcacaaaagtaggatatgagaaataatgttatttatggacaatttgtttttgtaatttaatgttaaattttggggacctcttttctagttgtacattattttcaaattgataaatttttaggtttcccaactattatgtctttaaatatgctttgtgcagcttacacttttgtactcttttccctgtggaatagatttttagaaatgagatggatggatcaaagggtatgcacatttttaaattttaatagatactatcacataataaaatattttaatttataagcccattacacaatatggatgtggtgatttttctatttacatcatcatgtcaataagtatgacagcatcatacttactgatttattgactgatagagatcatcagtctttgtaattttgaacaatttgaaaggcaaaatatggtaacctattgcataattttatcgttcattgttaactaaaaatattagggatttttttcatctggctattcagtatttttctattacatgcttattttttaaactggaattcaatatttaagtttattcaccctatctttattatttttgttgaaaacattttttgaaatttaaaagttaatgagttttaatatatatttttaaaatgaaagatcaagaaaacacaaccataattaccttttagattctagatttcttgctggtctctgacaagttttcctgttccggatgatagcaatttacttctatattttcttctaatataagtgtattgcttccatttgtatttttaatctatttgatgtatatttcacatggctttgaagtagaaatatgaatttgtttttatttaaatgaataaccaattctgtcacttcatttattatgtattgtgcattttatccctctccaatgatttgatacttcaacatctaacaaatattaaatattctgtatctctgcactttgtttttgtctaactttatattcaattctattaatctatttttgtgccaccgtattttagttgcagaaatttggtagcatttagtacacggcaaggaaattgaccattgtaggacattatttcagaatattttaatggcatttttgttcaactgcaaattacattgaatcaaaaacaatccccagtgaccctatcagaattctcagaatcaaggaattaatatataaattaatttgggcagacttgatctcttaataatactgaatctgtccatgaaggaatgtcagaggcatttgaaccagagcaactccatctagaataggagtaaggtaaaataaggctgaaacctactgggctgcattctcagacagttaagaaattctaagtcacagaatgagatacaaggttggtacaagatacaggtcataaagaccttgctgataaacaggttgtagtaaagaagccggccaaaacccaccaaaaccaagatggtcacaagagtgatctctggtcgtcctcactgctacacacccgccagcaccattacagttgacaaatgccatggcaacatcaggaagttactttgaagggtctaaaaaggggaggcatgaattatccacccctagtttagcatacaataacaaataaccataaaaatgggcaaccagcagcccttggggctgctctgtctatggagtagccattctttcattcctttgctttcttaataaacttgctttcactttgtagtgaaattagtaatttttctaattaattatttcttgcaggagattcaagaatgatctcttggggtctggattgggactcctttccggtaacaggaatacaagacaaattcttaatattcaagccttattttataactttgcataaaattatttagatttcctcatatatgctgagtggttttttaactaaatgtaaaccttggcatatttttagttttgctggtattgttaacaaaattttattcatattaacataataactggtaatattaaaaaggaaagttagaggtttaaaaaatatatatttagtatttattacattgctttactagtttcatttctagttgatgaatatttattacatatataatcaccttcaaatattaatagctgatttctctacataaacatttaatttttcattattaaattagttcacttttaaaaatttgttgactgacatagtgagagaagaattatggtcttcctcctcattttatttggaatgcatcccctatgcccctatacgtgtattttgatttattaaaaaagcttaaatttttttcaattagtttttaatcacaaaaaacagcaactcttgtttttatttaaaacaaataattgtagtaatattgacccgttttggctttcttgaaataaaccctattgggtcaatagatttttgtccttagacatactacttgaatttatttcctattatttttgtctgctattgttgcatttatattcacatgtaaattttattttggaagctatggttatgaggtattgatattgaggttttcaatctatgtaaaatgaattggagaaactttcccttttaatctgcattctgaaattttgttaaaatataaaaactacttgtgctcttaagagtaaatggaattgccaccaagtttagtagttctcttactacctttctacattttccccctttggctaactgaaagcagtggttctcaaaataggatactggacaagcaacattaggatcacctggaagcttgttggaaatgcaaattctcagcccccgtccccaatctcagacctaccaaacagaaaacccaggtgtagagaccagtaatctgcattttaacaagccccttaggtgattcgaattcatgcttaaatttaagaaccactatcttagatgtgctaccgcttgctcttcagcaaattttagctatttatatttggatgcaaaatgttccatttcttctatataaaaaattattgccatataaacacagatgatatacttatttaaatattttccatagctgtggctatgtctttaaatttattatgctgtgtatttatttctttctgttaaaaaaatatttgtgccggtctatgtgtattctatttgtcatttttttaggggagaaaaaagctttgggctttgtctgtcattatacttccgctctttttttccaagttgttttctttttgtcaattgcatcttaactttctatttgtcttgtagctttttcctagttctttcttaatttgactattgcttatttttatctttttaaaaaaataacatcttcatggctataattttgtcctccatatacagttttgcccatatgcatattggcttttgatagaaaatcttcatatatttgttaacttgtaaataatactttttccatttttatttccattttacctaaaaaaaaatttaaatgatgcttatggaaattcttaaatttcttaattttttggtgttacttggtttatttttatttccaaatttatttcattgtcatcaaggaaattatcatttagactccttacatatttattatttattatggtatacaaaaattcttaaaattattttcctgcaacattggttgattattttatctcatttatcattcttaatgtttactattttgttcttttacttgtttgctgtaatcaaatttctaagatgttctttttcatagctctttttcaagaaattctttctagatgcatccattattggtcttatcgggaaacacatctccacatttttatctgtctctttatatatatctatatggttattatatataattgccatttatatatttatgataaatatctatataatatgtaaataatttagatatatatacatatgtataccttctgtatagaggatgactatatcataattacagcattgttagtaatgaattttctcttagtttatattatctttgtatctaaatttctgctataaatattaaattctttttttgttctagaaatgaaagtttataaatcttcttctgaggatgcctttcacaattttacattagaattgtatatttcctgtatagtttgccatttttcctttttatttcaactttgatccaataattaaccagaaatgttttacaattttcaaatgttaagatttttagaccaactttttgcgtacttgtaatatgactgaattatatgagatcaatttgcctttaagatttctgcttttttaaaaaaaactgattttccttgtggccacatgtgtaattgattttaataaattgttcatggatattccagaaaacacacatattccctaaagatgtaaatttcttggtatcttttgaaaatccaccaagccgctaagaaaaaccaagaggctgtatccagatgtctaagtgagaaactctactcacctgctcagcaattttatggctgttggagaccagaacactcctgtaggttcagtatgtttggctcttgtgtgcctcagatctgctgctttccagtccttacacctaggactccatttgcttactcaacccacttggggagaaatccctgcctgaagtacctcagctaaggctctaacaaagccaaaacatactagctcccagctgcccctggtctccagcatccatttgaatcaggagagttgaagcaattgaacaaagcagatcacctgcatgtccctattttcttagaagcctccaaatattcccctgggaaagcccacaggtgtgtgtgaaatgtgctaggatgtgttccctgtgaccaacatgacctaacaccatgtccaacataatggtgacttttttcaaaaatgtagaaatactctgtaattacatcaattttcttagcatatagactttttctatctctaaatttctgtagtactttaggctagaataacctataaaatcaattatttttccttgcagttttatcaattacatataccaagtttattgaagaatctctccctatgcactatatcatgttatgtctctaaagtcccagttactttttgctctgcagtcctcctacatcattttggaggaagggggcacagcgtagagggtaatggtctgctcattctgaactgaaatccctcaaaaaaccctctgtaaaggtagctgacctaaaatacaggcagtctctttagtatgcattcaggttgggccttagttctggggtaaaagcaataatcttatgcaaccttctattacctacagcatatgccccttagaggtaatggggtttatactatacaatttatttttagaaaactcaactactattgtcaattgaattttttgttacatcatgaatttattaaattatttcaaaaacttgatgcattgaaaataaaatatttagcagttgcctaatcacaatactaaagtcactgagatgtcaaagccttggatctcaaacatttgtgaacagagttgtgatagcagctatttagtgaaactccaggatgtcacttggcccctctgggcactgggctatttctaacttaagcatcttcaaattatttcttttttcttttcttttcttttttttacttttcttttctcttctcttttcttttgtttctccttccttccttcctcccttcctctcttcctctcttcttccctccctttctccctcccttcctttttgccttcctctctttttctttcatttaagtgtggagaaacatttattcaatcttctgcccattttgtaactaggttattagattttttttttactgtttaattgtgctaattacatattttggcgattaacccttgtgatgtagtgaaatatttatatttagtctttctcctctttttcttttttactttctcctctctttttttattgttgtaagaacacaacatcagaacttaggacttaacatgagatctaccttcttaacaaagtataaaatacattattgttgagtataggtacaatgttttacaacatatcactagagtttatccctctagctttactgaaactttatttatgtccgttgattaataattttccatttccccctcttcctagccctggtagccacaattccactcttcagttttatgaatttgaccattttatatacctcatataaatgcaattatgaagtagttgtctttctgtggtgggtttatttcatctaggataatgtcctcaaggttcatccttttagttgcatattgcaaaactttcttttttaaaaaactgaataacattcagttgtatgtatagaccacatcttctttatccattcatctgtggttgagcagttatattgcttctatatcttggctatagcaaagtgtgctgcaatatacatgacagtgtgaacatctctcttcaagatcctgatttcaatccttttagatagtcaggagtggaattgctgaattatacaacagttctatttttcattttttgagaaacctccacattgtattgcatagtggctataccattttgcatcccaacattatgcaggagtcccaatttctccaaatcttcacaatcacctgttgtttctgacaatagccattctagcaggtatgagatgatatctcgttgtgcttttgatgtgaatttccctgatgattaataatattgagcatttagaaatatatactggttcattatttgaatgtcttctttggagaaaagtttgttcaattttctacccattttgtagctaggtgatacggtatggctgtgtccccatccaaatctcaccttgaattttaataatccccacatgtcattggagggacccagtggaaggtaactgaattatgggagcaggtctttcccgtcctcttctcatgatagtgaataagtctcaggaaagctgatggttgtataatggagagttcccctgcacacactctcttgcctgacaccatgtaagatgtggctttgttcctccttttctttctgccatgatagtgaggcctctccagccatgtgaatctgtgagtttattaaccctatttttctttataaattacacagtctcaggtatgtctttattagcatcatggaaacagatgaatacagtaaattggtaccaagagtggcgtgctgttttaaagataccccaaaatggagacgtgactttggaatagagtgacaggcagaagatggaacagtttggagggctcagaaaaagacagaaaaatgttgcaaagtttggaacttcctagagacttggagggctcagaagatagtgatatggacaataagatccaggctgaggtagtctcagatggagatgagaaacttgggaactggagcaatggtaactcttgctatacaaagagattggtggcattttgcccctgccctagagatctgtggggctttgaacttgagagagatgatttaggatatctgaggaaagaaatttctaagtggcaaagcattcaagaggaagcagagcataaaagtttggaaaatttgcagcctgacaatgcaatagaaaataaaaatccattttcgggggagaaattcaagcctgctgcagaaatctgcataagtaacaaggagcccaatgttattcaccaagaaatggggaaactgtctccagagcatgcgagagacattgtggcagcccccctcatcacaggcctgggggccttggaggaaaaaatggttttatgggctgggcccagggcccccctcatgtgtgcagcctatagacttggtaccccatgtctcagctactccagctgtggttaaaagggaccaaggtacagctcagaatgtggttccagagggtgcaagccccaagccttggcagcaagctctaagccttggcagcttccacatggtgttgagcctgcaggtacatagaagtcaagaattgaggtttggaaacctccacctagatttcagaggatgtatggaaacatctggatatccaggaagaagtttgctacaggggtggggacctcatgtagaacctctgctagcatgcagaagtgcataagggaaatgtggggttggagcccctacacagagtccccactgggacactgcctagtggagctgtgagaagagggccaccatcctccacaccccagaatggcagatccactggcagcttgcaccttgcactggaaaagttgcagacactcaatgccagcctgtgaaagcagccaggagggaagatgtaccctgcaaagacacagaggtggagctgtccaaggccatggaagcctatcttttgcatcagtgtgacctggatgtgagacatggagtaaaaggagatcattttggaactcgaaggtttaatgactgccctatttgattttggacttcccttttgttttggacgatttctcccatttggaatgagtgtatttacccaatgtctgtacccccattgtatctaggaagcaattaacttgcctttgattttacaggctcataggcagaagggacttgccttgttttagattagactttggactatggacttttgagttaatgctgaaatgggttaatactttgggggactgttgaaaaggcatgattgtgttttgaaatgtgaggataggagatttgggagggaccaatagtgggaagatatggtttggctgtgtccccacccaaatctcaccttaaattgtaataatggccatgtgttgtgggagggacccagtgagaggtaactgaatcacaggggcaggtctttcccatgctgttcttgtgatagtgaataagtgtcaggagagctgatggttttatgaaggggaattctgctgtacacgctctcttgcctgccaccatgtaaggcacgcctttgttcctcttctgccttctgccatgattgggaggcctccccagccatgtgaaactgtgagtccactaaacctatttttctttataaattacgtagtcttgggtctgtctttattagcggcatgagaacagagtaattcactaggttattcatttttttactatttacttgtggaaattacttatactttggagattaactcttgtaatgaaatatatatttggttttccctgtttcttgacaaaaaacttctaaaattcttgaaatcttcaaagtggtaagtgccattttgtctgttaatgagttgacagaattgagtgaattttttagttcaattattgttttcttccattccatgatttctatttggtaccttttaatattttctatctttttgttgaaattctcactttgtttatgcgttattttcttgacctcaatgagtatctttataagagttattttaaattatctgtcagataaatcatacaactctgttttttttttttttttaagttggttcttggtggtttaattggtccactgttgggaatatccttgtctactttttcatttttcttgattctctatgtttatgtaatctgcacattagacaaaacattcacctctccctgtcttcacagactagccttgtatggaaaagacccccaacaactagccaggtgaaatattctggggtcttcaccaagttttccttcctcagagaaaagcaagctgctgtagttttcctgctcactctgtgctcagccaggggaatgaaaaagctatggtttctgctagcacaagccaccatttctgttctcctaaaggcagctctgtgttagacccatcagagtttcaagactggtaagacaaatgctagctctttgggcagccctggagaaatttgtgtgatgaactcatggagctactttttatttaagcaggcagaagctgagagctgaaaatttttgtctgcttgctctgtgctgagcaaggggaaggatcaatggtatccattagttaagccactgcctgtattctcccctaggtggctggttttgctgaagccattagtgttccacctggaaagacagaaactagtcttccagggagataccttggaaaagtggaagtgctggacattcaaactaacctcttccttcctctaagtaaagctgggggttgagggttttcttactgatcatgtgatgctgtgcctgggcctggtcttcagtgagagggtaacccaattctccctaccaacttaaatgagtctggttttgcattatcccagggtacagtagcatttcaaagattttcagatttctcacaaagggaattagtctgtaaaagatttctgaagctatatgtttgtcaggggaagaagatgtaggtcttcctagtctgccatgttgctgatatcactctggttatttgtattttaatattaaatggaatttaaaaattcctcttgaaaatttcttatctctgttactatatagtctttatagatgcatcttcactggcccaatttcttcagttttgtcctgtttttaccagacttcttagcagctttctatttagtcggccattcttttcttaatctttttttttcttttttgcttacctgaacattatatactttttgttttcctcctgcttcattggccattgttttccagggcatttcccatgccatcttcttctagtagactctaggtattagtaaacctcaaggctttatcctaaagttccatttcttctctttttgagctctccctattaatctcgtcagtccacactgatttaagtatatgtttaggtagatggaaaataatggataaactttctcccattcctgaatgtccccttgcaatgtaactgtcttccgtcaagaggtagattctatatcttctctccttgaatataagcttagttatgtgatattctttggctaatgacacattagcaagctggatgcaaacagaggtttgcatcaagaggtttgcattgggctttaccctctttttctactgaaaatttttccaccattatgtaacaaagtctggcttaacctgttggatgctgggagtcatatggcccattatcatcatcagcctactaacagctagaaccaactgccagatatatgagggagaccagcatagaatagctccaggtaatcttccactaaaggcacaaccacccagttgacacacagacttgtgaataataaaatggttagcatattaagccactgaattttaggaaggtgattcataaagccatatagaaataaatatgtcaatgactccaaattctccctaagtgagatagtcttctaagcttccaacttaaatatccaaccatagccctgaaatttccactatgacatgcacctcaaactgagcatgtctttatatcctccactaaacctgaatcataaataattaagcccatctcagtaaatgagaccacctagttgttaaacttaaaacctcaggatattttatttccttccatcccctggacactgtcgattttattttcaaaatatttcttaagtctttccagtttttttcagtatccatggctcttagtgtactcatctgtctcttattttactagaagatattctaggatggtctctttgcttccattcttgaaaacttccatgtcattcgccatgtgaccaccagaatgatttttaatatagtaatttttttaaaaactgagcttcctttaagtgagcagccagattaatattttttcttcataaattatattgaatctgaatattgttaacagactattgtctagcaaatctgcacatttttctttttagtttttgaggtttatgatgaccaagagtcgcttgtgttgtttccaaacctgtttatgcctgttttactttccattatacttatataatttaatcacatataattggaaagtataattttaaaaagaatcattttatagaaactaaatcaaatgctttaggaagatgtaatataaatgtaatgctgaaactttgctgtataattatatgtaagggtaataattataaaagatttttaaaaacaattttaagtatctagaaggattttactcatatggcttcacaagtgtcttctgagtttttactctaaataaactgaaactgaaaataatagatggtttattatggactgtggtttacacaaggcagagtttatagaatctcagtgactgacattcaaaaataagacattggctgggtttatgagggaagatggccaattcaattatatttatagattttaggtagaaagaaaacatttaaagttgtttgtgtcatttttatgacaattgttttatttttcaattaatatccaactatcacctttagtagaagaatttctgctgcaaatggatcgggttacctcattccctaatgataattatttaattattcagtgacctaccacttaaaaggcaaatatcacaccatagtcctacaggagacttcgagacatggtggcagctgtgttaacagcagcctttcatgttactcactccccctatccctctccatgctccaggcacattgacctagcagagctttgaaggcactaagctctttcttacctcaagtctttcacatacagttatacttgcctggtatgctcatgacatctctttggtgtccagctcacttatgtatattcttcagatctcttcttaaatgcatcctctttatataagcctttcctgactctcagatctacggttgatgtccttcatggtagcttttgttttctttcacagcatttatcataattttcaaaaatgttgtatttgtgcattggttttttgctttttaaaaatatctccttgcatcattaaactccaagttctaataatgagatgacctgtatatatatatataaaaaattatccatttatatatatgtttatatatattatataaatatataattatatgtttatatatataatatacaattatatttatatatattatatataattatatatttatatattatatatattatatatttatatataatatatataattatattatatatattatatatttatatattatatatataattatattatatatataatatatttatatattatatataattatattatatatattatatatttatatattatatatataattatattatatatattatatatttatatattatatatataattatattatatatattatatatttatatattatatatataattatattatatattatatataattatatatttatatattatatatatttatatattatatataattatataattatatatttatatattataattatatataattatatataattatatattggataattatatataattatccaattataaataaagatatatatatatatatatatcttttttattgagatggagtctcactccgttgtgcaggctgcagtgcagtggtgcgatctcggctcactgcaacctctgcctctcaggttcaagcacttgtcctgcctcagcctcccaagtagctgggactacaggcatgtgcctccatgcccagctaatttttgtatttttagtagaggtgcggttttaccatgttgaccaggctggccttgaactcctgacttcaggtgatctgccttccttggcctcccaaagtgctgggattaaaggcgtgagccacagcacccagccagatgacctgtgtctttaatttactcccataaccctagagcctgaaaaaaataagtgcttagtttttttgtttaattaaacaagtgaatgaagaaacaactatggaaattaaactaatggggtagaaagttttattcctgggatatttaaagatatctgtagttggcttttgcttctaatgtccatctgtctagcatctcatgacaatcttctttcacctcactgccatgtaagcttagtgactatacagacttctatcattttcattgctaatcctcaaacagtacctggtacatagaaggtactaaataaatatgcttttattgatggaccatcactgtggaagaatatctatttttagagttaattatgatttcaggatcatttccgatagttctggctaaattggaaaagcattaaaaagaaggaattgccatagtgtctagttattgatcaatttccctttctacctaggcagacaaaatttatttcctcagctttcttacaattatgtgcaggcaagtgattgagatctggccagtgagttatgagtggaaatgatgctacatcttccaggtatgggcccactaaaaaaaatccactttctttagccattcagttgttgaatagagaaggttatctgtcaagatggaaggagcctgggtcaccgattgacaacatagagcagagcctctccccaatttttaacctatcctgacctgtcacgtgaggaaaaactgatttttattcattgtcagaccacggataatttgtaccagcagtcaacccattctgaataatacaaagggtctataacaatgaatatgaaggtgatatagctacatatttctgacctcgggctttctaaaaattggaggcaaggttctttgtatattgtacagcgctagctgtcagtaaataagggacgatagttgaaataatgaaaacaatactgagattagaatcaaacttggaaatcactttgtaactagacagcagaagggttcctaaagacaatttcaagtacaaactacgtgctcatctgaagctttttcatgctgttatagcataaagttgagatgcatcccatatgctttaaatccttcaactccactatttgttatatattcaggaatgatttgagacaatttattttatttcattatattctagattcattgattgaggaagaggaatgtaagctgctgagtagatgactttgttgaatgacattcaaggtagaagatctattgctctgattatgtccctgagcattgagattttgtgtccctggggcaggaataaatctttcagggaggaatgcctcctctctttatccccctaatccccatattatgctcaggtaaaggaggcccaagtcaaaggaaacaagaccctttaaaagaaaactcagtcaaagccaccttatttgtttaattagttctgatctgccttaaaatcataaacattctatcacatagtttttattagtttctaaatgtcatcttttaaatttagatctttaataagtctggcgtgtacttatataatatgaggtagagttctaacaaaagttttttctttctaggaagctaggtttgaacattatcaactaagtaatctgccatttcctcagtgaatttttgtgccatccctatactaagttccaatatgtgtctctgtacttcctcattggttcattcatctattatttcataggaccattctgttataattatccaattcaattgtagcatgtataatttagtaaaacaaatttatttctctccttattgttaaaattgacttagctattttgtcatacatattttaaataagtttgttataaaatccagctccaatcttgcatagttatatattaaatgtataaattaattgaatattatatcaagaaatctcatataagaatagaaaatgtctccatttattctgatcttgtgtgtctttgcagagagttttaacattttctttatataggtcatgtgtattttttattaattcttagatactttcaatttttttgttattgtttctggaaagtcattgattattgctaatataagcatatactagtgaatatttaagttgattttatatttggcaaatttgctataatctcatactagtcataatatattttcaattaggtatatattttttcaattggaatatatataaatatatatttatcattatttttattacttttttaaattttttgtttttcaccatatgttgtttacttataattctctatagagtatttttgcaaagtcaatttttcaataggtctgattaacttttctcaataatgcagctttcagttttgctaacattacgaatttttgttgttgttgttactctctgccattttctgtctcatttctattatagctttccttttcaagttttttggttttgtatcatttctctttttcaaacaccttgactttttgtatttaaatacaattgacccctgaacaacatgggagttaggggtgctgaccactcttgcagacaaaaaaattggagcataacatttgactacccagaaacttaacaactaatactctactgttgactggaagccttaccaataacataaagccaattaatatatattttgtatgttatgcatattatatactgtattcttaccagaaagtcagctaaagaaaagaaaatgttaagaaaattataagaaagagaaaatatatatactattcattaactggaagttgatcatcataaaggtctttatcttcatcatcttcagattgagtaagttaaaggggaggaagaagagaaggggttgatcttgctctcccagaggtggcagaggcaaaataggtggagaaggtaaaaggggaggcaaattacactgggtataacttttattgaaaaaaaaatcgataagttgaccagtgccgttcaaacctgtgttgttcaaaggtcaagtgtatttctgtttcctaatataagggttttacaacctcgacactattgacattttgagctgtatagctgtataattctttactttgtatttgaggtgttgtcccatgcagtaagcgtatttagcagcattcctaactttacctactagttagcaaaaaaaccctgctttagtcatgacaatcaagcagacattgccaaatgtcttccaggaagaggcaaaattctcctctgttgagaaccactggaaattgaccaaagcatataaaaaaaatgagaaatgtttatttaggaaaaactactgagcctcagataagaactctctaattagtgatatttcagatttgggttgcttcattagccttcagctccctgggtgctgtagttctatcagagtggaataagctaagaaaacaagtagattcattgtcagtggaactgacttgatttgaaatggaagccagaaaatctctatggcctagaacattgttttacaacttacacttacagtagtgatatctgtggcaaatgaacagggagagccagtgtcatagctagcctgagtttgtgaaactgactttagggccagcagctaaccagcagattggccagagatttaacaagagatctcggaatcaaactttcatatgggctgtgataaacttctatatattcctggctgtctgaaaatctgtatggatttgcaaggctacacaaatgctcagaagagacaaaagaggatcctagttatctacacatccttggttaaatgagaggttttgtacatgagcggaagagacgaaagaaaggccagattatattaaaagccgaagtgatttctaattgcctgaactttgaatgtattcttcagtgaccatatggatgcgatgacaaagaaaagaagacttactggctcaaagtgtttgagcgcaatctctagacaaccattttgacacaggggtgatctctaggaaagcagtatacaccataagaaagaaaggctccacaggtaagtcactaaatagacaaacataggaacaatgataaccactgtgggcagataaaaatccagagaattaaagatataaacaattttcagtattcaacaaaaaacgaggagatatgcaaaggaataggaaagtgtgtcacacatttagggaaataacaagcaaacaaacaaggtctctgatggggcacagatatttgacttcacagacaaatacttccaaacagatattataaatatgtcaaaagaatgaaaagaaacaccatttaaagaataaagtataggccgggcgcggtagctcatgcctgtaatcccagcactttgggaggccgaggtgggcggatcatgaggtcaggagatccagaccatcctggctaaccccgtatctactaaaaatacaaaaaaaaaaaaaaattagccgggcatggtggcgggtgcctgtagtcccagctactcgggaggctgaggcaggagaatgtcgtgaacccaggaggtggagtttgcagtgagccgagatcgtgccactgcactccagcctgggtgacagagcgagacaccatctcaaaaaaaaagaaaaaaaaaagaataaagtataaagtatagtaacaatgactctccaaatagaaaacgttaattaaagatacaaaattataaacaaaagaaccaagtagaaattctggagttaaaaagtctggtaaccaaaacaaacaaaaaatcctaagagacttaagagacaggcatcattaatatctaaagattggaaacaatcaatatgtccaccaattggtgaagggataaccaatatttgatacctccatgccacagaatcctattcaacagcaaaaagggaaacaatatttatacagttcatatgagtgaactcaaaaacttcatgctaggtgaaggactccagatgcaaaactcctatattgtgtgattttaaaaattattttcccataagtttttggggtacagtggtatttggttacatgagtaagtcctttgtgagattttagatatttttaaatatagaatgtccataaaagacaaatcttagaggcagaaagccaatcaattccttcctgaaactgggaaaaagagccaagattgaataaaaatgggcatgagggttctgatttgcgtaataaaaatgttctaaaattggattaatttactaaaatcattaaaaagtacacttacaatgaatgaattaggttgtgtgtaagtgatacactaagaaagctgttaaaaatactgtttttataccaacgtgaataggagggcttctctggatcaagacacattgcatttttctttcaaataataatagtcattacagtattagtaaccattgtatatttagccttcatcatgtaccactctatgagattctttaaatgtacaatcatatttgtaactctatgagagaggaaataataaccagcatggcacagataaataaatagatactgagattaaataatttgcttaaagacttttacccaggtagcttacctcttaagttcatggactcaaccaatgctttctatattctactagcctttttataatctatctctgtgtgtgtgtgtgtgtgtgtgtgtgtgtgtgtgtgtgtatgagatgtgacatgacataaaattagcatgggatgacatacattaaatttaatgtaatgctttattttctatatttttagatttcataatcattggctaaaaatatatataaaatcactattaaaattattcctttaggattaaaattttaataactatttcaactgccatataatattttactctgtgtaagattctaaaagaaatgaaatgaaaagccagccttctgacttattaatcacttgagaatagtagcaggattttttgtagacttttcatagatttttagtaagttataatgattttataaaatgcatctcaaagtaagataaaatttaacgcaatattttcacattttcaataatatggagttttagcttatactctaaaacttgtaagtatattaaatcattctaagcttcattttagtaacacaaataaaccaattacaaagaatatagtttttttcctttgcttaagacatgaaaaatatgtcaattgctgatactctgacttcaaattggtaagcgatgataataatgatagtcattagagcaataataattgcctattagaagagatgttttgatggcacaaaaggtaaaataagttatttataatcagtaaattttcatagtttaaaagttttctcactgtgattatacagtacaggtacaaaggtaaaatttagtggagaatcttaccacgccaatggaaaagtaattattgatgatactgtaaggcactgggtctcctttctcatctttgtcattaggtatgacttcaaacttccacctgtccaacatgatttctgtgctgttttcaatgtcttttagaattttcatcagattctcaccttcgtaacctagtgggaaaaaaaaataccttgagaaaagaactctaaccaaataaaaaagctgtatttttatgtttcagtgtgcttatgcatatgtaatattctaaaggtaaataatgattttgaagcacattctgccaccaaatgaagaattaattataagattatactcatacccacatttaattcttaactttaattggtaacatgtactgtatttctctttttgtggtgcaaattctcagcatatacaactgccaagtgaacatttctactgtattccccacaaaactttataccaatagattcaaaactgaatgaattctctgcttccatatcttcctcctgggcagctgacttcacaaagacaccatcctctacccagctgctaaagtcagaaacgtggatgacattttagacttttccctttccatcactctcttaccctcaccttttcccgtctagtgatataaaactttcaatttaagtaaaaggtcctactttttgtaagctttaaaatttcgtttcttattctgtctactcagggtgtcccttttctttttggctggtttgcatctatttctttggcattgttttatatttgctaatactacttcccagtgctgctgcttatgcctgtagtctcagctactcaggaggctgaggcgggaggactacttgaggccaggagttccaggctgcagtgagctatgattgcaccactgtatcccagcctgggtgacagagtaatattccctgtttaaaacaataaaattaaataaaactaataaatttgctaacacttctttctggaaagcaccctttcaaaataatggctcagatgcccctctcacagtccgctatacgcagttctcaaaactagccctatcttagaactagtacaccacattgtcattacttgtgtttttctcactacaggtccctcttaacccagcctgcaatagagtaaatgctcaacaaatcaattttttaatgaatatatgatagacggtcaacatgacctgaaaataaaagtcttgtcaatattacattctcaatattcaatttatttgtaggtagataacattatagttatcactgcagcctaaccctgacagagttactgtttttgtttctgaatcttcctcaacattagtttccttccctgtaaaaaccttagggttcttgtgaagattaagcaagataatgcctaaaaagttctcagtacatgagtcctaaaacagagaataaaaagttctcagtaatattttactactgatgatgataccatcagaatttgaaatattgtactaagttaaatcatctctcttttcacccacacaaaagcacacacatagtcctaaaatgattattttgagtcggaacaacattttcagtttttatttttttctgttcattatttaattgttgaacaaggaaatgccagaggctatgagtcctcattagagctattagcatacatatcattgaataaactcattgggttaaaagaaaacaggcactctcatataccaaaattccctaaagaggaatacgttacacttaaggtgtatctgttcaattaactattagaaggtgaaagccaccagaaactagaaatacctcttctggagctcatcatcacttcttaccttacacaggtttaaaaagtaattactcgctacttaatacatacagtaaagggtacaataagtaacgattacataaacattgaaaatattaaatattatttcagaagagattgggtctattcagggtggtatggccatagactaaatactatttaaaaagctatcatatattttacagtataatttgaagctgttaagtattaataatatgcatataactgtactcagtggcaaaacactgaatggcttaaactgcaagattacaataattatatttactaacatttcatgtttcttaatagtgctaccttattttaaatgtttaattaatttctaattgttaatttcttttaagaagtataagtaatagctccccaaataaattatatacatatatatattattttacctactgaattaagtaaaaaacacttaaatatattcatctattttccaaattctgctttcatgtcagaataagcttgatagtctctaggcataaattaatttgcatataattatatattataatataggagtatcgtgtgtgtgtatgtgtatacatatatacaattagcagaaatactagtaaataataatgctttcaaaaaggttgaattttttctcagtcatgtctcaggttaatagcagcaccgtccaacataacactggaacaatgtaggaacagcaacctaaccgggagagaacatgataggaatgaatgtagtgaaaatcaattaccacatctagattgtagcagggtcacgcagcttaaaatctttaccactggatatgtgtgtagggatttttatgactaaacatgaaaaaggctggtttaaatctgtcttctagccaagcaaaagtagaaagaggcaataaataaatcttgagaattacaacatctgcaattcagaagtgattcacatagataaactctgaactgtagtcccccatttaacaaatatcttttccctacttcttgtatgtatctatgcccaagattgttaaataatgataagtaactattaatagggttcctgtacccaagaagatcatgattttaaaaaagacaaatcaaatccactaaatatgccagcaaaagatttttacagaaaagaataatgctattttactttcattattttggtttaaagcctgtaatcaatccaggctaagaaacaaaatgaaaacatgattaatatttattttatatttaatgatattatgttataatgactgaatctaaaaagtcatagaaatttttgcaaatgaaaatcacataaagaaatgcaacaacaaatctgtataaaagtgtgttcaggccaggtgcggtggctcatgtctataatcccagcactttgggaggtcaaggcgggtggatcacgaggtcaggagatcaagaccattctggctaacacggtgaaaccctgtctctactaaaagtacaaaaaattagcctggcaaggtggcgggcgcccgtagtaccagctactcgggaggctgaggcaggagaatggcgtgaacccggggggcggagcctgcagtgagctgagattgcgccactgcactccagcctgggccaaagagtgagactccgtctcaaaaaaaaaaagtgtgtccaatttacaactattacttgcctccttattctacacaaacaagattttccttgcaattaaatttttgttaagagagactaatgattgccagaaatttacaaaaagaatgctaattaagctagaatatcctacattcttacagtgtcaacttttccaaaatatgaaaatatattcctataaaaaagaggcttcaagtcaatagattccctgaatcttaagtgaaccaaatgattattggttgaatgaagtactttcttctacaaatattaagcataataataattactgcaactgcataaagtacttaacacaaacattgatatggtttggctctgtgtccccactcaaatctcatttttagttgtaatccccataatccccacgtgtcaagggagggacctggtgggaggtgattagatcatgagggttgtttcctccatgcagttctggtggtggtgagtgagttctcatgagatctgatggttttatcagggactatttcccctttgctcatttgcttctctcacctgctgccatgtaaaaaatgcctttgcttctccttcaccttcacgattgtaagtttcctgaggcctccccagccatttggaagtgggagtcaattaaacctttctttataaattaccgagtcttgggtatgtctttatagcagtgtgagaacaaactaatacaaacactgtgcaaacaagttatcggtttagcacgagaacctacaaggcactgttattttcttcaaattctgatgaggaatctacagcacacaattgttaagtaacttgctcaaagttacacacctgtcaagaaataatcccaccgtaaagcatatttctttgttaataatctctagcaaatggcttctccatttccctaattgctcaacttgggcatcttgataccttgctttccctaaaattcctaaccaatccactggtaagtacaattaagctaagcctgaaaatgtacctccagtttggctacttgcctgatttaaatcatgtaagctctagtctgctcactttattatgcaattgggacaactataatagaagttctcatttggagaactatagttctgcatgttttcacattttctgaccagtttattttctacccccaaattaatctgtttttgaaaatgtgtcagtgtgttactctgcttctgagactttcgaagcttcactttgcatgacaaattcaatcaagtaaaactctcacaatgacaaataggttcctgcattatctggctcccaattgtctttccaaagtcatagtactcactatccctaattgcccaccatgcactgctgcttcagcaaccccacctgcattccttccttcagtccttgaaacacagggagctatttctcctccttcttatattttaggtccagttttaatgttacctcctcagagagaccttcttggccatctagctagatagttcatctctattattcattcttctgattctttgatattttataattatatatttcattattgttcaatttattttcaattatactcaacgaaaatgtaatctccagaaggatagaagccatttgtttatttcctcactgtatatttagcacctagaacagtgccaacacatatcagacactcaaagggaattcatcactaatagattctttgacacatgctacagtccttgcctttgtccattgttagtgctttgtatgtggtttcacaagaattattagagtatgccaaatatggacttctttaacaaatttgagatttaggccatttgttaatctggaagcaaaaataaaattattaattttcatatacatcaaatatatgttccaggagaacatggcaagaagactcacatattttccttctttttaatctatgcacttgtatgaacactggcaaatacaagtatcttatcagaaatggtgatgtctttattcatttctttagattgcatgaactctaatgcaactcatgaaaatactcctgaagtatattcttactgaacatcccaaatagactacatactaagctcttgacttagtcaagcacgtatacagcttagagctagttggtcagatattcatggaattattctccaactttgccgtaaatcagagttacttagggagtttgtttaaaaaaaaaaatcatctgctcaggtcccaattccagatatttccattcagcatgtctggggtggggtcaggccactgtatttttaacaagtgccccagggactctgttcaccttgtcttagtagacacttttcaaacttctctaagtgagctttgatgctaaaaatatttagcattcaagtcctgcttctttaccaaagtctgatggtgtttagtgatcttacctagtggtgttcagtgatcttcagataaatatagcctattagtgactctgcaaaatgttttaagacctcatctccaaatattctctctttgcttaccctactccatcgacactatttcagtttcagttccttgaatatgtcaagtgccttcccacctctgggcctttgaactcaatgttccctccgcctatgaagttcacacccagctttacatggctgtgtcattatctagctagcagttttttcttctatgtcatatcctcagtgaggtctttccctataatgatcatctgtttacttgttagtgtaaggtctcacatatgattttatgtgccactagaaatcaaggtacttttgtttttcttttgtcaactctgtatccaaagtgcagagcacagctggctagcatagagtgagtctcaaaactgagtattatttaacgtattcactcctgggaaactaattcattagcctttcatctttcctttgtttgtgattttacctcccaacttataaatgaaaagtataaaaattaccttgaagtgcatccatgtgtaccttattttctaaacaaaaaaatcaaaaaccaaaaccagagatgtttggaaacttgacctcctttagtttaagtctctatttaatatcacattaaaacccaatacccatggtctcttttttccactatttgttcttctatccaagactattgttcaaaatcatatattatatataccacatcagttatcttcactgaaatcatatcgtttttgtttcttttcttttctttttgttttgcaagggaaaggggtgttgtgtactgtttctgcttttgttgttgcagctgctttacctcctccccatcgcaggcatcttgctagatcattgccagtcccaagaggcagaatcgcaactggaggatgcttgcctacattggccttttctgcagaataaaaaaaaatacaaataaagaaaattttaagttcagataaaacgacggaaataaaaagatagcctgatgacattaaatgaaggaattccaataggtactcataaacaaaacataattgtagttttagatatacacaataatgaattatggataatttgtatacatttgtagcaattgataagacacaaatactattattcacggaatgatggaattttcaaaactcaggcaagaggaaagctttttaaatatcttaactcagctaaaaattgtggtgtgtcttatctccactacaatcctcagggatattattatatacagcataagattacaatacagagacacaactaggatggatgggtaggttcctacataaagtccttttgcaacatcaattctaggtacattttacttaaaggaataaaatatttgaaaactgttgaattataaaagtgagtaaattgctaacaatgtccttgactttttcccacccatggtgctgctttgtgtcagagcaaatggaacacaacgttaacagctggaatacaacgagatcagcaggttttccatgagattaatctttacatcacataatgctttgggttcagagcagtaaagatctctgccgctgacatcccatatgctttggtttgaatcattgcatgccttgaattaatctcacaaatgtatatcactttcttttatttgtttcttcctccttagcccctcaaaatcagtgtacatatgtgtgtagggatagaggggatagataatgtagggaaatgtcacaatgaaatagccgacaataagatttttgagggctaaaacaagctaagaattcctgctgtttttcctctaaaatccttacaagtcctcagatacttttccagctaactcattaacttttgtaattcttgaattctggttgtcttctcagataaaacatataaatatgatttacattgtttaatggaaggccagatcagaattttcactgtttctttttaaatcaaatattagtagattaaagctgttagatccttatcaaaagtgttgccaacatgtatttttcttattttgaatatttttagtgtatgcatagacagaatgttttctgcattgactaaataggtgtctgtttcaatttatacagaaggtaaaacttcttttgaatcaattcgttttatgaaagggcctgttttaaacaaagaattgatcaatgcggtaactgaaatgagaccaaaaagagtcaatatttgttttggatttatttcctcataaaggccaattcatggtctctttttctaactagtaaccagttccaacaactgactagatctgaaaaagcaaataattttcctgaatttatactttttcttgtgctgcatacttaccttatatcctcagtgatgttcctgtattatttgctcataaaaatcgagcgttttcagtttaaatagagaggcaatatagaataaggcttaactgtgcattctaatctcagctctctcagttcacagctataagactttgttgtagttatttacttttttccaagttttaggttccctatctctacatgggattattaatactatctgtatcatagagttgtgaggaataaacaagataacatgatgaataaaaattagctatgatgatgatgatgatgatggatgataacgatacaaatgtatacagagggtaaggttttgagggtccatgttttaaaaacgtaagcacatcaatttcgcacagactttatcacaaatactaagactgctccttcagttccttgtctggggcacacaaacaatctgatttcctagagcccctgaaaacaactctgaaaatttggtaaacactgtaagaagtggattagaaaggaaggacttctatgtacttctaaactattttgccagttgaatttttgaactacagaataataagttaaaccagtgtgcaaccttccagatgtccaattatatcactgcttccaaagataatgatacaagcaatagacacatagatgaaacaggatttaaagctattgctctctccccagccatattaagtatgtgtctgcattacctatgcaatccaaaacccagcccacggttccatctccaccacaggctaacactctgaagtcaggaacatcacggaaaaagtttaacctgaaaaataagcatgttatggcacatgattaatagtttaaaaataagatgttttcagttttgtatcattaacattttacccgatgaaatacgtttttattttataaaaactgtaaaatatctcagtgataacttacatatcctttaatcctattttataattatatattcaagattctataatttaaaaatattttgtaattacatattctagattccataatgaatatactctttttctttaataaactctaaaattttaaggataaaattagtaaattataataattttcattgatattctcccagatgtgatttgcagttcgcataacccagaatgacatatactacattatttcatttaataaatttcatcaatccaaaattatcttttgagtgaatatataaatgtgacagttatgtcagtaaatatgtctttaacaatgttctactttctccattactgggagaaattgatcagactgcaactggggttctagccaactttccttttgactgagaatctgcaaataggaggcaggcttcaccttgtattttgacctggttgacagtgttttccacccaggaacactctagcctaattgctgggtcagctgccataaatacccactgcttctgctgttactgcatgcagggtgcttaataatgcaacctaccttgggaaaagtcacaaaggcaggtaatgcagccagctatacagtcatagcctattttattgcaataaaaaaattgaaacaggacagaaattttggtatgttatgtgtctcttcacctcccttgtcccaaacataacaactgatagtgatataatatgcaactatccaaggaatttttctacgtacttacgtatacaaattttcgtacataaatctttattacacacatattttcaacacgaataaaactgtgctatacatactgttcattaacttgtgtggttttattttaacttcaaatatgtctaagagaactttgtgtatcagtatataacatatgcatatgtcatgtgttgcattctgtcagattattatttttaagcactgcatcatgttttataataagttcatgtactacaagataaaatgaatgatctctttttatgaatttttaagctatttcctgtgtctcattactacaaaaaagtattgtatttaacattagttgaagaacatttgtgtaaatgtgcgcatgtgttttgaaggctactctagagaaaaatattccattacatcattatatccctctgaatggctcccactgtcaaatatgcaaggattcatttccttgcaaccacaaaacactacatatgaacaactttatgatatgtctttaataataagtgaaagccaatgtctttttatttgttgtaaaatcacacttccctgtttactagtgagttcagcatatttttatacatttcctggagatgcgtaacctgtcctatgaaaagaacactcaaagatgtgcctttctttctattgaattgcctttttattttttatttttattttttttttgagatggagtttcacttttgtcgcccaatatggagtgcaatggtgcaatctcgactcactgcaacctcctcctcctgggttcaagggattctcctgcctcagcctcccaagtaagctgggattacaggtgcctgccaccacgcctggctaatttttgtatttttagtagagacagggtttcaccatgttggccaggctggtctcatactgttgacctcaggtgatccattctccttggcctcccaaagtgctgggattacaggtgtgagccaccttgccgggcgagatgtcttttaataatactttaaaactctttgcatattacagcaatcttcgcatttaaatttgcatcatttaaaaaaattttgtcaaggtaataccaacactgcataaatataataaaatatgtataaaaattactaaaacccatcatctgattataatatccatggatatttagaacaggaaactttcatgcattttctcatttattatattgtggatatttaacctttgtgagacatgttgcaaatattttattcggttctaatactcattgttttgcttatactaatatatatacaatataataaacacatatgtaccagttgcccattccaggaagtagaacatttctaataacttacatatttctctgttttctttccctatagcactgccctttctaatttacaaaggtgagcactactctgaatactgagttaccacgtgtctgacataatcaacatgtgtctttctacttttcccacttacattggtactcagattcattcatgttgtagctgaagcttttcccacgtgtagctgaagttctttctacttctactgctgtgttaaataccacttacatgtcttttaaaatccatgtcaatgggcatttcaactggtttgctttacattcttgcaaaaagtgcattcttgtacaggcatacctcattgtattactctttattgagtttagcagatactgcattttttacaacttgaatgtctgtggcaactctgcttctagcaagtctatcagtgccatgttttccaacagcacatgctcacttggtgtctgtgtcacatttttgtaattatcgcaatatttcaagctttttcattattattatatctgttatggtgatctctgatcagttattatagtaattgctttgaggtgccatgaaccacgcccatgtaagacagagaacataattgtgaatgttgtgtgtgttctgactgctccacccaccagcggttctcctgtctctctttgtgtcctcaggcctcttaattcccttagacacaacagtattgaaattagggaaattaacaaccctacaatgtcctctaagtgttcaagtgaaaggaagagttgcatttctctttcaatcaaaagctagaaattattaagctgagtgagtaaagcatgtcaaaagcacaggcaggccaaaagctagccattttgtgccagtaagccaagctgtaaaagcgaaggcaaagttattgaaggaaattaaaagtgttactccagcgaacacacaaacaacaagaaggcgaaacagccttattgctgatagggagaatgttttagtggtctagacagaagatcaaaggagccacaacattcccttaagctaaagccaagtccagagcaagcccctaactctattcaattgtatgaaggctgagagatgtgaggaagctgaaaaatagtttgatgcaagcagatgttggttcttgaagcttaaggaaagaagctgtataaacagcaagtgctgaggaagaagtggcagcaaattatccagaagatctagctacaattattgataaaggtggtacgctaaacaacaatttttcaatgtagacaacatagccttctaatggaagaagatgccatctagcactttgatagctacaaaggagaagtcaatgcctggcctcaaagcttcaaagaacaggctgactctcctgttaggggctaatgaggctgatgactttaagttgaagccaatgctcatttgccattatgaaaatcctagggcccctaagaattatgccaaacttactctacctgtgcactataaatggtggaacaaagcgtgagggatatcgcatttctttacagcatggtttactgagtattttaagtccacgactgagacatatttctcaaaaaaaaaaaaagattcctttcaaaatattattttcattgacaatgtacctggtcacccaatattctgatggagatgtgcagaaagatgaatgttgttttcatgcctgcaaacacagcatacattctgcagctcgtcgatcaaggagtaattcaactttcaagtcttatttaaaaaatacatttcatatggctataggtgccacagacagtgattcattttggggatctgggcaaagttaattgacaacctctgtaaaggatttaataatctaggtgtcattaagaacattcataattcatggacagaggtcaaaatatcagcattaacaagagtttggaagaagttgatgccaagtctcatggatgactttaaagggttcaagacttcagtggaggaagtcgctgcagatgtcataaaaacagcaaaaagtagaattgtaagtggaggctgcatgtgactgaattgccgcaatctcatcatatttgatgagaattgaatttgaaaggatgaggaattgacttttagagataagcaaaaaaagagggtttcttgaaatggaatctactcctagtaaagatgctgtgaacactgtcgaaatggtaacaaaggatttagattattacataaatttaattgacaaggcagcagcaggatttgagaagactgactcaaattctgagggaagttctactgtgtataagatgctagcaaacagcatcacatgctagagagaaatctttcataaaagtaagtgtccatcaatgggtcaaacttcattgttgtcttattttaagaaactactagagccacctccaccttcagcaaccaccactctgatcatttggttcccattaaaatcaaggctaaactctctaccagaaaaaacattatgactccctggaggctcacatgattgttactaatttttcgcaatgaattatttttaaattaaggtatatacattttttaaaccacaatgctattgcacatttaatagacaacagtataaacataacttttatatgtactgggaaacgaaaaaatttgtgtgattcactttattgtgatattcactttattgtggtggtgtggaaccaaatccacaatgtctccaaggtatgcctgtacgtacttcctagtgcttaagggtagtggccactttagagtaatgcatattaatatgcaactttaccagataacatcaatgtttttcgcaaagaaggtgcaccaatgtacaatggatgtgctctattgaatccattctctttaacacttgtcacgctttttcattttatttcttatttttgtgaaatgcctatttatccttttggtttccattatctattccttttcaccttgttggtttgcaaaaaaattttacacgtctttgattttagtcctttttgaataacttttttttcaaatatcttctacaaatttaaagttttttcttttactttcattaatgtgtattttaatgaataagaacctagttttaatattcaatttcatcatccctttgataagtagtcagtaccttaactagtcttctgtaagacaagcttccttactcagagctcagaattcacatacactctcttaaaatgtcagttttacttttgacatagaaattcttagtttgttgtggtgtgaagtactttcttttcttctctccccactttctcccatctcccctttatcctggcctccggccctccctctcttcctttcttactccctttcatccttccttttggctgtagtggagcactttttttctatttattttttatccatcttttcatttattgaataattcaactttctactatgcaaagtccatgataagtattatttccacatatgggtacatttctatttctattctctattgtgttttactcacgactttgtccatctctgcactagtaccatactctcgcaattactacagctttccagtaagtccatatctcagggcatgaagaatcttaccaattatttcttctttttttcatgtacatttaaactcatcatatttcaccaaaactaaaataatagtaagaaaaaccaatcatgattttgactgaagttgcattaaaactatatattaattttgggagaaataacacacgtataatatgaattaagtttccttattcatgaatgtagtattgctcgatttatttacatattctttaatatccttcaacaaagatataaattttctactaacaggtcttgcatatattttgttagatttattcttcgttgttttgtggtttttgttggtattttaaacatttaaaaattatgtttattaatattaatatttttgttgctggcatatataaacatatttgagtgttatacattgattttataaataatcatattatcactgtttttctattgcttacattttgtttgtggatacatttggatttctatgtatgtaattgtggcatttgctactagcaatggtattattagtaatctctagtctttataattgttatttctttccctgagtctttttccttgacagaattccaacatattgttgaataggagtattcatagtgaatatccatatcttgttcctgaagataagaattacttttggaatctgcccatttaggatatctgttattgagattttatttttctttctttttactttccttctttttgatggagattttttatgaggttaacaagtttctcttctactcctatcataagaatttttactatataaaaatattaagtttttctgcatttttgagatttgacaaggtctctgtcctttaatcggttagtgtgagaataaacatttatatatttctgcattattaatcattcttgaaatcctttcaggcacccaaattgattcttgtgtattaatatttttaagataattgagtttctttgctaatattttgtttagaaattttgcatcaatctttatgaacaaattgacctatttttcttcctcataccacttttgtctactttttaaaattaaaattataccgcctcataaaatatgttgcagagtattccccattttacgattttttgtggaagaatttgtataattattgaagttctttgaaaactggtagcacttgcatataaaacctaaatgtcgggtcgggggaggggggagggatagcactgggagatatacctaatgctagatgacacgttagtgggtgcagcgcaccagcatggcacatgtatacatatgtaactaacctgcacaatgtgcacatgtaccctaaaacttaaagtataataataaaaaaaaaaacattaaagagaaaagtcttacatcattgtttaaattactttagtaactattcttaaaatttatgattttaaattctccttaagtcagcttttttccagctatacttctgtagcaatttgattctccctcctagattttcaaacattggcactgaagcttaagaaaactttgtaaaacacggcagtagctgcaacatttcccaccgagctaactgtttctggtgaaagcctaaccatccagttgactcaccattgttcttctattccatgatgatgtttcatctgttattcattcttgttttctttaaaaattgtcatcattggttcttcagcagcatcctacccccaaacataaaccccatgtgactgtcagaccagcttactctctgtaaattgattgctaatcggaaaatttgacctctctttatctcaatttcttgatccattcaatccatgcagttttccctagaaactcattcattccttactacattcattcattaatatccttgggatttatttagtgattctgaccctcagtttccataactttagaatagaattaacaccacgtggtttgttgggctctttatatacacataaagaaaatgtgtatgtaaatacaccttactattcacatgttattactgatttaattatatttttttctttattaaaagtagtataggtatgttttaggtcagagtgccactcctctatttccccacctcctccgcctgcactgttctggcagaatagtcacaattttctaacaagcagtaaggagagtttttctgcatgcaatctgaaactgtagctagcggacaattgggagacctgcctacagcactggagacacaaggtacagaggaaaacagctgtgatagaagacaagtaaactgaagagtctcagcaagagccaaaatgcagggtcctgcatggcactgacttttcacccaggaaggctgtgatgaggagcagctgtgaggcttccacattacaggtcatccttccaatggggagaagtgagaaaatggggagtgtcaggaaggatttcactctggggaaacttttgtactgcgtattgtactttttacctatcagttccacagtgttccatgtgaagaatgaataagcatgaacattttgcaatgaaatcatgcttgggtcctgaatttatttgcaccattttattaatttttttgaaattaaaaattcaaatgatgtatgaagaaaatgaatgatgatgagtttccaatgttggcctttatagcattgattcacctagagagtttcctatgtatctccaatagctatatttgaaagcaagcctattatttgggtttagcagccctctgtcagacacttctttttttatcatatttgctctataatcaccactataacattccataaagtttcagttatgcaagatgaataaattctaagatccactgcacaacactgttcctatagttaacgacacttttttgtacatttaaaaagtttttaagaatgtagatctaatgttaattgttcttaccacaaccacaacaaaagagcaggtggtgaaattgtgatgcttaatattactaaaaacaaatccagaaaatttcatctaagattcagaggcttactttgtgttaagataaaattgatacagaaaaggcagtaaattttcacttgtacctaattgttattaggtacaaagcacaccaggaaaaccttttttaaaagaaaagaaaattgtagtactgattccagaatcttggaaagtgtcataaatcagaattcttaacatcaatacgtaaatattactttttattccaatcttatattttattattaaaaaatactatcgcttacatacaatgtggctgtatgggttagaaatagattaagtatataaaataaataaatatatggctctaagtagtatatatattataaatcataaaataatatttttgatacttagaggaaatcagtgtgagagtcataaatattttcagcatatctatacatggtgaatgctcgctttaattatacatatttacatctctttgtattaaagaaacacaaggctgaaggatccaaaatgactttaccatatgtcatcaattctctttttcctcgttcttgtttagaaaaaataatttcaagagctttccttacgaaaggtctgcattttgatttaagcatttagagacagaaagaagcatacttatctctgattattctattcaattcatatttatacttgcatgtacacagttacatactatattattcttaaagttacaagattagatggattcaaaattgccttagtaaaatctggctgaattttctgatttgtgatgttaccgttgtttttgaaacaatatttatggtctagaaaaccaatttttaataactttcagcttatttattaatacccaaactgtatctgtacataccttggtatcattgatattattattattgctggtgtaatatcttttaaaaatccatgcatgaattatttatgctccctaaagtttcactctattatatatattacaaaatgggggaaaggttatttcatgtttttctctgtgggtttcgatgttttatcaatttaatgtgactctctcaacattttaatttaaagtaaaattaattataataatatcctccaatctaatatcttatgtactttagttcaacaatacattataaaatttagttaaactaggaaatgcacctgtttcaacaaattcgtttagagttttgagatattgtgtggaagctgaatttacactgttttgggaagacattccatgtggctaagtgggatagttataaaaaattaatttgaattaatctttataaacccagtgtaaataattatgttaccataataaccagaaataagttttagagtatttgaaaaatatacatattccagtgggccattaataactgaaacatttatttcattatttctggaaatctcaaacaaatcttttatgcttatgtgtgttaaaagtgaaggagagagggacagagaaagggaaaaacacagactgaaatgacaaaagagagcatgagacacagaaaatgagagaatatttattcctggggaacctataatgttatctcattaaataactttaatattccttctaatataaagtgagttagaaatgaaaggtcagtaaatgacaggttctatgatgtagcctaaatatttttcctttcttcactaatgtacatgtttctttaaaaattaatattggcagaaacatcaaatttttaatgtcatttctgagtgaatagaaacactaatatttagttgaaatatccttgccatcatatagaaaatatttataattttattagtataagtaaaacacttttgtaaatatatttgttaaaatataaattttttctattgcatggaaaattataacccttgaaggatatttttaaagtacataaattaatattcaaaaaccaagtaaccgatgttaaacaaaaattatgagtggtcattattttagactgagcttctgcactaggccccaacagaccagaacaaaccagaatggagtcacttgtgctaagtgccatgtaatcaaattgaactttaaaatggtccagttaaaaaaagaaaaaaacaacacaggagatttgcagcatccaatcagaaggggcccagttcaccagagctagcatgataaggaagtcctttcggttttgaccctgtaagaaaagtaactttgaaatgaccaatctgcctttcatgccttatttctgctttcttcagccctcttctgcttataaagccaaactcctgtgctcagttcattggaacactcatactattctatagaattaggtgttacccaattctagaattgcaaatataagccaatgagatctttaaactaactttgttgtaattttgttttttaacactgaagaacacaaaacaccttttaaaacgccattttctctcatctgtaagtgtgttttttacattagaaagggagggatttaattgaacttagtattttcatactgtatttactgctacaaatacgcagtaaaatttatggtcatgctacatgaaagtccatctcttaaggtattaatgaatatgcataagttatgtgtgtactgatatgcatatatatatgtttggaaatgcaggttaaaatatttcttgtaagttacatgactaaacatagagaattgacagacaattctgatgtagtaagttgaaaatgaagggaaaaatacgataaagagtgtcaattaaaacagaagttacacagtcttcctgatatttgaaagaagttaaaatggaataattcattcttattacttctaattggaaagcacatatattttatggtccaaattcatcatctataaaattaacccctaaaatgtagcagcacaagtgattaggttgctgaagactgtttgacaaatttactgaaatccattctgtcgtgtgaatgattttaatattaataattagaatgaggttttattctgtacacatcagatcattccatggagttagcttagagtgtgaagtaagaatgtattttgaaaggaaataaatctagacttctatagggaaaaaagactttgcttagggtcaaatacaaaagaatagctctaaatactttataaatgaaatggcacctgtatctatccacttatttaatttaaatgtagtaactgcaactatgtactaggaactgagatagattccagagattcaaaacaaggtagaattcttgcctttgagtatctcactggcttaactgagaaggcagacaagaaaacacacagttcaggtcactataagatgctctttgagggcagttaatgtggactaggtagggatgaggggtggcttaataaacttggagacatatgagttgaatctcgaagcttaggtaaagttaattagctgatgaattgggggacagaagtgaggagaaattgagtgaagggttgttatgtaagaaggagggtaaatatagatcctaggagagtggttagatgacaaatcttgaaagcctgaagtgacatactgtcagtgggaatgagaaagcggttctttagtgaatggtctttttattcatcaagttagagaataaaaacagtgtgtaaattcgggaaaaagggagaaaactagtttagtaatagacatgtagaatttgagatactcatggaacttgtgttcatggactattgaacataataagttaatttcctccttatgatctctctttgataaataaggagcaggagagtgaatcctgattatgtagggcctgatgtttataaaaattgaggcccccctttaagaaaaaatatgcaaaataaatgtgtacaaacttttataaaagtgatgtatatatataaatatgtataaataaatacttatctataataaaaaatcacattagattgtaaatttaagatagcttacaaacattacatcataggatttcaaataacatagttttataaattagtaaactgcttaatgcttcgtttttacatttttatatggtaatttaaaataatatttgtactgaggttaaaagataattttcttttcctctagaatgatttattaagatatgtttaaattgatgatttattaggaatgttccacttagcttcacaagtcatcattgataaagtaaatttttagtattattgttaaatacgtgaaaatcaatattgggtttttggtcatagccaagctgtaagacttgcaggcatttcaattttttgttcaatgactaaccttaagtactgtttgaattcatgatatacattaaccattgttacgttaataacatgacatattgtgagttttaggtatcttcattgatggcgatatttcatagagatttataaaacatgtactttacacataaacatgcctgcttgttgtagagctgatataggctgtgctctacaagcacaggaataatgatacatttaatatcatgtaactttcatcaataataaaaatttaaaattgtttatactgcattgttaactgtattcctggaagaataacgcttctgttttgatgacacattaaagagaactgaatgggatgattagaagaattttccaaggataagctttgaactttgtacatttcaaacctcatttctcccctactatacacatattctgttaccaggcaggctctggaccatttttatcaagacatgtcttctggctctttaaatttatgtcagaaaaccagtgtaaagtcacactgagcaatggggatatgcctggaagtcatttttacaccaggagaactagcaataacaaccatacacaaaaatatccatgaaccacatattataagtctcagggttcaatcatgtaattggacctcatcctcttttagtcagatcctaaaatgctcatgctcattccaatgctactagtcactaggtaaagtgtgatgaaaaaggagttggaatggagacaaaagtcttttttgttttttactgttttatttttccatatagatgcccaatttttctggttaataccaatacatatacagggcatgggggagggctcttaattatcttccattgatatatttgcctctctatgcattactactgagctggcttaactaacattgttcataaaaattcttgtagttaaaataccctctttttaaaatatcaaaaactcaaatgagaaaggcaatacaaccacattgctaagatccttcctatagtcttgaaaggagtccttgcaagtgagagacactgaagttgaagattcattgccttcaagagcatctgcttctgggcacacatcttactatagcataatactggtcagagaccataatttaaaatatgacagctactcgggaggctgaggcaggagaatggcgtgaacccaggaggcggagcttgcagtgagccgagatcctgccactgcattccagcctgggcgacagagcaagactccgtctcaaaaaaaaccatgaataatttaattacacagaattctaactataggcataaaggtaactaaatgaaaaatacatgactcatcaagaagagataagtaaaagtaaataatgtaattggagaataaaacattatgaattcaacaaacatctgccattttcaggaaatgatatgtacataattgaagattagtatcttagacaccaagatatttatgattttaatagttgtaaatataatttgtatcaattttatcaaatgtattatattccaaatccaattatctgcttttcggagtgtgtttattaggctaaacttgtcttgattacgaagaacactgttacccaataatataattcaagttgtagatttctatatgctgataacctctatattaaattaccttaaattttcatgctccttgagttgcagattttaaatagaagaggagggtatgtataatcaggaaaagactggctgaaggactgttgtccagagagatttttacagggttttattacttgagtcacctaagacttgagtcttattattattattattttggtccagaaggttcctgggtgactactgaatcagtaggagaataactgaataatttacatgtgtgtgtgtgtgcatgcatgtgtacaagcaatataattatggcttttattttaattattagaatattaaaatttcttgggatgtgattataatttatgtgagcaatcaatttaaagcacaatcttttttatcaatcaattcattactgtattagaaatcacgtttttgccatgatggcatgcttcaccagaatctacattcaaattattcccacagaaggaaattattgtatcagtagtgctaaacgtttatactgattttatgatagcattatcactaatatctaatgtctcaccttcatccaaatgaacttccaaaaaactttatttagagtgcatgaattgaatgaattcaaatcatctttgcaacaaacagatgtttcatttaaaacattctgatcactctgatataaaaatggcattacttgatcttttggaaaagttattctgctaatggagtcaagatattaacagctataacttcattaataatacacataaagaaacttggaattgaaaattaacactaattttgaaaagtcatttgatctaaacgaaaagtcatgcttcaaagagtgatatgcaaagggactttctgcatactaaatgattgctttggggcagagaattaactattaattttaaagcagatgctcatgtttcttcagcatagttgtgtttactgatttctgcatagtcaatgatatcactggagctctcattgcagatggtaaatgttcataaatatttcacacagattatgtattcatcaactctttaagaaacagaaattcagaactattttttgttttgaaattcagattatttttatttaaaagacattttatttttaagctatcttttgctgaaaagtgttattgcaaaataaaaatctattataaagtaaatatttataaactatatatttaatgaaaaataaaacattgaggaagtatattcaagccattcactatacattcttggtaaaactgctcatgctctttttctcacatacatttcatgaacatctaacctatgatttgtcaatatctccacaggcatttctgattggtatatttgtgaccctttgcaactctcagggagctgtgaggtccaggccacagcataatgggctggcataaaagggataccaattcttcaaaagttgtcacttgtttttgtgtttaaagaacattggaaaatagtttatttttggtcacgttttaggtataatgattactattaaagtcagatctctcttccttggacgtgtgtcttacacattacaagaggataacacagcaaaagctggatttagaaattggagggctgccaaacacatcatcatcattcttcattgcaatgcacttattaatagcaatacttaaaatacaatacagtcctgggcaaatgctaaattgggccagatgctaggacaccagaaacaacctgaagaatcttaggtaaacctaattattatggtcacaataatcctaaaaccctctgtgaactagcccttagtagctttctgacatccgactgcccttcactctgttctagtctccctgggcttcttgctaatgtttcccaaacttacacaatattttccaatcattatgcttttatgcttgctgctctctctgccttaaaagctcttgtacaagatgacaatgagctacctcctcatcttcacatctatactcagccagttcttctccacctcatttaaaagaacaaccacgaaaccctcaccaacaatgcacactccttgtttacattccctgctaatatatgtatatttcacctgtttattagtttaatatatgttttccatcactaaaatataaggctgtgagggcaagagttattatccgttttgttcagagtggattggcagtgatgagattgttcctggcatctggtagccattgaataaatgttttgaaccaattcatctgctatgggttttcttatttttacttattggtaagctatcatcagttaactgcctggggctggaggtgaatttgagccagtaattttactatgtacacttacataacagtaaatgggaggatatttaagtaaaatatgttatttattaaaaacttaactcctatagaaaaaaaatcagaaacagattactttagttcatttgtgctgctatatgaaaataactgaaactggataatttataaatgacaggtatttatttctcacatttctggaggctgggaagtccaaggtcaagacatcaacagatttgttgtctggtaaggcttattatctgcttcaaggatggcacgttcttgatgcatccactcatggcagagggatgaatgctgtatcttcacatggcagtagaaggggaaaggcgagagctagttcccttgagccattttataagggcattgatccaactcatgagggtagagccctcataacctaatcatttgctcattgctccacctcttaatatgattgcattggtgattaaggttcaatataaattttggagagacacaagtattcaaaccatagcattctgcctctgctctcccaaaatttatgttcttctgataagtaaaatacatccattctatcccaggagccccaaaagttttaacaatttccagcatcaactaaaaagtctaaagtccagagtctcctctaaccgtcatctaaataatacagagttaccactccaggtacaatttattttgaggaaaattccccaccagctgtgggcctgtgaaatcaagcaagttaggtccttccaaagtacaatggtgtacgatagaatggacaataccattgaaaagggataaataggaaagaagaaaggagtaacaagtcccaagtaagtccaacacccaacaaggcaaacaacattaactcttgaagctgggaataacaaaaaccaaaaaaccctctttgacgatgtgtcctgccttctgaacacactgtgcagagtttaagcccctaaggctccgaaacccccattccttccatggctgtgctgtgtgcagcccacactgcatttctcacttgttagagttgaatgccaacagctctctcaggctggctttactagcctggagtctcagaggtggcccagcccccatagctccactaggcattgtcctagtggaggctctctgcaggggcctgaaccatgtagcagttctctgtctggggtctggggatctcaaggacctctccatcctttgaaatctaggcagaggtaggcatgccttcacagcttttgcactctgtgcctgcagagttagcaccagctggatgctgcaaacctttgccacctctgtctcctgaagggtggctctggttgcactgaggctcactggagccacagatggagtggcccaggagtgctgcactagaatgcattgagcagaaacttgaggcagctctgggaagtgagccctgagatcccacaggtgctctgaatccctctttgaagtctttctgtcctcaaggccctgacactgtgggcctgtgatgggagtggcagccttgaagatctctgaaacgttttcagggccactcttccattgtcttgatgaatagcattctagattccttctagacatactaatctacccaaactttcattggtaacacccttggtgttttatcataaacacatttctctttctttaccaattggccagtctgagaatttgtcaaatccttaatttttgcttcccttttgatgacaaattctgtcactaattcatttctctcttattacatcttactataagcagtcaagggaagccatgccacaccctcaacactttgcttagagatttcttttaccaagtatcactccatggtatttcatcactctaaaattcaacctcccacaaaatagtaggacatggatacaattcgacaaagttctttgccacttcataacaaggattgcctttcctctggttgcaaataacttgttccccattttcgtatgaaacctcattacaatggcctttcttatccatatttctagcaacattttgttcgcaaccatgtagataatctctaagactgaacctctctctatggtcttctttctttcttcttctatcccccacctctcctcctcctcctctacctcctcttcctcctcctctttctcctcctcctcatcctccatattgcagcctctccccagtccacatagcaccttctacgtttttaggaatttgttacattagcacctcactccttagtaccaattctgtcttagtccattctagcagctataacaaactactttagtctgtaaagtctaaaagtctataaagggtaatttataaacaacagaaatgttttgatatcacaggggtacagcagaagagcaatttagcccaggatggatcataccttgagtctcatccatatctgatttagaagatatttagatgagactctgggttttagatttttgagttggtattaaaacaaattaagactttgagactattgggatggaatgaatgtaatgtatctgtatgtaagaagaacacgaattttgggggacccaatccagaatgctatggtttgaactttcatgtgtctccaaaattaatgcttaaaattagtgcccaaagcaatagtattgggaggtggggtactgaggatgtgattaggtcatgaggactctacgcttacgaatgggattagtgaatttgtaaaggggcttgaggaaaccagccagctgtttttctgctcttctgccatgtggagactcagcattcattctctccagaggatacagcaagaagacaccaccttggaaacaaaaagtgagccatcagcagataccaaatctcctggcccctggaccttggacttctcagcttctagaactgtgagaaataaatttatgttgtttgtaattagccagtctaagggattttgttatagcagccagaacagaataaaacacaagttaaagcacacacacaaatacgaaacggtcatttcaaatggccaattcagaacatgtttgtttctttagagtgtttcagcaattttgataggcaataatctttaaacagtgacacacagatctctagtctaattgctatttggcctttgttggtgagatagataataaaagctagacttttcaacatctttaaaatcatagtgcatttgtggatgcatgtaaaaggtgactaaaggcctacaatgactcaaagggggaaatttgtgtgaaaggcaagcaattatgtgaccttattcattgtggtaacatatttttgttacttttattaatccatagatctttaattttagaagcatgaatcaattttcatactccatcactccagtgaccaaggcagaatcagaattatgcttacacatttaattgggggagagcttgccgaatcatctgcattttattttatgattaatcatgagaaggatagagttgagtgcttcacttttatattagtaaagaaaattttttatttttgaaatttgcaacagagctcaattaaattttgatgaacatttccttagccttttgaggattctgttcatttctgtgtcataatttcataacaagaggcatatgtaaaaggtcataagctctgattttccttaaataaaatatggtagaaatttggttatataaaatgatattttaaattaagaagataatgaaatctgtgaaatctgttatgcattttctaaattatacatttattttaataggagaatatattccaaagtttcactatgaaatatgcatatttgaaatatgtaaatctgtaggttgactgttgcattatatttttaaaattatgtgtcgtttgcatttagttcaggtagatggaagcaaagatttctaagagcagctttctcacacacaattaattattcttaattatcctgatcaatctgaaaaataatttacatattttaaagttatcttgtattttatttcaattcattaagtgcttcctatttctcacttaaaattttagaaataatgtgagaataaaccatctgtattttcatgaagattagattcagaaggggaaaagtaatgtcacaagtatacaaaaaacttgatatgaacttttcataagtcacattaacatgtgaagttggtgtacagctagagctatacatacttattttaatgtagtgaaggaaaacatattgttatataaagcccaagagtaatttatattttatatttcatctcttctaactaacctatacctccaaataatttattcaattatatcacaacatgttccattaggaaagaaacaacttatttgaaagagactattgtttcagacaccttgaaacagaataatcaggatcagggagagatgatttatataaagagatagaatggaaacacataatacacacccatttctgttttaaaaacaattaaagataaaaaatgaaatgcccagtgagttttagtatttgccagataatttagattaggaatagttttagttcaagaaagttatttcctcttataaacatagtttttgaaaaaaaataaagttgggataaaagaagagttgtataccaaaagaatacatcaatctggtgtggtaaagaggaaaatatttttaaaaaagaatttggaagaatgcataaccacaggtttaaagtagcagaaaaaatgcatactatactttcaagagtatgcattcaaaaacctattgttagcattggaaaagtaataaactagaaatggtgataaaactaaaatgtataaatcaccaagggtatcagagtaatagggagaccttatgaaacagagcaacttctaacgccatacattaaaagggaatcactgcaataggacactcttagcatgatcaggggcaatacagctagaaaacagggctgggaggattcacaagtgagcagatcagtcattgagttcagagaaagggcaacatcatagcctggccagagtccccgttctgagcaactacctgtggcatttgcctttaggataaacaaagactagctctctaacagaagtctgagtctgacactagggatgcagtgtgggcatcagtatcagaggcaaacaggacattctcatgttgatcaagatgaagctaaaagttcaacacaattatatttaatcattttttaaaacaaacttttgacattgaatattttcagccaggcaattctactcatagccactgataccataaaaatatttgaacacactttcaagaatatgcagataaattgatagatattgacgtagcatatttggtaataattgtaaaacacaggcaatataaatattcatcagtaatgggatggctcacatgattatggaatatcatgcagcagttagaaaaatgaaactgatcaatgtctactgaaacggaacaatgtgtatcacctgctttagagtgcagaaagcaagttgcaagataatataaaatctatattctgttacgtaaaaaactatctacctatatttcatatatatatttcatatatatatactatatatatatacacctatatatgtgtgtgtgtgtgtgtgtgtatgaatacgttatagatagaggggaatatgctcatttatatgtgtgtattagattgggaagctacagcaaacaaccacaataataatttctgaggagtagtagtgctcaaagtgggacctttaaatttttttctaaataatattcattgtagtgtagactttttacagttacatacattactttcattttttaaacatgttaagatagagcagaggataacaggatgcctagaactgaaagagtagaaggaaacatgtagtacatatttaaagtgtagtaggaaaaaagtgagatgagagaacagggctaaaatcaaatttattccaatatatttacatagtgctacaaaacagtcatgtttttattaattattaattcatatttgtacaaataatacggataataaaccacattcactgaggacatgctatgcagtaagtacattgttatttgcttcataggcattatcccatttaacttcacaactatcctataaggcaggcagaaatcctcattttacagataagataatgaagccacacagaggtgaaactgtaaggcttgtaattagcagagccaattgacctcttgtttaactatgaaatacaggaaaatcctggattaacttggtttgattcaacttacaggggtcttagaatggcaacagttttgaatgcacaatatcctaattcaaagaagagctacttttttgaagtccagagaatattaaaggacaagaaaaagagccatcctgactgagcttgagtttacaatactttacttttgcttggctttatctacttggggacttcctgcatgtagctagctcacttagccaacagtctgatcatgatcctctagattctggattgtgaagcttgacaaagacattgttctgaactaaattcctgtgatgagcctgtcttccacaggaaggaggttctgcagatcactgctcagcattgggaaactgatcccagacagcaggcagcaaggcagtagaagaaagagctgaatataatgctgaaagactatgctaattaattatactttatgaatgtattttttgggtaagacactatggtacaaattttattctgagtttttaaaagagtactatttaaatacttggtttctggttcctgagaatgagaagtaagactaattttaaatcaactgccttttttttaaaaaaaaaaaatgaagcatgcataaagcttatagagcttctgtccacttcatgtggtctaatgtttaccctcatgttgacagaaagaaaagaggtcaatgaaataaaatgacattaattatttaactaagccaaattaatggtgatttgtttaggtgcatatcagtaacttcaaaagtatacagtttatgttaaaaatttattttactagatcttacctgttaacaatgaagtataagagagtgatattgattagatttggtaagtagtaaatgaaatcgtatgatttttttcattaacccatttatgctggaggttgcaatttttaaaatttaacttgaatttaaaaataagaccttggcaatgaccttaagctgtagaatataaataactcctacatgcttagtgttccaataatggaacactaggcataaatggactaactagctttctctttacttttagcagatattttaaatataagaagtacaataaaagagaatcgttcttcaaatacatggtttggcagtgttcaaactggcattcagctagtttgtcgtgtgtgtgtgtgtgtgtgtgtgtgagattaatatcatcattagtacaataaggagcattacttcacaatatttagaaagaagaaaaatctgctagaaatggactattttggaaaaccagtatttgcactcatttctcttacgtagttgatatttcatttttatgtactaatatgctgctgtgttcaaataacattatttctacatatgtcaggcagcttatttaattaattaacattaactgagttaatggtaataatattatccttggacttaccctggcattggtccatttccagaaagactgtaaacctgacgaggatttaatagatactggaattttctgtaaattctataaaggtgaaaatgtggggaaaaaatttaataatattcaatacttttaaaataagtaatgtctctcagtgttataaaatatatatagttgcaattaattatataatttaataaaaaatttctatcaatttaataaattttgaatcaatatcagaagtccaacagctcaataggaattaatggttttttaaaaggcttagtagccactattaaggcaatatagttcataagttagaaatattgcttggatccttaatatgcacatacatttaggatattctctaacccgcttttgaacattatttagctaactagatttcaaataaatgtatttttttaatatttcagtataaaattgcctaaatatcttctctcagtaaatccttgtgaataatttgtcctctatagatctctgatagatctgaaaattatctatcccctatatgaaacgggactgtacattgtatatgtgtacatgtaagcaaagaatgtagcctcatctggcctaatcatttcacataaacaagatcttgaccagtcatctcacaaaattgctaaactgtcttagcagcatatgacaaataattctttttttctgaaagaaaacaatctttataaataaatgcaatagaaatgtttctatgcatgcacatatctcacactgttttaattcttagacaaatactaaaagtaaagagataaatagtacatcaaaaagttaatttaccacaatcagttaggcattattcctgggataaaaagttggttcaacatacacaaatcaataaatgtgattcaccacataaatagaattaaaagccaaatccatataattatctcaatagatgcagaaaaagcatttaataaaatacaaaatcctgtcatgaaaaaaaatcttcaacagactagacatcaaaggaacataactcaaaataataaaagccatctatgacaaacccacagccaacagcacactgaatgagcaaaagctggaagaattccccttcaaaactggaacaaaacatgcccactctcaccactcctattcaacatagttctggaagttctaatcagagcaattagacaagagaaagaaataaaaggtatccaaacaagaaaataaatcaagctctctctcttcattgataatgattctatactcagaaaactgtcaaaattccaccaaaaggctgttagaactgaagaattttagcaaggtttcaggacacaaaataaatgtataaaaatcaatagcagttcaataacatccagccagagtcaagtcaagaatacaatatcatttacaagagtcacacacaaaaaatgaaatacctcggaatacaactaaggaaggaggtgaaagtgctctacaaggagaaccacaaagcactgctgaaagaaatcagaggtgacacaaacaaatgaaaaaaaatccatgctcatggaagaatcactatcgttaaatggctattctgcccaaagcaatttatagatttaacactatttctatgaaactaccaatgtcgttcttcaaagacttagaagaaaactcttctaaaattcatgtttaaccaaaaaacagcctggatagccaaagcaagcctaagctaaaaagaacaaagatggaagaatcacaccataaggctacagtaacaaaaactgcatggtactggtataaaaccagacactcaggccaatggaacagagtagaaaactcagaaataaagctgcaaaccttcatctgatcttcaacaaggccaacaaatacaaaacaatagcgaaaggacttcctattcaatacatgttactggaatagctggctagccatatgcagaaaaatgaaactggactcttttctttcaccacatacaaaaattaactcaacatggattaaaaatttaaatgtaagatcccaagctatatttctaaaagaaaacctaggaaataccccacgtgacaatggctttggcaacacattttttattaagtcctcaaattgcaacaaaaacagaaattgacaattaagctacagagcttctgcacagcaaaagaaaccatcaacagagtaaagtgacaatctgcagaatgggagaaaatatttgcaaactattcatccaacaaaggtgtaatatccagaatctataagaacttaaatcaatgggaaaaaaacaacaacaaataaccccattaaacatgagcaaaatacatgaacagacacttcttgaaagtcatacaagcaggaaacaaacatatgaaaacatgcttatcatcactaataatcatggaaatgcaaattaaaaccacaataaaacaccatctcacgccaatcagaatggctattattaaaaagtcaaaaaccagtggatgctggcaaggctgcaaagaaaaggaaatgcctctatgctgttgttgtgaatgtaaattagttcagccattgtagaaaatggcttgaatatttttttaagaacttcaaacagatctaccattcaacccagcaatcccattagtgggtgtaaactcgaaggaaaacataccatataccaaaaagatacatgcacttttatttgcatccctgctgtattcacaagagcaaagacatggaatcaacctaggtatccatcaatgctgggctggataaagaaaatgcggtacatatatagcatggaatactacacagccattacaaaagaatgaaatcatgtcctttgcagcaatatggatggagatggaggccatttccctaagagaattaacacagaaacagaaaaccaaatactgcatgtactgcacgaaatgttaagcagcagctaaacattgagaacacacacacttaaacatgggaacagtagacatgggggactaccagagtggggaaggaagaagtggaggaagatatgaaaaaaactacctgttgggtactacgcttgctacctgagcataatatactcatgtaacaaacctgcacatgtacctcctgtatctaaagtaaaagttgaaattaaaaagatttttttaaagttaagggatatatttaaacctaaattggttttatatacatgtgaaaatatgattattttataaacaaattcttatgatatttactgataaaactctccaaattcagtatgtaatatctgctcatatcacctagagttgttctcaataccctcttttccctggcacctgaacctactagtggacaactctgtgccttcctaaaagaaaacctaggaaataccctatctgacgttgtccttggcaacaaacttaaaaaaaatgcctatcaaacctggctattctatcccactgccttacttaaggtcttcaagttctttcaccagctttataaatttcttggcaatccagccttcctctatactgttgtctaagtacagccatgccttatccatgatgcaaagtttatgccagtgtccagttattcacaatataaaattaagacatcttcacaattcagccacagtttctctctcatctttcccctctttttccttacattgtcatcccggtaaattcctcttggttgacaccctgccatttcacaagtctgcctttctccttctttcattgggcaaacatctaccatataataacctataaagaagctccttcttctctaaagacttcttggtcttcagagatagttatctccttctctgaactttgatagcacttttatcttaaacatttctacttcaacctgtaatatatggtattgcaacagatctatttatgtccctgcctctctgcacgactgtgtattatgcctcttattcccagtcactagtagagtttggattcaactaggcattgctgtctgaacacatatgtgaacattttcagacttattgattgatatggaaaagtttatgtggatttatgattctgtgaccttttgcaacttatctaacatatcaaagtcaaaaaagccaaaaaatttggaaaggaaaacactgaacgggatcaccttgtgaaaggtgcctcttatgcaggcagaaaaattatgtttgcattgaaaacagatcacctttaaaacatatttacatttcatttgacttcgcgtggtcccagtcaatgaataaagaacaaaacacacgtggatgtgtatatagaagagctcgaagttgaagcccccagtaaatttaatttacttaacattttagtgtaactatatatatatatatgtatatttttaatttagggaaaattatttatatgtactggtagaaagggaaggcaaatattcaactaagggtcattctacatgattcatattatcttaattggagaaaaattattttcctttgaaaatactattttttttctcttcaaacttcaatattctgtaatttccaatgtggatttaagtctcatctaatcctttgtggaaagttttctttttttgttaaactatcaataacatatacagctaactgactgtaaatagtaaagaagaaagtaatttcagcattattatttaatgattattttatgagtaaaactattccctttaataaagcattaggaatatttttaattattaaaacattatttaaaataatttctatcatgtttagaggagtaaaacataactatatactgatgaaaagaaaaaatcttatactcattttattttattttattttattttattttatttatttgagacagagtctcacacggtcacctgggctggagtgcagtggcacgatcttggcttactgcaacctcccaggttcaagtgattctccttgcctcagcctcccaagtagctgggattacaggtgcccacgaccatgcctcgctaattttttcgtattttagtagagacggggtttcactatgttggccaggctggtctcaaattcctgacctcatggtctgcccacctcagcctcccaaagtgctaggataataatcttacactctttaaagcaaaaatgttttgttgattcaataatgaaaagcattcttcatttcatggaaagaaagctggaaagttaaatggtagaaaaaaattactttattcatggaaacatttcaactttgctatttggtgagccacaaaggaaatttgttatactgttatcatgtttgttatgagtgctttcatctgcttgcttatttttggttgagattaggagagttatctaaaaagcattaaggcaggtataaatgcatttttgtttatgactgtcatctttaggaagacataagatttactcttcaatgtagtgattttcatatttgtattaaataatatgatttaatcattcattcattacaaaataaaatgttatcagccagaatgctgaaatacctgataatgcagctcattattattcagattaaatatattgtacttctccaggaaatatggcatcatgttctccaaaatgcacatgcagaaaatcattataatatattttgcctagatgttgggtataaattcggttcctcagtactgaattatgatttatgtggattcatcttgttaaccatttagagaaccaattttcattcaacagtatttatgaagccagactctttgttaggggataggggtgataggtggggtagagagaattcaaacacctgagctataatagtaaaaatagttacaaaaggccattgtattaaaatttcaatcctaaaaacaagatcatataaacatattaaatgctagcatcatttattttgcattaaaattagcagagaggaataattgtttttaagcatttttacatcatagttttgtctatttttttacatatacatgacatagacactaaaatcaatcaaaaaacataccgttctccttgttttccaccacttttggggttcacaaaaactaaaagtgggtgagtaccaggcacaggagtgacctataagaaaagttatatacatggaaaaattattaggcccattatatatgaagaagactccttgttatttctaaattataaaataccaatacgcaatttcaataatattactttccacaatgtgtgtgtgtgcatgtgtgtgtgagtgtgtgcgtgtgtgtgcgtgtgtatgtgtgtgtggtgtgttcaacaggaaaacctcctccacaaagaaaggcatgcctatctagatagagggccgaggggaaggcagtcaggaagagggaataacatttgtaattcctgtaagataaaaaaaaaaattacgattttcagacagtaagtgaacaagccagaatacagcagaatttgaggaaaaagggatgagaagcaaagaaagagatcaacttatagagaggcctccttttacgcaggagtcctaattgagagtttcgaggcatgtgtggaatccatcttcccaaccacctgtgaactggaaagaaactcaataagatcctttgaggtcccttttggcctaagagtccttatctacacaatttgttcagtgctttcttttcctccttgctgaataggttgctagttaatcaagtatatttgctaagtagagtccattaactattgatctctctttcaggtaacacgaattgactcgactatacgtcatgtgctactgctttcatcacaactcagctctcagttgaacaagaaagacaaagtttctgtcctaatggagcttatattatagtggagaaatatacaataaacaaatacatatttagcaatgaaacatgccacgatgggaaataaagcaggtaaggtgatagcacgtatttttgtgggtagagttgttttacgtagtgtgggaaaggacaagtgttgtctcttacctgattccaatgttaaataacagactttttaaaataaaagtattcctattcaatgtaaccctatgtaactcccatctaaatacagtttgatgaaaaaaatttaataacaaaagtattcagctaattgtgtcctctaaatactaagttgaacagttttggatcaatctgcttttttgaaagtacattcaaattatctttactgcagtgttatttctcccctagaaagtagtcttaaatgtttaatgagacaattaaaaacactcattttaccatatcatgcccttccttcctgtttaacaatataagttaaaatattctactaacatattttcctccacttctttagtaaaatggcatttttctaatgagaataggcaatggggaaatgttaaaatctccacattaccgaagtgggaagattgactgagatactcgtaatttttctattcatatccaactagctctcattataatttactgtgtctgtttctattttactttccattgcaaagaggacaaagtttctttcttcctaatttgtctccaattcagctgggagaaggatgagcaggaaaaacttatgcactaacttcccaggtctcccctgaaccaaatgtgtgcaatcaattaatgtacataaagtgtctattatctttaagccatggtggctgcggattgcaatgggtaccccttcctcccattaaaaactaaaatcaaacaaacaactatatctaaaaacctgtgttcgattttctttatttctcatcctattacaaattgaaactcctaacgttttcataagcaaatagcaataataaatagatgtagattttagttgactttttagtcaatttgaactgtttctactggtttttaagtagaaatgggaatctcaaagtaaacagatttttaagcatgagcaaagtattaactctgaacccaaatactcattaggatgagttttccttttctccctaaagtcaacattcattttataactatatgagattatacaaaaattcatgctgagtccaatatatggaattattttcaaactatgttttgaaatgtctctcagagatatttaattgtgagaatatttatagacatcactataaattgtcaagtaaaggggaattaaaattgtattttaagttatatactgttatgaacaaataaatatcccactggaatagattatagtctgtaaggaatttcaaaataaaatacaaaatcttgatgtaatttttaggggtagttaaatggagaaacagattaaatgtattagaaaaatcagagaatttaaagaatttagagcaatgatgatattccacaagtggcaaaagttgaatatccaatatggatatacaggaataatatcaatcaattagcaaccattattttacataatacttctctcattattgagtatgagttcattttcagacagtcctaacatataaagtatgagataagtaaaattgtggatattatcacatgtagtctttcaattagttaatttgatctgtttgattccagattctggttttcagagaggtccatcaaataagaactatctttgcattgtattgcaatgcaaaacatgtctactgacaaaatgaatataaatagttttcttagtttctgaaactcagtatatctgattttggtgaataaagttttatggaaatatcttacattaatattttttaaattttacagtaatatttttatttttttgaaaaactctcaaatttacagaaaagttgcaatgactctcaattaactttttccctcaaccacttgagagtaagttgccaaaattctactccatcactaccactcccatttacattagtatttcctacatataaaaacattctctcgtatatacatatatatacatatatataatatacatatatacatatatatatatacacacaatacaaccatcaataacagaaaactaatatgattttggactagttttgtggaaaaaaactattattgggacaactgatgaaacctaaatgggatatgaggtaccaatgtagttaggtaccaacgttatattcaagcttactaattctcttttggattgtatccaatctgtctatgaatttagaatttttactttcacaaaacaattgtgaaataatatgtaaaattcaattattctgaaaatacatttgctgcaatcctaaaatattgtgtcctttttgttatagattttggtggagtaggaggtgaaagataaaaacacaactatgtcaaaaattctgtcagctgaaaactattcattctttgaagtacatatatttatacagcatttgagatcatctgaagtagaacagcatatagaacagatgacttcctagttgatttgtttaaaggatgaaagaaccctcaacctgctctcaatctcccatgactcttccattgtgcttgaggctctctctacagagccctgtgtcttttcaaaacagttaaacaatacttgagatacagtaatacggtttcacacacacaaaaatactgatgaagagagaaagtgtctaggaaagattttatagcatctgtggtagttgaaatcttgaagaatggttataaatttgatgtgcagggtattccaggagactgttcacactggattctccaccatactgaatagaattcatcatgtaaaatcttacttaatcacataaaggggcagttaaaaacagtacatttaaagagcatgattttagagttagactggttttggatcccagttcaatcacttctctctatatacacactctgtcctttaatgatctcatcttatctgatggctgccatcaatgcctttcactcccaaattcatgtctgccttttcttctaatttctaggttcacatattggtctacctacttgatatttttatttggatatctaacagcagcagaaatttccctctaaacattcatacagatgctcccctatctcagtcaatggcaatttcatcatttcagttgcatggtccaaactattaatatcttggagaagttcctgattcctcacttttctcataaaccctgtagtcaattcatcagcatatcttttgctcattcctcaaaatatatgtagaatcccatcacatctctctacttccactgctccatcctaacaagcctacgtcttataacccctgaataacttcaacagtaatctactggactcttggctccccaacaatctaatctttataagagtaagccttttaaaataccattcaatcatgtcactcctctgcttatctttcccaccaatatcttctcatcacactcagatcaaaagtcagtctttattgaagccttcaagcctttaaaaattctagcccctgttacttctctgaattacttgctaccactttccatcttgcccaccctactccaactacagttcttactgaccctaggcatatacttaccttagggttgtccattccccatatatccaaatgaccaactgcttcatctcttttaagtctttacccaaatatcactttattaatggggcctaaactagccattgttcttaaaattatagacaattctgactcttagccctgatctttcttatcttactcagctctatttttacatcatttattatctaccattttatgtatatggagatactcagtttaaaggttgctataatgctcaaaactatagagtaacaattctgggtttacattgagagttagaatgtcaatgaagtgctaagtatgaaacagtcaacagggttaagaattctaaaatgagcaaaggacatacacacacacacacacacacgtacacacacatacatcaaagaaagtgaattgattatatagagataattaatttaatatacatatatactatacacttacatttagtgcatgggtgcatggtttacagtcttggtgattacaagaataagatattacaaataaggaagataaaataaagaggcagttttgtgaggaaagacactggttcagttttagatatttaatcataaaggtccccctttctttctcgtgctaaaagtgttacaaactagattcgttacttcttaaatgacccttttatttggaaatgtttctcaaagaatatttaggaacaaggtaacttcaacataaacacagtttaaaacaattgttctgtttttctccttatttcttcacatgtgggagagccatctgtaattttatatctcttgcatggtaagaagtcgcagtttcaattacatttgatcatatgtattaagtgtaaacctatggtgtgagcgatgacaaagacagagtgcctaaccacctctatttgaagtcccctaggacttgggttaattaatgagactcatcctaaggttatacatgatctattacttcctctaattagaaataataatcctgatcattatgctggttagctggaaagaaataagatgaatgtgcttaactatgattaatagtcttctttaagcagtgtagatctcttctgtcactgaagttatatgcaaactgggctgcaactcaatgctttttaatgatacatactttttaaagctcatggaaaaaattaactttatggtagatctttttacctttcttgataataaacaaacattttggtattttaaaattgataaatacaacacaaaattactattttttcattttgcatataatagctatccagaactttattcttttattttttttctccaaaactatgtggctatatatgtgtattctattttggtcctttctgctgaggtacaacaggcttttgcacatgattatataccaactttttttaattcaaaaaattattactacacatatggtatttttttaactggtgtttttttagggctgatttctatacttgtcccactcacaattttagctgacacttttatatgtcaaagaaagttataaaaagttattatctggttagagagatgaaacacttccacaaagaatgttaatcatctaagatttttaatgtgactaatttagctgtaataaggtcgaatatttcagattattttaaaatagaaaataaaatcaaacatattactatgtaggtttaaaacctttaaaacactgcatgtactatttaattttggttttgatgtccgggcaaattgaggtatgattatgaaaatcttggaaaactgagattagaggagttaaaattctgttgcatacataaattgtatctcaaagcctgcagcaatataaaagcacacagaagaacaagatgttcagaagtttagcagttacatacatgttaaaaaattttaagcaaagagacagggtgtcttgggagtgaaacacataaactctagtcagatggtcttcattcaaaccttggttttaccactgactgtgcccttggggaagttatctcacttctgaacatcaacatgattttgaaaatgatgataataatggtattgatctcatatgtttattgagagaattaaacaagctaatatgtataaaataccatcataatgcttaagctatcctatttaacaaatgatatatgcttcccatctgtgatgagaagtatgtgcctagtcatgtgaaatacaattagatttcagaattaggcttccctttcattaatttcattccaggaacccagagtagctgaagatttaaacttatcaatattaggcatccacgtattgaattaaaatgttgatttttttcaataaaaattttataggataatttaattaatttttttgctaataaaattgtggatagattttatatttgacagctcctatgaaatttctaaacatatggatatgagttccaaaatgtacatcttgatttacttttttaaaattaaattttctgttctctaatatataataattttattattcagaattccctccttttatatttgagtttaataatttatgaaaaattttctattcacaatggatttttagataaaaaacaaacagtaacttagttatcaatatttaataaattattattaaattttaatgacattcaagatgataaagaagcaagcatttaggcatcttctctgtgccctgaactgtgctctcatattgaaaaaatacaaaagacataatctatagtatcagaaataaaataagaaataaaaaaagatgatagaaaatcaaatataatgaatgcaagtgtgtgacatactgtttgtatgttaaattgttggtaaatattcccagagaatgtgaaacttgaagtataggcagttggaacacaaaaacataagtagaaaaacatacttaaatccacaatttcataaattaagccaacgttattgaccatttttctgttgaagtaagaaacacaggtaaaaaatagaggtaagtaaatgttatacattcaccccatacaatgtcttaaaatgctattcttgatgccacaggcggtaaagataacttacacgtttttatataatagtattaaaaaatgactacctgtgtttatttaacctagatatatatttgaggtttaaattttgacttaaaattttgacttaaaaatttgaaagctagaaatatattacaatacattctttattattaaaaatatttatttagaaaaaaatgcattcagagttcattttcttctttcctaaagtcttttttgctatcagagtgactcttcatatcatacccatactaaatataaatatatagagagatataaagtatacctgtaaataaataacacatatgtatttaataagtgtgtatatttagcaataattttcaaatctttcaaaagatctcttgccaatttgagtttaaatggagataaaatcataaatgattaatttaaccagaatgttactctgtcaatcaaccgtaagactgacatcttgataaattaataaagatctttctgaaagagtctactaagctaatatgcagattaaacaaatgtgttgatagctgaacatatgcccctttagagcctagaagtatcaaatatgaaacctactaaaattttgatttaaaaaatcatacctgcaggccttgtccatctacagtaacagagttggctctttgcattttattcttgtcaatcactttgtttggctgctgggaaccactcttttcctttttcactgttgattgtctttcctgtaaaaaagaaaattttgataaaaataaaaattaggaaaataacataataaaatgttaagttgtttttactaatagaagagtttcatggttacaaacacaggctcaactttctaatttgaagttcctagtgaataatatgaaagctgttgttttcaactggctcaatatatatgatagcttcatgatcgaaccaccatttaaagaaataatgagaaagaataccaaattgtattatccctatgtgcccaattatgactctttatcaaaagttactaacgattactgaagttgattattttcatatgtaatgatacagataaagggtacaggattataatttaaagaatgtggtattgagtactaagaaaagcttataaatacatgcaatattgaaaattatttttaattgcatgatggacttttaagctactatttatatcaaaaatagcatatatcttaaaactgacattccatcccagctaattactttgttcctcatagtaaaaaaatttcttttaggagttgcctgctccctgtttctatttcctctcttttcactctctcttaacacaacccaatcaacttgtatcaccattactccaccaaactatcttttactaaaatcaccaatgaccgtctcagtttcacatctaatgatcagtcttcatcttctcaaatctttcagcagcatctgacagaattgatctcttcttactctttgaaaacttgcctcacgtggcttccaggacacttctttctctgagctctcttcttccttcacaacttcgccctcatagtctcttttgcccattgcttctccagctttgccacctgtaagactcagcctcttccttggacctctcatcatctctatctaccctcactccctaggtaacttcattcattcccacaactttcaatttcatttttatgaagatttctaaatgtataattcttgttctgatttctacctgagccttaatttccacatgcagatgctgtttctgtatgtccacatgaaggcctaaagcacaacattgtaaaatgtccaagattagttttaaaatttcctgcctactctgtccctagaaaataaatctcaaactggatgacaactcaccacctgcctcattacatggcttaaacatccattatctttttgtgcttggattattgtaactatcacctaatgaatcattctacttccatttttgtctccctacactcagttctctacacaaaagccaaactcatcccttttttttaccctactccagctgcactggcttcctcattgttccttgatcataacaatcatgctttaaattcagagctcttgcaatcattctgcagtctgctggaaaacttgccactgcacatttgtgggccttggtcctgacttcaggatgtggtcaaatgtcagagaagtttctctagtcccttgagcctccttttaaaacatcaattattacaacctaaagtattatttatctgatttgtttaattgtctgcattctttcatcttaatcaaagttccataagcaaaagaactttctttgtgtcactggtctatatcagatcctaaatcagtgactaacaaaagtcaggataaatcaagaaataaatgaaaacttttttgaaaagttttctaagttcttgaagcaactgttgagaaggattcttagggattttaggcttgatgtgaaaaattgtcctaattgattggcaatgcatgccatgggtgcttaagtgctttagtgccacacatttcctatcacttactcagctatatatatttcctagttcctatatttgcttgttagagtaccatttcaatttctataatttagaaagatcggattttatttgtgcaaatgtatggggtaactgagaaatgttttacatgtaaagggtatttagagtgatcattgcccaagtacaatacatttattaagtataatcacccttctctgctatcaagcattgaatttattcctagaaagacatttttaaatagctttgaaagtaaagctgtttttaaatatattagggctagatggatcagaaatcgtctctgactaaaataatgctaatcaatatagtccatttaccttgcaattccatggtgcaaaaacactgaatatattttgtgtgtggctgaaaatggatgccataataggattcctgaaattcaagtcgtttggaaagtgatgtgctttcatataagcataatttctggcaaaaatattgatttttaaaagaaagttccttctttttaagtttgcaaattataattttattcatagatagttaaatggcataatgtatataggagtgaattattagatgaggtctcgaatcagaatgcctgagttgaatctcatctctactacctaagtattatgtaacctagagggtttatgctttggcaaaatggagatagtgatacctatttctcagagttgtgtaaggtttaatataaaatgtatagtctgtaatattgtcactacattaaagtatgtattcaatataacagttactatgaatgatgtaaaatagttgtggttgcctttttgggtactcatcaacattgtttttatatttccaaatgtgtgtgtgtatgaaaaaacattcagtggttacgtcaggaacatatttaaaatttaaaagttcaacgcttatatttgaaaatgcatagcttgtgttagctgttcaaaaacttaatgctgttggtgagtgtggaaataatttactccagcattcttgcatgcatatatataaaacatggcatcaatattttgtaaaaatctgcaatgtgaaagatataccttaatacagttattcttcctaattatccaacaattgttgtttggcattcaatttataaaatgcttacacttgaagaattaaataaaattcaatttgattagttacaatggaactgggaatttgcaccagattatatatttatgttttaatggaaatttaagacatgcaagtatatgtttttaaagagctatgaaaccatctattaatatgactttacttttggccacacgtatagctagggaagttcttgtgttctaagaacctccaaatggcagagatagcagttgattaaatggcatcatgtccctccaagtagtcacccccctaagtaagttgggcaggagactaaacaattgctttagtgtaaacaatcagaaataatacaaacaggctgcatgtggtggctcacacctgtaatcccagcattttgggaggctgaagcaggcagatcgctggagcccaggagttcaagaccagcttgggcaacatggtgagcccctgtcgctactaaaaacgcaaaaatatagtcgggcatggtggtggacacctgtggtcccagttactctggaagctgaagtgggaggatcactggagtctggggatggaggttgcagtgagccaagattgtaccactgaactccatcctgagagacagagtgagactctgtctcaataaataaataaatatataaataaaaacaaattttaaaaccctaagttgagttttcaacttatgagatttcatttatgaaatccagaattatgagaaagaggtatataacaagttaatttttaaatcctcagtgtatccatctgtctgtgtattttattatagtatctaatactaaaatggtaagcattcatttaaacacaaacacacagacacacgcatcaagaaaaccaagtgatttctttggggaaaaatgcaaatgtgtggaatttgtgcaattaatccagtctaaaatcttaaaaacaggagagcctcatcactatttaatttttcttctatttccattgagaaaattgtctctcctttttatatgagggacaggaagggggaggcaactgtatcctcaaaaaatttcctgtccaccaggtttcactagcttttttgggaaggtaaattgaccctgactggcagacctctattatgatatttatgagagttaattaccaatgttgaagttattgaaagtttcagaaagagctcaccaatcttaggttgcacaatcattcaggataaaattgctctctgataataggggacaaagtttgccatttaaccttcagtttctttctttaagttttggggctctaaaccacaaaataaattacattgttgtaattaaggcaaatttccttctgccagataaatcatcctagatatacaaagagttggaaaattgttgctttaatcaatagaaattattcaaacactgaaaagagctactctaactaaaaaaaagtcatgaaagaaaatagaacatataactacaaaatataaaatacagttattgatatttgagcattttcaaatatcaaccatttgtgtttgctatgtagacattttaaatatagaattcagtgttttgtgatccgtagactccacaagtagcacaacagatcttaactggggaatatattgtattagaattccaaaagaataatcatcatcataaacagagaagaaaagccaaaaagaccattcacagaaaatagaaaggtgaaatgaataaaataaaaagacctcactttaaatatgtgctctaaaaaaaaaatctttgtctacatcatgctgattctcagaggtagagtatttgtacactggtgaaaactgctttcacaaaagggttgtttaccacaatacttaagcctgctgttatcgatcgctggcaaactgcaagcagcaagtgatgattacctcaagaacagggttttcttctttttgtccaatctcagcatgagaaactggcagcagcaaagcacctccactggtacaaagctacaaaggcgagtgctttcctgccaacagcatccatcacttgtatcgtagaacttactttccctgctactactgcacaacttgcctgaatggagatttagtcctttctgccactggagctaggccacatgaattttccagaaaccctagagtttttaacccaaggtatcatatagattcacagcagttaagatctctctgatgcagaaatgttaccacattcagcagggcttacgaaggttcggtctgagacaccaacttactaacaaactgcaaagctgcacctttaatcaatatggactgaacgtgggatttgaacattttaatggttgaaggaaacaaattcatttcaaaaatgatgaaggctctaaatctattagtaatctttggaaattgcagcaaaactatttgctgactagaaaaaacagttttgattgtttttaattataaagttttaaagataaatataataaacgatataaggtctaaagatttttatttcttttaaacttagttaagtaagtacttttaaaaaaggcaaaaacaactttttgtaaaggcaaaagtatgagtttagaagccaaattgcagctttgtcttttatttctgtgtaagcttgggcaagttatttaccattgctatgttaccacttattttaactataaattggaaagcttatgttagaaaaaagtaagaaaatttagacaaaagtactgacataaaacaggcactcagtaaatggcaatgattttaaagtatagataaaaaattttatttattttattattaagttaatcacaggtatactgcttggtcatagcagtaaaaggtaagtgttgtaagaagtatgatttatttaacatcctgtactttatttgcccactaagtcaccatagctgagaataattgctgtggtgatttgggtggtgtctttttgggagacgggggacaacaaaacagacaaaatgacaactggtcttaaagtacctgggggtgttagtcacttcctacacttgaaggtacacttggtgacttgatccataagtcccggttttcacacattacacatgaagttcatattttctcctaggatgattttatcctgggtataaaccacttacaagatttctgttaaggaaattcttattggagggaatgaaatttaggaataagagggtctatgccaaaataattcaattttggctatgtgctagtacatggcagcaccattataaaataatgtgtgtatgtctgtgtctgtgtgtgtgtgtgtgtgtgtagtatacatacacatatatgtatgtgtatactttatatacaaaagaagactttgggctaggcgcggtggctcacacctgtaatctcagcactttgggaggctgaggagggcagatcacgaggtcaggagttcgagaccagcctggccaacatggtgaaacctcatctctactaaaaatacaaaaaattagccgggcgtggtcacgtgcgcctatgatcccagctactttggcggctgaagcaggagaatcgcttgaacccgtgaggcagaggctgcagtgagccgagatcatgccactgtactccagcctgggagacagagtgagaccttgtctcaaaaaaacaaaaaaaaaaaacaacaaaaaaaaccagactttgtaaccaacctcaacattcctctttctccaatccctttgtaaaccatactgactgtcatccacagtaaactgaaagtaagtaccaggaggcagctctcttatgctcacactcattgtctctttctaccacctaagctaaatgctcaacacagtgacttattagccctcaatctgtttatgccagttctaagtaaaacttaccttgtaattgtaactgtgtaatttaattattactcaaatcattgaattttgaatacaaaatgaaagagtcatctttataaaaaataacctgcaagctttagaaagacaaaataacacaagttatgtgtgtgtgtgtgtgtggtgtgtatgaggagtggtcaagttaagtttagagagaacaactgtgcaagctttgggtattaataataaaaatagtatttttacactcagatttcttcacagatgttcttgagtttttgctatactttaaaagaattgaaactattataagtgataagattgtgatatatacaagaaaggcaagataccatttccaattagaagatctgtcctcatagaaaagcccttaatcttcaaaaatatagccaatgaatataaatgtacatattttaagttaaacatttaatgtatgtatatatctttctatatgttctcccacatatactttaaccacattttccgttaaccaaggagcaactgttcctgatggcagaacataaggtttcttgtctttctgtgtgtatatatgtgtattcacacactcagccatgcatatatccatgcatgggcttaaggaaatttttggaacaacaaagttgaaaaatcttatataatgactttgagggatactggaaagtttaagttaatgtaaaccaatatatagtgccagaaaaaaataactataggaagacttttaaaaacttcatatcaaaataaagacttttttcctgaaaattaaaaaaatatataaaaacaaaaatttggatctatttactcaatctatatgacacaaattatataactgaatgcatggggatgctttggagattaacagatctaaagagaaaagtttagatctcaaatgcaatgcctatatttgcttgattgggctggtaatcggggcagaaacaaactcaagaacctgaggatgcaaaattaattctctcacacttaaataacccaatgaaataataaactgtcctaatacttttgtcacttgagtgtgtaatttagcatctctattttataataataattgtgataataatgtcaccaactcacttaaagaatataaaatcagtttaacattttcttagattagaaacattatatttaagtgtatgtccaagtatttttgagtatgtctctggttaaaaatgagaactttttttttaatttaacgaagaggtctacactgattaaaaagccatttttggtggggagaaaagagcagttatgacacttttttacaaacatgttatcctctaaataaattcataatcttatgtagcattcatataagcaatactttctaaaataagcagattttaattacaattttagggaaacaataccatttgggcatttcctatagagataataacaattgaattggatactgtcacagaacaatgtggaggctttgcatcatcaatgcaaaggtaaagcaaaaatgttactgaaaataatgttgtggcaatgcttacatttgttttcaaaacaaaagccatttattctgactatattttattctgatgtttctctatacaatggcatgggctaggtgattaatgctgcattcatttgaaagtgatgggcacttcaaagtaagcaagagtctctcaacatactgccattgaaacttatattttgatggctcaaagaataaattcttttggatttccagcaatgtatctacattttaacgtgaaaaaatgggagtggcactatttttctatgtagtaaaaactctttgtaaagtaacctttatttttctctgtgaagtctaggtcacataacttcttgttttcttaatgcttatcacaaatatagatggaaaattcttcaagtctatcccatcactgaaaatatgaaaaccaccacttccaattagcagaatatgaaaaaaataaaatataacatgctggtattcgaatgtcactgagccagcacaaaatgttctttacagcaatacaagatgtataatgacctataattttaagtgtgaaaacctgtttttgcttacgcacctcaggaactgaaactcctgaagtgggcagagtctgctgaaaaagagaagttcatatgaaagctgaaaaagagtcaaactcaaaacaaatcagtgaagtttctcatatcattacatgcctgtgaaataaatgagtaaattaaaaatacatttccttggtataattttactgcttccttgaattaaataattaaatatcttttcattgaataagaaattatctaacacagagtgggttaggttgtgaaattatttatccaaaacacaacttcatctacccaaagcatgctgatcaacatctttggtcagctttagctccaagttccattctctttaataaataatttccactaagtttttttaatttgcccctttacccatcccaattttcattttgaagtccaactctcattctttcctaaaaatactgtgtcttttgaacacagacatagcttatgatgttcattttgttttgtgatactctggaaataagaaaacatattccattaataccagtaaaagaataaaaactataattaaataagtagcaagaattttacttgagagtaatttttttaagatggggttaaatacattgacattagtcttcacaactgtgttttccattatctaccactactacccactttgtagttcatattggaaagcctttttttttttgacaagaaatgataaaaggtcactgaattccaaaagcctgcattctatggaaatgagaacataaaatacaaatttggataattagttgacaaatcacacacacaatactagataaagtttccccatgctggaacgggagaagaaaagttggatgggatgccagttcttagatatttgtgtccctgaaaagaaggaggtagtcagaattcccttttcctccctagatacgagctatctgagggagggtctgggcagtgctagatcaccaagatgggtatgaaaaatctgatagtccagatattattatagtcccttacccaggagaactttagaaaggcagcaagaaccaaaaaaaaaaaaaaaaaaagaaaaaaatagctgaatctgagataggtaaaacctgacaccctcacagctgtgcagaatagagatggactaaaagcattcagtgcactcaaaagtgacacagaaggagaagaagaggtctagcacagccccacagaaaattaaggtgttcaggaatacagctctatttggaagatatttccataatataagtagaaagtactgtagctgcagatttctagtcaaaagaagccacgaagtggaagagtatgagctctggccaactatccattccacaggagaatctaatggaagtaattattgttgttttgaagatgaattgacagtaggtttggtagagcctttactgaaaacttcctgatttcagtaacattcttgacttctgagtccaaatcagtctacataacaccagggacaacgaatatttgtgctagtttctctctgggtcagttcaaagatatttgccaaccttattatcattctttcttagcttcgggttgaagcttaaggtctgaataaaattgcaagacatggatatagtccttccatctttatcataatatatacaagtttgttcttcaaattcaggtcaggaatgtaatcctatggatccttatcccattctgtgccatggacccaggaaactctcagagactctcaagcaaccaaaataagagacttcaatcagcctccagagcctgagtcagagatgccttttaccttagaagagtgtatgcttaccatgcatacatttgcagagagcaggcactggaaagccaagtgaaaagattatggctgtctaaatggttcagaataacaaccaaatgcaattcaagagcttcagatagatcctggtccactttcacttttaccatgcccaaaaagtaaataaataaaagcaacagaaggcattttggggataactgtagacatttgaatatggacaagataatgactgatattatggaatcattgttaattttcttaggtgagagtataataatgtcattaggtagaaaattgtccttagtcttagaaggtgcttgctgaaatatttagtgatgtggtgttaggctatgtgcagcttactttcaaaagcttcagctttatatatatatatacacatacatatatatttatatgtaaagaagtatatataaagaaattatggcaacacaatagcaattattgaatatatgtggaaaatatattggatttttttattgttagtgaatattttctaataaaatttgagagaagaaagttctttctacctcttcattatatcctttaacgcctaaaagtgtgtaaaaatgtttctacaatgaaataaaaatatgtacattatctcagtgaaaactatgaagttgctagaaggttgggagagaagtcataggagtgggtgggagagaaataaggagcactattttcatggaaacagagttctcatttaagatgagtaaatagaggtaagtttctaggctgctgggaaagaggaacagagaaagagggggaactgttaaagataaatgaaaaacaaggctttttagaaaaaagcaatatttcaattagagcagaagcccttattgacaggcatcgcacttttccaaatgtgttccttttgggtctcaaatgcagaaacccacagcggccaaaagataatacaaataggtaaaacaggtccgatgttgcaaaggtaaagactgtgccatgctggataataatcctcccatttgaagttatccaaaaaagaaaaagaaaagacactgtggtatgaaattgaaacctagctaccactttgcaattaattggcaattcatggataacatacttgaagtcttcctctttctcagagcagcaggggtatgagatatctactgatagagagcaagtgaggttggcagagaggtggtacaatgaaaaaggtaatgaaacagaggtttgtcacttcttttctgaaaataaaaaagcagtttgctaaggatgagtagcaggatcaaccaaaactgatgacccagctggagctagaagttttaaatatgtaagagagaaagccaccagccctaagaattttcttatgcaacactcagccttctgagagcaacactagaaatttactccaagaataagagtgacaaaaccaacatatatctaacctcatttacaatcaaaatgtgtaaagagttatatattaaatgtacatgcccatcagtagtttattcctgttacaatgagcaaaccatggtacttagatctaaaagaaaagtagaaacttattagaaaataaatttagctatcgtatcacttctttttttactctcctgtacttaatttttaaatatcaaagatgagcagagtaaatgttttggtttttttgaaaatcatcatgagtgcatgattctaaatgtaatatatttttaatcagaattaatacagaaactgtatatttttatttaatccaatgtgaggtgtgactacagaggaatgtgattgattttatttgatcagtatctttttaatattaaatagaatacacagtacagataattagtttaaaagatgcatttgccttcagggcactcattaagttcaatttaatatcaaagaattttttaaaattctattattcttaagtattaggatatctcttgtcttcatattttctaatgtgtaatcattttaaattgacaatttaatccaaattgtcataggacaaagaaaaatctttggtggagattattggaggtttgacttagttaagatataatgagagcacagtactcacattaaaagggtcattagttatttcaggctaaaggaaaactttaaaaatgataccttatacctacataagaacatttatatttttatatatatattttacatttatatatttttcatgtttgctatcttgcctcatttaatactcccactgaaacaagatactttatctttcaggttaggaagctgaaaatcagagagcttagatgcctaacccaggaaaacaaagttagtgacagaatattgcttccctaacccaggctctatttattcaaataacagtagttgcaagaggagactttttaaaattactatttttagccttgccttcattttttaagtggtttggaaataaaattattttaaaatattgatgaagaatgaaaaatatttagaaatcactatatctacaaagtgatacacacacacacacacacacacacacacacacacacttgttttgcctgaaaaactggcttgaataatgtgaattaatttaacacaataacttccagtgtagtagttaaagtgttccaaatatacaattggatatctctggcatcaaaaaagtagtaagagacagagaaaaaaaactagggtaagataaagaaaaattgtcttcataaaatgacactttgtcttagctggacaggtaaagttgttctctcaaacaagataataaagtgtattatctctaggatataaaaattacatatatttttggcttccatgttttttttatatttcagtttcatataatttgtttaaactttataattcttgaggtccttaattgtgtacactcacacatatgaatacaatgcaagttttaaaaaggacgtgagataaaaatgattttaatactattgttgtctttattaaaacctttagtaagagattatttcagtcataatacaagcaagacactgaaaagaaacataaattatttttcttttccacaaaaattctgatatgtctaattaagatgtaactataaaaataaaacattttaaaagctacacatattgtaatcttatccagggtcccttgactacttctcacctgactcaaattttaaagtttgcattaacagaaatttaatggtaaaatatatttttaactgtggttacttcactacccttcaactgtaattgctcacaaaatattccattcttacttagtaaatatgattgtttatgtctatttgtagagttttgtctggaggctattgacaagaagggaaccaacagaattttaaaaaataaaaacatgtatttgggggctattagagacacagaagaaattatggaggagggtagaaaacatatcaaagatagaaagcaatggagaaaaatggagacagaggaagctcttagaagaaagaaagaacaaaattctctctctgttgttttcctcaattatagaaactgttctttccaaagactgagcaaagaaaactatgaaatcgaggaggagaaagaggggagctgatatttagagcacccatcttcaaaacacatttcaaaatgaaacatgcacatcctattgactattttttcagattattcttcagaactcttaatttacatataattcattaatagatacctatttatgaatgtgtatatgtatatgtgattatgtttgtgtatgtttgggacagggatctgagggaagttggtaacttgaaaaaatcacccccttcaaagaactcagtataatagactgatacatacaaattttatgttcataaaattaatctataatatttcctgttatgcctattttatctccctataaaaacgagagccagttctagaaatatatcattgtatagttagcgtattgctgctttccagaatacaaatatagcactataggtaatgaaagtatattgataataatatttagaattaaagcctaggtctccttttcaccatccttgaaaaagatcttgaattaaaaaacaaagaggttataatggaatttgttcttgtcttttgctcctttaaatatccattgatctcatgccaaagtattttctaaccaggttaaagtccaattctgtactcacgttaggctaagattcaattgagttaaaattttacactgactgccagtcaaccttatcatgaactttcattatgtgcatgtaattaattgggtccaacgaacaatatcagttctgagttatagactcttttcccccgaccatataattagaatataattacccacaggatatcagaatgatgcagaacctttcctctaaatgcgccctcattaggaaacaagtctcaatgtacacttattcaatcagtgtgaattaattaaaatgttactgaaataaaagagggtagcgataaagagtatctgacatctattaagagtctatcactagagatctgcatgcacagtttatatttaaatccttttagccgaaatagaaactttgctatgtaatgttatatacatccagtgtactaggaaatctgagtacatacatcggtgtgtgtcatcatttttgaaaagagtacaagatacgataactatagaatctttaagaattgggtaggaatctaagagccccattattccataaatatgtcatcatcagatagaatctacctggcgggcaaaaatcattttaactcaaactacctaagcaattattggtttaacccacaaccttatattacaaatctgaaaatatttgtcccaaaattgcttaggagacaacaattcgaaaagcccagatttgtgaaaacactaattatttttgtctttataaaataacctgaattccttaagctagctcaagttattacagtagcatattttctttaagcagcacattcaaatacagctaagaatagcttctttttaagagaataaataatacatcataccacacattctgattatataaaacacatttaaaaatagtaaatgcacaaagaagctgagggacacatgatacatagcgcacaagaagctgcggattcaaacagtaacattctacctaagagctattcatctttatttctccaggtgtatagttatattcaataaaactttgctaaataaataacccgtgtacaaaggaatactcagcattagtcagaaacaatgccatgaactgttaacataaaaatttcagagctgcatgtaataaactaagatatatacatattttcaagctttcagtgttattatatattcctcagaaaattttagatacagaaaaaggttttataaaacatagttctggtaataaaaatttggcattcacttttataagtagacatgcaccactttgtaatggaaattctgcatgagtattaagataaactaggctatctacaaatgtatactttttatatgctctttaggagcaaacttcaagcagttttaaattattagtcttttttacaagaatgtttaactctataagattatatatatatgtgtgtatatatatatacatgtgtgtatacatgtatatacttgtgattacaacattcaaaaatatgttttatatacctatatatgtgtatatacacatatatacatatatatatatgcatgttgtaatcacattctggtataatattctattcagacactaaactcatcttggtggagaccaaaagtgagagaaataatggttccactctgctaagcaaatgaagattgtctcacaaaggtttgctttattcttaacctaaaatttttttagaatttcagtaataaatacatgtagctacagttgcctgctgaaaatattctattggagtaacattcactaaaatgccacattaactaagagtaattactaccaaaaagccacaatttctaaacaagagaatgtgaatatttttgaagttccattctataataaacatcaattttcattttctgaacacaaagaagaatgattatttattatattttacatggaaaactatattgcttaaattatatttaaaaatcagatttttaaatacaatttaatatccagagaaaaacatctcaattctcctcagaattctgaaaatgttccctttatattctctacctgctgtaactcctcattttacatgtgaggcattttacagtaccatctattggatattttatataactacaacacataaaactcaccagcttttcgaaatttagtagtaactataagaagctgcaagagccattccggaaactaaatacaatgctactttggtatccactaacatttcctcatcatcacacactttaaactcaattttattagcttctaacaaaatgatttaattatgagttaccaatgattttttaaaaccaagcctccttgttatatatttgttttaatttttacttgatatatatgttactgtctgatatattttttcttgactcagggaaaagagtgataaatgatgggaattttcaaaagctgactgaatgctattcattcactcagcaaatatttgttaagcatctagtctatgaccaaatcaaattaggcactagacataaagagatacacccttttgctgggagtgataagaataatgggggtgctagtcaatgagcataagggacagtttcacaagaaatgtttcaagttcaattcctgctatgttgactttaagcttctgtgggatatatctgagaggaaacttaaaacatgaagtgagggccgggtgcagtggctcatgcctgtaatcctggcactttgggaggctgaggcaagtggatcatctgaggagtttgagaccagcctggccaatatggtgaaacccatctctactaaaaaaatacaaaaattatcccggcatggtggcttgctcttgtaatcatggctactcaggaggctgacccaggagaatcgcttgaacccgggaggtggaggttgcagtgagctgagatcacgccactgcactgcagcctgggcaacaagagtgaaactccatctcaaaaataaataaataagtttatttattaaattaaaaaaaacacgaagtgagcatttcgatctagatgtatgtggggagaatgggctcatacagacacatgcaaacatggtagctgtagctctggaactggataacataatttataaagtgtgggtgtaataagatgagaattgaagaaaaaactgaagttttacacatattaaagaatgaaaggaagactagggatttagtaatattgacaaagtgtggcttaaaaggtaaaagaaaacctagtggaaatgcactggatgagtgttagaggctatcaaaggtaagcatctcagtgtcaaacactgtagagcattcaaaacagattatacttggaaagggtttccagtagatgctgttggtagctcaaagcagatcctttgctaccttgccagagcaactatcaccagctgctatgagtgttaacttctgaaagcttgcagccgtccctaagaattaacctttatccacagaaataggctgtgccaggaggccctagataatgactgacacataggtgaggaaaggccagccttcttgccttaagttaggaacaatcctatgattggatttttgctgcaaagccctaaaggtacgggccaaggctaaactatcactatgatcaacattcttgcttagagcttgcctcttcctttttctgcctccctcccttcattataggttgttttgtttttgtttttgtttttttctaaagaactttttctccctccataaatcacacaaagccaaatcttggcttaatgctctactccttaggaacccacctaaaagagtgcaattcgatttagtaaggatagcaagaacaatttcatatccatgttacagtcagaagttacactaaagtgggttgagaaggaagagaggaatgtgacacagtgggtgttatctacacacctgcacaaacatacttatggttatgtgaagagccagacaagagtcagcatgcaaatacaggaaatagaattgcacaggagaaggacaaacagccctttcactggaatgagttctacaacacactaatagtaaaaacaatattcacctactggactcaaatcatgatgctgtttagtactaaattacataagtgtgctggattataccttgtctgggtttttcctattgtaaattaggaaattgatattttattaaagatctgtgacaaatgccatgaaaggagaaaaatgtggaattccaggagaattaaggcagagaatactagaatgaaagaaatctgaaagaatatacgcattgggtggctcaaggatgttgaagaaatgataatcaaaggaagtaatttaaaaatatttgtggtcaagataaaatgagagtaatgtaatgaagaatagatcactaggtacagagccgtaatcttccagggtttgggtttccttgggcaaatgaggttgaataagtcaaagctctttagagtattagcaacagaatttcaactgatagatttttatcaactggactggacagcaaggagtggtcatggaaagctcgagaactatccttattccacataaaggggaacatgggttgaactagggaacaaagacaggcaatgagacagagatcatggtagtatttacaaaattgatgtgtggaccaaaagttatatgtgacttaattcttcaccaggtttcaagtaaaagttgagaataaacaagccatatttaatagtaaaacagagaaagtcatgtacataaatactttctgatcaccactgtttcagcaggaatcattaaaactacagattacctttgcaaggtggaatttatcccttaatgtctagtggtggttaagaatgtctggttttgactgcattcaaaatgtaaaaattaaaagataaaaatgatataaagcatttgtctctactctaatgctattagctctagatatatgccttgccccaaccccaaatttctttgaaaggtgaaagcagaaatatcaacatagaagttcacatatttgggagcttttatgccatagtttgtggcaatttagtttcaccagtgtttaatgagaatagcaaattttgcacattcttgccaacactgggtattatcattttaaaaatattttccaaaatggatagaaaaattaaatctcattgttttaatttatatttcttcattactttttacaatatagggatttggtttacaatatagggatttggtttacaatatagggatttggtttacaatatagggatttggtttacaatatagggatttggtttacaatatagggattgcattttacaatacaaagatttgttgttgctgttgttactgttattatgatccttatctttaacttgatttgtaagttttgggatttagcattttctttaaaataaattttcattgctcaaggcagttaacattttatctttctcattttggaaaaaaaaaaaaggctgtgcctaggcaaaaattaaaccctgaattcatgtttgatttttttgtaatagatgtaatgtagaatttaccttactttattttcacgtggttatacaataatcctgacgcctttgatgctccaccagatttcatttgtgacttttattatagactatataattacatatagttcaatatgtctttagactttctatcacatctttacaacttttagagccatattattttgatcactgaaaatttaacaaacatatttttaagactttttgttagaataagcatttttttattactcttcgtttttaagattttataatgtttatgtacatttattcttccagacaaaattagaaatcattttgtccagccaaaaaattgcatgcaaattgcaccaagtagataaattaatttgaagtgacgtaggttctttttcattcagtttaattttctttacacttaagagaacaatttagttttttgtttgtttgtctgtctgttttgcttagggatagcatgatctcttttcaatttgttgccattctctacagtagtaaaaggagattttcgtaatcctcttctccagattacttattttgttgtcctcagtgttgatttttgccttattctaatacagatatagttagtttctgctaaaacattatttttttctatactctttcttaattcttttgtttctttcaagtcagtgcattataaagtaaatgttttctttagtattcttgaccatctaaaactattgctattgatgtcttcttctgtttgatgcaataaaactttatgtatggcattcatctaacttttatctgccatcctttttctttatttttgagttgcataactattagtattttatttggcaacaggtagactctttaataccaaaaggcacttgggtcataaaccatcagtctgcattggcagttgatagaaaagtcaaaggaaacaaatacaactacaccgattattgcaatattgtttaggtactgtccaatacagaaacaacttcacacagaaaaattaatctaaggtctcagtaaccacaaaataataaaaaatattttctctaattgaatacaatcaagcctataatatttatttttgctaaggctaccaagaaactcagggaaattctgaaaaattacctctgttaactttgaatggtattgtgaaataaatttgagttttaacttaattttggcacaaacttactacattttattttgctgcatatggtatattacataagctgttttgaatactgttagcaataacttgtagaataatttaaatcattcatgaatacataatttcccatcctcactttagaatcagacatatataatactctttgttttaagtctatttttaaaatttagcttttaatacattgtaatctctctttggataatgctcatgtatggctatatgtttaagatttcccgacaccatcaagatggctgactagaggaacctagcactcatctcttaaacaaagaagggccacaacagcaaataaataaccacaaatcaaatggagcatctaagggagaacacaaattcagcaagaaaatgatgaagcccttctaagacatggaaactcctgatggcacaataaaaataaaagcaaagcagctagccaggatcagcatagaggcaggagagactctccattgcaggaaaaaggtaggtgggagattccccagccatctacattcccatcagagatgtctggaatcctagggagagaaaagcccctctgccctcacagaccccgagcctagtgcagagagtttcctggagttcacatgactgtattgttccagagaggaaaatcaaactgggtgccctacactcctgggaccaaagctgatgcatcatggcattattttgagggaagaaccatcaccagaatacattctgacttgggccaaatagcccctgtatctccacatccatagtattccactgatattcccctacatccactgagaaggctacagtctcatgaaaccaactggaactggtggtacaactgtgttcccagcatctgagcccatgtagctccctgtactccagaaaataggtgatctaaacccttaggaagtctgcctccaggacacaggtagctgaagcatgtgcacaccaaagcttgagagccacctgtcttatctgccgtcaccaacagtgacctctccccctctagcagtggggccaccacatgtccatgtgcaatgtcaataacctgcaaaccagtttaactggggtccactgccagtgccccaatgtgtgccatccaggagcccgaggccatcctcctcaggaattgctaccacttcaagcccaaaaaactgacctctccaatagtggggctgctgcgcacctttgcacaccatttaggagccagaggagtggaccaaccagggtctactgccaccaacacccatgcctacaaatatcccccaggatcctgaagactggcctacctgggctctcccaaagaaagttatgacagagcctccacaaacaactacagcctaaactactgagaaaatcacatatgctactgatttgattacaggcaaaaaaaaaaaaaatcatatggagaatacattactgtacctacctagaactaaaaccaaagcactctacctaactgactctatagatacatctacaggaaaaaaagtgttaccctatgaaagctacttcagaaaattcaaagaagtgacagctatatcagagatgtagatatcagtgtagggatgcaggaaacatgacaaaccaataaaacataacacctctaaaggaaaataattattctgcagtaacagaccacaaataaaagaaaatctataaactacttgaaagggaattcaaaataattatctttcaaaaattcagtgaaatacaagagaacacagataggcaataccgtgatatcaagaaaagaattcatgatctgaatgagaaattcaacaaagatgtccaacagaaatcatagaactgaagaattcaatgaaaatataaaaagtacagttgagagcttcaacaattacagaagaaataatttccgagcttaaagacagatcttttgaagtatcctagtcacacacaaaaaaaagagaaaaagaatttttaaaaagagtgaagaaactctatgtacatacaggagaactttaagcaaacacatttttaaattctgggagttccaaaaagaaaagatggggaaagacatggaaacctattgaataaaataatacttgaaaatatcctatgtcttgggagataaatagacatccagatacaggacactcaataatcctcaaatagacttaaattaaaaaggtcctatcgatggcgacaggggacagacaaattcctaggcagacagggatgggtctccagtgaaacccaaccttccagcaaaggacagtttaaagcctgaaaaccaagctgccagttccagatagactccacaactggcatgagaacttctatctccatctcacccactcagtcttgattggttccttctgaatgatgccttttaactaatcaaatgatatttttttcaagaccaaccatggacccatcagcatgcattccccgattctaagcccataaaaaccccagactcagactcacaaatggctacctgtttaggggtcctctctcattgccgagagctttccttcagtgactcaatacaattctactatatcttactcactttctggtgtgcacataccttgatccttttggtcacggacaagaaactggaaatccttgaactgcaggagcaaaagagctgtaatgttcctgcttgctgagctataggtggtgagaataaaagagtggtaatattctctgccgctcgccgaacaacaggacagaaaaacccactgggtgccaccttctcctgcttgctgaacaatggcagcaaagagccactgggtgccctttctctcactcactgaactgtggaagcgaaaaagccacaacactatctgaggcacattatagtcaaacagtcaacagtcaatgataacaagagaaaagaatcaagtcacatacaagggagtccccattagactaacaacacacttctcagaagaaaccatatggtcagaagagcatgagatgatatattcaaaatgctaaaagaaaaaaaaaaacctgtcagccaagaatacaatacccagcaaagctatcttaaagaaataaagagtaaagttttctcagacaagcaaaaactgagggaattcatcatcaccagactggatatacaagaaataagggagttcaacatctgaaggcaaaaggatgatatctgccattatgataacaaatgagaaagacaaggaatgaaatgttatttctacagaaaacaagcaaactgcaaaaaataacttaagagagaaagagagaaacaaaacaaatacaaaacaatcagaaaacaaataccaatgggtagttagtcttcacctatcaacaactatgaagaggtttaattcaccaattaaaagatagagatttggctgaatggattaaaaaacaacaagatccaactatatgctgcctacaaaaatctcacttcacttgcaaagacactcatagactgaaagcaaaggaatagaaaaagatattccaatgcaaactgaaacgaaaagtaggcaggattatctatatttgtatcagacaaagtagactttaagtcaaaaaacataaaaacagacaaagaaggtcattagataaaaattaagtggtcaattcagtaagaggatataacaattatagaaaagtaaataaacatatatatacacactcaacattggagaccataatacaataatagctaggaacttcaatgccccacattgagtattagacagataatctaaaaggataataaattgtaaaatattggacttacactgcactatagaccaaatgaacccaatagatatttacagagtatttcatccaatagctgcagaacacacattattctcctcaggacatgggacatttgcaaggatagactgtatcttaggcctcaatataaatctcaaacattttaaaacatcaaaattctctcaagcatcttctcagaacacaataaaataaaatcagaatcaatattaagaagaactttggaaattgtacaaatacatggaaattaaacaacatgctcctgaatgacaaacaggtcaataaggaaattaagaagaaagtaaaaaaaattcttgaagacatgaaaatagaaatacctatgggatagagcaaaagaagtgctaagagggaagattacaccaatgaacacctatataaaaaattaaaatatttaaaataaacaacctaacaatacacctcaagaaactagaaaagcaagaacaaactaaattcaaaatttatggaagaaaaaaataataaagatcaaagcagaactaaacaaaatagagactaaaaaattacaaacagtcaacaaaatgaaaagttagttttctgaaaagataaactaaaacgacaattagactaagaaataataaagaaaacctcaataaataaaaccagaaacaaaaaaggagacattacaactgataccacataaatacaaaggatcattagaaactgttatgaacaactatacactaccacactgggtaatctagaggaaacatataaattcctggaaaacttacaacctgccaaaattgaaccaagaagaaatagaaaatctgaacagaccaattacaagtaacaagactgaatcagaaataaaaagtctcccaaaaagaaaacaacaacaacaacaacaacaacaaggcccaggacagagagttttactgctgaattcaaccaaacttttaaagacaaacgaaaccaattatttttaaattactccaaaaacaaaaaaatagaccatacttcttaattcactttataagtacagcatcaccctgataacaaaacgaaacacagacacaaaacaacaacaaactacaggccaatatccctgatgaatatgggtgtaaaaatcctctaccaaataatagcaaagcaaattcaacatcacatcaaaaagataattcatgggggaggagccaagatggccgaatagtaacagctcgggtctacagctcccagcatgaacgacgcagaagacgggtgatttctgcatttccatctgaggtaccgggttcatctcactagggagtgccagacagtgggcgcaggtcagtggtcgcgcgcaccatgcgcgagccgaagcagggcgaggcattgcctcacttgggaagcgcaaggggtcagggagttccctttctgagtcaaagaaaggggtgacggacagcacctggaaaatcgggtcactcccaccagaatactgtgcttttctgacgggcttaaaaaatggcgcaccatgagattatatcctgcacctggctcagagggtcctacgcccacggagtctcgctgattgctagcacagcagtctgagatcaaactgcaaggcggcagcgaggctgggggaggggcgcccaccattgcccaggcttgattaggtaaacaaagctgccaggaagctggaactgggtggagcccaccacagctcaaggaggcctgcctgcctctgtaggctccacctctgggggcaaggcacagacaaacaaaaagacagcagtaacctctgcagacttaaatgtccctgtctgacagctttgaagagagcagtagttctcccagcatgcagctggagatctgagaacgggcagactgcctcctcaagtgggtccctgacccctgacccccgagcagcctaactgggaggcaccccccagcaggggcacactcacacctcacagggcagggtactccaacagacctgcagctgagggtcctctctgttagacggaaaactaacaaacagaaaggacatccacaccaaaaacccatctgtacatcaccatcatcaaacaccaaaagtagataaaaccacaaagatggggaaaaaacagaacaggaaaactggaaactctaaaaagcagagcgcctctcctcctccaaaggaatgcagttcctcaccagcaacggaacaaagctggatggagaatgactttgacgagctgagagaagaaggcttcagtcgatcaaattactctgagctacgggaggacattctaaccaaaggcaaagaagttgaaaaccttgaaaaaaatttagaagaatgtataactagaataaccaatacagagaagtgcttaaaggagctgatggagctgaaaaccaaggctcgagagctacatgaagaatgcagaagcctcaggagctgatgcgatcaactggaagaaagggtatcagcaatggaagatgaaatgaatgaaatgaagcgagaagggaagtttagagaaaaaagaataaaaagaaatgagcaaagcctccaagaaatatgggactatgtgaaaagaccaaatctacgtctcattggtgtacctgaaagtgatggggagaatggaaccaagttggaaaacatgctgcaggatattatccaggagaacttccccaatctagcaaggcaggccaacgttcagattcaggaaatacagagaacgccacaaagatactcctcgagaagggcaactgtaagacacataattgtcagattcaccaaagttgaaatgaaggaaaaaatgttaagggcagccagagagaaaggtcgggttcccctcaaagggaagcccatcagactaacagcggatctctcggcagaaaccccacaagccagaagacagtggggaccaatattcaacattcttaaagaaaagaattttcaacccagaatttcatatccagccaaactaagcttcataagtgaaggagaaataaaatactttacagacaagcaaatgctgagagattttgtcaccaccaggcctgccttacaagagctcctgaaggaagcactaaacatggaaaggaacaaccggtaccagttgctgcaaaatcatgacaaaatgtaaagaccatcaacactaggaagaaactgcatcaactaacgagcaaaatcaccagctaacatcataatgacaggatcaaattcacacataacactattaactttaaatgtaaatggacaaaatgctccaattaaaagacacagactggcaaattggataaagagtcaagacccatcagtgtgctgtattcaggaaacccatctcatgtgcagagacacacataggctcaaaataaaaggatggaggaagatctaccaagcaaatggaaaacaaaaaaaggcaggggttgcaatcctagtctctgataaaacagactttaaaccaacaaagatcaaaagagacaaagaaggccattacataatggtaaagggatcaattcaactagaagagctaactatcctaaatatatatgcacccaatacaggagcacccagattcataaagcaagtcctgagtgacctacaaagagacttagactcccacgcattaataaagggagactttaacaccccactgtcaacattggacagatcaacgagacagaaagtcaacaaggatacccaggaattgaactcagctctgcaccaagtggacctaatagacatctacagaactctccaccccaaatcaacagaatatacatttttttcagcaccacaccacacctattccaaaattgaccacatacttggaagtaaagctctcctcagcaaatgtaaaagaacagaaattataacaaactatctctcagaccacagtgcaatcaaactagaactcaggattaagaatctcactcaaagccgctcaactacatggaaactgaacaacctgctcctgaatgactactgggtacataacgaaatgaaggcagaaataaagatgttctttgaaaccaacgagaacaaagacacaacataccagaatctctgggatgcattcaaagcagtgtgtagagggaaatttatagcactaaatgcccacaagagaaagcaggaaagatccaaaattgacagcctaacatcacaattaaaagaactagaaaagcaagagcaaacacattcaaaagctagcagaaggcaagaaataactaaaatcagagcagaactgaaggaaatagagacacaaaaaacccttcaaaaaattaatgaatccaagagctggttttttgaaaggatcaacaaaattgatagaccgctagcaagactaataaagaaaaaaagagagaaggatcaaatagacgcaataaaaaatgataaaggggatatcaccacagatcccacagaaatacaaactaccatcagagaataatacaaacacctctacgcaaataaactagaaaatctagaagaaatggataaactcctcgacacatacactctcccaagactaaaccaggaagaagttgaatctcttaatagaccaataacaggagctgaaactgtggcaataatcaatagcttaccaaccaaaaagagtccagcaccagatggattcacagccgaattctaccagaggtacaaggaggagctggtaccattccttctgaaactattccaatcaatagaaaaagagggaatcctccctaactcatttgatgaggccagcatcattctgataccaaagccaggcagagacacaacaaaaaaagagaattttagaccaatatccttgatgaacattgatgcaaaaaatcctcaataaaatactggcaaaccgaatccagcagcacatcaaaaagcttatccaccatgatcaagtgggcttcatccctgggatgcaaggctggttcaatacacgcaaatcaataaatgtaatccagcatataaacagagccaaagacaaaaaccacatgaatatctcaatagatgcagaaaaggcctttgacaaaattcaacaacccttcatgctaaaaactctcaataaattaggtattgatgggacgtatctcaaaataataagagctatctatgacaaacccacagccaatatcatactgaatgggcaaaaactggaagcattccctttgaaaactggcacaagacagggatgcgctctctcaccactcctattcaacatagtgttggaagttctggccagggcaattaggcaggagaaggaaataaagggtattcaattaggaaaagaggaagtcaaattgtccctgtttgcagacgacatgattgtatatccagaaaaccccattgtctcagcccaaaatctccttaagctgataagcaacttcagcaaagtctcaggatacaaaatcaatgtacaaaaatcacaagcattcttatacaccaataacagacaaacagagagccaaatcatgagtgaactcccattcacaattgcttcaaagagaataaaatacctaggaatccaccttacaagggatgtgaaggacctcttcaaggagaactacaaaccactgctcaaggaaataaaagaggatacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcccacatcaccaagtcaatcctaagccaaaagaacaaagctggaggcatcacactacctgacttcaaactatactacaagtctacagtaacccaaacagcacggtactggtaccaaaacagagatatagattaatggaacagaacagagccctcagaaataacgccgcatatctacaactatccgatctttgacaaacttgagaaaaacaagcaatggggaaaggattccctgtttaataaatggtgctgggaaaactggcaagccatatgtagaaagctgaaactggatcccttccttacaccttattcaaaaatcaattcaagatggattaaagacttaaacgttagacctaaaaccataaaaaccctagaagaaaacctaggctttaccattcgggacataggcatgggcaaggacttcctgtctaaaacaccaaaagcaatggcaacaaaagccaaaattgacaaatgggatctaattaaagtaaagagcttctgcacagcaaaagaaactaccatcagagtgaacaggcaacctacagaatgggagaaaattttcgcaatctactcatctgacaaagggctaataatatccagaatctacaatgaactcaaacaaattcacaagaaaaaaacaaacaaccccatcaaaaagtgggcaaagtatatgaacagacacttctcaaaagaagacatttatgcagccaaaaaaacacatgaaaaaatgctcatcatcactggccatcagagaaatgcaaatcaaaaccataatgagataccatctcacaccagttagaatggcaatcattaaaaagtcaggaaacaacaggtgctggagtggatgtggagaaataggaacacttttacactgttggtgggactgtaaactagttcaaccattgtggaagtcagtgtggcgattcctcagggatctagaactggaaataccatttgacccagccatcccattactgggtatatacccaaaggactataaatcatgctgctataaagacacatgcacacgtatgtttattgcggcattattcacaacagcaaagacttggaaccaacccaaatgtcccacaatgatagactggattaagaaaatgtggcgcatatacaccatggaatactatgcagccataaaaaatgatgagttcacgtcctttgtagggacatggatgaaattggaaatcatcattctcagtaaactactgcaagaacaaaaaaccaaacaccgcatattctcactcataggtgggaattgaacaatgagatcacatggacacaggaaggagaatatcacactctggggactgttgtggggtgggggtaggggggagggatagcatcgggagatatacctaatgctagatgacgagttagtgggttcagcgcaccagcatggcacatgtatgcatatgtaactaacctgcacaatgtgcacatgtactctaaaacttaaagtataatttaaaaaaaaaaagataattcaccatgatcaagtaggagttatcccagggttgcaaagatggttcatatatgcaaatcaataaatgtgatataatacatcaatagaataaaggaaaaagtcttacgatcatcataatagaaaccaaaacaaagcaattcataaatcttcatcctaaaatttcttcatcataaagtctctcaaaaattggacatagaattagatatacccctacacaataaaggccatttatgacaaacccacaactaacagtacactgaacagagaaaagcttaaagcattttctacaagaactggaataggacaagtatgcctacttttaccactcttattcaacatactactagcagacctaggcagagcagtttggcaacaggatgaaataaagggcatccaaattggaaaagaggatgtcaacttatccctccttgtaaatgagataatcttacatatagaaaaacctgaagacttcacaaaaaactcttatgactaagaaatgagtttaataaagttgcaggatataaaaattaacatacaaaaaaatcagtagcattcctatttaccaaaaacaagctagctgaaaaggaactggagaaggaaatcccatttataatagcttaaataaaataataaaatacttaggaataaatttaaccaaggaggtaaataatctctacaattaaaactgcaaaacactgatgaaaaaaattgaagagggcataaaaatcaaaagacatgccatgctcatggattagaacagttaatattgtcaaaatgaccatacaacccaaagcaatttatagattcaatgtaatccctattaaaaattgcaattacatttttcttcaaataaatagggaaaaatcctaaaatttgtattgaacccaaacaaatacaagtagtcaaagtaatactgagcaaagggaggaataacactatgtgacttccaagtatatcacaaagcaatagtaaccaaaacagcatagcattgctataaaaactgacacacagacaaatagaacagtatagagaacactgaaacaaatctatgtattttacagtcaactcacttttgacataggctctaagaacatacactggggaaaagacaccctctataataaatggtgttgagaaaactggatattcatatgcagaggaataaaaccagatccccatctttcaccagaaccaaaaattgacacaaaatatattaacaacttaaatgtaagacccaaaactataaaactactagaaaaaaacagagggggatttctttgggactctggtctgagcaaagatttttatggataaggttacaaaggcacaggtaccaaaaagaaaaatggacaaacaagactatatgaaacttttaaagagcttttgctcagcgaaggaaacaatcacagagtgaacagacaatctgtatattgggagaaaatatctacaaactatttacctgacaagggccttttacctagaatatacaaggaactcaaacaacttaacagcaataataataatggtaataatcccattaagaggtggaaaagaatctgaaagacatttctcagaagaagaaatacaaatggccaaaaagtatataaaaaatgttcagcatcactaatcatcagggaaatgcaaatcaaaaccaccataagatatcacctcaccccagttagaatggctattatcaaaaagacaaaaaataagaaatactggctaggatgcagagaaaagggaattcatacattgttggaaggaattatagttagtacaactattatgaaaaacagtatggaggttccttaaaaaactaaaaatagaaatatcatataatccagcaatcctgttattgggtatttagccaaaggaaaggaaacttgtgtatcaaagtgacatcttcacccccatgtttataacagcactattcactatagccaagatgtgatatcaacctaaatgtccatcaatagatgagtagataaaataattatggtatatatgcacaatggaatactattcaaccataaaaagaaatgggacgttgtcattttttgcaacatggatgaacctgaagggcattatgttaaattagtcaagcacagaaagatcaataccacattcttacttatatatgggatctaaaaaattgagctcatgaaataaaagggtagaattgtggttttcagaggctgagaagttagggatgagaaaggcaaagagagaagttggttaactgatacaaaattacagctagacataataaataagttatgttctatagcactataatgtgaatagagctaacaataatttattgtgtatgttcaaaaagctagactggagaattatgaatatttccaatacgaagaaatgataaatgttttaggtgatggttatactaattactctgatttaatcactgcatatttcatacaggcatcaaaatatcattctgcatcctataaatatgtaaaattattatggtaactatagataaagtgaaggaaacaaaaaatgcaaaaaaccaaccaaaatcatgtaaatacaatttttaaagaatttttatgacttcattattatttttgatttgtgggactatatatttcacagcaatttcaatgtaccttctagatattatatagacacctatgatctgaacttaaagttttagaagatttctacctataataggtttttggatatttaaattttggtttttttttctaggtttgaggtcagcgaagaaaattgacattttaaattaatataggaatgatggcctaattaatcttcttgacagtgaactcctgtgtgtcaagagtcaatccataggacactgcatcctgaatatattaacttcccaattgttcatatattaaactaaaagattttcatcagatttcttcttagctgaacttccaattcatgtcttatggggcttttgtttggcttttccataaatcatggcaaaccaaatgtggcacaagtttgatttttgaaaaaaattattattgcttaccctgggtacagttatacatataggatatatatacagtatatatataggatatatacacacacacacacacacatatcctatatatatggtatatatatacatatccctgtttaaaaaatccctttaagtatacaactctaccttatgcatttaggtagaaacaaaaacaattgtctacaacacttgaactttttcttttagactagaccctgtttataattatacacgttctacataatataaactagttcaatgtaaagacagtttgtcagaaagcaacagcacacagccaatctgagacaatgtaacagataaatggttggttaacctcccaagggtaagattatgaaatcacttagtgaggctgggtcccttccagttttcttatgctatgtctctttaaaatatatgtacatgaagaaatacacggacatgctatgactctttaaaatacatgtacatgaagaatattttaaaccaaaatggatgtacacatgttttataaatattatagcaccctagttcttaatgtgttcctcatcagaatttgaatagtgagaatgtaatcctacacatttaaaaaattaaataaataaaaggcagctatcctttatgaataataccatgaaattgagtctgagttagatttccaaaatatggaaaaatgaggtttctttttgcctatcattactatgatgacaattatgaattgatctataatgaatattaattaaatgaatattaagtaatgacactgatgaaacatttattgagagctgacaatatgctttatccctgctctttcaacaaaaaagaacgttgcataggcacaaacctttggtagatgacataggatttcaaggaaatagatgacttcagtaactttgcttaaaggttaaagaggtaaatttaaaagaagggtgaaacagccataatgatgtgaaataaaagctgaagctcagtgcagcaagacacatccttagttagttatatgttcacacctccccaccagactctgcatttctggaagttttataactagcctaggaataatattacagagaattcaaaattcaaatttcagaatcacagaagatttgaatatctcccaccctccttgaattagctgatgtgtagcattgggattgtcattattaactcttgccgataaaagtcagatgaaaaaatctacagaaagtttccatactactggagctgtgagaaagagacacacaccatacttctacttcctaacaaactttctgacattgctgagaaataatgacttagttcaacacatgctctaaggaaagatttaacatactctatgctatttaagacttaatcaccatatttacaatgcataatttagtagaattcttaaaattgtggaagagcaagcaagatcggaagaagaggagaagttaatatgacatatggttttctgagggtgttataggtagagatacgtagattgctgcttcagcaacatcacaacttagccaagttttcagagttacagtgaagaaaaaagagatgcagaactgggaccattttaagtttcagcaacatagatggaactggaggtcaatatgataggtgaaataagccaagcacagaaagattaatattacatgttctcattcatatgtgggagttaaaaagttaattccatgcgggtagagagtagaatgatggttatcagaggatgggaagagtttgcatgtttgtggagtagggggataaagagaggttggttaatggatacaaacacgaggttagatagaagaaataaattttaatgttcaatagtagagtagaatgacgatagtttcacacattgtatgtttcaaaatagctggaagagaggacttcccaacataaagaaataatgaaatactcaaggtgatgtataccctaaataccctgacctgatcattacacattttatgcatgtaacaaaatattacatgtaccccataaacatgtacaaatattatatatcaatacagaataaaattcatattttatatttataattttaataaatatgatttaaaaattacgtttataaaacaggattaattaattttaatactaaagaatattttttaaatatacatttttcaaatagttttgttgtcctttctgtgaactaacaagcttcataatttatcttgatggtatttttattaactctattcttcttttttaaactttactttaaagttctgggatacatgcgcagaatgtgcaggtttgttccacaggtatacatgtgccatggtggtttgctgcacctatcaacccatcatctaggtttcaagccccacatgcattaggtatttgtcctaatgttctccctcccctaaccccctaccactcgacaggccctggtgtgtgatgttcccttccctgtgcccatgtgttctcattgtattaactctattcttaaaggctcatcagatattataacaagagagtgtattccaggaagaacacaccataactggtctaaagggctatggtgctgaacatattcattgtttcacatcctatcatttcctgctaatggacagtaataatatggttaagttcaaaagtgagataaattaccctgggcagtatggcaattttcacgatattgattcttcctacccatgagcatggaatgttcttccatttgtttgtatcctcttttatttccttgagcagtagtttgtagttctccttgaagaggtccttcacatcccttgtaaggtggattcctaggtattttattctccttgaagcagttgtgaatgggagttcactcatgatttggctctctgtttgtctgttattggtgtataagaatgcttgtgatttttgtacattgattttgtatcctgagactttgctgaagttgcttatcagcttaaggagattttgggctgagacaatggggttttctagatatacaatcatgtcgtctgcaaacagggacaatttgacttcctcttttcctaattgaataccctttatttccttctcctgcctaactgccctggccagaacttccaacactatgttgagtaggagtggtgagagagggcatccctgtcttgtgccagttttcaaagggaatgcttccagtttttgcccattcagtatgatattggctgtgggtttgtcatagatagctctaactattttgaaatacgtcccatcaatacctaatttattgagagtttttagcatgaagggttgttgaattttgtcaaaggccttttctgcatctattgagataatcatgtggtttttgtctttggctctgtttatatgctggattacatttattgatttgcgtgtattgaaccagccttgcatcccagggatgaagcccacatgatcatggtggataagctttttgatgtgctgctggatttgttttgccagtattttattgaggatatttgcatcaatgttcctcaaggatattggtctaaaattctcttttttggttgtgtctctgcccggctttggtatcaggatgatgctggcctcatcaaatgagttagggaggattccctctttttctattgattggaatagtttcagaaggaatggtaccagttcctccttgtacctctggtagaattcggctgtgaatccatctggtcctggactctttttggttggtaagctattgattattgccacaatttcagatcctgttattggtctattcttcctggtttagtcttaggagactgtatgtgtcgaggaatttatccatttcttctagattttctagtttatttgcgtagaggtgtttgcagtattctctgatggtagtttgtatttctgtgggatcggtggtgatatcccctttatcatttttattgcgtctatttgattcttctctctttttttctttattagtcttgctagcggtttatcaattttgatgccatccccatcaagctaccaacgactttcttcacagaattggaaaaaactactttaaagttcatatggaaccaaaaaagagcccgcatcgccaagtcaatcctgagccaaaagaacaaagctggaggcatcacactacctgacttcaaactatactacaaggctacagtaacccaaacagcatgctactggtaccaaaacagagatatagatcaatggaacagaacagaaccctcagaaataatgccacatatctacaactatctgatctttgacaaacctgagaaaaacaagcaatggggaaaggattccctatttaataaatggtgctgggaaaactggctagccatatttagaaagctgaaactggatcccttccttacaccttatacaaaaatcaattcaagatggattaaagacttaaatgttagacctaaaaccacaaagaccctagaagaaaacctaggctttaccattcgggacataggcatgggcaaggacttcgtgtctaaaacaccaaaagcaatggcaacaaaagccaaaattgacaaatgggatctaattaaactaaagagcttctgcacagcaaaagaagctaccatctgagtgaacaggcaacctacagaatgggagaaaattttcacaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaaaaaatgctcaccgtcactggccatcagagaaatgctaatcaaaaccacaatgagataccatctcacaccagttagaatggcaatcattaaaaagtcaggaaacaacaggtgctggagaggatgtggagaaataggaacacttttacactgctggtaggactgtaaactagttcagccattgtggaagtcagtgtggcgattcctcagggatctagaactagaaataccatttgacccagccatcccattaccgggtatatacccaaaggactataaatcatgctgctataaagacacatgcacacgtatgtttattgcggcattattcacaatagcaaagacttggaaccaacccaaatgtcccacaatgatagactggattaagaaaatgtggcgcatatacaccatggaatactatgcagccataaaaaatgatgagttcacgtcctttgtagggacatggatgaaattggaaagcatcattctcagtaaactatctcaagaacaaaaaaccaaacaccgcatattctcactcataggtgggaaatgaacaatgagaacacatggacacaggaaggggaacatcacactctggggcccgttgtggggtggggttaggggagagggatatcaatgggagatatacctaatgctagatgacgagttagtgggtgcagcgcaccagcatggcacatgtatacatatgtaactaacctgcatgttgtgcacatgtaccctaaaacttaaagtataataattaaaaaaaataaaaataaaaataaaaaaagagatatgagagttggcaggggctagaaatccagtttaaaaaaaaagtgagataaataatcatctaaaaatgattttaaaattttaaataattttctattctaagacaaatgttctgttttaggaaatatttaatcattattttcttcattaggaatgggtttatagtacagaaagaattaaacaaccataaaagcggactcatttgtaggacaaaataacacagtatggggaaaatgatcctttgcacttctgagtagagaacagccagaagaaaccattcttcataaagatgttcactatcatgttacttataataacaaaatgaggaattgaaaagatgctagacaaaaacagtttcaactaaaatatgacttctttacttaatgagattacacaggcattaacagtgatgtcccatagtatatggaaatacataaaaatttaaggatatcaagttaagtgttaaaatataatgccacatggtatattcaggttaactttaaaaaggtgaaaaaaaaacctaaaaatcaggaaggtaattttaatagtgtttctatttatatattaattgtaattcttcttatataactgtatcacaggtttttaaatgtttaaattctttttctttattattttaaaattttgtatgattacatagttatggtatgataaaatgttaaaattcacttttcaaattacagcataacacttataatagtaatattagatgatatcatcttagcactcaccatcagctatgcatagttataagcaattttcatgaattaactcatttgattttatttacaaatggaatacagagggacaaaatgttaatagctcgcttcatatcacaaaactagtgaaaaacccaggattaaaatacaaatggtatactgccagagttctaaggtaactgaaccaatttactctctcacctgcaatggatgaacaatttggctgaatcttaacaaagcttaggctttttaacgtgcttgtatcattctcttcagtgtctggtgttatctcctgatacttaacatcaattttcttgataagtaatgatggtgagtgcatattcatatgtttataggtggtttatcaatagacttagttcaaatgcctgtttaggtctcttgcccttttcaactgaattgtttgtttattattgatctatatcaattctttttatatttcacatacaagtcatttgccaccattttgaaactactggatggaaacgacttgcccacagatcaggagttcatgtaagaactctggactctagtcttccacactttctggctatcattattctctcttccttctttctcttcttccttttctttccttctcttctttcttttcttttcccttcctcccttcctcccttcctcccttccttccttccctccttccctccttcccgctcccctcccctccactcccctcccttccctcacttccttccttccttccttctttcctcccttcctttctctctctgtctcataaatcttccacacttctcctcttttctaaaacttttaactgggctccctggaaccagtgtgcaaaaaaaaacaaattatccttttcctttctaaatgattgccacttttgctaataacacttctgaaaagaggcagctcactctctcaatccttacaactgctatagttttaagggcaatctcttggccttccatcaaaattaccatttgtccagctacaaagctggacttgaggttcatgaaatctttacacttgaggttcatgaaatctaatagttctcctctacccttattcattactgtcaagtaataactatttttaaaactctgcaactatcctggatggttttaaggataatatccaataagtcattctcagagttcccttactttctaacatctaatgaacttcccctgcacatcagttgagccacccagattcatggctgcatattggatcttaccatcatctgaaaataatctattttgaaatcacatcaaatcctaatgttctactctctgctacagttttctctcctggttgcctaattttctttctctgttggtgtctcttgactattcacattgcagtctcctagtgatactctcatatctcttctgctccctgctttacatttcttttacaccacactgctagcaaagctgtctttctacaacacaaagttaatcatttaagctcatatttatattggataaagccgatctccttgacaagacaggccaggaagccattatcttggaccttgtattttctccctctccagcctcacccttacacatgccctttaaaaaatattttggagtttcatgatcacactatgtactctcttgtcactgagactatttatataaacatcactttacattttccttcaaaatacctatttatgctcagacatcatttctttaagaaaaagtttaatttactgttttcccttgggatggattaagattcccacctctagagcccctgtaagtgagtatgtatcacaccctaatatttaacctctttggatgcttcatctaatttactctgaattgcaggaaagaagacaactgctcttatctggatttttagctccattgtctttagtaaaaattaaggggaagaaaaaggaagaaaagaaagaaggaaggaaagaaggcaggaagaaaagaggaaagagaggaaaaataaacagtagaaagcgagcactgcagatattgtgtataaaaataatgcaatgatcttaaaggtacctttaagaaataaaaataacaattcatataaaacaatggttacttatgtatcatacaacttcaactttaaataatcagcatattaacactatgtcattcataattccaatttatcaatataaaatattgatattgatatgaaaaaaaggctaggtaattaacccctttgttagagaattaagaaccttgctcttcaagatcgatcgtgttcttggcaagagcatggatggagctaaaggccattttccttaggaaactaatgtaggaacagaaaaccaaataccacatgttctcacttataaatgagagctcgatgatgagaacacatggacagatagagggcaacaacgacagagggtggagggtgggaggaggaagaggatgaggaaaaataagtaatgcatagtaggcttagtacctgggtgatgaaataatctgtacaacaagcccccgtgacacaagcttacctatataataaacctgtacatggacccttgaacctaaaagttaaattaaaataaggaatattgtttctaaattataacacaaaatgtgtacatacagaaaacaaaactaaatcatggaggtgaatacaacagaaatgatttttgtgataatctgcttgattttactcttcaaagtttaaaatgtgattttctcatgagatatctcaagtcttcttttgttgatggtggcagaattaattgaataaaagcccctccaaaactgaaaaataattacataaatatgtgcactcttaaagagccactttacctcatcataaaaattatataaaacttagaatgaatgtaaaactaaaatataattctagagaaattgatcagatttgtagcctcctatatgagattactctaaaatcaaagggattctataggcctattttatcgatttctgtgacctcacaaatttatgtactacccaaaataatttcaaaagtatggacttaagccattgcagagaaacagaagagaaatttatgaatagaatagtgataaaggtatatataaacacataaaaataaacaacttatattccaacatcatagttcaatgttagtataaatttaattataagcttcttaagtaccaaaaataaaagcatgatggcaacgacacatgaagtctaagagataacatcatgataaacagaactgagaagaacttttgtcaggtaatgaaggacatttccaacatatctttttttgttaaaatagggagttttatatgattaatttttaaaactccctttcaatgcaggctgatgacataattgctgaagcccaatttaatttaagagaaactgagaagggctaaaacaacatagactacatctgtcttgagttaggggtaaattagaacatagaagagtgagtggcttgcatatggcctcattaggccatattccatatgagattattaaaatttatttgcaatgtcactttgttttggattggccagctgagatttcagtgtgttatctgcagcaagaaccaagaatgcattttttaatagattctattaaaggcagaacatctgttttgacaatcagttgggaagggttaatggccttttataaattaagcagcttatcatgagtctcgatgagttgggattcatcctacatttttttggaagtaaaataaggggaggatttaaggaaatctacctttgtaaacagtttctgacctctcttcaatatggcagtaaatgaactatagctataattgttaccagaacattttttttcttaaaaaaaagcattctaagtacctaaacacagtcatgggaaaatcttgactaaatcacacattaaataaattttaagtaatatagatttttgatagtactttcaaaagatactggatgccaattgcaacctcagaaaactaattatatctgatgtagggaatcattgtttaatttttatttgaatgaaaacaccatatgataataattttaatttcagagtagttgattttaacccatttttatggcaacagccattatcaaggccaattatctgtgaaagccgtttgtaatgcatgcttataaaaagcatttcatcagtgcagaggagatgcttaccttgctaatctctggaaatggtgagcatatatctactgaatcattaacctacagcttataacaacgattggggaggaatgggaaggctgagaagggtggtacaaattttttttaatgaccctggagaaggtgttctaaaatatgagaagacaatggctatggatcttgaccttgtggtatgtcattaagatacaaggctatgtgagcttcaaccagaaattaaggatccacgctgtatttatagaggtcattcaataaccaattcctaactacagagtcaacgactaaggaaaaaataaaactagacatcttaagttctctaatattttttataatgtgatagagataatatcaatatccactttgtattaactgagtctgaacctcatctgctcctcttagagaagattagccaaagaaactggggcatacaatttcttaaagaggaaactggtactaaataataaaaaccaaaacaacatgatatatgtgaggactaacgatttgctttaaatgaagggctacaggtcatgcagtgtgaaattattcctggaaagttactgaaagttcgcagactgaaaaggctcagagcctatcagctggagctgattaagcaattttgtgggcagaacagtttcattaatttgtttgaagtatgatcacttaaatagttaatgtgtacaacagtcaatatttttattccgtgacaagaaagtaaccttttaattcggacttagctaggtgggcaaaattttaaagcaaagtgatttaaattgatttattaacacatacgagacccgaagggcttgacacaacaagtgcacttaaagaattacaagcagttcaattatccttgatttctagtggataaggtactatatgagagaatgagtaggttgatccagttaaagacccttgtttactgtaatagagtgtttgggattcaaatagggaatcaccaaaaatattttaagagtgagagggacttataatatttgcattttttgaaagttgacccaggaagcaggttggggtgtacagaaaggaggtagttcacaaggatgctactgggacaatcctagaataaaatttgtgaggctggtatacaagacagtcacagttgggctgaagtaaagagacaggattaagaacattagaatagaattgagtaatattatattccagatgagaaataaaaaatgctacttaggtttctagtttgggaaagttggggtgtgaaggtttcagtagctgagatacaacagataaaatctctctattgggatttggagaaaatctcagagcacagctctggagtgataaccactcgggctccacttctaaattgccatgtactattcatgggacactgggaaatttacttaacctctttgtttctcagtttcctcatatgtaaaatgggaacaattataatatttatcttatgttgtcactttgaaaacaaaatgaatttatatattgtgttacttataaccataccccttcataatctcaattcctacctcactcactctcaacctgacaccatttaccttgattccaacaacctttgacttcactgtaatttacaatgtactatttctaaaatctattactgtacctcatatttaatgttcttacttccctcacttccagctcaaattccacgattaagccttacaattactcctttgcatatattctcaactctctggctgccctctctgtacatcacatttgccaaaagacacggtcacatgaagactgggctgtgcctattccattcataaagctggaatgtaactagataaatatgactgaatgtgagtaaagaaatatattcatccaagccgactggaattatatactaaatggatgattattaactagaggtagctgctcttttctccttgaaaatcacagtttctttgaacaattttgttcccactttcctaggtgacacaggcttcttacacatcttgcaccatcctcactctagctaatgacccaggtttctatttctttgagaaaacagaagtattatatctttttgccattgttgcccctcaacactacacagattgttccttttaaaatataagtcagataatttctggttctggtcggaatcctctaatggcttcctattttattcagagtaaaggccaaagattttacaacgacctaaattgtcccacccaatataaaaatcgtatgatatctttgaacttctatttttcctcctatacactcagggctagccactaatccccccagtgcctttgagatctgtcaagtgtctactgcctcagaatctgttggtgaagttctgtccccagatagccacagaggtgactccctcaaatcactcaactctactcaactgtctcttcagtgaacatcttgacagcctcttttatcactgcagccccaacatttcttctttctctgctttaatttttcccttgacattgaaaacaaaaccagtacttatttattgtgtatatttaaggcatatgattactgtacaattaatgttttgatattgttaaacaaaaattatcaaagtccattgttttggactgagctcctacaggaggccccaacagaccagaccagaccaaaccaaaatggaaaccaaactttagtacaaacaacttgtactaaagtgtcacataatcaagctgaaattttaaggaagcaaactgaatcccagaacacatcagttgtttctaaaaatgtgaaattcaagtctacctgacttgggataataaggatgtaacctctcctttaactctttacccaaagagtaacctgaagtaacatgatgttaaacaatcagcttttgttttgtattattgtgttttcttgttcccaccttacaaaatccactgttctatgtctagtgggagctctcattctactctgtagaatagatgctgtcctaattcatgaataaaggcctatttgatctataaataaatgtgttgttattttgttttcaatagtgtaaatattcatagtgaaataattattatagttaagcaaattaacataaccatctcctcacatctcctcatatagttacccttgtgtgtgtgcatgtgtgtgtgtgtatgtgtgttaagagcacctagtctcttggcagattttcagtatgttatactatatatatatatatatacacacacacatttttttttgagacagagtctcactctgtcactcagtctggagtgcagtgatgcaatcttggctcactgcaacctccgcctccagggttcaagcgattcccctgcctcagcctcctcagtagctgggattacaggtgcctgccaccacgtacagctaaatttttgtatgtttagttgagatggggtttcaccatgttggccagggggggtcttgaactcctgacctcaagtgatccacccacctcgaccccccaaaatgcagggattacaggcgtgagccaccatgcccagccatgttgtacaatattagctatagtcatcatactgtacattggatttctacaattattcatcttatgtaactgcaactttgtactctttgaccaacatctccccactcctcccctcttcatatcttcagggatcaacattctactctgtttatgtattttagtacaaccaggtactaaataatttatttagttttattgtttattgtctacattacccctgctggaatgtaaactccataaaagcaaagatttgtctttgttttaatgttttctttcctacctataatactgtttggcacatactaggcatgcaatgaatatttactgaataaattaaataatattttagcatagtctctgggatagcatatatgctcaatcaaaagagctataattattgcagtagtaaataataatatatcgggtatatgcacttaaaataatatgggtcctgcaggtggcagttctaggtttggaatttaggataatgagctgaacataaattaacatggtaatgcaatcaactgaataaacaagatctcattgagaagaatactaagagaggaatgccatgacataggagggtagaatccagggatgcaccgacatgggcatgtcgacattgtgaacccaggaaagatactgaaagcaagtatccagagaaacagagaaaggaccaggagtgaggtataatggaagtcaatgaaaggtagacattttggaaggacgaaatgctcaatagtcatcacacgcttcagagtagatagtaccacaaaaatggtaaacaacaaatgctgagatataaattattaaaactgtggggatatttaatgattagagatgaatcttcagaataaaaactgtctaaaaacagcaatgaaagatttttcaagattgttcaaagacaagaaaattcacgtaacacacgctctttacatttgattctctcaaaaaaagaagtgatagcataataaaaagaatacaccttatgtttgaatttatataactagaggttgacataagtgggccaaggaggcagaccccaggctcactgaattgagtggggtcttgcacagacagatgggtagtaggaagaaatcatagatctcatcttagagttaaaatctgagatcaaaaatgcatctaaaccagtaaaattgccatatttcaaaataagaatataaataatacaaaaattctagaagtcttcaagacaacacttaaatgaataaaaacaacatttaaattaacctaaaatgtaaagtatttttatatggctctcattttatttaattaatcttatttaccataggatgtctaataaaccttacatgaagaaaggaaatttagaattagttattgctatactcagcaatatggaggtattttcttttcctctatttttgtagtttgagaaaatgaagcatttttaataattttgtgaaataaaggcatttaaaatacaaccagtattttacagataattagaatcataagtggtacaaaatgagtaatatgattaatttctaggttgacctttagaaaagtatttttctatcatttcttagttgttataattttattatatcaaatggaagttccagccatttaatttccatgttgtttttcaaaatgagaagtgcatcatggatataaaatagtttgttttttaaaataactttaattttcaaagtaatttgggttttgaatatgaatattgtttgaatatctgcttctcttcctaccaaggttcgttcttttcatagttactttactcatgcattttcatttctatacttattgaattaagtaattattttgcaggtagttaaatttattgttcaataaaattttttttttaaaaaacagctaatagcagtgcataactttcttcatggatgtgtcatcattttaggtagcctctaacctagatgagagccctcaacattgcagatatataatgtgcatctccagcaaaattgcccataagaataacttcattattctgggaagctagatctataaaatatataaaatgttgaagtcttctgcctttacaattcctggtaagtagcagcacgactaagtgataaaacctgagtcagcgtcatttcaagcatatcgttctagaaagcgtattttgacagaaggaaaaaggaaatatagtggacaaaggtgttctgtttcagagtaacgacgtattttagatctatatacttctaccttgattgatgaaaaattatctctagaagcttttaatggtatacgatactgataagtcacagcaatcctaagttatagtagaatgataaggaaaaactcaccagtaccactggacagattgttgtgggtggtaaaatatggtccttcaaaggtccacagtcacattcaggttttagatgagaagcacatttattatgcagctagaaaaacagaaagggggatagtatcaaattctacatgacaacgcctaacatgggggagattatatttcaatcgagatacagcaaacacattaaaagtacaataaagaaattataagaacaaataaacagagtcataaaggaattcataatacatttgtccttatatatgaaccctaaataaaccatctagcagcttctgtgacccattctatacattttataattctcagaaatgtttatattaaaaatgtactttaggttttacaccaaagaaccctgatttctttgacaaacacaaattattgtccattacagttcttcctttgcttatctgttagcataatcttgaaaccactgtgcctgtgtatgctttttttttttttttttgaccctcctgttttctcaaagtcattccaaagtgcacagctcagtatggggcataattgatcccatcattagttttaactttgtaattcaatatgtaaatgtaaccagagattcatctcagtaggagcaggatataaataaaagaagatgattatgattataaaaatttatctgtatattgtatttatcagctcaacgttaagttagtatataatcatacaatgtcctatttattttttaatatgtatgagcccaaactaatatttttattaacctggtcataagtttacattaaggtgttacaacgtggtgttttaaatagtgatgttttaaaactgagatggtagttttttaaagaattacacagatttggtaaaataatacttgcttgagggcatctagagatttctccctcctgcactatgcattaatttgatatgaactcttcatactttagaaaaaaatatacatttcaataagataacatgttatgttcaaaacaaaaaagagccacattatttttccattttgaatcaaaagctacctcatttaagccttggctgcattaatttccacaacatacatacctttgtgagcagttaattatcaactaagcataggagtctaatgagagttgatttatttttagtaatagaacagtatcaaagaggtatttctgcggtcctagaatctaacactgctgtcatgctaactccctgcattggagttaagatgacttgtactgtaattaatgcccattaggttacattacatgaaataaacgtatctttccatgttcatccataattagcagctctgcttctcaggggcatataaacttctctataaaaaagtgatttaattgtattaggcactactggtctttgtcaagaggcaagaagtgttgaagatagagaagcagctgaatgcacaatagaactaaataaactgatactcagagcaaattaaaaggtatagtttcctcaaaataaaattagtgacttgtttaaaatgtattattaatttattggacctagtaattaactttcttagaatctgccatggccatggatgtttggatttagagttaacagattagcaagtgttgggatggatcaatttctcccaaaagatatgctgaagtcctaacttctgggacctttgaatgtgaacttaattggaaatacggtctttctagatgtatttaagctaagatgttggtttagctggaccctaatccaatgactggtgtccttataagaagaggggaatctggacagagagacaacggcacagagaggagaagtccctctgataacataggtcgatatctgagtgatgcactacaagacaaagaattccagggattgctggcaaccaccagaagctaggaagaagcagaaaaggattcttccagaaagccttcagagggaggatgacctgctgacatttggaattctagcctccagagctatgagtgaatacattcttgttgttttaggcacctattatatgacattttgttacagcagccctaggaaactaataaacccagtactatgaaaacggcactaaaaccaaagagagattatgggtcttaagactctgctgcactatggatgtcacagagaaagagctttggctctttaatcttgggcaacttccttaaaactgagaaaacagacgctaagaaccctctacaaaaaacagatctgagataaaaacctatttgtgtttacagcaagaaagtgttgaaatattattcttgattacagtgtaaagctaaacacgtgactctgaaggccacaggggcaggacatactgagtcttatgccaacgctgactacagatgcagtcagaggcctcagcctcctccacacctccatccatgtgtttccaacaatttgcaactgacatggtaaaggacgactaagctctctgtatagttatttgagggttactgatgtaagaaaggatgacaaaaataaaattaatttgatgatagtttgggggcatttaggctagtttcccagaaggaaggaaagaatcgaagactcagatagaatcatgcaatagatgagcttaccagagtgtgtgtgaaggggcaactctgtatattgggatttgggagtttcagagcataggtactgacagttgattccatgaaattctggtctttgcagagccaaataaatctagtatgggatttcccagtttgattgccgctgtggtcctgagttttgtctaggcggtcgtaaggcactccccaagacataggaggatctataagtttagtaaccatactatcatctgttaaacagagtcacacaatgcaagaaaattctcctaaccaagaagtctatatttgataatatgcaggaataccttatgcttgtattaagactagaatctggcagctaataaatacattttcttaaccatcaacattatgacgttgtttgtagccaagagtgttaaaactgagggcatcatgttaggagtacggatcattttacaagtcgtgaatcaaatttgtatgacaggtttagtttatgcatcatatttcttggagatatacttgaggaaaaaatatacaatgtgaaagccaatgtgaaaaatgtgtatcattttcaggaccacctataaagtgtaaaagtgaatatcatctttgctgtgaacttaaaattgctctaaatcataaagtctattttaaaaagcaaaaatcaacaaaattatacaatagaattcaaaagctacaaattttttttctttaagatactggtaatattttgtttcctgatcaggtactgcttacagaacattcatgtggggaaaattcattgggctctgccctttggatataaatgcctttctgtatgtacactttccttcaatgaaaagctttttatagtttgaaagaatgaataagacctactatgtgatagcacaacagggtgactacagtcagtaataatttaattgtacattttaaaacaactaaaagaaggtaattggattgtttgcaactcaaaggataaatgcttgaaaggatggataccccattctccatgatgtgcttatttcacattgcatgcctgtatcaaaacatctcatgtgcctcataaatgtatatacctactaagtacccacaaaattaaaaataaaaaaattaaataagtgaatatcatcaacaatagaaagttgcttaaacttatcatcatatttcgtggacaagaatataagaaaaagacacagctgggtccttctcagtgtaaataagatgctgaaggctgactattgttttaaagataacctatatcccaaatcagcaaaatcctaaacaccagggtcctcatcaagaatagaaatgaactacagcattgaagatgctgcctctttagtaaaataaccaatagcgcaccagagaaaatcaaatgtttactatttaaaatttaaaaaaacatttttgttcagttatctttgtatttttttcaagccaaggcatagaaatccttagctcatttttaaatatacatccagaaattcccattcatgttaagggattcagtgccatatgtaggaaaatcatataatagaaaccagcttttcctggaagtgaattaaacacttggaaataatttcagagtttatgacaacttccagtagcacctaatttagagccagatctatgtttattagaaaaagctgtctcaagatagaaagaaaaagaaagtgtgtggatgtctgtgtgcatgtgtgccagcatatagttctatggatggagttaggaagagtggctgcgctggtcagagaagaaaatgggatctgagaagtcaaaaggaggaaaaatggaaaataagtgttcataggaatttagaggaaaataagaagagaaataagctacttttctaaagaaaaatttgaagacctgatttggaggcacatatttactggttcacctgttacactggcccctaatattttgcagtttggggtacttcctaagactggcatttactgaagcagaaatgtttccatggcattggaaacctttaaacattactgttaggaatttagtatcttaataaacaatattatctctatatcatagcaaaagttagtaattcatttttatgaaataggtgttattttttcaagcctaaataaaatccctcaacttcccatcctggtgagtcctgcctgaccagtgagagcttaccttgacaagcaatgattcacaacatgttatacaacgaaggtcaagaaaacacagtttcagaagaaatgaacaggtataagcagtgggatattaaggatgttagtaatcaagacagaaaagagaactgaggtgaatattttgcctgtcacagaggattgaaatataaaacacagagactggttgcctaattatcagaaggcagttttccactgatctttcctaagcttttcgtatttttaattttgaagtggctagatttacaaatgaacagaaaatttcattctaagagcctaactttatatctacaagatagccaactagtaaatcaagaaactgcaagtatgaactgaaaaatgggtgtgaaaattgattcttaagtatttgtttaagtttacttgcatatctgatggagatttgagtattacaggatgatattataaaacaaaacttaaatagtacatatgtttgaaatttaatattctactgtaagaatagcatatcagagattaaagtgatcttactgaagacttttctacactcagtactttgtcaagaacttcaggtgattaggaaaaaatgtgtgacatggacaagcaacaggagcgggccacagttaacagtgcaaacgatgttagactatggtgtgaaaccaatggagagcatttgagtttttcctttggatgtggaatgtaagtacagaaactattcagaatcaagatatattagcgtcaagaaaaatttcaaggaagacaggtaacctaacttgtttcctaaggtatgattagaatttaagacaggtgcattcaagggaccgggatgaacaaaatagtaggcatgagggaaacatggcctccccaagggactgccaacagaaatacacagctatggcagagggtgtgtgtagaagaggaatattatatacagttatgtttaggtttgattctgatttctaaagaactaaaaaccaacttgatgcaaggggtgttgagggctgcatttattatcacagaactattatagattgctaaagaaggcatataacaaactagtattttcagaagatctttctggaggtggtatgcagcctgcattataggaaaagtaccttctgttagggagatgagccaagagattttgactctaatctagtcaagaggtgctaagagcttgcactagggctgcgaatgtggagacaaaacctcaaatctgagagagatattttaagtaggaaatgacaagactcagtgacaggttgtgtacaagagataaaggtaaaagacaagagtaaaaaaaattgacttcaaactttttttccagtgactggaagcatgacaataccaggtctgatagaatgagagagttgtagtaacagtctttgggaataaaaatcagtcagttgggcttaggatttagtgagattcaggaccacaggattctggatgtttttttgagtgcatgcaggtgctgttctgactcagactggacaactatccatccttctacaggagagagagaaatgacgtaagtgttcttcatggagtgccctctggaaaaccagggattggtttatgtgcacccaaatgtatttatgtatttcataatacccacaaatataattgttacttactaagcacttaatatgtatgaggtcttgtcctaaacatatctacagagaattttttgcccctttaatcctcataataatctaataacttaggtatcattaactccatttgacacattaggaaatttgtctaaactggttacataaatggcccaagatggcacaactagtaagtgaggagacgatcttaagaatctggttggtctgagttgcaacagtcaaatcatttccaaaagtcatatataaaaggaagtaatggcttttggacaaaccctgaaagaaagccaagcatcattctttctgtttctctctacaatatattcttcacggaacccgaatttcagataggcctttctgaagccagcactggcagtgccatatcccattactcccataacttctgctagctctttgttatgtccatagtactttctggaaagtgtaagagcaaaagaaagtacattcagttgtttaaaggcaagcagtagtagtagatactcatcagtcaagagcagatcaattttatgctgaaattttcatgcaatggttcaatagaaaactataaatactactaaatacataaatgttctgaggtaaatatatcctgtttaaccaaggcacaaaatcaataattaagtaaatgtgtccctaaaattgcttaaaattaaaaatccggaactggatggaggctgaagtgacttttgagaaactgatagagtctcctggatatatgataactttttaaaaatttgcacaagttgtgttttatgaacttaatacccataagacccctaaagctcattgtttatagaaaataaggctgaggatggataaaagtctcaggactttagagagtttagtaagagggcagcctttttttttctttctgactctgccttaactccaccagagatccctggttagccttgtttcctaaatagagctttgagattgattaattgacttatttattaataattttgaacttggggatttaagacatttgctgtttatgttgtgctttgccataatgacaaacaaaatcacattcagctattcaatggtatttagtgtaagaataaaatgttaagggtatattgtcttatctgatttgagacatatgatatttagatttttaaaagtacagtctattgaaaagtgatatcctttttcctgtaaaagaaactgcctcttttcctgtaaggctagggtcaggatcaagaccaaagaaaaatgaataacttgtgaatggtagggctaggtgtggattctgaagtaccagataagaagaaccattaaaacaaaaaggaaaacaatgagaaaaacaaaaagcaaaaccatgaggaaaacaaaatggaatataatacaaggaaaggaagaattttaagatgctttgtgtaccagtaagagaccactagcaatggtaactttgaggacagtggttctcatgactggaaagggtagaagacagacttcatggagattaaatagagaaagaatgagaggattcaaatacagaaaattctaacagctttgaaagcttttccattagaaaaggcagcaatgcatgtttttagagggttcaaactgagtacacacttaaaaacattgattttttaagaactaaaaaagaaaatatgaataataaacctaagacaataagtttgtaatttatgaagaataggtaaacaattggagatacaaagaagaaattatttctaatattatctaatctcagcttatgttaaagttaagatataaccagtgaaatattcactatatgaaaaaaataagaggaagctccctgcaaggtctgaaacaaaaatgacatatgtttgtaaatgcttagcaaaaaaaaaaactggtttttaaaaatctacatgaatgtttttaaaaatgaagtagttatgatcttcttaaaactgggaattcaatgtttgagtaattcatgtgtaaaatttgaatcatcgttagacattttattatactaaccaaacacttttaaaaaactatctttcataatgagaaaatttcaaatgtaaacataatttaactaatagctgaaaatgattgcagaaaatgtattcatttaaaggaaagtacttaattgtatttttgaaaagtaagtcagttgtttttctcatcattctgtatgagtgtgcatgtgtgtgtgagtgtgtgtgtatgtgtgtgtgtgagagagagagaaaaagagagcatttaagagaattgtttaagccctgggttgagggtggggcacttggggacacagtggagacagttatttacttaactgattcagtgcctcctactgttttattttgacaaaagtaaaaactttagtcctgtaacacgaatactcactctaagctgggaaacaaaacctcagccccataaatattttgtactacattatcaaaaatagctattattgaaaatgtgtgattctaattaacttacagaaattacacatataactgtagaagtaccatctaacaactgcattcattccaaaaattttttcaagctagatttgacagtcattcaaaccaggtgaaattcccaagtgtcccagaaaagaccaatttatctcttcttacttaattgtgaacaccatcaagacaagcatttacatcagtctctcttataccccaatgcatgatttaactgaaagaggaaggcaacaatatgttggaagaagcgtaagatgaatttttagatgcatcaagacctgaataaaacacggtctacttgcccttctatctagtcacgtggtcaaggacaatctgcttaacttttttggtcttagtcttcactatgtacttaaatcattgaagctcattgttcatttttctaacccttttaagcccatagattttatgactaaaataagtttacaataagcaaaccagaaaacccttattaaacagggttgtggagtaaagggagagctgagttctacccaaacagtatcctattcttattgcttactcctagccatggcctctgattaccttcctgggaacctctaacactccatggaacacagtttaaaaaccataccatggtatcatctcttagattgtcaccagctctaaaattcaggactctatggggacaaatctgaccctgagcctatctctttgcaaacaagctgaaatgagaagtttccatggttttatgcttacactcagtttcaggaagcccttctagggtaggactttcagagagtatgatatacacgtcttcagtgtgggtgaatgctgggatttgttttccaatttttactcactgtgatctgacaccaaacacaatgcagtcctgtcaggccctggtaacatttaacagttttgtggcacttatcacacttggttgggcagttaccttcaacccagtaatggtgcatgacctagaacagaatgacaacattgtgataagaggacacactacataatggccaccttcagaaagcaagcatgcacacaaacttacatcagtgttccttttggacttcacataggtcttgatgcaagagggaggtgctcgagccacacagcgctcatggactgtgtacttgcagactgaaaggaaacaggtacacaaattcagagctaatcctggtcctggttgtaattttatagagaaagaatgacattaacagaacctcatttcatatccactgctccctaatcaatccaatcagccacatcaaggagaagtccaagtcgactgtttttaccatggaatataaaaggccaattagtacaggaaatattatgcatgtgaaaaaccaaggctcctctatcatggcatagcaggaaatgcttaattaaatcagtcctcactcaaatttttcacaataattcccagatgacaaaaatattaaagacaaattgatgactgccaaatggcttggtgtcatttgctagaaggaagagatctatattttacaaagtataggcatgagagcagctggcgggtatgggaataaaagcccatgagtttatgttattttgtctcttatctaaatcttaaatggctgattagtctatttccagagaagagatttcatcatacatgccaggcctttggtgaaaattcatccttcacttgccatcatggcatcgtttgtccaaaagcaacagcctttgctgggcggcatattgtatacatatggaaaaatttatgtcactatgcaaatgtatacctacacataagcaaatatatgtatctatgtatatatataatacgtgtcagaaaaccaagacatacatttttggcatcttcaaattctttatggtttgagtctgaatatgatttagggtcaactacatgtgttcttttaataaaatgttggttccagattaagggttctaaatgcataaatatataaaacagtacttaaaaataaacatatagcctcctcaataaaaacaaaagcaaaaaactaaccactgcctcaaattaaaatgaaaaacactaaatctaaataatatttatatagtaaaactctcccaaaatattcatatctgtgattttctttggcaacattgagggagaaaacatgttttctcttctcctccgtattaaaaataatattgaatattgcattcaccacactaatcagtaaaaacttatgagcaaaattctcattcctcatataatatcactcatcttatttgagacttatcattttgttttatgtgttcttgttaacagactgtaccataaaaattccttttcttaaatataatagaactttaaaaacaaagtacttcctttgtatagggagaatgttctagtgtaactaacatgtaactaaactttcaaacgtagctgtcagagactatgttacacatggcaaatttcaggtaactttattaaaattcgtaaatagttcagaaatcatatgcatatgtggcattaaaacatggtattaaatttcaagtaacacagctgagagaaaggaaattctcaaacatattaccaaagaagctgctagctaacgacaaacaaacaaacaaacaaaaaacctataaaccatggatggtattggaagccagtaagaaattagatttaatgaaatgcacaacaatggaatgtatctaatgaacttgacagtttcagtaattctgtacaagctgaaaaggttggggagagataaattgatggattaatggagaacttaaatgaaggggttataatatctacccttttttatcaggactatcatggattgtaaaattttctcaggtagatatgctgtagatttaaaattacttaggtgattttataaactaactgttatatacactataagaacattctaattggcagacctgagttaacagaataaaatgaaaattgcaaagatgggtgaactgaaatttttaaaatggccacgactcattaatcatcaatgctctgcattccaatgtctattaaccatatatgaagattttctttctgttagcattgaaaataataggcttgaggtgtaaaattagttcgtatatcttgcgatttcctaattttaatgcaaatctatttttaatcaattaatgtaacttaaacaaaatacccaaaggaatcaactcattataagatgttcatgtgaataaagtcactaacatgtggggagggggggatgaatatgaataagatgtaagtatgaaaaactagtggaaatattcaaaataatccctgaagaaatgggaaacatgaataaattaaactacagtggaaagaaaattgctgaagacttggaaaatgtccttcatttttttccaacggtaggtttttccaaaactgaagaaattagagtaacctaaatattcaaaaacacactacaggaaaatataaatcacatgtacagagacagtccagatcagatcttaggtctccatttacaaataagactattccatgaaatcaacctttcctcacttgaggagatgatgtccaggcagagcaaatgtactcacaggaacagcagaggccctgcttccccacgccaatcagcatgttcaggcaaaggttgcaataggcaggtttgttaaagtgcttcagtcgccacacgtgctgtccatcatccttcacgttctgcatgggacgtaagagaaacagatttcacttaatgaaataaacagtgaaagatgtaagtgccaatgaaattcagagctggactgaagcatgtgaagacaatctgttatttcatccctgactttctccaagatcaccgcagagcctttagaaaaacacatgtgctccagtgaaatgagatagtgctaacaaatcaccgatgctatagcaacccacaaatccttgtctaatattaacagctcaacagcgtaccccaagccatcgtcatgacctgccaaatggatcagggacgtgattgcctcttctttaaatactttatccttagcacaattccataaacaaataaataaataaagagaaagagaaaatacccttcagtggaacagcctgacaaagaaaaacctgcaaagacgtcattaacccttgcttactagtagtaatatacaaaattcatgatggtgatcaggtcatgtaaggtggcagaggaatgggatgggatggaaaactaatactaaaaggtaagttattggtgacatactagggcttcattcgaggagtccttatactatattccaatttatattaatacattgagtatgccacaaatagtatattttaaaaggcaaactttttaaaggatttcattatgttaccattttgtttacccccttataaaatataagtagttttaatctcacagaaagatggtaaaaatattaaaactgtattaatatttttatttataacaatcactatggttatttgccacaatacaaccttgggtttaaattaattcccactttagcaaaacactttatttttttctcttctcagtaaaactctctatatcataatagctactcctgtaggtatttaatcacagctgcattgttcaagattaaaataaaatgaaataatatgatgcttaggaatttcttgaactccttacaagaaggtcaagatattaaatgaaattattatatattattacttttgctaccatcattttctccattaacatgtactgtttgtagtctaatcatcaaattatatcaaacagattaacatttattggtattctattgaaaacattatttgccataactttccaggttgtccaagttgtcatatttcttggaacacattcacctaataatttctgagcatgttttaagtgcttgggcattaacgttactcctgtggtagtgaggcaatataaatatattcagatcatcttgtttctcttgataataaaatattaataataatgctcctaactacctttcctattcccagtcaagggataaaccaccagatttgtaatactagagaaaatctacagtaactaattcttacattagaaccagaaatgtcaaatttgcctcacaacatgaaacattaatgaaatgcttcctgggcgataattcttggtgggtctcttgaatttcttcatgttttgcaaacagaagcactgtcctttctttttctttctttcttttttttcttcttaagactatcttttcaaagatgtttgagtaacaaacagcctagccttggacaatagagacatgtctccctccagaggagagggccagtttgcttactatacttacagtataataaaaataatcactcccttgtaggcaaaggtgaaatgggcttgtttcctacacattataattcatttagttttcttaagtcagggtttccaaaacgtgatgctgtgcacaatcatcaattgggtcccactctgtcgttcccatgagattttggaggcaaggtgaactcaaacgtgaagctcctgttgctctctttgttgtgaataacaaagtctattgtctctgactcaggagtctcatgtcctctggcagcatccataaaactgtggcaagctaatacattaacttccaatagggtaaattttggaccctttacaattcttgacattgctcagatttacctttctgacaaggggctaacaaagtctcaacaaatacagctacgcaggtgtcatacagaaaacttcagaaaacacaggtgttttaattttctttcaaaacctaagaaataggctttgtattaatttctgaatttcctattttggtttcggtgagtcatagatttctagtagctttatcacgtgaatagaatactttatatatttaactttgctatattttcaaaactgcctacattttaaaatttatatcccctcaaataatatttaaacatccttatgtggaaaggttaaatatggggttgttaatttttaaaaaactaaattaatatttaaaaaattaaaagtagtagctaagtgcttaaaaacatttttaaataaaaaggacaaaaagctaattttcgtatatattactgttcttgtaattcttgtcgttttatttttaaatgattgtccattacatgtgaataagcttcatcctttgaagagcacatatggagtaagttagctggcattttccttatcaaaaaataaacaagtctgaacgtgggtgttctgtcaatcagaacacttagccgtgttacaggctgcaactgatgtacaaatccattacccaggcataaaatgctttaccaaaaaacaaattaaatggctttatagctcttagctggatacattgccaaaatatgcaagggatgaaatatgtatgtgacttctttaagagaagaaattgaaaccaggagccaattacttctcagcagtgcaaattatactccaactctctattttcatgtcttgtcttgtttatcttacttagatcgtaaacttaatgggggagggaaagaatctgtcccttctttctatcagccagtagagcacattcctattagtccttccactgcaaatatatatttattgtcaaaaaagggaatttattttttataaaacaaaaataagcagggcatccagaaaggcttgattcctagcctactatgaaaatgtgaataagccatttcacctttcttcctatttcttcctattttcctctcgaatgaaaggaaaatacccacttcccttttccaggccgtggtgtgaggtttcattatacaacacctgtgaagttaatttggtttctcagaagacgggtgttatataaacagcaaatattatcaccctcattgggttgtgttgtgtaacatcccaatttttcagtcaaaataattgagaaagatacctaaaatttcactttatttcattaaaatgtgctcttttttcatcaccagacataacactgtgtattgtaatgaagctgttcaggtccgtgtttatgacagataaatgcttaatgaatcctaggctactccatgctgagaaggaactttacattttccccaactcttagttgcctacaaggcaaagggatgtttcaaaggaaataatgctcttcagaacttttaaaacctattatcctagtgattctaaagttttagtttttccataaataaaaatcattatcctagtgattctaaagttttagtttttccataaataaaaatctttatcctagtgattctaaagttttagtttttccataaatacttccaagatcacataaaatgttcaagtgaactagggctactataaataattttttttcagaagacctcaaggagaaatttcattgatgtcctaacccacatgcttctctccccacacctagttatgtttcaactgacttaacttatatagagagagagaggagctaatgttacaaataattacttccaactcattaaataacaaagaacattaaattaccttactttttgtccaaggtctccaaaaaaaaaattatgacaatgtgacagaaactcctcttatttttttttttttttttttttttttgagaggagtctcgctctgtcgcccaggctggagggcagtggcgcgatctcggctcactgcaagctccgcctcccgggttcgtgccattctcctgccttcacccactgcgcccggctaattttttgtatttttagtagagacggggtttcaccgtgttagccaggatggtatcacctgacctcgtgatccgcccgcctcggcctcccaaagtgctgggattacaggcgtgagccaccgcgcccggccgaaacttctcttttagacaaaaagatgagctctattaggcctgggcaaagagaatgcagagaaaagttttaaaattctgagtggagctgtcatcaactgttcatctccagaccacacattgtaaggtcacctgtcattcctgaggctcaaatgcaaaatcaacagcaggttacaccacgtagtcatttttcttaaatgacacaatctggaatctcaagaatttttgcattcatctagttttgtaactgctttctacattgagcaaagtatagacagcagaacaaaaactcttaaccaaattaaaaacttttaaaaatcgatgtgctgaacatcagctcccaaaatataatacatagtcttctattctccatcactcaggaatttcatcagagaacacactgcatattactttactgagagtcaagaaaaaaatgtgtcttaaacaatctcagtcaaaggcaaagtttaaatgacctataagaattgaagaccaggatttttggcacacatatagtgagaccaaagtataaaccatccagaaaccatgcaggctagatgtgggtacaacaatccacaataacaagttaaggtatcgctatttcaagctagtctactgcttaaatgtacatttctcttttccctataatataaattcaggaattttccttgaaaaaattaaatgacgatccaaagttagagatttcagaaattgaagccttattaattatcttgttcatgcaggaaaaggaaatgttcaaactgaaagagtattaggaaacactaacttctcttcttggctaacttctcgtttttccggagacagcaactgcctggtataaaaatgacctagttagttaataacagagctaaggtctgttatctgatcaatttgatgacgttcactgctcctatgctttctgtctattagtcctcatgtcttgctgtggttgtccgattgtgccaagtaaaaggtattagattcctttcttccaaatgaattaaaataaattaaaactttttctgttttttaatctgagaaatgagtgatagaacagatcagcggttggcaaactatggcactgagtcaaacctggccagcaacctgtttttgcacatgcagttttattaaaacatagcttttgtggttcatttacataatttctgcgattgcatttgtgctggaacagcagagtttagcagttaaggcggagaccttatggccccatagccaaaattacttaatatctctccctctgcagacagtttccaatcactggaacagagtttacctctatataaagttattcaacaaaaaaagtgttttaattacattggatttttttaaaaaacaattctccaatgagatgaattctgaaggaagaatgaataagtctcaggtataaattttcattgtggtaatcagaatcacaaagccatccaaattctcaattttccttcaaatctaagagacactaacactctataccatttctgacccattcatcttgtattttgtaaagtttgtagagcctcttgtaagagaaaagatatggctcttgctctctgctatttggtatagaatctggtccccatcaactccatttctgattttggtaccaaaatagatattctttaaaatagactagtttttaaactgctgttgctggagaaaaataaattgcattgaaatcgtaaatgttgtgccttacattagaagtgaagattactctcccaggactacttccttttctgtgtaatttgactaggacaccacagtcactttcaaatacactgtggtattttacatgcaccatcaattagaacctactccccgagctcataattgacaatagacaataacatataggacaacctaacaagacaagcttcacaacaaatggccaacttcaaactgcagtatctagattttcaattaaataagcaaaggtgaggggatagattcatggatcaaattctctacaggtaataatgtaacacattaactgcctacagaaaggaaataaatctcaattgctaaaaaaggttctcatcactcagttgtcttggtgtcattcttgctttttaaaacaattaccatgccttagaattcaacagctctttctaacaaatagatgctgtattttgtgatcattacacatgattatatggcttatacattttattaaaagacagcttaaaatgtaggtggcttacttttttcacaaaaatgaaagaaaagggaaatttcttcttttaaagttgttctttacagagatggggtggggggcggaatttagtctcagatttaaggtggtctcttgagattaaataaggtgcctctgccatctagcggccgtcactggtaacacaactctggaacacagctctgatagctataataaaaccttagatttctcctatttagctccagacactcccttttactaaaaacataaaaaataagtttacaaatactattaaaaagtaaattatgtacagttaatagagtgcacattaaatgcatagaattgccttacaattgaaataatactacactagaaactaatgaggtattatattggtttaaaatactttgagttaaatcatatagatttgtggactctattacctgtgataatttttataacttcacaaatatctatatttataaattaaataataaataatatatcagcagtagtttccaaaaaaaatcatcatttcaaaaaatctcttgtgacatttaaaatacgggcaactgactgtccctttctgcacttttctatctcaccctcgactaccagatgatttacttgctcattcctgcatcttccctccttctctcatcctagaatttacatagatgcttagaatatacaaagtttagctttacaaacataaaatgtccttctcgggaatcattattattggaatttcctgactaaagttatctgacaatttttcaggataaagtatacattaaaccttaaaatgtcaacattttgtcaatttttcttttgttttctcccagtagtctgatttacataatggtttttgtcataaggtacatgaacaattaaataaatattgataatatagagctaaatatggtattataaaaaaatactcagttatgtgtagtataagaaattcaggtacaagaaaatactatttcacaaaatttttaagtgtagaactacatacttattaacaataatatatatattatattttgtttaaataaattagtttaagggtaactttccatatatcacttattagtattttattgttttccatcctctgaccatgtcttggatcccatgggcctcatgaaaggtaagcttcaactgagtttagaagaaatttgaagacccaggtaaaaaagaaaacaaatagtaatctcttgaaacctattattttttcctaaacttatacatattccttaaccctcagctcatttgtatattcctaaagcccatttatatattcctaaacccatatgtgccaacatatttttatatatactcatatgtttcacaaacacagacagtaagttatcttgagaaatgacttttaaaaatttggtgtcttgaataactatgatatagtcttgaatctgtaaaaatatttcagctggtaataagaagtatgaagagttttgggtttggcagcaaagtggtgaatactatggtcttacaccttaaaactctaaatattacaatttcattgttctttccacccctaatgttctttgaaattaagtagacatgttattctatacatagtatatctaattattgcataactattaatgctgaatttaaaaatctggcatacactatagatttcatcagatttttagaataaaaataactgaaatctgcttcaagtctgggtcagcaagatttgctttcaaagtcattattatattacattctcatcttaggttgatttattttattccttcacaatggtatttaattgcaactagaggaactactccaagaaaacttttgacaggcgatagaataagaacctggctcctgctgatacaggaaaaacttacgtttatttaagttggtgcaaaagtcattgcgttttctgccattaaaggtaatggcagaaaacgcaatgacttttggcaccactaatctttaaaccactggagatatttaactgcctcctccaagtatcagttttcaataaaatagattacctttataggtaggaggaacattgaaataatgaagcaccaaaagaactgcaaaatacaataatactggagagcctcttgctttagataatatgaggaggtcagtaacttaaaaacactagattgcaccttcaacagaggaaaacaaaagagagagaatatatttttaatcctgaagtaatacctggagtgaatcaatatgtgtgtggcaagtattactacacaaggagttactgtcaaattgcaccgtggcatacttattaaaagttccaggcactcactgcatgcttaatggtagaaaatggtcacatcaatctgtaatcaaaatgtgtaatagagagccccactgactcaccaccaggccaccctcctctgtggaaatgcttacattttctaagcccaggagcacaagaagtggaatcgttgtcattcctccttgaatccattcctccagagacacggttccatcatgatcatagtcaatttcttccatcatttcatggaggatctggagtagaggagataagggaaaattggtggtcaaccaataaaataaatttcataggctacaacatatgaaattgtgactaacagctaagtggagagttgggataactgtcttgctaactcagtacaacattaattctattactgatgaagagcgactttgttagcatttctaaacctggccacttaacactgatcactttttagaaataagtgcttaacttttcaatatttttcccatgaacagcacagctaaaacaagaagaatctttaataagtgtgaaagtggtctttaattactttcttcatattattttttagattcatatatatgccagaaaatgtctgaacaaattaacttcatggcaaagagctcatataattctttgctaagtagtaaggggcgaaggaatttagttgcttttaattgcctatcagaatttaatagagtcgagaagttaaaggatcaaatcaagtttaattaaacttcgtttctaaagatgacttgcacgtaatgtcttaaaatgttctctgcagtgtttgtttgcaatacatttacctctctgtggtatggtggcaatatcagtacttacctagaagggctgttgtgaggattaaataagctaacgtattataagcagacgagcccctggcatacagagtcagagtcatatagtgttgtttgtgctattattaatggaaattatatataagttccaaacatattacccttggttgctgggaaagcaaagtacttcccatctaatggcgtcaagatggcaaacatggtaagaattctaatgaagaaaggaactcacgtctttatataatacaaaaatgttaatcaatttggaaaaaagagaaatgcagagagcattggaacagagattggaaaagatgcaatgcatgaaatatttgatttgttggtagaagtattgtctgcctagacactcttgtgcttggtgtcttcactcaggaagtattgtatttgaaaattagattatttttctcctcttgcctctcaagagcttgctgatgaattagtagaaatgtatcaatcataagagaaataaaacaatgacatttgtttcagatgggtgatgctttcctttttgtacctaataaatctcatgttaaagccatcctctgaccgtgtctcaaatcccatgggcctcataaaaaaataagattgaactgagtgtagagcctgagttaatttgataaaaacttctagggacgctccagtcttccctactactattgtaatcaacctcaaatgttcatttctctctctctctctctttttttttttttttttttttttgagatggagtctcactctgtcgcccaggctggagtgctgtggcgcaatctgggctcatagcaagctccgcctcctgggttcacgccattctcctgcctcagcctcccgagtagctgggactacaggcgtccgccactacgcccggctgattttttttgtgtgtgtatttttagtagacacagggtttcaccatgttagccaggttggcctcaatctcctgacctcatgatccacctgcctcggcctcccaaagtgctcggattacaggcttgagccaccgagcccggcccatttctctttatttatatatgcaaacctatgagaagcctgctgatgtgtacatttgtttacaatgagaactactgaagccttaggcaagatgacaaggcagttcccatgacagcagacataatgtacaactttgtaccatttcagctccctggaatagtagcagacttatcagtaacacacatgtcaaataatgctatagtttattacttgtattctccattcaataatctgacaaatacactaggtatttgttgtagaaagactactcagccaccagctttccccttcctcctagcatcctgatgtcctttttctcaaatctacaaacacaccccccaacacacacaccaaaaatgcttttgttgagaagtgttagtgcccgctgtttagaaacctgaatggaggccgggcgcggtggctcacgcctgtaatcccagcactttgggaggccgaggcgggtggatcaggaggtcaggagatcgagaccatcctggctaacacggtgaaaccccgtctctactaaaaatacaaaaaaaattagccgggcgcggtggcgggcgcctgtagtcccagctactcgggaggctgaggcaggagaatggagtgaacccgggaggcggagcttgcagtgagccgagattgcgccactgcagtccgcagtccggcctgggcgacagagcgagactccgtctcaaaaaaaaaaaaaaaaaaaaaaaaaaaaaaaagaaacctgaatggaaaaacaaatccccctcccactctccatctaataacaagctggcttgattgacagatgactaatctgcacaggtagaaaggtgagtaggagaggagaaagctgttgtcgattacaagggcaacagaaataatcagaaattcctggctttcagtgaaaatattaaggtgagtcaaacaataaattaaatacatgttaccatctactttattattccacatacaaatgacaacctgttaatgacatctgccactcactagaagcacagcatatgcatttcccaatagctgctttaaaactggaaaaatcctaatcccagtaagacaggaaaatgctatcagagttcttgcagcatatactcatgccattatcctgttgtttaccgcatagatgtgaacagaggttaaatatacacttcttgaatttgcataaaatgtaaaatcatttaaataaaatttatttgcattgctttattcatatacactttgctaaaggttttaaaaataatataaactcaatatctcttatcaactttccccaaaatattttttgtggccaaagttatggtttcaagtcaagtatattttaatatgtattttaataatgttgaaattttgatgtttattcaaaataagaattctatattcttaaaagcatttttagatactctttctctaaacaatttaattaaaaattcctgactagctgaagagctttgggcaagtaattttaacatatttgggtctcaatttacttctctgcaaaagggaaaaaaaatagtgtatctacctcagagagttgaaagcaatatataacatatacacaaggtaacatgatgcactgtgcatggaaaactaccatcttcttttatggcatggcatggccttggcagtgtctatcaggaccttctgcttatccacatgtatgtaagaccaccattcaaaataacttccacgaggaagaaagcaaaagttactgttaacagcttcagaaccccacatataccttgttatcttattcagaatccactttgacttctgattagaaatagtaacttagttatcaaaagataaaatgaaatgacaggaatatatcagggtcccagacaagagaaaaaaaaagaaaaagaaagaaaagaaaaggaaggaaggaaggaaggaaggaaagaaagaaaaggaaggaaggaaagaaagaaggaggaaagaaagaaagaaagaaagaaagaaacaaagagaaagaaagaaaggaaggaaggaagaaagagaaagaaaggaaaggagagagagagaaggaaggaagggagagagagaaggaaggaaggaaggtaggagggagggaggggagaaagaaagagaaagagagaaggaaggaagagagagaaagaaagagggagagaaacagaaagggagatagaaggaaggaaagaaagaaagaaagagagagagaaagaaaaaaagaaagaaagaaagaaagagaaagaaagaaagaaagaaaagaaagaaagaggccttccagaatttagccaatagtgaaatcattcatatacctactggattaagttcagtgacatcccactcaaggtattctgcaacatgcatcatctgactgatgatattttctagctcctggaagagaaagagagataaaaaatatgaatacaagatcttagtgagttttaaatctttcacttgcagaaattgttttgttcaatgtgtagctaaaaaagttaaatgagttctatgggaatatatatatgtacataatcctttttaaaggtctaattaactatataaagaaaaaagaatcctgaatataaatttatcttgtacattgtctagaaattttcaccaggagagggcacaactttacaaaaaatacattttcttctactaaaagagagtgtctgaagaaagcaggaccaaatacatactgtcacatgtgatttttaagacactgaattccctgaacctttggcttgaaaatagatgtgaaagggtggacaaatcatttgaggacaactgagaagtctatttttatcttgatacactgagaatatacattgactgttttagtcatgtattgaataatttgctcttgaaagaagagtgttcagggccaaggtttgcaggacaagtatatgcagcatttattttgtgagaggatgaaattttagtttgaatttccatattattctgctcaattatcaactctttgaagaattgcaagttaatacagatgacctggctaaattaattaaaacattttcctgcctatttatctaatgttttaatttttctctacctacagaaaagattaaacatggctttgtgaaatgcttgtaatttcacatgaaaacattacataatttgaaaagtggtgttttaccgtatgatttaaaatgtaagaagtataaaagaataaagcttgaaagtgcaatagtcaaagagtattctactcaaatctctaatctaatatatgtagtcgatgttcatggaatagagaagaaatacgataaaacagattctcttttgggaagccgtgtttccctccgaggaactaatgaaagctatactccctctctccagaaaaaaaaaatataattatgaatatgttacttaagtaagacaggctgccccagaagtaatacaaagataaatgtatttattacagattaacaaattttaaaacataaatccctttgaattataggttaaaagtgtgcatgtgtatgcacacatgcattactaatctctcacctactccatctttgcttacatatgccttaatggtttggaagtgttaaagttcccggatatcttttaagaacagaaactatttttggtggactgttacgtaggcatgtgatattaggtaagccaccccacctaagactcagttttctcgttggtaaaatagctactctaactttacctccttcatagaattgcttcaaaggttaaacatgttattatacaaaaggcatttattttgttgtttgccgtattgcaaatgatcaacaaatcttaactattattattagaaatagtggacaattttcaaattatcattttctttctgttttgcctccagtaggtgaactgctacaccttaaaggtaccaagacacatgatgtcagaaggtacaatttaaacctgacagcgaaggaaaaatattggagtagtagctattgtggagaaaaccctagaaatgaaatccaggcctttaattacaaaaaaatagagactagtttaatcaaaactaaatatatttatccccaactcattgtttaatattgggactatagttctaaatattgctagtagtctactgtatatgctaacaaaaaatgggcagagacaaaaaaaaaaaggactatttgactgaattttcaaatcaactgccaacccatggctaaagcctagtaaagaatcatcattttaatttaattaaaaaagaaacattaaataaaacaactctccttgaaaatagaatttgcattagtgtagtcacaagtgctatactaagcatattaaagtatctagaagaaattaaaatttctagtcgtgaaatggcaccataaaatgagcaaatttattatgtagcttggtatttctaatgggaaactgaagaccactaggcacttaaaaataatagcatttgaaaaaaaatttttttttttttttttttgagatggagtcttgctctctcgcccaggctggagtgcagtggcacgatctcggctcactgcaacctccgcctcccgggttcaagcggttctcctgcctcagcctcccaagtagctgggattacaggtgcccactaccacgcctcgataatttttgtatttttagtagagacggggtttcaccatgttggccagctggtctcaaactcctgacttcaggtgatcgcctgcccgtcttggcatcccaaaatgctgggattacaggcataagccaccacacccagccagcatttgaaaaattactgagacttacagataataaatcccacaatcacagcatcaattcagagtgatggtcatttcctagagtaggagttatatattttaatctctctctggagaagctaatgtaccattatcctactcaaagttacataaataggcttccaacctcattgctttgcttttaaaagtctattttagctgccatagggtggtctatcagatgacgagaaaaactcactcattttcagagatcatgtctatttcagtcattattaaatatatcaaaacatttgtttttaataatattaaatacattaaaaatggtacacttcaaaatttccaaatgacacttattctattaatattcttatatttccttgatagaacaagaaataatataatatgcaaaatatgttaccaaacataaggtagattattggatagaacctgagatggaatttcatgcatggtactgatctgtgcactaagactaagaactactttctatttctctgaaagctagcaatgatttccatatattacaaataaacgtttaattattcccttcagttaatcatataaagatggtattttcttattttttatgactataactatacaatgtaaaatgaatattaaactggatgagatattttaaaagcaaagtttgtgaaagcaatctgtaaatacatttacctatttcagccgcatataggacaaaagataccatgtaaaactgggaaaataatgagataattaaactgactttatacatccttaaaattctacttatagtctcaagtttccttaatgccaaatgttacagatagtttttccctcattctaaatcaatggtttcaacttaatcttatgttttattcagacaaggctggtgcctttcttttttttacctaacttcagtgcaggaaaaataaaattaaaaaagtcatgctgtggtatgcaaaactattcagtagaacaattgtaatcccaacagtttcctcagatcactctctcgcaaaaagtcaaaaagataaaaatgccatatgagtggatgtaaattacattaagtgtgccttctgtggtaataactacaaatttattcattgcattcttcagaagaaaatctttgaagttttcacagaaactttgaagaaaaaaattaccgagctgtccaggaagccattcccatccgtgtcataaaggcgaaacataactagaatgaaagaggtgttgaaaacaagattataggcaaataagatcaatgttagtttaaagtatattcattaaaatttagtttgtgttgaaaacaaatactaaattcctctcctgctccaaacaattaatttgtgggattatttctcaaactaaattgaaaatgaattaattagttaatagaaatactggatagcataaagtctatcaaattttgtttgtttctagaagacactaaaaagtactattatttgtttaaactctttattacaagatcattaaatgtcaactcaaaactaaaagagaagaagttgaaatattcaaagcctgggtattaaagagcagagtgcataaggaaaaacaacaaatgtgaaatttagaaatcaactataatttgaaatccactattcacaattataagagcttggtcaaaaacttttctttatctgtaaagtgagaataatcattctaccataacacatattaactgtgaaagttaagggaggtgatagacacaaaagtgaatgtaagccatagatcatgatacaaatagatgccattgttaggattgatccccaagcagtatgggcgaggaaggcggagtgcaaaataacaggttctttctgatggaggaagccagcacagaaaaactgcattatgatcatggctctcatggtttatttgtttaaatctgaggtggagcttcagagggtaactgatgtttgaactaatcaagtaagggaaaggagaacattgggtctctgttagggggttcaggaaagcagatgacagaggtccctgatgggcctgaggattcccttgtataattcacacatccccaggaggctgtggaggaggccacaggtgccattttgagataaatagagaagacagacacagctgtaaaaatagaagaatggaagtacgggtttgtcttgggtttgtataatttcctgaatgatcttgatgtctgaagtctataatattaataaagatgttgattactaagcagcataattatataatgaccctgatggtctatttgtaggtgattatttttgtatttaatggttactgcatttcaccaattctaacatattattattaataagatgcataattagtctatatattgctaaaaagaaaaaaagttagccatgtcactataatattatatttattgtaagaggcaaacaaatgttaaagatgttaaagtgtaagaaaacaaatgtctgtctattgacttaagggcaataatactaaactggctaaaagacttaaatatctgtattgtaaatcatggtaatgattccttctcatacagtcaataaataaaatgcagaaggaaacagcaacttacaacattgtggatactaggcatttcaagagattgtagtgcagcagcaaatagtgaaaaatatctttgtaagtggcaagaattgacggactactcagagaaatgattaactaccaggaataaggcaaatatctagaaaagcctaaatatatttcagattgagggacatttataactctgttaacccttactggagtaaatgactgcaaaatgaccatttcacgtcgctcaaatttgtggaaaccctgttctgatttgttgaccttaatgggaacatgaactcaaagaaacacacatgggtaggatatatatagataatgggcattcattactgacagtgtctgaaacttcttcctattttctgaaaatcacactttatgaagagcattagaaaatgaaaactctagataccttttctttactagcctgacttgaagctagactgtgtgcatggcccaggctccaccacacagaagcacagtcccaggttatcaatcagatgctagtgacctaagcaaaagaagcttgcacagaatcccttctggtgatgggaggcggcagtgatttcagagagaatatccagggttctggatgagtcaggggtgtttcgaggcaaccatcccagcccaatttaatacttcatttggtcatcgttcctgaaaaggcagcctctagaatttgttctctacctctcccagtgattctgcatgctcctaaatatcgcttaaaaataataacatgctttattaaaaacaaccagttgaaataaacccgtttctatgtctttcccaaggatagtgtgtacttaacgttggttttaaaaatgaacttactattgtaatattacacttacagataaacgtattatttaacaccttattaaagtgtacacaccaatgtaactattacctctaaatcgaaaaatagaattcttactaacaaatcagaacccctttcatcctcccccatcattattttttcttctctctccaaagacacccattatcttgacttctacatcttttcttttgaattgaattgaatataacatttagaaaatgtttgccggccgggcgcggtggcttatgcctgtaatcccaccactttgggaagccgaggcaggtggatcacgaggtcaggagatcgagaccatcctgtctaacacggtgaaaccccgtctctactaaaaatacaaaaaaaaaaaaaaaaaaattagccgggtgtggtggcaggtgcctgtagtcccagctacgcgggaggctgaggcaggagaatggcgcgaaccagggaggcggagcttgcagtgagccgagatcacgccactgcactccagcctgggcgacagagcgagactccatctcaaaaaaaaaaaaaaaaagaaaaaagaaaaaaagggggaggagccaagatggccgaataggaacagctccggtctacagctcccagcgagaccgacgcagaagacgggtgatttctgcatttccatctgagctttgaagggagcagtggttctcccagcacgcagctgaagatctgagaaccggcagactgcctcttcaagtgggtccctaacccctgacccctgagcagcctaactgggaggcaccctccagcaggggcacactgacacctcacacggcagggtattccaatagacctgcagctgagggtcctgtctgttagaaggaaaactaacaaacagaaaggacatccacaccaaaaacccatctgtacatcaccatcatcaaacaccaaaagtagataaaaccacaaagatggggaaaaaacagaacagaaaaactggaagctctaaaaatcagagcgcctctcctcctccaaaggaacgcagctcctcaccagcaacggaacaaagctggatggagaatgactttgacgagctgagagaagaaggcttcagacgatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctcgagagctacgtgaagaatgcagaagcctcaggagccgatgcgatcaactggaaaaagggtgtcagcaatggaagatgaaatgaatgaaatgaagcgagaagggaagtttagagaaaaaagaataaaaagaaatgagcaaagcctccaagaaatatgggactatgtgaaaagaccaaatctacgtctgattggtgtacctgaaagtgatggggagaatggaaccaagttggaaaacactctgcaggatattatccaggagaacttccccaatctagcaaggcaggccaacgttcagattcaggaaatacagagaacgccacaaagatactcgagaagagcaactccaagacacataattgtcagattcaccaaagttgaaatgaaggaaaaaatgttaagggcagccagagagaaaggtcgggttcccctcaaagggaagcccatcagactaacagcggatctctcggcagaaaccccacaagccagaagagagtgggggccaatattcaacattcttaaagaaaagaattttcaacccagaatttcatatccagccaaactaagcttcataagtgaaggagaaataaaatactttacagacaagcaaatgctaagagattttgtcaccaccagacctgccctaaaagagctcctgaaggaagcgctaaatatggaaaggaacaaccagtaccagccactgcaaaatcatgccaaaatgtaaagaccatcgagactaggaagaaactgcatcaaataacgagcaaaatcaccagctaacatcatgatgacaggatcaaattcacacataacaatattaactttaaatgtaaacggactaaatgctccaattaaaagacacagactggcaaattggataaagagtcaagacccatcagtgtgctgtattcaggaaacccatctcacgtgcagagacacacataggctcaaaataaaaggatggaggaagatctaccaagcaaatggaaaacaaaaaaaggcaggggttgcaatcctagtctctgataaaacagactttaaaccaacaaagatcaaaagagacaaagaaggccattacataatggtaaagggatcaattcaacaagaagagctaactatcctaaatatacatgcacccaatacaggagcacccagattcataaagcaagtcctgagtgacctacaaagagacttagactcccacacaataataatgggagactttaacaccccactgtcaacattagacagatcaacgagacagaaagtcaacaaggatacccaggaattgaactcagctctgcaccaagaggacctaatacacatctacagaactctccaccccaaatcaacagaatatacatttttttcagcaccacaccacacctattccaaaattgaccacatacttggaagtaaagctctcctcagcaaatgtaaaagaacagaaattataacaaactatctctcagaccacagtgcaatcaaactagaactcaggattaagaatctcactcaaagccgctcaactacatggaaactgaacaacctgctcctgaatgactactgggtacataacgaaatgaaggcagaaataaagatgttctttgaaaccaacgagaacaaagacacaacataccagaatctctgggacgcattcaaagcagtgtgtagagggaaatttatagcactaaatgcccacaagagaaagcaggaaagatccaaaattgacagcctaacatcacaattaaaagaactagaaaagcaagagcaaacacattcaaaagctagcagaaggcaagaaataactaaaatcagagcagaactgaaggaaatagagacacaaaaaacccttcaaaaagtcaatgaatccaggagctggttttttgaaaggatcaacaaaattgacagaccgctagcaagactaataaagaaaaaaagagagaagaatcaaatagacgcaataaaaaatgataaaggggatatcaccaccgattccacagaaatacaaactaccatcagagaatactacaaacacctctatgcaaataaactagaaaatctagaagaaatggataaattcctcgacacatacactctcccaagactaaaccaggaagaagttgaatctcttaatagaccaataacaggagctgaaattgtggcaataatcaatagtttaccaaccaaaaagagtccagggccagatggattcacagccgaattctaccagaggtacaaggaggaactggtaccattccttctgaaactattccaatcaatagaaaaagagggaatcctccctaactcatttgatgaggccagcatcattctgataccaaagccgggcagagacacaaccaaacaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatacgcaaatcaataaatgtaatccagcatataaacagagccaaagacaaaaaccacatgattatctcaatagatgcagaaaaagcctttgacaaaattcaacaacccttcatgctaaaaactctcaataaattaggtatcgatgggacgtatttcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaattaggaaaagaggaagtcaaattgtccctgtttgcagacgacatgattgtatatctagaaaaccccattgtctcagcccaaaatctccttaagctgataagcaacttcagcaaagtctcaggatacaaaatcaatgtacaaaaatcacaagcattcttatacaccaacaacagacagagagccaaatcatgagtgaactcccattcacaactgcttcaaagagaataaaatacctaggaatccaccttacaagggatgtgaaggacctcttcaaggagaactacaaaccactgctcaaggaaataaaagaggatacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaagagagacggcatcgccaagtgaatcctaagccaaaagaacaaagctggaggcatcacactacctgacttcaaactatactacaaggctacagtaaccaaaacagcatggtactggtaccaaaacagagatataaatcaatggaacagaacagagccctcagaaataacgccgcatacctacaactgtctgatctttgacaaacctgagaaaaacaagaaatggggaaaggattccctatttaataaatggtgctgggaaaactggctagccatacgtagaaagctgaaactggatcccttccttacaccttatacaaaaatcaattcaagatggattaaagatttaaacgttagacctaaaaccataaaaaccctaaaagaaaacctaggctttaccattcgggacataggcatgggcaaggacttcatgtccaaaacaccaaaagcaatggcaacaaaagccaaaattgacaaatcggatctaattaaactaaagagcttctgcacagcaaaagaaactaccatcagagtgaacaggcaacctacaaaatgggagaagattttcgcaacctactcatctgacaaagggctaatatccagaatctacaatgaactcaaacaaatttacaagaaaaaatcaaacaaccccatcaaaaagtgggcgaaggacatgaacagacacttctcaaaagaagacatttatgcagccaacaggcacatgaaaaaatgctcatcatcactggccatcagagaaatgcaaatcaaaaccactatgagataccatctcacaccagttagaatggcagtcattaaaaagtcaggaaacaacaggtgctggagaggatgtggagaaataggaacacttttacactgttggtgggactgtgaactagttcaaccattgtggaagtcagtgtggcgattcctcagggatctagaactggaaataccatttgacccagccatcccattactgggtatatacccaaatgactataaatcatgctgctataaagacacatgcacacgtatgtttattgcggcattattcacaatagcaaagacttggaaccaacccaaatgtccaacaatgatagactggattaagaaaatgtggcacatatacaccatggaacactatgcagccataaaaaatgatgagttcatgtcctttgtagggacatggatgaaattggaaatcatcattctcagtaaactatcgcaagaacaaaaaaccaaacaccgcatattctcactcagaggtgggaattgaacaatgagatcacatggacacaggaaggggaatatcacactctggggactgtggtggggtggggggaggggagagggatagcattgggagatatacctaatgctagatgaggagttagtgggtgcagcgcaccagcatggcacatgtatacatatgtaactaacctgcacaatgtgcacatgtaccctaaaacttaaagtataattaaaaaaaaaaaagaaaagaaaagaaaaaaaaaagaaaatgtttgccaatcttttcttctcctattacaaaacaaaatgaaaaacaaaccaaaataacactgctggatttctaatgagattgtactgaacctatagatctgtttgggggagaatctttaaaatgctgagtcttgaaatctacaaccatattatattcttctttatttagagctttaatttctctcaataatatttcatattgttctgtatagagacctttcaaatagtttttaaagatttatttccaggtatttaaaaattttgatttgataaatggtaaaatttcttaaattttatttacctattattagttgatgtcatacagaaatacaagtgatttttatttctaccttgtaggcatagatcttgctaaacacacttattaattcaagtacttgatctatctatagattactgggtagtctataataaacaatgaatttcaatttcttctttcccattctcataaacttcatggatttttcttgccttattgccatgagcaatgatctccaacagaaagttgaactatacttagagtagtggccattcttgtcttgttcccaatatcaatgagagaaacttcaatatttcactcttaaatataaagtttgatgggtgtttcttatatatacacattattagattaatggagttctatactacttttatttcgctaagaatttttgctattacagttgttttgtttttaatcatgaatagaatgcatatggaatgtgataaaatacttttatgattttcttctttattctcttaatgtggcataatacattgtttcattttctaaagttaagtcaaatttaaatgcctgtaataatcccaaattgaacctggacatgttattttagctactttacatatataactgtacttgattgctaatatcttgtttcctttctgcttgttatctggaaaaatatatgaatggcttgtactttaatttctttaattaaatggaaaaagccatgcttccttctcccaaatatttgccctaaaaatccaagttgctttgatacttccctgaaaattttgaacaggtttttaaaatacacattcgttccaaattttccagttgattccagtaggaaggttggtctgaaaatccctacttcactagtgactgaagaaactaatattttaaataatttattcctaaacacattaacaagagttaatgctctataaatcctgtctaattcatcaaggaagaaagtttggagagttttaagctctagttaatataataacaataataaaaatatcatacatatattgagtaccaagtaccatatactctaaatattaccaagtcaaggtcaaggatagaacttttctttcatccagaagaagaaagagaaattcaaggactttaattttcagtgataagtctacttttctaatttaaaattgtagctaggtaatgcaaaacatgaagtattgaacacacatatttaccttggttttctattgaagtaccactatagtaacagtaagagatgaaataggtataaatctataagcagaaataaaatatgagaggagaaaacactaacacaattttcaggagctggagaaaatatgtacacatgtatattgacttagaggtcttagaaatataaatgtaagctggcagaggagaagaagcatagatttgcttagaaagggtggtgagttggaaaattaacagattatcttcacaggatgatctctggggagtatgtaagctctcttccccaacagaagactagatctttgagttctgcaaaagtgaaatgaaaggaattctgggctaaaggtactcaggaattctgagtataaggatacaataccaaaacaaggtaattatgtgaaagcgaatataccgaatattgagagaataagtccttttccttatccccagtaagtcaataccatccgtatggatactcacctatacaactactaccatcagaaaagttctttcaacacaagtagtttggaagaaaacaacaaagcagggaggaggggaaaccttataactaaaaggaaagtttcaatccatgaaatacaaataggaacacataaggatcaagctgagaataaaatggattctctgtgaagttaaatgtaaggaaaaagtgggaaaaatctcatcaccaggtataaaagatgtcccagatatggagtgaaaaacataagaagaaagaaaagaagatggaaaatagaaaaagcaagaaaaaatagtaattcagagttctgtcttggatgttcagcatccaaataatattggttctagaaagagaacaactaaaataaagggtgaaagtgattatcaatgaaaatattcaagaacaaatgaagaacgcaagtttatgaacataaatttatggtggagaatttgggaattgattagttatagaaatagagaaaatgaggcgggcggatatttgaggtcaggagttcaagagcagcctgaccaacatggtgaaaccccatctctactaaaatacaaaaattagccaggcatagtgacacatgcctgtaatcccagctactagggaggctgaggcaggagaatcacttgaacccaggaggcagaggttgcagggagccaagactgtgccactgcactccagcctgggaaacagagtgagactgtgtctcaaaataaataaataaataaatagaaagaaaaataattaagtaagaaaaaaggcaattattaactccatggaaaataaaagttgtttggcctggtgagcctataaaacctttctcttttaaaactatatttaaaaataatatagacattattaatattgaattttcaaattatatagtaagactatttcttagtattcaaaagtaaagtcaggcccaaaggtcaagggaatcactgaacaaaaggatcatatttttaaaaacaaaataaatatatagctgtttggctgcaaaaatttaaaaagcccaatgttaaaattattctgacaacacgacagcttccaaatatgggtatacctgcttcaatgttataaactagtttaacccacattttttcctatttttatgctcatgtcatttcactttatatagaaacaattatgcccacacacgtatttagttaaaagatcagagcaaaggcatattatgcaagataattttttatatccaaattttttttccttccaaaagatttgcaagtttctatctgttttcataatgaatatatcctactatacacactctggtgttttgcacttgccattatgtgttgttgatatgagcattatatgatatatgttattaatataaacaatgtaaaatatatttagaaaaggcacttaagctggaatttctttaattcacttttttccactcttgtatattttgatactgatttaataaactttaaaagcagaggtgaaaaaaatcagctgcttaggtgtgtttgacatccagtttaatggagagagattttcgccttttattcataagagaaacaacaataagaacaacaaaagacagcttttcaaaataaaaagagccctataaagtagctcagaaattatggattttagtaatagctagataaactggtggtgtaattaataaccaccctctcttggtctttttttttttttcattgtcaaactataggaaagttgactagatggtctttaaggtctcttcattattaaatctcatagtttctaaggttaatactgcacagggaagtaacttttaacatgtagcttactattcagtctccatatgtcagttatctactttctgaatattgattccctattgattttctctttagtgatacattttaaggaaatgtaagataatataaaaaattcttgttaaataattgataacttgataagcacaaattcaaaagtgaatatcatgtattttaaagtcaaaaatataaagttagtattattcaatatcttaaatagttgatgttatttttatattttcaagcactcattgactttatttttacccattgactttaatacacttccatttaactatcatttattgagcatatacctgttgaaacacacacacacacacacacacacacacacacactgatgtaggtgcaagggtacaaaagagagcaaaataaatccaattaggagatggcaagaagattcatgatgcagggtaagcctcaaatgtggactagactcaatcaaatatacactgtggggaggcagggggttgaaacccagcaattgcacattgtaatcaaagggatcaaagtggaaaagttcagggtttgtctgatgatagaaaagttaacccttgtgactaggacatggtttgtgcatatgtgtgcaggtcacagccaaagcaagcctggcagagtaggttggggtcaaactgtggagtcagatcggtgtatgcacgccaagttaagggtttcaattttacgcattatgaaatcaggaactatcaaaggggatttttcactctgaatcagaagagaaacagaaaaaaaataagtatgttagttgataaggttttaagtaagatgaaaggaagttgcaagaacatacacttaatgagtaagatgatgattaaataggtaggtgtttggaaaaaaaaacattatctggattaatttttaactagaaaactagacaagagaaacactgagcactgaaggccagctgaggttttgagtagagctataacccaaagaattatatttttatttcactaagtctctgccactcagtatagtataggagcaaataagttgaatgtctgaaattaagtgtgaaaaactaattgacatcatggattatgagatcagtttaaatttgaaaggatgggcaaccaaaagtcagcaagcaaattcaagagggagtaaagtgggcaagagtaaaacagttttaatttacttttatttcacctaacatgcatttatgggaagtaataagtgtgaaggaatgtatgtgaacaaatactagtttaatctaatcctcatagttatcccatgggacagagactatttaatgatctcaattttacagttgagaaaactgagtcctgaggaagttttaaaaatgaactcagatcactgagacagtgaattctcaacctagggtttgcattcaatcattataaatcaagagtcaaggtttttaattattgtactatgcaataattaaattaaaagtaggaaagtgagaagttaagtgaacataggctgggatcaaagtaaaattgacagtttagttttggaataatagcagttctcgacagttacaaggcttggagtattgtaacagaagtgaatggctgaaagaaaatggaggcaaagccacaggatttgagggtaaaagagaggttgttgactttccctaaagtactatggagcacttgaagttagaagggcaaatcagccctgagaccatgtccttgttcattcacagaggctgttggtaattggtaccaacaaggagagataaaaatggaattccccacaaccccaacacacacaggcacacatgcacgtatgcatgcatgcaaaagcacacatccaagggtaacaaacaccttctacctgatagagccttgggacgggaaggtcctcagagagaagaattaggattgcataaaggaaataaagctgaagacatggcttatatggtaagtcctcaatatgattgctagatactgggaaactgtgacttcaagcaaaacaatgtacagagggttctcgaataacaccctttccttctatgacattttgttataacattgataagcaaaaagtggttttgttatatacatttctcaacttcaagtcacagcttccaaaaccctattgaggatgttaagtgaggacttcctgtaatcagtaaaacatttgggaacttttgtttgttattctttaacggaataagctttataataaacatggtgtaaatacctggcagaaaagacaggcaatggaaagtggcgggaggcactgaatagattttaaaaatatttggggaaacaaagtattacttatataaacattgacaacagtgtaattcgtttatctaataacccaggtaaaatacctaacaaatactgccactattcatcaactccaggaaaaacaactgttgtgtcaggtgaattccttgtgtatatgtgttttcactggacagaaggaattgcataagccagtgcttctcaaaatgtgatccctagaacaatagcatccgcatcacctggaaacttgttagaaatgcacattttcagatcccaccccaggccagctgaatcagatataccagtcctgcaggtgactctgatgtgtgataaagtttgagaacctctaacctaaatcaaatttctttctgcttagctaccctggaagtatgagccaaattcaacattgacctgcaaaagttaattttaggtacttgttcacatctgtttctgtgttaattataattgctttttcttattttcattcttctggtctatattgtatttagtaaattgtaatccttttggagtatttattaaactaacaatcaacacaaatttttgaagtcttactgacaatttgtttttaaaaatctgtaactgtaaaataatacatgttagtaacttttacatatgcaattttagaagggtaaacatatgtggtaaattgttaagaaagtggatgaggaagattgattgttatttaattgacacaggaaagagccaggcattggcattaaaaaagaaaaagaaagaaaaccaaacttcggatgattctgatgtatagccagggtaagaatcaccagattagaagataggagaaaagagacctacggcatcatgtattttgaagagtttggtgaaaatgatagtgataattctgggccataacaagactgcctataagaagagtctgaagaaatggtttaaaacaaaaggaaaaggcaatgcatctagtgtaagcttgaaaaaaagctgggaaactcaaagaaaaaaacagagagaagggggttgagaacactaaagaaaagtaaatggcaggtcagtggatgagattcatcatgtctttttgaatagtgtggtgagtcaacattctatctgcaactgtagacaaaatctatgtgggttcaaggatgcacatggaaaactcaaaagcattcttcttaggaattccacctaaaaagcaatatacatccagctgacctagaaatagttaaacagcaagactaaataccatcttggggaggatggatggggcctttattcattttcagatgtggaaaaaatgtttgtctttatatgtttataatcatcccaaatgtgctcctgataacacctgagcaaactttctctctggctgtcacttcaatagaaattcactgaacattaatatttactttggaatgagacagatttctgtaagttcttaggaatacaaaataaatcttgaaatgcaaatattgaacatttatgaataataaatatatatttaaagatgatattcatatggtttattcataacctaagcatgtgtgactcttaaataatcacattacagtaaatcctttatgggaagaagaaatattatcaaaaagttactactaaatttaactaaaaatgccccccaataataattctgagacgtcatgattatttacatttgcttcagaagtgttaaagtttagatttgttatcttcactatcattctagtagcaagcatttttcattaaatttaccatatcttatataatcaaatttatcaggttattgagtaagctgccaggactatatttagaaagaacctcagagatagaatagatgatcaaatgatcaggtttagagtaaatgcttgaaaaatattttcttatattgcaatgagtatagttagccaccagagagagctcagtcactatgttttattaaagacagtaattatttactttcaactgaatagaaattctctatccgccatgtcctaaatttaagaaacaaagctattgtttaatgatttataatatccagaatcaaatactataaatgacactttcaggtttagcatttgaggaataatgtgtctctgccaacaagagtgttagtgctgaagattgcaagggagatttccactggggaaaaggtgcaggttgcatatttacaggcaattttcttactcactaatgggaaggtttcttcacacactagaaatacatgctttatgaaaacaacacaaaggctattttctaatagcatcttgttaactccagagaactgaggaacagctttttaaagtcatatgacaaacataggaaataatcagtagtaaatggaacttgataaataagaacctgaaattaatagatcttaatatcttttgtctgatcctcagcaggaggaaatttttactattaagcaggatcactttattcaacaaaaattatacaactatactaatgcaattttaagttaatcaatatccagtcctttctcctgcccccaatcacgataagtaaacaaaatgaagaaacacatacactcaagcttatcctcaggtcttcctctttcaagcagagacaggtaacagacaatgtccttcagatggattacttctggggaacacgtatttgcaggagaagtagtccggggaggggtgatggcacctttattcattctcagacctggaaaaaaaattgtctttatattttgttaattatttacagtgatctcaaacagaaaacaaattaagaaaatagagaacacacaggctacatagaaatttatattttttaggcatagaataaccaaattctctgtaagatcggtacagcagctagacatagcctacgactgttgtagatgaaggagagttctttgggatccacagacatggcactgccctatcagccacggatggtatttgggtcagaataatattaccctaggtgagttggtacacatttgaatgcttgaagacccacttccctattccacttttctgtgctttaggtagtgacagctataaatcatttgggaagatatttaaaatggactttttcacaaaatactaaagaaaaaaatgtcagtctttcacaatataatttctctattcataataagtaatcatccattcataaagtcatatatttgtttcaaatatttgccaataccatgaagaagacatccttttttaccatcaagggacttgcccaggagtaagaataaagagaacataagcaaaactctggataaacatgatggatattagagaggtaaaaacatatgagtggtttggtttttaaatggttctgactttatttctgaaacccattatctgtgtctgttctatcacaaggatataggttgcttattacctgtctggtgataatctaaccgaaatatgttcacagtaacttgttagttctgtcttacccagaagccactgaagtcagattgtgtgtatctgacaaggcctgaagataaaccgcaattatcccttgagggatatatggcatttttagaggtatttgggagaaataactaatgggttgagtggctactagattcctaatcaaccaggagctactgtaaggaataatttgaaccaaacacagttctagaaccctgttcttagcacagatctacctgactgcgtatgtctcactctactttagtttttcaatttgtaactttccatgaatacctatcacctcgtcaagccatctcaagattcccaggcatataattcaatgtgttgtgatatgtcccaagttagttttatcattggtgatgttgtcactaataaagggaactatttactgagtgcctaatatgtggctgaaatcatggtagtagctttaacacatattatctcacattattcttacgtgaacgctgtgaggtagagtgcattttccccactttacagattagggaccgtcttacagattttaacttcccagagtttcataaccagcaagacaaatccatcttcctgtttctacagtggtagcttacaaactatttttgttcaaggccaatcataaaagtgtaagaaaaataatttacatcttaacacagcacacacacacgcacgcacgcacacacacgcacacacacattagtgggattcataattgcccaaatattttcttttctatattaacctactcatattctatcctattctgaaaatttttctcaaacaccatctaaattgagtttactagccaccaatggatcaaaaatcacagtctgaaaaaacacggctttgggtctttccatccttttttatttttaattttttttatttttttgagatggagtctcgctctgtaacccaggggctggagtgcaatggtgcgatcttggctcactgcaacctctgcctcctgggttcaagtgattctcctgcctcagcctcctgagtagctgggattactggtgcgggacaccacgcccggctgatttgtgtgtgtgtgtgtgtgtgtgtgtgtgtgtgtgtgtgtgtgtgtatgtttagtagagatggtgtttcaccatgttggtcaggctggtctcgaattcctgacctcatgatccatccacgtcggcctcccaaagtgctgggattacaggcgtgagccaccatgcccggcccctttctttttaaaatgaagtcttatttatttcaaatgtggctttatgttttacattaattctacttctgtttataaagttatcaacagagacatatattgtaaacggaatttcctttttaatagaagtatcagtgtatgtctaatacaaactaatagttatttatgaaccaaagaaggcagggaattgaagacaatcctgagctttaaaaaaaaaaaaaaaaagaccggaataattgaaactagccaactaaagcttagccagctgcaggaataagcagttccaacttatgataaaaaacattttggcgctgacccttgacatgaccataactttcagacttggagaacacagcacttgaattatggtcggataagctatgacctaactcatcctgctgatgagctaatcctcttttccaatgtttccccctgtggtactgaaatgatttaatcagcttgatttaactcctttatagaaaaattcagaacaaaacaaaaaagaaagaaaagaatatgctctgacatttatttgaaagaaagccaaatatattatagatcttcacttatttagaacatggcatgaccatttgtacttatacaactaaggtagatggtgtttaattatcagctttcaccatactgaacacaaacaattgagaacgtaaggatcacataattttgtcttttctgtatgtaatgtataaatcgagtatgaatgtacacatataatttgtatttagcatcacgtttttgaaggaatatgctactgtactaaaattatttttgtttggaaaaatgagtaatattttccattttcttttcatgaaatattgttaactgaacacttaaagctgtatcatgtatttatcacatggaatacggttaaatgaatatttaaagctgtatcatgtatttatttccatgaaatattattaactgaatattaaagctgtatcacatatttaattgtgtcacagttttacatttaaatagcttaaagcttatataaaagaaatatgggcatatattcaatctatacattgaagaactaatcaactcttccttaagtccaatagcagccaaatttgagaggtaaaatatatatttttggaatgatttatagagtgcactgaagaagaagataaaatgtcaaagaccttttattattattacttgataaaaagaaaattgtagaacaggacttaattctttaaaactattcttttttaaaaagtttgaggctcacaacaaaattgagactgtacagagattgaacactgctttatatctttccttcattttcttcactcaagtcttgcttacttcaaatatctctctgtgtttcacattaattctacttctgtttataaagttattacccactacacatgcatattcctccccactaccaacattctccaccaaagtagtacgttagttacaactggttaaactacattgacacctcattactatccaatctctataatatacattagggttctctttttgttgtatattctatgagtttggacaggtgtataatgaagtgtctaccattatagtgtctttcagagaagtttcactgccctaaaatatttctactctgtttatttatctctgccctcccaacaatctctgaacctttcattttctcccggattttgcctttcccatagtgtcatagagctgaaatcatacagactggctatttagactggcttttttctgttattaatatgcatttacatttcctccatgtcttcttatggcctgatagctcatttctttttatcactgaataacattgcattgtctggatgtactacagtttatgcattcatcaacttgattaaattttgaggtgtttaattaataaaaaagcttggccaggcaccggaactcatgcctgcaatcccagcactttgggaagccgaggtgggaggatcacaaggtgaagagatcgagaacatcctggccaacatggtgaaacctcgtctctactaaaaatacaaaaattagctgggcgcggtggtacatgcttgtagtcccagatacttgggaggttgaggcaggagaatcgctggaacccaggaggtggaggttgcagtgagccaagatcatgccactgcactccagcctgggcggcagagtgaaactgtctcaaaaataaataaataaataaataaaaataaaaaaactcacagatttattcctgctcctaccacctccccaagatcagcccactttttttaaatgtttctttatattatattttcatttagttttctgaaagcagaccctggtcctcaatctatctccacaggagttatttttacaccctactctaccctttatttatttatttatttatttattcatttttttttcttttgccctttccctaaatctggctgaagctcactacttatcttcctcgattgcagttcactaccctgaaaaaagtcctttttccttttaagaagtttgcactaatctaatggttattcagaagcttaggagacaacatgtacggcaaccaaaaagttgcaagcctgacttcttgactacagctgagatggtaaaatgataacatgaaatagtaagtgagatcctttctagcagcaatagcctctggtgaggaagctcaaaattctatttttaattaacaaaggccaattttacacacccagtcatcagtgaaattctctctttacaactaaaatgaaacataaagctgggcaaaacaaaagggtttgtttgttttttggcctcaagtgatcagagctaaatattgcttcagagtaaatattgcaattgacacttaaagtagtataatctgcagattcttctacttgccctaggctatactactttaaatatttcatcacaaaagtgaagcaaatgtgtgtgtgtgtatatatatgtgtgtgtgtgtgtatatacacatacacacacatatatatgtgtatgtatatactacaatagtacaaaataaagtgaaaagtaagcattgtaattagagcgtattagtcttttaggaataattatcttgtacttagcatttatttctgttaaaataagttcattatatatacacatacatacatacacacatacacattcttttcttcaaagctttagttataaaaagtagttagcattagtcatatcgaatgttgcctatgattatcacatttctaagcacatgattttcattatactccaatctagacacttcatttcttgaaacaataacctcaaaagttgtatttaatagataattttaattccagcttcaggttcaattattagcagataagttttgggtagctgttaaattagtgcctctggtccagtttgtttcattttcaaacacttgcatttcatataatgtaaacagtgacattttctctatttcttaatgaaatagtcaaaaacaataacatggatcacatttctaaatttataaggcaatacaacactggcaatttagctttttcttttaaaatattggttcaatttacagaaacgtatcagatttatttatcacatagtataattatatttccaacatccatactattggtcataatgagtagcatagataatcagaataaaaatagttgatattagtattgtcatatatttcatgatttttacacttaatctttcaactatgcttgttgtagtatattataattatctttcattctttatgtttacccaaaccggcagcaaaattaggtagatggcattttcagtgaataagaaatgtaatagagatggtgattccttataaagagaagacagactgtgagatacagtccctgatatgaaactgggatcagacaaacctctctgagaacatactctggttttcatctgtttggacattggcaaaaaccccaaacaagcaattacagggagaaggacttaaagtataggtctttggggataacgttttaagagcagagtaacctctgtgaaggaacaacattaataacagctctggttgtgtgcaaacaatacttttgtacagtggtcttatttgaccctacaattctgttttaaagatgagaaagtggaaagtcagtaagtaaactgttcgtgatcatataccagtcagtcaacggagcaaaaaggtgaagacaaatcatctcattccaaactttggactctttttaaaagcagtaaaaatgagatctgtctacaccagtgttatccaataaaattttctgaaggctgagttcagtggttcacacctgtaatcctagtgttttgggaggccaaggcaaaaagatcatttgagtccaggagtttgagcccaacctgggcaaaatagggaaacttcatctctataaaaaaaaatttttaattacccatttggggtggcatgcatttgtagtcccagctacctagggggctgagcaagaggatcacttgagcccagcaattcaaagttacagtaagctatgatcacaccactgcagtctgggcaacaaacagagcaagattctgtctcttgaaaacaaaaaacagaaaacaaaaaacaaaaaaactttctgcactcttcaatacaataaaattaactacctatgtctatttgaccaaaattattaatgaatttaaatttaaatagcagtggatagctagtggctaccatatcaggttgtgcaggctctatactgtatgcagatggataattgaaagttatttaaattattctcagtaatttgaatatatataagtatgggacaaaaataattaaaccaccacatattaaaagagcccatgatgccaaattttctgtatttatcacatgaaaagaaattccaataatctccttaaatttcactgtacagatattgttcagaatgtataatatctttaaaacaaaaaggatatgttgatttttttttttttgagatagggtctcactctctgatgcccaggctggagtgcagtggcatgttcactacaacctccacctccagggttcaagagattctcccacctcagcctccaagaagctggaattacaggtgtcagccaccacatccagctaatttttgtattttttggtagagacggagtttcaccatgttggccaggctggtctcaaactcccgacctcaagtgatctctgtacctcagcctcccaaagtgctgggattacaggggtgagcaaccacgcgcaaccaatatgttgaaattgaactttatgctatgtatgcacaccaaaacattgaaacataatttatttaatgaataatggtaatgactggcatttattaagcatttataatgtacacaatactatttcaaatgaagtacatgtatcctgtttttcttcagtctcacaatagttaataaaatacatacacatattatccccattttacatctaagaaaacagaggagagaacaagttgcacaggtacgactcaaaatgcagtctgaattggagttttattatttatttatttttatttatttatttatttatttttgagatggagtctcactctgtcgcccagactggagtgcagtggcgcaatctgggctcatggcaacctctgcctcccaggttcaagcgattctcctgcctcagcctcccaggtagctgggattataggcacctgccaccacacccagctaatttttgtatttttagtagagacggggtttttttatgttggccaggctggtttctaactcctgacctcaggtgatccatggcctcccaaagtgctgggattacagacgtgagccaccgtgcccggccagaatcggagttttatactctaagcatgattctgtgaggctggacagagaaaaataaatcagaggaaactgtcttctgcctctcaataaaagacctttgttttaagagtctggttttcaagactcttaagggtggatacattgattaaatcataaacatttgaaagaaaattagaaaccatagccagagctaagaactctaaattttcatcttccatttggcccatgtcttgggccatccatcataatatgtttgtgaacatgtatttatatgtgtgcttgcatgtgtaaacatgcacatatatttgccaaatctttacgtatgatttttcttattgctcatctgtgtttttgatagatatacaactagccctttataatcataaacacaataaatattcaggacccttaagattagtcatgtaaaaccagaccccaggtactgaggataaagcatggaacaaagcaggaaaatcccatttccacagagctttcattccaggggatcaaagcaagtgtccaacaccattgcatattttctagctatgactaggtgtttttatgagtgaaataatgttatgatggatttgggcctctgcagggtattaaatctcttatttccttttgctagaatattacaaactgtaaataaatatttttgaacatgaaagtacaaaaatgttaagacaacactattatttagtatgcaaccattaagatgaaaatgaaaatacagaaactcctgtgtgttgggtgaataaatctaataataaagtaaaggtggaaaatttgaggaccaaattttacttggaatattcagatggaagaaaaaagaaacctgattattcaagtctaacatattaaaaaccatttaatgattaaaggagagacttgaagagaaatcatcccttactggcagtaattatgttaaaaacaggaccacaaaattattgcaaggaagaggttggcaggataaaatattttttgaagtaaaataatctgtggatcattacttctaatgacaataattagaagtatgaattcaatactacagaggtacatcaaatgtaaaggttgatataaataaatatgaattggccagtagacagaatttatttcatctgtattcctggagcatttctgtgtcagtaagtttattacctcaacagtaataagtatatcgacattaagaaatacaccaatatattttaaatatctactatgtgtcaggaattcccctatctcatagtcacacaagctatgtagtctgttcagtttgtgttttggggaccctgactttccttgtttgcattgtggaaactgaaataactgatcagttataaaagacctgttaaggtacagcacagtaataaaaaatacacatacacacatatatatttaatatcctcaagacagtcctaataagagaaatatcttctcagcacaattaatgaagtatacctttcagcaagaacattcagtaagtctatttggtgaaagaacatttctcccaaggttcaagtatctcattctcattgtacaattttctgttcttaattgattaacttcctgacagacattttccttttctatctaaaataagtacttggggcgtgactcaaatgcacagaaaacataaaatgacataatcctcctattgatattatagcttattgatatgtgtagcatcacagtgcaaattaaccattgcctcatcaaacaagcaatgggagagttggggaccaatgataaggcatctaatttttttcagagatagctgttactactctcaatctgaaatatcttctggacccttttataccgtcagcctcattctccttcatgatagctgccacctcactagcagtgtaattattttctggcttaaaatctcataatggctttccgatttcttctggataaaattcacaacttagcatgacaggcaaaactcttccccacctggccttggctacctctctcgcctcttctgcagaagcacaactggagtccaggccagatccagacctctcagtgctcctaacaagtctatcttcctccagtctcctaaggtccttggggctttgaccttgccaggccctctttcctcattccactccaggccatgcccgatacttacaaggtcatgagcatcatctgctctgggatgaacagaaatgacctttttgaactcctatcttagtttaagtgaatcatgaggatcccacattcccagtcatcttcagcctcaagctgcactttccagcctcctttttttttttttttctctgagatggagtctcgctctgtcgtgcaggctggagtgcagtggcgccatctcagctcactgcaactctgcctcccaggctcaagcaattctcctgcctcagcctcccgagtaactaggattacaggtgtgcaccaccacgcccagctgatttttgtatttttagtaaagacgggtttcactatgttggccaggctggtctcaaactcctgaccttgtgatccccccacctcagcctcccaaagtgctaggattacaagcatgaaccactgtgccaaggctccagcctctttttgtatacatttttgccaatactacttactaccatctgatatggtacacgtatttacttttctgtatgtctgcctctccccactagaatggaaacgggtttcattttctttctttttttttttttttttttgatggagtctcactctgttgcccaggctggagtgcagtggcgccatctcggctcactgcaagctccgcctcctgggttcacgccattctcccgcctcagcctcccgagtagctgggactacaggcgcctgccaccacatccggctaattttttgtatttttagtagagaccaggtttcaccgtgttagccaggatggtctcgatctcctgaccttgtgattcgcccaccttggcctcccaaagtgctgggattacaggcacgagccatcattttgctcactgatgtatccctaacaacttgaacagtaaatatcaatttataagtgatgaattttgaatctatgaatactgaatgtcttacagttcatacattgccctttgatgggacattaaaaaatttttgaatagaaatgtgtatgttgatttctctccttggaactcctttcacatcctttcccacccttacttactcccctctccaactttacctggataactccaatttacactggatgactcctgcaacggttcacctcctcttttcctctagttttatttgggctcctgtaggcacctcactcttttctccacatagtcagttcaaaagtggtttacaatatttattttattataatataactgaacacataattgttcatctttttgcttgactttaaaggatcctcagctttcctgtggaagttctagcatataatgagtttaaataaatagataggatgcatgaattaatgaatgaataaaataaattactaaatggcacacctatcaattgagtgcctattattatttaaagggggctaggaaaatcttctctttctttcttataaaacaattaggaagaaacaacaacaaaaactgttacgctgacctgcaacaagtaccagacattttctattacagatgcaacattttggacattgtgtagtccaacagaaacaaacagtatgagtgtttaaatgagttaatatactatattacgtcctattttaattactatattattaaagaaactaacagttactaataattgctgttgattgctatcttatatgtaaagaaaggtaatttctctgaaggcagttaattcagttaatgaatactaaatggttggagttggcatgggtggcgatggagaagggacagggatgctacaagggacaaatggtgtcttgtaaaagtaccagagtgccagggtttcttcccagttgcacactccaggtgtgccatcttattaatcattgaattcctagtatggaacacaccgcgtgctatttaattaagactgacactttagctgaggctttaaggaagcattgggttttcatgcgataagggcaaagaaacattatgtaagaaaactcagtcctgagtgagaaaagcaggtttaagtcacagcaaatagttggatatggggtgcatagggcagggagatggagcgaatagggctgtaggcagatgctatagcctacgtgacatggtgcttcatggccatggaactctgattttatcaccttcttcactgtgactctggatcctggagtctcataaaggttacttcaggtgggaatgaatgtctcaaaaggtggggatgactgcaactccatgtactcatgtatctccagcacccatgcccttcactaaagcaactctgctttagctagctttacatattgaggatttaagtttgcttgaaaaataagtttaattaaaaaatgctctgacagttgacagtgaaggcctgaaatttagaaacccaggagtaatataatcaggcttctgtttgaaagaacgttttggagatgggaagtcagggcctgctctgagagcctgctaattgatagtttatgatgaattaaactatgacactggcagaacgtttgggaagaagcagttacaatgagtactagagagtattttgtgattaactaaatatgggaagtgacgcagcggaaggtgggaggattccagtattttaggactgggaagtggatagattcttggatgctattcaccaaaatagaaggtaggaatagtagcaggtttgtgcagaatctaattaatgaactttcaaacacagttagtttggtatctaactgtttgaaagatttggacatccagacaaagtgttccatctaaaatacagtacgtaaatattatttgtgagctgtgtaggttgtgtggggagtaattgaggtacgttatgtctgacagtgccaatttgttatatgatgcaaaaaaagtcatgtgttgaaatgagaagacatttagataaactttaaaaagtttaaaaaatcaacataattgatctcggatacagtgccaataataaataatttttacattgttttaaaaaaactgaagaagtgttaaggtcatataaacatcgggtagtaggaatttatagtgacagatatctgcatatttattaaatttctcttaggttatgttgagtgttcaagttgtagggactgatatgggagatgacaattttgattgacggttgaggttgtgagcctcaaccatctttctgcaaccatgttgtagaaaaagaaagattccaactgattttaaaagtgtataaagaaggaaattaacaaatggtgggccccaaggatggaagcaatatcagaaattggtcattgaactggcagagacgagagattagagacctgacatttgcaatgacacagaagtggtatgaaaaagctggagagataatgcattagcgatatcttcaaaaatcaaaagtcaaatatggaaacagtagtagtgacatcatttttaaataggtgataagaggcacttatattacaacaaattatattacaaaaataagtcatcttcttcatgaaatgccaaatggatcattacatattacagtcaaacaaaacccagctatacatatgcatatgtataaatacatacaacctttatgcctatttataattatttttaaatttttattctataaaaactaaatgttttgcttttactatgtatcctgtaattgattatcattcagtagtgagcataattttttttccttttcagttttgttttttcttgagaagcccttattttttagttgctgtatagagtaaaagactacctactctattcctgctggaactgtggtaatgaaatatggtgaactataacagcataaaccaaaccagattgtagcccctctctgttcaaaagtctgttatttttcagccacaaaaacacctcgttatacattagataacagattattgcaaagcaagattctatgaatggaaaggcatttcttttgtcagtttctgagtcaaggctacttcagccttgaaaattttattgttgtctattgttccttcttcctcaggaaaaaaaaaaataactatcaaaggtgggtctgaaaaaaaaatagggttagatatagtcctggacaagacactatgtacttagttgtaaaatgtggaggccaagctttgaaaaggaatcagagtttaattaatcattgctgcatgaggactacatagcccatattcctttcatgtagtctgtgtagaatgcgtaattttcccaaattcaagtacaatctgtttttcctttttttttccattttgaaacctgatttgatttttacccctaataaatctggcatcttctattcagtagataatataggctattagaagaaaaggaagttttaggtttgaatttcttacaaaatcacctaatttatcagaattgttctctttcttccatatgtgatacagttatttagacagacaacattatccagaaatattttctcttctttctcaaaactcaaggacaatattgtatcttatagaattaaatacaggacaactttcttatttaattcaatttaaggtatgtgtgtgatacatttatagcatgcagcagagaacaaggaagttttaatttctagaatcattttaaaatgtccaacccaaaacactattaaactgtaatactacacattaagaatagatccactgaaactcattccgagaaaaacagcaagtgcggtgaggcctctcaattcatgattgaaagagaattatttaagaatctaaaaatattttctaagaagagaaaaatgatgataaacatattagtcaccatacatcttaaagggctatcatgtggaatatgtacacttgctttaaaaaagcttctatcaacatgtgattactttatgaaaaataagttacatcattaatagatgggaaggccagacgccatggctcatgcctgtaatctcagcacttcgggaggctgaggcgggcagattgcttgaggccaggcattcgagaccagcctggtcaacatggtaaaaccctatctctactaaaaatacaaaaattggctgggcattttggcatgctcctgtagttcccaactacttgggaggttggggcaggaggatctcttgaatccagaaggcagaggttgcagtgagccaagatcatgccactgcactcaagcctgagaccctgtgtcagaaagaaagaaagaacaaaagaacgaaagaatgaaagagagaaagagaaagaaataaagaagaaagaaataaagaagaaagaaagaaagaaagaaagaaaggaagaaagaaagaagggagagagggagggaaggagggaaggaaggaaggagggaaggaagaaaggaaggaaagaaggaaggaagaaaggaagggaagcagtacaacataaggcttaatattatggactcttcatcatattgtctaagtttcatttatggctcaaccatctatttcttaattacatgttcttgcatttttatttatcagaatgtccattattgaacttatctctataccaacacgtgtgtgtgtgtgtgtgtgtgtgtgtggtgtgtgaaatggagtctcgctctgttgccagcctggagtgcagtgatgcgatctcggcttactgcaacctctgcttcctgggttcaagtgattctcctgtttcagcctcccaagtagctgggattacaggcgcctgccaccatgcccggctaatttttttttttgtatttttagtagagacggggtttcaccatgttggccaggctggtctcaaactcctgaccttgtgatctgtccacctcagcctccgaaagtgctgggattacaggcatgatccaccgtgtccggcctctataccaacaattctatattctactttgtgatactagagctgggactcgctagacttgtggctctcctgggatccctgagctccttgcaggagatttttaaggtcaaaataattttcataacggtattaagatattatttgcttttcttactcttattctcttttgaatgtacagtgaagttttcaagaggctatatgacatatgatccagtaacagaaacatagcaccagatgtaatttacccagctgtcttccatgaagccaggcattaaagagatttgcaattatgcaaaacaatgctacccttcttactattttttgtttgtttttgaaaatagttatttttcataataatgggttattttttgttaacaggtagtggtttgattcttgttatttttggaatgtcccatctttaatatggcaaatatcaatagatatcatccacataaacataagttccttcaggtcttcaatttttaagagttcacagagtcctgtgatcaaagagtgagaaacactgctgaagacatttcttcattgccagtggattcctgttctatccatagagggcgctagagagagacgagaaggcacaggggttggggcggtggggtggggagtcgcgggagaaggggctggacccagcaagagaacctgctgctcctgttgaatctctgcagcgtttcagcccggtggcggtagcatgttgtctctacctgcagactctaaagcagtgtaggctctagtctctagctcatgtccacaccaacaaaagcacaatgagctccctgctaagcaatctgggacaggccacggtgatgcaccctcctcagaggtctgagttcctgggctatagactagtcttgaattccccagttaccagaggcagccaggaagtatcacttccacaaaagtccaagggctaggtttgctaggcaacccctcacctcagaatttcatcctagctccaaggaatcctttcctcagggcttctaggtggtgattactgccatctaagggcagcacatgtttccttgagtctatctacatcacctgtcttctctttttgctttttcaatcctttgaaacagcttaaccaattacactgttttacattgggtaatacagtgaaatctctgttttcttgactggagggagattgatacaacaggtattaatgtaagtatgcatctctaaaaagctacccataatgagagaatcaccatctctacggtgacacaaatttacagtatctaaaagaaaaatcaaatctctgttctgagcttacaaatctaaacatgtgaaagtatattggcaattagcaaaatagatattaaatattatacctttttagatatagttgctttgtgaccacattttcaaatactcagcaatctatacgtatctagttatttaacaagagcagttttccaaatttgatggaaatatgtcttcaaattattacctatacatagaattctaaagcaagtgatagataaggataaattatattttctctaattagctataattttactggaaacattttaaatgagtcacacaatcttattgtaaaagtctaaaccctgtaacaaaacaatttttatgcaaatcatcattcatcttttatgataactagatatttatttagcctttgaaatttgtactatataaatgtttaaagtaagtaaacttaccgcctgataggagagcaggcttactttttaccattggactagaatgaggaaacttgttgctaaatgacatgaaaaggtgtgcagtgaaatcatcaggaagctcggcttccaggaatgtcttcatgaatagtttgaaaccttcaaaatctattgtctggaaaaaaaaaatgtaaacatgtattttaagatccaaccaaatgttaaaattctgtgctgtgttcaaaatcattagaagtagaaatgacctcaaaccatttttatatccaagtttaacaaatggaaagtgcctatttgagaaatagggtgggccgtcctgggctaacactggcaatgggatatgtttgtcttacctgtgatggcatagcaggaagaggaagaagtttctagttagatatttctatttccacagtatctgtaatgccttgaaaaatgtactgtttgaaacttagtttgctcctctctaaactgggaataataatcccaccccacatagttgttgcagtgattaaatcaggcgatcactgtgaacaagccaatacagagtcatataaacacagcaggcactcagagagaaaggaattttccatattttttgcttgtcactaatggtgattatcgcttttgacaatgtaaaaagaggttaaccttaatgtttcaactaaatgccaagctctattgataaacctaaaacttcatacgcagactttccaaagaaacatattttaagatcttactctctgatactcattgcagaactatataaatgattagacatttatttggagagaattgtggtggtgttaaggttctccatgcccattagcggaaatggtgatggaagacaacttccaacctcaagcttaatgagagcgtttcacaggagccatagtgaagagcttggtttctccttgcagatgaaggcagtgcaccaggatttgactctgcctaggaaattgaggacaagcacatgggtgctttggggacaaaggcaagaaaatggtactattttaagttggccaaaactcctcgttttggactgcaggaacaatggtgcatgagtattttctgggaaacagatgtagaccacatggaggagaaggccagtggagtggtcttgggttctatccagtagggcatttgaaaggactagaagacctacagagaagaggctggaataaagccacatatgtccagatcaagagagtgcaagggatgggctttataggtagcccttgaaggccaatttttttttttttttttttttttttttttacccagtttaatgtgctgagatgcaagaggaaatttggctggctgatgctcttagttttgttcacattgctggcaggtaagaataaaattaactttggaatagaaagtttgtttttcctatgtaataatactgggggaaagacatggagattgaccgaatttattattgtattatttgggacaaacctaatattaaatgtgacattcaggaatatcattagacatagtaaatttttatagatttgatcatgtgccaattaagtttacatacgatgtttgctttttacctaatagaatctcaggcaataaaaccaaacactttatttatcaatagtcccaagattctgcctataccttaatctaacttttttatttagtttcactttgcttattgattctcacaaggacacttcagatatttattttgctggcagtaaaaagacttcattttcttctatatttcataaattactaccaccaccatagaatattgtcaattctagcccgggaggtggaggttgcagtcagctgagattgtgccactacactccggcctggcgatagagtgagactccgtctcaaaaaaaaaaaaaaaaagaatattgtcaattctagtagtagagtgaactatataactaaaaactctgagtaatataaaaaatgtgaagaatagcctcaggtaggagaagtacttccaaaaaagcaatttgctacaatgaattcagccaacacttaaaaacatggcgattaggccaacagtcagacatgggatccaaatagtttccttgaaaaggaacacctactcttactaagagagctccttagagatgacctattaaagagaagtattccacattcatttgggtgagtgaccaaaattgatagctaatcttcaacatgtatgaaggcccatgaggaaccaggagttgattttattgcaaagttgcaggaagtctgtgggatgaaaatattcacaagcattgtggttagaagcaaagttacttatggtagcgcttccttctgttcctaggtcttccataatcagtattttgtttagcaacataacagatgataaggggcatggtctttgaagtcagactacctggatcaactcttgaatccaacacaagctgtgtcactgtggacaatttaagctctctgtgcctcaatttcttcatctataaaattagaataatagcacctacttcttgatttgttaggaggaacatattatttactatttttaaagcatctgaatgacatctggcacatagtaaacattgtatgtaattaaataaatttttgtgtaaagaatatccattttaaaaattcataatttgaaacaatatttgaagaagaagcctcaaagccacattacttcacatgttttcatatgcatttaacaaaccatgcatggttcattgttgtccttgttgctgctttaaaagctggtaataaaatgtgaacttccagaagtagtaaaggactagaaattggtgaaagtttttctctggatctgcttttggaccataattataccttaaaacagctctttcaagccaagactttaacttggtaacataacaaacaaacaaaacaaacaaaaacaaagagttcagaataaagcaattgtgtttcaaattctaatacttccactcaccacctaactgataaggggcaaagaatttatctgctcttttgaaggaaaaatatgccaagtcccaagtgtatgctctttacagagcctttcagaacccatgtcgatgctcattaaaatcgctgcctgtaatttaacgatgaaagccagaaaaataaccaaccaaaaggaaaaatgaactttaatatctaacgatagaggcaggacacagacaaatgtctaggcaggtaagggaaggtccccggagaacctccaacctgcccaggtcactgtgcacaggaggcctgtctaaacacgcccatggtgaaaaattctgtcccataacacatgctcagtaagggaaataaatcagtgtggggtggctcagactaagggctcacatgtgcactggaaaaatggggtggagctaccagaaattcatgctctatgcaggggagaatcttggcctcttcagctcatgtgtggtggcctggtattcaatttgtgaggtggaaacccgaatgcaggaccctctctttgttgagagctttcctttctcttaataacttccaccctctttacccttcaatgtgtccgcatgtttaatttttcctgatcatgagacaagcacccagatttagctgaattaagaagcaaaaattcctgcatcatttgatggcctatatggggatatgaggaagagcgagtaaaatgcgaacccaagaatctctttcactttcgtttctgggccttccagtcctcagactttttctgaaggcagaggaaactgcaccccttgcgtcactcttgggtttgggaatgtcggcctcagtccaacccagtctttgctatggcatttttcttcttttttttcccaggactgtaatggcacctatcttttcttttacaatatcaggagtgttccaccccaaccccaactgctgccacataggatagatgcggaagtggtggctccctgccctcccccacgttcccgccgtgctggggcacatggccgtgtgtctgcgtgtctgctgtatgtactttcggcatccaacagccatgcagggcgggactgagccgcagctgctgcccaggccccagggcaatcttgggggctagaggccccgtgcagacagctggccagcgttccccgccatgcatccatacagtcttcccctcccttggccaaggagtccagctcagtgggacaacaattaagtttctctctgtttgcataagaacaagaggtttcttccccaggcatttccctgccctacgcttaagccttttttttttttttttctccacaaggtcaggagttgatggattggtgtgaaggtagttacagtttttgctattacctagattggcagggaccacagttgattttgcaccaacctagtaacacagccctgtgagtacagggggcttctcaatgccagaggatttttcttgaaaagtgttttattaggccaggactccaattcacaggacacccttttctctcccttgtttgagaggacccaattttagagcttcaccttagcatttggcttatgacaaggaggcaattcttttgtcccaaactcaattccaagctttgggttgaagccctaggaaagaaaactggatcttagggatccagaggcagacaacaatggaagttaaaaggcaaacaccacagatgagcatgactaattcctgctgattaagccaagcctcccatatcatggatagaggtcatactagtatccatggcataaattaggtgtagggaactcaaaggctacttatagcagggggaaaggcagtgagtgcacggggaagtgcggataatcccaccccctaggcccaactgttaacatgagtgaaagctgcattgacacccatgggtggcaccctgttgtggtcaccaggcctcagggatataaggataaaagaaggaaagaggaagctttttccttctctctctcatgtaccctgggcattcgataggaagagaaaggaaccagggatgccttgctcctctttctagatgagtagccattcgtcttcagtctgtgcaccttacagatgcattctgagctggggggctcctttgaaaaaaatgccttctttgtcccccttggtcctctcttcacagatggttaatcctgtctccatactacaggacactcctctcggatgcatccttcaaactgtgaaaagtttatttctcaacccttaaactggttggcttagaattgagctcaggggaggggaacccagaaggctgacatgctggcaaagagataaaatattttttaacagtcagacttttggcctccctctccctgtgcaaaccagtaaaaggaatggtagggatatattctccgtaaagttttgattaatcaaaaagtatttatgaggttggtctcaagctgtagccaatctgttgtgctctgcatgtctttctatatggttctgtcagaaagaggagtaccttaggatgggataaggacctaggaccccatagcccactattcaagtcagcctggcaaactgcctagtatgttgtttttgtctccgctattttacggtggcagcctgggatcaatcctggcttagggaatgagtagtttctggcaaatacctgtgtgacttctaccatttgctgattctctcctgctccatgaacagcttctagctttcttttgtgaatcttcctttctctgagctacacttagacgttctagtttttgtaaaaactgcttaccacccctttgaaaataccttgtatactcgcagttaaatcataactttttggggcttgttggtttcacctgtaaggttactgttggtaaagttcaaaagccagaaatatgagtcatctggcatggctaaagttgggtagctagggatttaaaaggattttcttaaagaacgctcaagttaattaaaagtggatatccaagctataggtatatttaaaagacctttatgtttttttcttcatggatcttgtttttctgagaaaggttttttccccagtcaactgaattgtcttcctccattttatcttgccactcttaatgaactcatgagagaccctaagataatttctgatgaacagagactacttgggaaaaatggaaaagatataatgtattccatttttggagaaacctctgttttcctcatggaaccccagtaattagaggcagatagatccctttcaaaatctgtttttgtcttccacctgtatctgcttattaggtactgttacctctgtttcttgaagggctccaccctcaggccaattatccaattaggagattggcaaatgaaaaatcttacaactactggatcttcttctgtctgtctatgtagttatatatgtgatttttatataaaagcactctaattaattggcctaaagaaaaataagcattagatcaaatattttttcaaggaaaatacaagctgtagtaacttttagttcatgtagctttaatctttgagaaataaaaagtcttaaagattattggtaaaattcaaatgtcattaaaatttaaataggtggtctacattatggaagtcagatactaggttcgctaaatgttttaaggttgtaaactgcttctttggccttagagaactgttcaacttgcctgctttacaacttggtaaggcctgaggacatactgaattaaccaagcccttgaacaggctagaaggaatcaaactttattggtgcctagtacataattaaaacaacttatcagattttacattaaagtttaaaattgctaagagttaccattataacatgtaattgagaccaccactgaaaatagattgacatgcaaggtgtgtaagaagagtaaaatgtgttttcaggaaaagattgtaagaaggcatggaaatccaagtaactttttgcctagggttaaaggattgttttaaattagataaggtcaagctaaaggtttaaatagttgtggaaggtttctaaatttaatattgcaaaagaaatcctgtgtatgaacattgactaaactcaaaggatattatatgtttttttctgtaaactgagcaatgaaataaaagcacaacaaggttttcttaaggtactaatctgttctttagcaaaatgtgtaaagggttataaaaggtttttaagaatcttacctcatggtccaactggcttagattggatagaattgtctataaggtttcattagaaaattgggattaatagtaaactaatgtaagggtaaaatttggctctctctctcccttgttgaagatttctatgtaatattaatgaataatgaaagattttcatgtgccttgtaaatagactgccaaggaaaagaaagagaagacaggagacaaactgtttggaaagctaagtccttcctcttgatgagtaaaggttttccctattttaaaatttttgagtcatcattttaacaaaataaccaactgggattgtatttcaaattatcaagtgttttaaacctctaacatttaacaggcttccccaaatcaaatttcagcttcaaggttgtctttcctgacccctagcttttggatgctacagagggtccctagagcatctagaagaagagaggtaaacagaataatttaacatggttaggtacatgggatctccaaaatgatgtttaattttcttcaggttatattttagtgaataatgctaacatatgttccagaattttatgggatttctaaaattctaatgtttgagtgtatgctatcaatcacaattaaggttgttatattaagttattgtaagccacagagataaccacattttgtcaatcacatttctgactgtaactaccctggtcattttgttattcataaacaattgtcttcttttgatccccttcaaaagatggttaataatcagctataaaagtttgatgggtgttctccaatacaagtttctgataactttggagactctaacactggactaaagggaaaacgtacaggactcatgaaagagctgaaacattcacgaatatcaagcagagcatgagttaactgaatggactgaactaatagaaaactgaagtaatctttttttaaaaccttttgcttgaaacattgctggtccttgttttgttattcagagtcaagaaaacttttattttgagctatttacagtctttaataattgagtaagctatactcatgtgaacaaaatttggagcatacttctttctctttgcctggttcttctagaatttggaaactatctgtgagtattcttaacttatggcaatatggttatttgcatcagtgcaataggaattcattttctctggcaacagtacacagttggagagatgggttgttttaccaaggctttgactggagaggtgtacttccttttaaggaatcaagcttgagttgcagagtcaataaaagccccttgggaaaactggcctcataccttgtctacacagtcctcatacagggttcctaatctgtaatgagtaaagaatgtcactttctaatgggcccaggaactctatattctaggaacctcaagaagagaggaattcacccaattcataggtatttgagggtgctaacccatggctgggctgggctttccaaagtcctatctgagattccttatggaacagaattccatcaaaagcaattttaaaagtgtatgtaagaataattattcttgctgcactttatgcaaactgtcaggccaagtataagactgaagtctattttgcaaacaactcagtcctatcatgaattgtttttaacaaaaatgaggactggggagataaaaattatgtttcaaaacttaccacacatttgtcattaaattctagtctcattagttgttttgaatttttttttgcctacattttacattaaccctcttattcctgtgaaccaaccagcaatttctggctacaactcagaagaaacaaaaggcatgggtaatgtaataatctggatcaatattttaattctgagcagttatcctgctaatcctgacatctgataggagtaaatagggtgcccataacccagaggttcctctgggaaaataagaccaaaggagcaaaccaaagccaagccccatgcaaccaatcttagcaggcataattatagccaccagttatctgggcatgctgacagccttgggatttttcagctgcccttacccatccctctttgtttggttttaatatatgtcttctaataactccgtttgtctcttctcaccttcaggccatcaaactccaagcgatcatgcaaccagagtctcaaacaatggccccttttaacagagacccttaaataggctttcgagagagttatgactgccatatttccaaaacagtgccccctaagagcaggaagcagttaagatcagtcttcgtccctattctaactgcagtacctcttgtgtaccactttagagggaagaataatagaagtaggaggcaaatgcctaggcagataaaggagggtccacagagaacctctgacccactcaggttattgagcacaggggggcttgcctaagcatggtcacagagaaaaattctgtcccttaacacatgctcagtagggaaataaatcaatgtgtagtggctcagactaagggcccacatgtgcactggaatgattgggcagagccaccaaaaatttgtgctttatgcaggggaggagcctgacctcttcagctcatgtgtggtggcctggtattcaatttgtgaggtgaaaacctgtgtgcaggacccctctcttttctgagcactttcctttcacttaataaattctgccctcctcagccttcaatgtgtcgcatgcttaatttttcctggtcatgagacaagaacctggatttagctgaactaaggagcaaaaattcctgcatcactggcatttctcctaataagcaacacatttcttcttgactcttcttttttcagcatgcaggaaaactttctgaaatttctaaagtatagttctctctggctcagcaagcaaaatactgttttattttctgacagctctaagccttaattccctctatataaagtggtatatgaaatcattcattcaggctgggcatgctagctcatgcctggcactttgggaggctgaggcaggcagatcacctgaggtcaggagttcaagaccagcctggccaatgtggcaaaaccccgtctctactaaaaataaaaaaattagcatggtggcatgtgcctattgtcacagctacttgggtggttgagacaggagaatcacttgaaccttggaggcagaggttgcagtgagctgagatcacaccactgcactctagcctgggtgtcagagtgagactccatatacaaaaaaaaggaatcaatcattcagagttgtcccaatatgataaaaattgatgtaaagcacttagcatacacttgggcacataatatataaaataaataaaaggattaggttaaaggaagaactgtcctcagcttagatacatttttaagttactttaattttcctttttttatttttttgagacaaagtcttgctcttccccaccccatgctggagtgcaatggcgtgatcttggctcactgcaacttccgcctcctgggttcaagcaattctactgcctcagcctcccgaatagttgggatcataggtgctcacaaccacgcccagctaatttttgtatttttagtagagacagggtttcaccatgtgggccaggctggtcatgaactcctaacctcaggtgatccatctgcctcggcctcccaaaatactgggattacaggtgtgagccaccatgcccagccaatttgcctttttattggtacagaaaactgtaaaattcattgcatctttctgaataaaaacttcaggttttgtgtgtctcaaatactttgctataacatttctgtgtcagataacagagacaaataacaacttttataaggcaataattctaaaaaaaaaatcttcctttgaaaaataaaagcctattacagatataagaatggagtaaaaatttcctcaattcttaaattatttctacaagatgacatcacattatttattgctgaagtgttactgacaatgtaagcttgtttctcaaacttcttcactgtgttctttggagcaaaattaatttatctcacattttctggcattagatagggcttgcaatgtgggaaaacacaaacctctttttttttttttttttttcctaagagaaggtctctctctgttgctcagattggagtactgtggcccaatcatagctcactgcagcctcaatctcccagactcaagcaatccttccacctcatcctccccagtatctgggaccacaggattgtgccaccatgcctggctaatagtttttttttttaattttctaactcagagttttcaattcattgagaaatgtttcttcaatgtgtttcctggttaacccgtcccttttcttctcttgttagtaaaatcttttcaaatatctcctaaaattctatgttgtccacattattagacatttctgataaatggatgatatcttcatctgtacattttccttagatcatgacttacaagaaaatttccaaatttaggcatcagagtttctattgctgtcatgtaacagcattagaattgctttttgaagactgtgacctttaaatagaatgagatcatttatatgcatatcaatgaagccattaatgatacaaattgggtcagacttaactgaatgactattcaaaaattgaattgctgtgggctcaaacacatccacgcgcacgcacacacacacacacacacacaaatgttcaaaattttaaaaactgctttctcatttttttccttaaggaacagccacagactatttagggagataacagagaatttgtaaagaagactgactgagggagctgctcagatgtcgctgccaaattggcacagattcaaggcacatttctatatgcctttcattattatttctgaccatctggatcctttgtttttaaatccctgttaatactaaagagaagacactagtattcatccatgcagattcaaagtgaatgaaaataaatgtcatcactctatccttaatttcttttggtagttttgggttgtagattttctcatattcagaaagtgttctttgagcacccactctgcaccaggctctgttctaggtgtttgggtaaagatgttactagaacacacaaaattccttccatgagggagcttatcttctaatgaaaggaataagaacaacattaatgtgctcaatctacaatgtctaatggtattaaatgctatagaaaaaaaataaagaagaaaaagatttcttgggggaatgtgcttgcagttttttaaatccaattatcaggaaatgagaagctattctttgagtaaagatttaaaggtgatgaggcacatatttgcacatatttggagaaagcacatttcaggcagagaagacagctagtacaatggccctgaggtataatgatgcccctgtgctagagaaatttccactggagccagtgaggaggagcaggaaattggagcaggagtgagggaggaccagagtagtagaatacaaggtcaaagactcaagctgtggcaatgtgtggactgggcagagcatacaggatattagatcatcaaaagagagttatagctttaatgtggagtgagtttttagtaggaaattccatgatctgactcatattttaacagaaccatgtgaccattataacacttatttgtatcagacaaaagatagcctatcatcagtttttatgtttttctaactagctcaccactaattaataagtgactcctaaaacacaaaaatgaatcattcaactattatagataaagcaactgtttgaaaccacaaagaaatcactttatctatcaaccaatgttgactgagtacctatatgtgtaaaatactatgcgcttactgggcaaagaactctgatgaaattaactagataataatttaaattaatcagagttttttttacagttccatttctatttcgcattctaatttatatcattaactaattatatcaaactcaaaaattgatatgaaggtcactgagcaaaagtatattgattaaatatgcagcatggctatcttactgagatttcaaaatacaattttttatgttaaaattcacttagaaaaatttatattttaaatattgcatttcttatgcttatcttgcactgcaattgactattcattatttcaaatttcagagagttccttgatagtcccctaaagctgtcatatagatagttcctttgaagagaaagagtacaaagtgtgaaaaccttgaattttaatttttaaattagttttggcaaatgaaaactattttagcacttcagagtcacatactccattaactctacctttacctaagactagaattatgaagactcagtagaaagacaattagaaatatattattttagtaaaaaataggaaatggccgaaagataatgctactacattctactaattacaaaaagcaaataatggattcgaaaaagtttaagcagaatatttttactatgatttcagtatgtcttttaatcaaggatctatagctaactgttttattcttcagctgaaatctattttaatctggtgtgacactgtcttgtcacaccaaacattttttggtgttgtcactaggacaggagtgagtgttactgaaacacacacataaatcctctaacattttctccttgaaaaataaaacccaataaaaatgtcttggaaacctttgtatatataatttcaattaataagatcagtttttaattattccttacttgtatgttcacttttaaagaaaatctccacagggggtttttataatgcacatatgagcagacagattccatgcaaaacttctctttcctgaagggctatatgatccaacacgactttgcatcactaagtgtatgacacagtcttttaccttacaggtcctcattatgtaacactatccaaatgttactatgttttaggaactgcactaaatatgttatatgtgtgctatcatttagtcatcacaaaacctatggacaaagaaactaaggctcagaaaagttccttaaattgcccaacaccacaagcttctaattgacactgaagacataaatatttctagcttcaatgcacattatgttatagttaaagcataattttctaaacagattttgcaatattaacacatggtataaggtaatttcccactggtttatcagtattagatgcatttgctgctgtgtcaaattggtctgccgtttgagaaaaaaaagatatacacaaataaggtataacaattaaaagtaatggtacgattattcagtttcccactcttgaaaacgttgtgttgactgtaactgtttttgtaaccttcgatgttcaaagtacaacctattactttgggtcgtatacctgaaatgtgttcaaatctgcccgcctccatctccattctgatgcccattgtcatctagtgttcttacttgattggactgcttccataactcatatctagtcttctcttctacccaagtccatgccccacattgctactggaggtatttttctaaatagagaatttaacttgttcacctaaaaatatgatttataatttctttcacctataaaacttaaaattcgtagacattctaagcctttttaccaaaatgtctagatttatattcctttagtaccctgcagtgttctttcccttgaaaaagctatttctatttctttttttttttttttttttttttctgagacagagtctcactctgttgttgcccaggctggagtgcaatggcgcgatctcggttcactgcaacctccacctcctgggttcaagtgattctcctgcctcagcctcccaagtatctgagactacaggcgctcactccctcacccagctaatttttgtatttttagtggagtcagtattttaccatgttggccaggctggcaggctggtttcaaactcctgacccccaaatgactggcccacgttggcctcccaaagtgctgggattacaggtgtgagccaccatacctggccaaaaaagccatttctaatgatgaaaaagcacaagtaaaaacaacagataaaccctaaaaataaaacttagatgtgacagagtaatgttggttttaacttatacttggaaaagtacaaaaagatcacctaaaaaccccagcattagtttttaacttctatatcaattgtttaataaatgttattaaagaaatgaaagaacaaacattctacagtgtgaatttaaataccacttttcaaagttggaatttatcattaaactaaggagagttacttgtttatttatttcccaaatgtatttatgcttgatttcaaaacttgtttgtaaagaaagcaattgatcacaattggtataattgtattttataattgtaggtagatttgataagaagaggaacatcactgaaactatattgatggtaatagtgaagagaagcagaaatactggttaacatactatttctgttccttgctaactaactgtgctagcaccatgcagttgtaggaagtgaagcaatacaacagacaatagctctgctatcagaacagcactcaggattgtggccaggtttgggaggggaagcaaattacacgtcatgttccccactcctaccacatggtggaaggaaattacttttgaatgcagaagacatcagagttatagttcctcaatttaaaatgagaaaatgaggtcctgagaaaataaaggaaatagaatttgttggtggtatatctccaatattctcactttcatctttggcatgttctctagaacttttctatgaaatcacattggtcattaaagtatgaccacagccactgtctctaaacattagtggaacaccttttatgtgcaagacacagagctatttattatacatacattttagaacctaacccttttaacagtccaataaggctgatgctctcttccttttataagtgaacaaactaaagatagaaaacttgtccaagatccgttaagatgaattcggttcagtcagactcctcagaccatattttctctgttatactttccttatcctttccataatggaaagggttgaatttggttctagaaggataattatagattacagtaaaaaggtttttatatcattgttaataattatatcagtgtcattatccttgttaaagacatttaaaatattactttaggcagcagcactacaaaaggtaggttttgaatccccaggttccttattaagggtaaaagcatattgtctgaatgcaaagggtatacacattaaaagaaactacaatacagagtacaaagtgcgaaaataaagcaagcccctgtggagttatgaaagcgtaactcagcctcaggccaaggaacatctactgacaggaaacatgtacggaggaaatcctacactcagagaacactgatagacaaagagcacacatagagcagtaatatgtgcaggctgtcattcttctccccttgaacaccctcagttttgtcaattctttctattctgtaactgcaattgcttgcctactaagccactgcacatgaaacaaagactgggcaaggaaaaggaaggaagaaactcactctgctgactctccaaaaagctagagcttattttgacatgaattttcagacagcctctagtaaggatgtaggttgtggagaaaggtgtgtttgttgggtgctcaacaaaagtcatttaatagccgagtcctgaaaatgtagacattcttgaatgactacattagagtaaatgaaaacaaatcatttactccaagggattgcctcttaagtgtcataaagcctatttagtccatatttggggaaacaagtttccagaaaagtcagagatgaaatcaggaaaaggccatgctctgaaatggaggctagtaaatctcgccacagtcaatgagttgccatgttaccaatgtctctttatagaatattgtaagatgtaggatctgtatctaagtccaccagtatcattctgatgttataattgtactttacgtgttggacatgaaattacagtggctgttgtcattaaaagcatcaaacaatttaagaataagaagaagctagtacatatccaagattgcccaaaggagacaatattacggttttagataactcatacattttagcaagaaatatttctacagtggcgaagacaattgatatagctactctagtgtgattaaaaatgtccatttagagcacctgaaaatgtgttgtaattctgtgcacccaactgaactactgttctaaaacttaatttacaaaacagattttcagggagagtggttgaagcaacagattgaataatcttcccaggagggcaaaatcaacaactctttgcttatgtttcccccacatattctatcacagcactgtagacaaaacaaaacaaaacaaaacaaaacaaagccttatcattgcattttaaatgcaattttaaaatttcccatggtaaattaataaattaagacttttactaaataaaatataatagcacagccttatatatcttcatgaaattagaaaaataaattccagagtctacaaaactgaaggccacacttgagaccctttttgtctattaaggtaccagctcctattaaggcacgaaatcctttgatggattaaaaattttgtcacatccagcttagttataacctatgagtattataggcaaccttgtatactatagaaatcatattggtacagaagtatagttcagtgatatggatgagaaattcatagatcatatcagaataaagaaagaaaagacagactttaatagaaaagaaaatgtcttacttggttaagaatgtcttgtttctgtgcatgcaaggaaagaaagaatacatgtgttaatgtaagatactttatactcattatctcatatctctgattatttagctaaaagttcaagtttacaggttgattttaaaacacaccctagatccataggcctcaaaaggtggttccgaaacagtggcatcagcataagttagaaaactgatagaaatgcaaattcttgacccccacctcagaaacactgaatctaaaactgcgtggggtcggggggaggcaggcagcaatccatgttttgacaagccccccggttgattctgaggtacactaaaatttcagaatcaatgactagatcaatctttgtatataataagcaaactgttctgacattagataaatataatatgtaacacatacagtgtgattaaaatattttagaggattaacagaaatataaccatctatataaaggtatattagattttgaatatgtatttcccattcctaagatatccttctattagcgtcacgcctagcatctctccatactcttaaagattaaaatatatttctatacacatctgccactttcttcccatatctcagctgtgagtggaacaatttggaattgaacttgaagtccaagatcaaaagaaaaaaaaaatgtgtggaatgctaaactggtttcccctcatactaccaaattctactgctctcaggagactatttacatggcctgactatgttttactgagaataacctcactgaaactggatctctgctacaaactagctgtaataacgttcttaacattatattatttacacaagagtaggtggaggctaataagactctctccccttgtcaggcatgagtcattaatatgtatgtgtactgggaagtgccacactcactacaaaagcaatgtcttcccatgccttcccctaacctttctccttcctatctaagaggatgttcctctcccctatggcttggtcaatgaagtgaagagcacagggcattagccttaaactgggattctagtcaattaggtttttgttgtggttactgtcacaagctagctggtgaatcttggacaaatcatttcacttttcttaaaatagtttctttatttaaaaactttgtaattttattaatttgggaatctcaagacctttgaatggtttttattcctacagaatctttaaggctattgtttagatttctcttattcatttcttcaaggaatgattatcaaatgatctttaaaagatgggaattaaaagtaaatgattcattcacatattatacttaatattttttctctattaaaatagacttcaacaggtcatatctttttgggttaaatttttatccccagcactttaaaacttcagtaattcaagtgaattataagcaaaatagtacatctacgatttaaacagctttatgttgtaggaggataagcaatttaatttttgcaaatacattttatgtaaatgatacaagctatgttccttttagaaaacgatgaattaattattcattccaaattcaggttgcattactcaattgtccattttttcttgtataattcagcatcattaactagtcatcagtgcaaacaactttggggtcaacttgaccagccaatgcagagtgataacttcacatgtgaattgacattaggaattctgccatattgtaagagtaattttttataaattggatgaggtcatgtattgaagagaactttaagggcataaagatttatttctcatcattagatattcttaattattttcaattggcttttagaagatacatactagttttttaaatggttatataagccttaaaattttcttccgaaggaaaaattttatgaaaattaactaagatcagagagtggttttgctcttaatttagaattgttcttgggttgtaatgagatctaactttttgtttttcaactgttcgttattttaataacatgtttcaacaatagatctgtacatttatgaaatgtattacattgttgaaaagggtgatatgtgtgtctaataatgatctaataactacctcaaaaaatgcagcatatggtgactgataattctcatgaaatatataattacagtaagactaagtcttgagagtcctataaataaaaaataattgaagcaaaaaggctgctttgcaaacaagatcacttaactgagtttgtagccagcagctatcattatggagaaaaacaggttttatctctgtatatagattagataagcatgtaagttttcaaatattgttgtgaatataaatattaatgacaatttttgtgtcttatagcaattcagtgctataattcatctttacgtttcccaccctgctttcttaggctttgagattctcagttttgtaagtttagctgctaatttttttttcctcctcctctatggcatctagaaaaatacaagggaaatgtaggtcaaacatctattttttttctaatacagaaaaagggaacggctttaaatagcctttattttctccatcatttataggcaccaaatattaattttattttttaagaagaaaataaattccaggctaaagagttttaaaagttacagtaatgtaccagaatgtagagagaataagaaaatatgacatgaaaaatagctaactacgagaaatactgataggaaatttcaaaacaatttgaatatcttgagggttatgataactaaaattaagttctagaaatcccagggaagtacaatattgaaagataactaagaagtgtgctcttgcaaacatacaaaaaaaaaacaataatagcaaaaaataagtcacattttagtcagcaaacaaatctatctagttaatacatcctgacaaaagggtcttttgcaaagagaagtatgaagcaacgtaaatgttgccttctgaagctgcaaatgaactaacagtaatgatgatcgaacatttaaaatgtaacatctctcaactaatattaaataggttatttaacaagcaattaggaaggaaaaggcattcattccagcatggtattcaaaagcaattgacaagacatgcaaagttttcataagaaaatcttaaagaaatcttaagcttactggtaaaaggtaaaatagaagattaaaaaaattcctccctttttgtacaagttggttccttaaggtgacggaccaggtataagcaacacaaaatccttctttggtcaaggaaataattgcctgaaaggggtaactccctacccctacaccaatatccattttggattgaaattcgtgggtcatagactgagagccaagcatactccttctctattttatccaatgctgtttcctgacttctaggaaaagaaccaacgctacacttaaatgattcatattctttcaagcatacaatatagaagagttatttgaacgaaaaatgtacaacatttaatatatcttctagaatagcactgcattatgaacttcattttgtttatgttatgatacatggtaaatggtttatggtgtgcatatatatatatatacacacacatacacatatacatacatctgtatcatacatatataatgtatatgtgtacatatacatacacacacacacacatacatttttccaagaattgtttattaagaaataccctcttccaagcatatatacgaaactgatataaagaaaaagaagttttaccccttcaggattatactttgcaagcacaccattaccatggaattcttcaagaacatcctttaatttctttgtagaatctataaaaaacagaaaacacaaaaattgtttatatgcacatactgtggttgtgtagcccagtccagaaacagagaccacttaaaatgtaaataagcatcagcagaaactaaatttaaaaaccaacacataaaatatctcttgccatttttgaaaggctatttaattggaaaagaaattgcaaaggagcaaaaagatcactgcattaaataaaaacaatacagctggataagaaaaatatgggtagctaagcctcaatggtgaatccatttagagggacgctatagattttagtatctgtagatatttttaaggagaattttctctgtatacataacacaactaaactaaagcctactttagtaattaaagttttagtaagtaagctttaatttagttgtgtcacatattttaccctatatatgcattacgaataacattttagttttgttatgtataaattaaagcttaccctattcaatgaagaaacaaagcttagacatattaccaaaagaattataaattattttcttcaaaagtactattatttttaaacctttcatcttattagttggtgacaagaaattttaagttaataaaataatgtcataaaagaattatcagtattacaattaaagttaaatacattaatatgatatagatatatacattcagtctactaaaatatgctcattatacttattgaaatataatttttgatttagaaatctcagaattacaacgcatttttaagttagaaggaaataatagctaacaaatatgggtaagtcatctaaatatttaatcaagtttgaataataatgaaaaaacctcaaaattaaaatgtaggaaatacatggatttcccagttttcttttatggaacagagcatggaaaattattggctaccaattgaatataattcttgttgaccttccctaagagtcagtgatacttggactaccacaaaatatttcccagttccagaaaactaattcacaaattagcttttgaaacatcctgctagaaaactctctcatagatgcccattgaatatataatgcctatattttgtgaattgtacttttacttggaatgtaccatttcctttctttatattgtaaattctgtgggtttgtgtatgtgtgtgaaacaatagatagatagatagatagatagatagatagatagatagatagatagatacatagatagatagagtttcgctcttgttacccaggctggagtgcaatggcacagtcttggctcactgcaacctccatctcctgggttcaaccggttctcctgcctcagcctcccaagtagctgggattacaggggcttaccaccatgcctggctaatttttataattttagtagagacagggtttcaccacgttggccaggctggtgtcgaacccctgacctcaggtgatccactcaccttagccacccaaagaactgggattacaggcatgagccaccgtgctcagcctgtgaaacagtacttttaagtgagataaaattcgtgtcacataaaattgacattaacaatttcaaagtgtacaattcagtaatttttagcatattcatgatgttgtgcaatcattacctctgattaatcccataacattttcatcaccctgtaaagaaaccttatgcccattaaacagtcactccctgtattttctcccctctaacctctggctatcattagcctattttctgtgtctatggatttgcctattctggatatttcatgtaaattgaatcatataatatgtttcctttgtgtctggcttctttcacttagcttagtgttttcaaggtttttccatgttataacatgtatcagtacttcactcctttttatagctgaataatattccattataatgaatatactccatttaataaatctatttatcagctgatgtacattcaacttgtttccaggttttggctgttaggaattctgctatgaacattcaagtgtacacgtttttgtataaacatataattcaattctcttggctatatacctgatagtaaaattgccagatcatacagtaactctatgtttagtgttttgaggaactgccaaattgattttcacaacagctacaccattttacactcccaccagtaaggtgtaaggattccagtctctctatatccttgccaaaacttgttattttctaaccctttttttgttacagccatcctagtggatgtgaaatgattcgactcacatctgattagtcattcgctaatgactaataatgctgagcatctttttatatgcctattggtcgtttgtatattctttggcaaaatgtctattcaagttctttgaccattttttaattggacggtttgtctttttgttgtggacatcctctggggggtgtgtgtgtacgcacatttgcttgatgcctatacagcttcctatgtatttcctttttggtgtataatttgctggcattttccatattgtgatcagagttaattttttatgtcatgtcccttgctagattggaggttgttctcgggcagaaaatgtgtgttttcattttagcacaactttcaacttcatcacaaagttgaaacaatagcattgcaataaatattgagattaaattaatcagagctattcctaaatggcaaaaaattacaataattgcttctatatgtactttgttagacacttacactgcagagagagaccaaactgcatatcaaaaagagacatgaagctgaccccttattctcaaattcttctttgtgggtaataaggcactattctaagttagcagaactgcttttacttctttttatccataatcgtagatgcaacccatactgtgcagacccacagagacacacacatacacagatgcatacattctggaatatcatatctcgagagactatgtttattttaaccatatcttaggccaatgataaaatggaaggcggagaaaacaattttggtttctcccacataggcctgccccacaactttagagacactgcttagatggccttttcgtttcaggtttctatgagagtaaaaaacatattcagtaattatttataaatgactcagagaaggggaaagctcataaaattattcctacaatattttattagtgtactggtcatagtttatactgaatattcttagtagagaaatcatgagctaaattaacagccaaaaacctctagatatatgactgccctttccatgaactagggctcaacaatgacttggtctgagacaatttaaagtgctctagttgatattcagatgaatcactatcaattcaactcactgcctctccaattctcaagttccagttctaatatcttaatatttgaagtttaactatgacctgatctccactttacaatctagtttggaaactggagcattatcttgtttttgtattcctgtctcaataacatttcttgggcccagtttctctaaggctgaggccctgatttgaccggtcaatcttctaaagataaggatttgcgcatggaacaccagagagttcaggatatccataacctttcaacagcattgtttttacatgaattatctacatgtcttcttggacacccaaattgcactaggttgtgaaaatcctactgctatgttttaccttcttttggggggaacacacatttatcttatttgtaagttaactgcttgtccaaatttcttcctatggcctatcaccataaacattcctatcttttttattgtgccaactctgagttacattctgtccaaaactacactggggcagtggagaggggaaaggatctataactaggcctgacctgccttctaggacaaaataaacagaggaagttatacctggatgaacagatagtaagacgtggcctcagtcataattcagctaataatagagcttcgggaaagagcacagtgacagatactaggctgagcaatgctgagaaatccaggcaagcagccagccaggcaggcagctgtgagcttggagatcagtttagtaaatacatgtctgtaatgggagaaagaacctggaagattggccagtgaagtgctaggcagcccagtgctgagcagccaggttgaaaacagcaggtttagttcttgggataagggagctggacagatgcgcagcacaaaagattgggtctcctggaaagcaaaggaggggtatgacttggggaaattctgaaacatggggctaatttcagaggttcctatgcttggcttgactggcagggcaggatacttggaaaacaacagtgaatacaaattactgccctttgactaacatatccattttcccagcaagtaatttaatactataccaataactacagctgagacaatgggctgtctttttcatcactgtcagaatcaacttagagctgaaaatggtactgagcatgaaagcgggaggtgttttattaagcaaacattcttggaatgagctgggaaagaacaaagaaaatgtttatggggagatgagttgactttctcctatactttacctttctatcacctgctctggtacttgagtaattccaggggccccccaaaatgcacacaccctgtcaatcttctcatttcggctgagtcatgtaataaacaatgccatgagagttaaatgaactacattttagggatcaacgttaaatttttatttacttttaaaatgttcagaatttttaacgattttcaagaaaaattaaagaccctttacattagtctgaattgaaaataaataaatgactaatagcatttggtaacgtttagaaaatgcaaatagatcataaaaagtactacatgaaaaatgaaacacttagttcctctcacatctctttaggcatctgttacatcttgagtgagtctcctttgtgattttcctgcctctttgtctctttattccaaaaaactcaacacatacttgtcagattaatctcaaaggccccatgaagtaacggagagatttaaagccagctagatttagatttgaatcttggctccagaatgcttggctgaatgtccctgggcatatttttaacctctctatggttcagttttctaatatttaaaattagaataatgatagggatctggcaatactgtgtctagcaaagtgtctggtgcccaataaatccttgttcctttatttcatcctaaatgtgactttaaacaaatcatcacccttcaactgtttcctgttgcttttggattgaagcacaaactcctcctcttggcaccataggtgtgtcaaaatatgatccaaatctatcttccaacagttattttctgtatcttccatatttactattcaatatccattcatccaattgtgaaggcatcccatcatcccatgattttagagctcttcttttgctgatgatttttttttcctcaggaatcccgccaatgttgagtgaagttcaacataatgtatggcatggtttatctgtcaacttatccacaaaatctctcaggacctcctcaaacacagtaggttgtaactcatcctccatgggacaccccataataactctctcagaatctacatctcatttgtgcattgggcactagtaacactattaattatagcttgaatgcatgagcattttagagtttgcaaagtgttctattatctcatttaaaattcacaataatgttaacaaatattcactccacttaacacatgaagaaatcaaagttaaggaaattattacctacttaggatcacacagctaaaaagtttcacataatgattcaagctattgtatatgacccaaacccattctcgtcactttggaaaaagaacaaatacaagtttataatttggcttaggaacctcattattacaacagctaaaatcacacagccaaaagaatgtacagtagtgattcaaactcctatacagtaaatatattttaaagatcaaggccaataattttgccacctaaatagtagtcatagctgctgtgagaagactatcatatattctactgttaaagctaagacccaacttacaaaatgcatttgtcatttttgtaaataatgtgtttttagtggactgactgtaagttcattatctggtgtttttgtttttaaccaaaatagtgccatgtttcccacgttcagtagagatattggttttccaggctaatatgatagtttttacaaagtgagagaggctcaatgggaccatggaaaagtcatctttcgggtctctcaattcagtgctttcaaaagtttcctttaaaatctaagcctccccacatagctttttcctcttatcacaaaagatattcgtggtatagaagacttttcctgtgctcagcaaaaaagcattttttcaggaactatattaaccctgtagtagagagggctctgcaacttcaactgtttaaagagaagatttttctaatttaaatacttagctagcattaatgtgcagacgcattaatgctaagtatttaaattagaaaaatctttatcaattatgtcaatgttaaagttataattaatttatataatttaattgtataattgtatagttaaattgtattaattgttgtgcagacaacatagtagcattcagtccaatgttacatttcataaagtttcccttagctacatagtacttaaaagtagtgaaatagtgctttatcttcatttaacccagtaatactcaaacctggatccatatcaggatcatccggggatcttttaatatacactgatgtttgcactcaaaacacagtgaggcagatttaattagcctacatctccatgactggctagtcatgaggacctttaaaaaaggctctcagttgagtcttatatgcagctgagatggaattaatcactgctctgatccttaaatacatgcataaagaaagtgagagttaatcagcaatttttatcctgctaaattttcctatgtatgaatatatattttgtctgattgctacacggggaacttcttttagggaagaaaaaaaaaacctcatgagaacattttatttaaagatttatttactctcaccttaggtcacaatagcaaaaatagcattttggaatccagcagagagatccagaaaataatattgtcattaaatgaaattccccagatgatataaaagaagttctacttagagccagcagcagaaaataaatacctacaggactatagaataagagatttagagaactagtcaataagaaacagaagtttttatctacttgtgtgagaattttcataaaagtacaaagagattgaaaaagaaatatggaactattgttaaaaataataacagccatattgtagcagtttatatgctatttgaaatctatacacttggattttttaaaatcctaaaaataatattctaatgatactgctacagtgggaaaagctgtacaaaaaccaaaccctctattcaggtctttgctccaggctcaccacaggattctgggaaaatcctttaagctgctctgagtgcaagtcactctctacttgttcctgctaagcatttgggatcatcgttagcttaaaaagataatgggcataatatctttgagcaacctgttacacatatagcaataagtatttctacttagcaaaaataaaaactagttaattccaaaatgactacagatttgagaacatgaagaaaatttcctttctccttttcatatttattatcgttgttaatcctcttaaacatcagtttttattaactctttcttgtatttgctggtaatttttactccttcatctatctacatctaatgttttgatgtatgaatctaatccaatgccttgcacaaaatatttgtaagagtcatttgttttgatagacaaatatctgctaatttagccagcaaccctatccagacactaggaacctatgaaataatttccacctttatacgtattttattgtgtagaaaatacattaagaaaaagagtatacttgccttcgagccactcatctatactataactaaaaacttctattgaaaacataattgctaattaagagatactattagggacagaattgactggtgtggaccaatagtgtgctggtaaatgtttaacaactctttgggatgtgaagggtgcctactgtagtgtttgccaattgctgtcttgtaaatatttccaccatgacaatttcaagcctcccacatgacatcattaatgtggagttgggaaagaatgctaacattcagctctgataagcaataattaatgaatcaatctatatgtgattatttgtactttagaaacaataaataggtctttaaagacaaatctggagataaagaacggaaataaaaagcctgcagctatgacttcttaatcattctttcaaatattctcaagccacctattgagtttagaacaagtactgttccaactattggaatatatcattgaacaaaacagaaaatatgcctaatcctatagtttgtattctagtgcaagaagatagattacaaacataatacattattaagacaatcttatatcaatgcagtatagagatgtgatggcatggaggtgttagtggtggagtaggaaagatgaattattttgaaagtagagccaaaagaatttccttattgattggatatgggttgtgacagtaatgtgtcaagagtcccagagttgtagatttgagcaattggagggataaacttgccaataagtaaaatgaggaacactgcagatgaagcatgtttggaatgaggagtcttcaattttagttttaggcattttatatttcataaatatattagatatccaagtgtagccattaggaaagcaattatttatgagtgtggaacccaatagagaagcctgggctgaagaacgaaatttgagtataatttctatataaacagtatttaactggatgacatcacatgtatagtgattgtagatagataagatagcaaggactgagttttgagtctcagttcactctgcagttcaagtaccaggaaaagagatgcaatctgctaggaaactaagaatgaatgcctagtgaaatagcaagaataccaggaaaaataatgtatcccaaaagcaaagtgtcatgtaatatcaagttaaatgaggagcagatttagcaagacttttaagtttagccagaaggaaatcatttgtgtccctttcaagggctgtttcaattcagtagctgggaaaaaaaaaataaacccagagtgagtttaagagaaaatatgatgagaggaatgggaggcagcaaatataggcaactcattcaaaaacaattttttgccatagaaggaaagaatttgggcagtagctggactgcaagaagtgaaggcaagataaatttttttaaaaaaagagaaaaaaaacagcattctaatagaaattattcagtcgagagagaaaaaaataaaaaattaaaaaaaaaatttttaaacacccactagaatgttgtcctttagtgggtaagagagaatgcaatcttcttcatagcagaaggtctggcttagagtggaggcatggacagtttacctaagtaggaaggcagattgacaagtgctgcttaattaccattcactatttgtcatgacatcattactattggtaagtggatataataataatgttttctttgtccttaggctgggattagtagctggtgcatagtatatattcattgacagtgagcccttatcatcatcatctgtgccatcaggcttaagctaagctccggggatttcatttttctataaccttaatttcagattattcacaattttcttaattttcttttacattttcactagatgcttttaacttcctctctttaaccaacaacttgaatacaatataagatgtcttaaagttatatgtaaaatagaaattgtatatttttttgtgttgtaaaattcacttttgtgggcaatagaattaaatgcagacattttatgtgtgtaaatcaaaatgtttaaggaaatgcaagtatgagttacatttttgaatgtgtacattaaaaatatttaaacccacgctagttcagaagatgacaacttcattttattttttttaagttcttatgtgggttgcaaaacacttactggcaaaccaaacattctggcaacaattctgtattctctagtcacaacactaataacatcctgttttaagacaatacaaaatcattaaagttgacaattagtttctgaacataaaaagattcagctctctgtacacttaccaacaaacacaatattaggcaatgtggagaaaccaaagtctatttatcctgtgagcatatacattttaaggaatattatttgctcacatacatattttaaagaacataaaactccaaaatattgttcccaaatcttacattgagaacaaaactcaggaatgtgtcatatttaccttgtgactttatgcatccactcatctttatggtatgtccggaggcatgaagctttaatgtgagaaggaggctataactaactggacacataattaaatgtagttgaagaatttgcttccagatcttggctcttagatgatctataggatattcttctcacaaagtagaccttcattttctctttctaatacttcaaagaaacaatacttaaggactcttccaggtacagcattctctgattctatgatagtgcatatctccacatacttactagaacttgcagccccacatctcctaaacattcccttcccaattcagaaagagataattttctagcacatcaaattccccaatggtatcagtacctccagtgatatttgcactggtgttataattcaggaatatcttcagaattacagttattactctaaaaataatcatttgatcaagctctctaaaagtttatgttgactgtattaagctgtgaacattgcctacaatgtgacaatcaatctttacattttttaaaaaatttaggggaggagaactgactggaatcaaaacactgcaagtatgcatattgtttcttagttctgaaaatccctgtgaaatagtatttagaagggaaatctataatcttgatttgtacaaaatggcacctttcacaatctatgttcttacattggaacatttgttataacaaactttgtcataatttgctatcaaattaaaaaatacctgttcaaatactagctaaatgtgtagggtattttaaacgagatgatttatgatgtatcttagccgtatttcagacattcatctggtaaaaacaaagctacccctacactgtgtaaacatttttaaagataagaaagaaagaaagaaagaaagaaagaaagaaagaaagaaagaaagaaagaaagagagagagagaaagaaagaaagaaagagggagggagggaagggaaggaaagagaaaggaaagaaagaaagaaaggaagaaaggaaagaaagagaaagagagagagaaagaaagaaagaaagaaagaaagaaagaaagaaagaaagaaagaaagaaagattttgtaaaggagtttagttacaaagccagtttgatatggttttagagatttatagtccatgcaacattgcactatctgaaaatcaaagaagagcagttgcaatgtgtaaggctaaagcagtcttcaaagtgaattgtagaattcctttgaccgatgtgcttatattacaaagaacattctcagtcatgttgatattgggatttttttttaacaagcaccatctcataaatttatttagtaatgaaaaaaaaaactgccaagaacatcaaacataaaatctgccaaaggaaagcgaacactatttatttgtttcctagggctgctataaaaagttaccacaaacctggtgatttaaaactgcagaaatttactttttcataattctggaggccagaggtctgaaatcaaggtgtcagcagggttgtttttttctgaaggctctcataggaattagtttcacacctctcctctagtttctggtggctgctggaaatccctggcaacctttggcttgcaaactcatccctccaatctctgccctgtcgtcacatgatcttctccctttctgtctttcacattaggcttagagcctatcagaaatccaggataatctcatcgtgatatatttaatttgattatacttacaaatcacatcaaatgtaattacaaaataatttacattacttttcccaaatataaagccaccttaacagtatccagggcttaggatttggacatatctattttaaagtggaaactaattgaactcagtaggcaaaactttaaaggtgatgttcaaacaaaccttctctgatgcatagccctaaaatcctaatggaattttgtaaaattgttatgtggtatgttcatttagggcctctgagaagccttaagttgcaagaagctggtaggaacacctgtgaaggataaagaggagcaggagtaggcaaggagcgccttcagactatgacactggtctaacagcagcgagaggggacaagaaggtcaagaatcgggttgcaaggcttcatactgtggtatagctctgagaatgtctccactaggccaggaaggagttctccagcaacatcatccattgttgggattctctgttataaagaaatgtcctggattcaccatcacaactgcatttggtcattgcctgggagcagtccagggagagcatgcctccatgtcagaactgtagcaaatctaaagtgtcatgcctaaatgaagaatagatagtcaaagctcatgagagaagttttctgtaaccattcatcaaaattccaagaaaaattgaagaaggaaaattttgcaaatatagttcctttgatatctctagggaattctagaacatcccaggacatcattctaggattggtgattgtgagacaatatccaagagatctttatgcctcctagcaccactgttatgattagagccaagaggtattggcaaccttgaaggcatattgtggcaggccagttttcactaacagctgaacagacaggcctccatgacaactgttttagcactgactgagttgttaatttaaatattaaaagcggatagagccagtgctcttatacaaagggtggaatgtaacaaaagcccaccaagagttttgcctagaccattcctgggccttgaagcgtaagaagataatgaaggaattcttcacaggatatgtttagaattaaataagttttattgggggtatctgaaggaactcctcacacctccactaacaagttttattggggtctaaatgaactccccaaatctctttgatttagcatgagcaaaataagggtagccacccctggcacctggacccatctggttaaagtaaatttactgaggctccagaggaaggtcttcaggactctcagaccttagttatagattagaggttaatcacatatgtctttaggtaaatacaaacttacatgtagacatatagctaagaaggtatacaagctctgggaaactgtaattttcagttggtctggtgatattttcccagcattctccctgtacccggtaacagaaataaactctcttctttcccagtttgtctgcatctcgttattgggcggcaagaataagcagcctgaccctcactttagtctgggaacaatattacccaatgctggtgatgtagtatctaaagggggtgcttatatagatgactttgctttgatgaaggattaattaaatggtcttgatagcaatgaggacaaagctctgattttttttcttgcccaaattcttttctatggggtctagggaattgggccttacaaatcataaattctcatcatcagatgggttttatttaaccctgtatattgtgacttactttccagtctgattctggcataactagggaaaaaatcaaaatatattttccccaaaatatatttccctgccataccttgaaaatgccctgcaaagtctcttttgggaaaaatccacattcaatagagaatccccttccccctttgttttccttcctttctttccagatccaggagataatcaactaagcgccaggcacccttttaggtctgataagaaacattttacaacctgctgtctccctgaagtctgatatctgagagatttctctgcacagtaatacttgatctccacaattctttatcttaacctgaacactcctttccattgatcccaggtctccagataaactcaaccaattgtcaaccagaaaatgtttaaatttacctagagcctagaagcccccggctttgagctgtcccgcctttctgaaccaaaccaatgtatttcttaaatgtatttgattgatgtctcatgcctccctaaaaatatataaaaccaagctgtaccccaaccaccttaggcatatgttctcagaacctcctgagggctgtgtcaagggccatggtcattcatatttagcttagaataaatctcttaaaacattttacagagtttgactcttttcattgacagcaagtaggtactcaaattggtcaactgggctatgaaaagaatctcatgcctaacaataaataaagtatgaaaaaagaactggttctacagtttgtcgctaaacttccaaaatttttttgaagagaactacacaaaacagatatgttaatctggtgtggaggactgtcttaccacattggatagtaaaaatgttgaagaatttttatgaaatacacttacagaaaagaattactaaacttaattcttatgaattagaagagaaagcatgcatatttgatgaaaatctttaaagtttagatcacatagataaaataatgtagctattggatatgattatgacatgaatgcatcacacactcttcctatcatctgttacactgacaccaagaaagtgaatggaaagagatatccaatgtgaattttaatcctcccattgttgctgtctatggcatcagctgatagttgaggatggacagccatccatttccagagtcaaaaccaccaggaggaaatcatccattgttttcttgtacttggacatagccagacctcaggcatttactttctgcctttctcacccctcaccagttccctcctgctcatccttccccttcagcaagcagcagcactgactacatcttccagctttctcttttcaccgctgtacctcaattgggttatcttcaatgctttaatcttcaaaagaaacaaaacatgccttgtctcctatgttgctttgttaagagttaattctattccttgtgtttttaacatattatttattcttcaagcttctgcttagaagaaaaatgtaatttgtatctaatactttacaagacagcatcattgtatatagaatggatatgtactaataagcacataaagtgctaaataattaggtgttaaatgattaaataattgatactttagtgctttatattacgaaaaagtctttgttgagttttatatacatgtttcagtatttattattacttgggaaaatttggttgggtgttttcataggttgagaatgcattcttattttccctactaaaaataacagcatacaggcccctactattaaaaaaatcaatgtttaacatgtttacaataatgtgttcgattcagataatgaaggatatatgcattacacttattatgtagaactaaaaggtacagagtcagtgaatttaaagtaaatgaagaatgacagagaaggtaatgaagagaccacaagagtgagaaaagcaaaaaatagcattgtaagttaaccaagcagatgggacagtccaactaaactggaacagtgtagtcccctttgttagctgctctaaataaggggttctatcttcacatatatagtaatataatcaacaatgaggggcacaaaaacacatgatcaaaaccctctaccttagaaaaagttccagaaagaagaatgggatggcttttgctgtgggcaaaagctgagatcaccaggacatgtagatgggtcataaataaatatatatatatacttggcctacattttgtgggaaattcttttacattacatcctgtgttgttagtgctaaacagttacatttccatgaacccacattgccttttaagtgttttgtagtctctcggcaaagggggaaaaaggctcctacacaataagctcattttcctgagggtgtggcttttgcaaatggacttaaattactagaatttgtgacagccagctgccttggtttttgtttgattgtttgtttgtttttgccctgacactccattagtgttatttattctcactcataggcttgggaggagtgcaaggacaagttaaaaatctgtctgaatgactgggcagaaaagattttcaagccatagagaaatgtcttaggcattgttgtttctctaatgggaagagcctgagaaaacacttggaaagtatctcctccaaagttacagtcgatttggagaaaagctatctaaataaagaatatttcaagaaattacataaactttgattgttaccttgcaagaactttgcctaaggcacattgtccaagcactacagaagtataaagaagattctaacttgattggatatttgttccacttgaaatctgaagttacggaaaagccaaatagaggctgtatgaaatggaaaatgtcaaaaatcttaggtctcctcttattcacatattattatcactattactttgctatagcatactgatgattttacttgaatgttgctatgaatgagggtatctcattgatgacttaaaccactggtgctttgaaaatgttatttaaaacttggatcataattgaatatcaattattcttttctcaaccttagaatatatatagtcatatgcaacagtcttctccaaattattcgattttctcaggaaatccaagttaataaagacagatggtgaattaagtgaaattggcagcaaatttatctcaatttttgagatttttaaaaaacaatgtgttattgttttagaattctctaatttctttcctccctgtcttaaatcttctttccatcacagatttctttgcatgccttggctgtattgtccagattgacatcatattaagtggcatgtgtttctttgctattaagctgaagtggcttttatgtttacaggcaagatcattgcattttttatgattgtgtaattaaaaatgcccatttcataaaaactaaaagcacttaaatataagaatatataaccttccatgatttttctacctggaaatgactactattatcactgcagtgatatccttctagaatattttgaattcgtgagcataaatacatatttagaaaattgggatccaaaattacgaaaatggaattagggattacatggcattttgaagctactttttaatttaatatatttaaatttattttcatgttaatatatatatattcatactatcaacagtattgcttgaatggtaattcttttatagctgtaccacaatttcatttttcaagcagcctcttattttgagcatttaaataactgttaaatttgtattcatgttaacagtaaaataaatgtgatatacatacgttgatatggtttggctgtgtccccaccgaaatctcatcttgaattatattaggttggtgcaaaagtaattgcggtttttgccattgaaagtgaaggccaaaactgcaattacttttgcaccaacctaataattcccataatctccacatgttgtgggagcgacctagtgggagataattgaatcatcgagatggttacttccatgctgtttttgtgatagtgggtgagttctcatgagacctggtggttttataaggagcttcttcccaatttcgttctgcatttcttgctgccaccatgtgaagaaggatgtgtttgattctttttctgccatgattgtaagtttcctgaggcctccccagccctgctgaattttgagtcagttaaacctctttcctttataatttgcccattttcaggtatgtttctattagtagtgtgagaatggactaaaacagtaaattggtcatgggaggagtggggtgctgctgtaaagatatccgaaaatgtggaagtgactttggaactgggtaacaggaagaggctggaagaatttggagggctcagagaagtcagaagaatgtgagaaagtttggaactttccagagacttgtggaatggctttgaccaaattgctaatagtgatatggacaatgaagtccaagctgaggtggtctcagacggagatgaggaactgttgggaactggagcaaagattactcttgctagccaaagagactggcagcattttgcccctgctgtagatacctgtggaaatttgaacttgagagaaatgatttaatgtatctgatggaaaaaatttctaagcagcaaaacattcaagaggaagcagagaatgaaagtttgaaaaatttgcagcctgatgatgcgataaaaaaataaaaatccattttttggggagaaatacaagccagcagcagaaatttgtataagtaacaaggagctgaatgttaatcaccaagacaatggggaaaatgactccagggtatgtcacagaccttcacagcaggccctaccatcacaggccaggaggccttggaggaaaaaatggtttcctggactgggcccagggcccacctgctgtgtgcagcctagggacttggggccttgcattccagctgctccagctatggctaaaaggggccaaggtatgactcgggccttggcttcagagggtgcaagcccgaagccttgttagcttccatgtggtgttggtcctgtgggtacacagaagtcaagaattgagatttggaaacctctgcctgaatttcagagaatgtatggaaatgcctggatgtccaggcagaagtctgctgcagagccagagccctcatggagaacctctgctagggcagtggagaagggaaaagtggggttagagcccttatacagcacagagtccctactgtggcacaacctagtggagctgcgagaagtgtgccaccatcctccagaccccagaatggtaggtccatcaacagcttgcatcatgtgcctggaaaagccacagacactcaatgctagctatgaaatcagccaggagggaagctgtattctgcaagctacaggggtggagattcccaaggctctgtgagtccacctcttgcatcagtatgacctggatgtgagacatggagtcaaaggagatcatttttgaattttgaggtttaatgactgccctattggatacaaacttgcacgggccctgtagctcctttgttttggccaatttcttctatttggaagacgtgtttttacccaatgcctgtacccccgttgtatctaggaagtgactcagttgcttttgattttataggctcataagcaaaagggacttgccttgtctcagatgagactttggacttggacttttgagttaatgctggaatgagttaagactttgggggactgttgggaaggcatggttgtgttttgaaatgtgaggatatgagatttgggagagctgggggcagaatgacatggtttggctatgtcaccacccaaatctcatcttgaattgtagtttccataatccccacatgtcatgggagggacctggtgggaggtaactgaatcatggtggcaggtacctccatgctgttctcatgatagtgagttctcaaaagatctgatggtttaataaggggcttttcttcctctttgctctgcacttctccttactgctgccatgtgaagaagggcatgtttgcttctccttctgccatgattgtaagtttcctgagggttccctagccaggctgaactgtgagtccattaaatctctttcctttataaattacacagtctcaggtatgtctttattagtagtgtgacaatggactaatacatacacatttagaacatatttcatctgaaccttaccataaattcctaaaggtagtgtgaacgggtcaacgggctcacagaatttaaggtgttttttttcttttttaatatcctgcttaatttgcccttgagcaagtttgaactaatttaatttgtcatagcagtgtattagagggaagtgttggctcttgtgtatagaatctggaaataattctaatgtgaagcagatctatttaaatctagctacaataatcacatgcttcagtaaaaatgtcacattaattcagatttcatatcaccgtgaattaattaaagagacatcagtattagtaaattttctgacttacttgcattgtagtagagtgattactgaacaccctgttcttaaagataaaagactgacgaagaaaattgctttgaagcagaaagagaacaggattcagagttaaaagacctgtgcaagtggggcaaatacattccttggaacttattgttattttatctgtaaataaagatgacagattgagcaatctcaaggcttttccagttctaaaacattccctgtatgctatattgcagtctccattaagctaatacccacgacctgttttcttgtttttttttcatagaacctagtgcataaactaacttgcaaaacagtcatttttatgtgctacacgctccacattacaatatatttttaaatgagcatgctaggctgcttattaatcagatttcatttcataggattgtacaaataaaatgataattgattttccagtattaattactctgtagcccttggcagatggaatcattcttccagttgcttgattttttagaaggtaaagagaaactagaaggtaaaggtaaactagttaattgaggtctcatgcaaagtttactaacagaaaaacatacctaaactaagaaacgattggttttattcagttagaagggagaggtgaagagggagttgacttgtaaccttgacccttatagataaccaagcattttaaatgtagcttttagcacatttttgtgacttttaagtataagttacatagtagaaagagaaaatatttctttttatttttatgccaattgcttaaattaatcaaaataaattatgtgccaggcacagtggctcacacctgtaatcccagcattttgggaggctgaggtgggcagaaagcctgaggtcaggagttcgagatcaacctggccaacatggtgaaaccccacctctactaaaactacacaaattagctaggcgtggtggcacatgcctgtagtccaagctactcaggaggttgagtcaggagaattgcttgaacatgggagggagaggttgcagtgagccaagatcgtgccactgctctccagcctgggagacagagtgagactccatctcaaaaataaataaataaaatatgaaaagtttgtcatctttatttaagacacatagttgccctgttttaacattattctatttttaattgtaaaagcaggtggagaggggtggggttcatgcctgtaatcccagaactttgggaggccaaggctggcaaattgcttgagccgaggagttcaagaccagtctgggaaacatggtgaaacctggtctctataaaaaaatacaaaaattagctgggtctggtggcacatgcctatagtcccaactacgcaggaggttgaggctgaggatggcttgagcccaggagtttgaggctgcagtgaggcaagatcatgctactgtattctagcctgggcaacagaaaaaaaagaatatgattataaccatcaattaagattcagctagtttaagcaaaataatcaaaatattaaaaaataacaaaaggtataaaataaaaagtaaaggctcccacaaattccagaactgaatattttatccacttctgttttgtttaaccatctgtttcttgtcacaatatctatttatttcctgctataaaaggtgagaaatatacatccaacatacacagagagattcaaaattttactggttatatttctggttttagtcttctgattggcactttataactgtaaatattttactaagaactttatttgttaattcttcaactccagagtatctattgtctgttctctaccaactctgcaaaaaatggtttgacctagctttttctttctctcaccactctttttccaccttttcttaactatacctttatttttacatttgtattcctccatggagattcctcttcttctatatttaattttgttgctgggtgcatggccagttaagatgtagaaatggggcatggaaagtatggaagtgatctatgctgattctatgttgggacacttaaacagtgatgtgccttctgcatgctttctctgccctgcttttgccagctgggaaatgagcgggacctagacccagcctaaagcacatgatgaaagtaacatgagtctataaatgaccctgtgatggagagccacccacagatctggaaaattctccagctgactcttttgtgcaggaaggatataaatgtctttgttctttaaatctaggaatttttggtctctgtgctttagcatcttcgcccaccctaaaaaacacatttccgtattttgcctacttttttattctacagtttcaaaaccacttagcaccatttacaacaataggcatataatagtgttatttatttcttaaccaaatagtgtggctggcccctgagagagcagttgtgatgctaggttaattctatgccacttggagaatgttccaagcatcaggtaaattccattttcttattcttatattcaatcagtagctcaacccatgctgtattttagtttgcatagcattttgagcatgatgttccacagatttttttttcacactgcttatgtgcctttctttattcttactgaggtgcttactatatgaacactagaccttccatacttctcatattctgctctatgtgcaaaatagatccagggttttatatttagataattaagatcttattcacccatataagttgcctttttaacattctttatgctggcatcataacgtagtttctgagaaggcttgctattctttgttcccacctcagcatacacttacttgcctttttttatgatgtagctctaacaataatacatagaaatgcattctgcttcccaatggtttcttttccttgttgtcatgtgtttgttcagattcatttgtgtcacttcttattttgatgtttctcttcctggctgttcattttcttcaaatatcttgtgattcttgattaaacattccaacttgatggcaataagtacctatggttgatttctttcacagttttgtaagtctatttaaccataaaagcctggttctatcaaaaggtaacgtttcccttaagatgtgtggttgagcaaggggccgactaactcacagccttcaaaaataacaagggtggagggcaatatactggtataaagtgcttttgtgtatttcactcctacatgggatttgctttattctgcttatctttcaattcagtattcacattctgggtcctccataagtacactttgattttcaattagaaattagtattctttacaccagctgaatgcaaatactacacatccaacatctttgagtatattagaagagaagaaactgctgcaactcactcaccattatctcttctactaactattctggttgcctccccacagctctcctcacctgctaatattctgtctcaagccagtggtttctatattcattttctcttaatcacaatttttccttggttttcctttctttgctctgggctgtcaattaagtcacatttactttgcagttgtaatagaaattactcagagacttgttcttaatcaggaaatttgagcttgtctgtctttattcaaacaaactattctacttgaaaactatgtagttatttttacgcaccattcttatatgtaatatttgtattataacatataactctgggcttatcctcattactgtaccctaagataatatatttcacaagtttatatccttacaatccttttgaataatgcagtttttgtgtaaggccataaccagctaaatcagaaaatggtattttctttcctctctccatccttctttttcttctttccttccttccaggaagacacagagttttgccatctttaatccctagtatttagcacaatatctggccaaaagtagaaagcatttttttaaaaaaaataattgatggaattattttatttcatttgagacagaatcttgttgtctctcccaggctgaagtgcagtggtgagatctcggctcactgcaacctctccctctcaggctcaagcaattctcatgcctcagtctcctgactaactgggactataggcctgtgccaccaaactcaggcaattttttgtattttcagtacagaatgggttttgccttgttgtccaggctggtcttgaactcctggcctcaagtgatctgctctcctcagcctctcaaagtgctgggattacaggtgtgagccactgtgcccccggcctgaatttttaaatgaatgagttaagtaatgaatactatgattgcactatacttagactttaatattttgtttcttcaaccttggaaaaaaaactttcaccctctaactgggtatatctcatttgtgataattttatttttttcaagaatatttattcagtgcctactctgtcctttgctctaggcatgtggaataaaagcataagaaaccaaaagaaatattaacttcttggaaaaattcatggcgaagggatcagaggaaaaagaagacaaatattacaccaataatgataaaattgtaatagagaattacaggtgatgaaggagagagtgaattaaacaggagggttggagaatgtccttctgaagaagtgacaattcagcaaagatctagatgagaaagccccatagaagatgggaaagtctattcgaggttagtgtaaaggcaaagtggaagagtaaggaggctagtgtgattgtacctcagtttgctcacatgattatatatatatatatatttttaagacagatgcggtcttgttctgtggcccaggctggagtgcagtgatgatcatagctcccttctgcctcgaaattctgggctcaagaaatcccccagcctcagcctcccaagtcactgggattacagatgtgagcctgtctggctcacatatctggctatgtgaacatattattttatactattctctgtaagagtttatgaactttgcctttcttaactttccatttggctattatctaagtcttccataagttttttgaaggctcgatcatttcaatccttttcaccatccctggtaagtaataaacatatagtaacaagattaaatattacttgaaataatgaataaaagagctgattgtcaacctgatcaaattacgtgaattttaggcacatctacaggatatggttattcaaaatatggctcattcttataccaaagagaatacattaagcaagaatttcaaaactcggattcacttgtcacaccgcataaatgaaagaggaagaaatatgtactcctgaattactgatcacaagatatttcaaagatttttgaaggttttgaaacacttgcaagtatgaatgtggaataaagttaatttgccttcccactgcaacttgcccttatacctgaatttcctctcacttattgaagccatttcatcctgctttcgctgcctgattttgctgtttgacattaggcaattaatggagtggttatgtatggtcatttctatctcaataaattctgctcattataaaactccaatacaagaattattattgacattgacaagtgcaaatattttggccttccttttgtcatcattaaatttggcaattacctttctccacagactgtacatttataaagaaagggaaaaagtaaataccaaggatgtttagtgcaatttattttcagatgagagaacaggccttgatagattcaatgctttcctgatggcttctaaagtagagaatgaaagagatgggatctttttcatagtaagtaattacttttattatagagtatttcacacacataaaagaataagcacaaaaatgatcccttgttaaatttctgttaaatacttaaaattgatttgaggaaattttcttgttttcctggtttacaaagaattacaagaatcataaatattcaatattgaattttgaatcataaatataatgttgagttttactgaatgcttttaattttttaaacatgaatcttttaatgtaaattgtgattcttgcattcttgaagtaaatataattagattatgatatatattgcctttttttttactacaatctactgatgtatccttttcagctgaagctcttttttgttcttttactttactgctctgtgtgttctatcgtctaagcttttctttggttatactagagagaacaacatacattcttatgttattaaagtctagttttaatcatatcagaacaatataaacacctttttgaccatgttcaccatccgtccaaattatatgcttttttttttttttttttgagctggagtctcactctgtagcccaggctggaaggcagtggttcgatcttggctcaatgcagcctctgcctcccagtttcccaggttcaagcgattctcccacctcagcctccccagtagctgggtataggtgcacaccaccatgcccagttaattctatatttttagtagagatgtggttttgtttgttatgttggccagattagtctcgacctcctggcctcaagcaatctgcccacctcagcctcccaaagtgctgagattacaggtgtgagctgccgcacccagtttatatgctatttttgattaggatttttgttatctattttttagtcattgttagaaattattacaattacttatgcacctaagatctgtttaattttgtttgccccagggcaacctggcttcattattttacctcctgtgtcaactgctgtttttttttttaatgtttttttggcctttgggaattttttatacttcttgtgatccctacaatatattctatgtgtatttgttgctgaaatacttttcaatatgtctagtctgccacactactggtctctcattcttttatgatagcacagctattataaactaaggttatgtatgtatcacagtaacttgtccattatctctgtcaactgtgagatggaggtcacaacgtgctttctataaagaaagggcaataaagagtcaactaaatatcatgaacaattttatctgtatttttcatttccccttgacattttacacttattttatcacatgactttcaaagtctcggaaaaaatataaagaaaaagtaatgttatataaaatatggcactttaaaggtttataaataacaaataggcattttaaaattcttttcaagtatcttattataagtattttgtaaaaagtatagaaaacggcaggcaaactcactagctcattaaaatagcttcagtgtcattttctaatcttcttgccttgtcatttgatttactttggctcttaatatctattcacttatagattagttcatcaaaatcatatgtatacatgtatgtatatacatgtatatgtatataattttgtgcacacatggcataaacctcaaacgtcatgactaaattaaattaaattaaattatatccattcactgctgtacttttgtctgcagaactgaaagagacagaggattccttagaaccgaattaaaaattcaagaccacctgcatcaaaaacatgtgggagaaagcacataactggaaaagcatgtcacagagaactgtaagcctgctctgccaagctgaaattctaaaatagaaaattaaatattgaaacataaccttgaaatacacagccattgtacattcaaaagccatgagagccattatttctgaaacaccacgtgaaattaaccatttattttacactccacaatatagactacatcaaatttatctgaatactattagaaagtacaattttcagacattaaaggaagaagtttttctttttttttttttgcaagagctgtaagatctacggataaagaaagtcatctttcaagtttttattccataagcttaaagaattatttacaaaatagtttttatattccttggcagaaaatcctttttgaaagtcatccatctttcctttttttcgtcttcatgacatttgcaagcaattgtacagagatttcctgtgtcacaaacttcataggaatcaaagattagaaaaatttccaggaacatgtacacacacacacacacacacacacgcacacagccttaagatattatattctagtatgtagtggctagtttcctacgaacttggatatctacaaataactaatttctaactaatcctaactggttataatcggttgaatgtgtgcatgtttgtgtgtgtgtttatattttaccaatcaggttgtaatgtctttggaacatttttgccattcctccatatttaaactgaaaatacctaaagaccatgtcaattacttcccaaaacagactgatcaactcctgtaaaattgatggcagctgtggcccatctggagtggctgctgcaaaagagctggctgcagtggggaggcatggccagggctgtgtattccctggagccggggggaaccaggaacaggcggaaggcctgtccccttaagagttggtgggccaggagccctgcactcccaggcacagctgcggacactgtgctcagaagtacctgctctcactgcctggcttctcctcgctcctggcacccactgtgatttccgagcaaagttgtggctgagcctgtgtcacaacctggccagatgtgcatgcacttggggtgacactgacacatcagccccctgtcacctcagccccctccagattttgggtgccaatgagcacggcagggaagccaaggggccactgaggatggctcggcataggcccgcaggtgcccctttgcatgaacagctaaaaacccgagactcagtcagactcaggcagatgacggggtgactgcctgtggagaagaactacccactgtggatctcctctccactgagagctgcaaatatcaggatgatctgactgtggagaggagctatccactgtaagtctcttcttagctgagagttgagcagattttgggacaacctgccagtagataggagctaccccgtttgggtgtcctgagagctgtactgtcactcaatagagcacctcttcaccttactcaccctccagttatctgcacacctcattcttcccagatacgggccaagaactcaggaccagcttaagcaacaacagtaggacacaattttatagcggagtgtgggggcagaagatgtaccattttaattttttatatattagcaatttattaaaaattaattagcatttcacaagcaatgcaattatttagaaataaagctaagttcagagtcctacttattacacagaaatctgcaagagaatgtcacccctatcaaacagaataaaaagccttttaatctaaaacactatgtatcttttatgttaattccataagttagctgagacttcaaagcaatatggtgaaattaattccagagagtgacaagatccttgaaggacacatgcattgtttcaccactgacagaggccaagaagaaagggtgatagacgtagagatgcataaaaagaaaacaacagatacatttttaaaattcttaaaggtgaagtgtggtcggggtaacagtttagtctggagaactaagagtcaccagctcttctccacccctctctgaaggtgctgacaagaaataatgtgggcaggcaagtgattgagaggcctccctcctccaggtgacgtgagcatacccccagtgattggcttttgctgggaatcaaatacaaattttgcatagattcttcacacagagcaaagctgtctgttgctggagaagggacaggaaaacctctcctgcctgcatcctgcaatgaaacaaagcagttttctgctgctagcaaagaggaggaaactccctctcacccaagatccaccaccattacaggtcagcatttgactgcctttgaggcagaggcacatagggcctggccaagggcctggctaagactgaggttatgacaggagagtaaagacaaggcccgggccccttgcagcatcccattgagtaacaagccacagcaaggtggctgttgggaaagggtatcctctggtacctttatcccagacaaaaccttcttgctattgaaggatgggcacaaatagctctaatgcccatggcattgccctgatacaaaacagatctgtttgcgtctggagaaggatcaggaacacagaaagagccccatccctgaagctcaggtgtacagaatctttctaagcctgaggatgcagcagaagatctgaaagcttccaccaccacctcaaaatccaccaaagccttgtctattaactatgccttttattttctgtgttttcatgctttgacatcttggggtcttgctaatgctggaggaagtattcctctcaggttagctaattcctagggacagcaaaatagttgtctgtgagcattcctatcaaacacaaaccaatgaatccagtctacactccaacaccttttttaactgagctttcatactctgtgccactatccacttaccctaatcacctcagggccaggtaacagacaactatgggtagcccatatcactcagaacctgcagaaattatttaaactagcccatcccaagcctgatgagcctcttacttcccctggaaaacacaatcaagtttcttgcccaccttttcttctcaccctctctcctcctggtctcccctaatgcttccctgtgtactgcctgtcccatggtacagtgggttcctttctctcgggattcgtgagtgcaacaaactaccttcccaatggcagtcagttcctaatctgttggccttgtgatgcctaaataataaaacctgcttttaaaaaaaccgtatgcccaggaaaatacaatagcagtcttctccccaaaggtgggaggcagcacagataaagccccctctgtgtcacaggcactccaggcgtgccgaaggaaaacagtggagcagaaacacagaaaaattcagtactccagacccaaccttaagcacaaaaaagctgcagcttaccactggaggaattttttttttaattaaatgttgaaatttgagataactgcagattcacttgtagatataaggcatagagatctcgtgtgtcctttcctcattttctctaaatggtaatgtcttgcaaaattacagtacaatattacaagcagaatattgacattgatatgatcaataaacagaccaacactgtcaccacaaaggtccttcatgctgccctttagtaatcatacacaattccctctgtctctcacttcctcctcaacctctggcaaacattcatctgttcttcatttctataattgtgtcttttcaaaaatgctatgtgcatccatgttgttgcatttattattgatccatccattttttatcactgaatactattctgtggtatagggctaccacagtgtccttaagcattcaccagttgaagactatctgggttgttttcagttttgggctattatgaatgaagtgcttttaaagatttgtgtataggcctttttctctttttatgagacagtctcatcctgtctcattaaaaaagacacaatcttcgctcactgaagccttgacctcctggctcaagtgatgctcctacctcagccttcccagtagctgggacttacaggtgcatgttaccacatctggctaatttaaaaaaaaattttgcagagttatggtctcatacaggcttttatatgaacatattttcattcctcccagagtgcatttgcctaggaatgcatttgctgagttatatagtagtgccatgtttagttttttaagaaatggccaaaatgttttccagagtgctgaaaaaccattttgaattcccaccagcagaggatgactgatacagtgtctccacaccctttccagtagttgatgtcgttaccaatttttgtttagctattctaatagctgaataatgatatctctttttggttttgattgcatttccctaatgggtaatgatgtttaatagctttccatgtgcttatttaccatctgaatattctcttcaggacaatatctgttcatgcctttggctcattttctaattagattgtttgttttgtttttacttcgaattttgcgagttcattatatattttacatgctagtcctgtgatttatatgtgttttccaagtatgttctcccactgtctacctttttcttcatttctcttaacagaatctatagaagaccacgagttttttattttgatgaagtccaatttatttttccttttatggattgcactttcaatatcaagtctaagaaatgtttgcctagcgttagttcccaaagattttcttttatgttacatttttttcacccaaaaactgttcagttttatgttttaaatataagaccacatccattttgtttaatttttctgaggtgcacaatttaggctcattttttttgttgttgttggctggtttatttatttaatggatgttcaattactcaagcacatttgtttaaaagggcatctttctaatattgagctcttgtccttttgtcagaaattatttaggcatatttttatgggtttattttagggttctctctgtcattgttgatctatgctttaatcctgcaaatatcacaggcttcattaatgtagcttgtatatagtaaggtcttaaaattgggtagacaaattcctcccactttattcttatttttctaaataattttggccattctagttcttttgcctttttagcatacgctttaaataaacttgtctatatctgccaaaaaaaattcctggcattttgattacagttacattaaaatctttatattattttagggagaactgccatctttgctatgtttagactcccaaccatgaattgtatattgatcaatttatttagattttattatatttccttcatcagatttttaaaaatttttttctttttgtaaagaacggggtctcactatgttgcccaagctggtcttgaactcctatgctaaagcgatcctcctacctctgccgccttaaatgttgggattacaggcgtgagtcactgtgcctggcagaattttttagttttcaccacacaagtcttgtacatattttgttagacttacatctaagtattttggggagttgtaaatgatattgtattttgaatttcattgtcaatatatagaaatacaattggctttgggatgtttatcttctatcctgcaaactttctaaactcagtaattctaagaagctgtttttggagattgctggaggttttcaaaataatcatgtcatctgtaaacagtggtagttttatttctttatttctgatataatttttttattttctttacttgtcttattgcactggctagaaattcaagcactatgttgaattgaaaaagggataatggacatctttctcttcttcccaatgtttgcagaaaagccttcttttaccattatgtagatgttaagctgtgggtattgtatagatgctctttgtcaagttgaggaaattcccttctttttctgttttatcagagaagttttgtttcttgttattttacaaatgggtgttggattttgtcagatacattttctgtacttgttaatataattatgaaatttttattttcatcccattaatatgaaagatcacactgattgattttctaatattgaactaacctcatatccctgcactaaaccataattggacatgacgtatcattttatgtattcctgaattctacactagggattttattacatctttcaaaatccttttgaaagtcatccatctttcctttttttggtcttcattttttcattgtgttcatgagggatgctggtctgtggttttccatatttttactctttggttctggtatcagggtaatacaagctttataatatgaattgctgagtattcccttcccttctattaattggtagagactgtgtagaattggtattaattcttctgtaaatttttgataaaattcctcagtgaaaccatgtgtgcctagggatttcttttttggaagatattaaattatcaatttagtttgcttaattcaaaatctaccttttgtgttttctagctacatgacatctacaggttactcagcatctctgtgagcttcagctgtattatttgcagtaattatgctattgaattcaaaagaatgtaatgaaagttaaatataataatgaatgtaaggtatttggtatatattaagtgctttattcgtgttttaaaatagcctttattatcaccagcactcttatcctttattcataaattcaggtaatagaagtagaaagggaatagataatatctcttggaagccactcagggaaggcctgggactaggcaagtctcaactcaagtaggtggacagtgataggcagaagtaagaaaaggtactcatctgctttgggcaaaatgaatcttttttttctaatctttctgtaaatgacaaccctggttccctgaaatatcttcatacctacagtaaaaataagctggcagagaatcaagtgaaaagaggaacactaaaccaaacaaaaaaatatctgttgagcaaagtttgaagattattttgcaaacgtaagttaaaatatgttttgcttgcttaatatagttacacttcatctttttgcataatcttttaggaaaagacaccatatctacagtatgattattatcccctgacattttttctattcaaatacttccatttcaatccacttgaagaaatgtatctcataatactagtcccataaaaggaaattctataggaaattactgctacttttaattcattgaattcgtcaattaatgaacatacagattaactctataaaaatgctcttttggcagaaagactaatatttgagttaaatagagaagaaaaacacaggtatgtgaagatatacacagacaaaaaaagtcgtctgaggcaaaatcaccaaatgagatttttgcaaaaagactgcccctaccaaacatatgcgtatgtaatacacattttagaggaaagaaggtaaacacaggagccacagacttcttagaatgcttaatgggtttaataacaattctacataaatattataatgacacttaagaaaaatactgacattattctcatagaagactattagaaatgcattctgtaagatagaaatgtcatgtaaaattgtttagattcagaaaagacaatggttgaattgctcccccgccaatcctgcctgattgggtcatgcattcctaccacagctaccccaagaaaacattcctgtcttttcccctacgcatctcagttaggacactctaaatgccatattgctcctttctatttcctgaaaggattgaagatgctttgccttctgtctgctttgtattctatgcctaggctcctgagcctcaggatcttcagctgttagaaatcagggatgactacatactttttaaagtatcactcaaatattttctgtaattaatactcaacagtttttatgatgataatcaataatgcttgccaggaggagaaggatgtacataaacctctctgtgtttatgaagagtatatgcataagctgacagaaaaattgtgatgaaattaactatctctatgagaaattatcctattacatctgtgatggttggttttgtatgtcaacttggctggccatggaatacccagattaagcgttatttttgggtgtctctgtgggggagttttggtatgagattagcatctaaatctgtggactcaataaagtagattgccaccccactgtaagtgagcattacccaatccactgagggcctgagtaagacagaaggtacaggaagaaagaacttgcttctttttgcttcctgcctgcctgactgagctcatcttattttctccagccctcagataggaattcaccaactactccactagttcttagacattcagacttggactgaattactccatcagctttcctgggtcaacagcttgcagaaagcacattgtgagacttctcagcctctacaatcttgtaaatcattcttcacaataaatctgttctgtttctctgaagaaccctcactaacacagattttggaaccaagagtggttctagaggaacgtaattttaaagataagttttcaaaattggttctggagtttctagaattgattctgtatttgataatatttcaagacactaataactctattctcaggagtaaagggagcactgatagactagggcctaaaatttttatggagatatagaaaatatctgcattggatactcctaatcaactacttacaagaagtaaagagctagatacctctgtataaaatacttttgaagattttcagaaaactaactaataaaatgacactggttggttgttcctgatgttgctgatcaagtggtaaaagaaaaacataagctaaggatttgaattcccagctcaagtgctgcataaatgacttaggagcttccatgtatgccctgaagtatagccttatctcctagagctgcaggactgaaattgtcaaaaatccaaagcagagcattatcttgcaactggctgaattacaaagcaagttgagctttcggtctggcaggaggtctacagttaaaatgaaggcatttaattgaaaaagaatgggatcctctaagttggaaagggaacacgtgggatagatcctgatgaagctgtggacattgagcctctaagttctgatgagtcttcattaccagtaaaagagatctccccaacctccagcagaattggcctcctctacccacagtgacagcagtattcccacccatagtggtactggcatctctgcctctatagttataaaagattggccttacattgcctaaggaaactgtaatgacctcccccaaggcagatgccatacaagacaatgctgattctctgcagaaccgactctttgcttctagacctataattagactcaagtctcatcagtctcctaaaggtgaggtacaatgtgtgacccatgaggaggtatgttaaactcaaacaaactacttgagtttttaatttatacagacagaaatctggagaacatgtacgaaattgataactaaggatgtgggataatggtggaaggaacttaatgttggatcaggctgaatttggcatggactcattaagcaaaggttctgcattaaatgttgcagcttgtggagtttgattctaacaggttggttggttaactgctgagatatggaccaaaaggtagtccggcatgagaaagttgaaaatacttggcatgccttattgcaatgtagaagaaatacaaaggcttagggatatattgtaatgttagggtagatttgtcatttaaggcctacttacccatagtgggagagtccagaaggcatacctttcaccaatactgtgaataataaatttgtcagtggagccctgtcatccttaaagatctctgtgatcactgtctgtaggccagacctcagagtgggaactgtagtcactgcattgagaagcctaaaggcaattggagtaattggatcctggagtgggaggggccactcagtcaccacatacaaggtagagctggttacctggctactgtaatggacagtagagttaaagcagcaatcagaagagtctgatatgttgacctatggacctatggactaggcttactgattatggcatttctagacgtgaaatagaaaatctgtcaaattgttacttaatctgtacaaggggtcttttaaaagtttatttaaaagcatattatgaaaaactatgcatgaatttcaaaaatgtttgcaccaaaataaacttgtactaatgttatgacatgtcttaacaggatctaatttgaggcactaaggaggataagacatcagtttgaaaataacccttatctctaataggaattaattttgctctcaaaattaattctgctaaaatggaagtaagaacaaactccaaatttatggtaaagcttgggtggaagaatggtgaaatcactgatgctttacaaaaagttgatgggtgcaattcccagaataaaacagcagtttacaaacagataacttgctttaagaaggagcaagacaattttgacaacaaggcccacagtagaggaccatacacatcaatttttgatggaaaaatttatcttttgcattctctacttgaagaagatcaataattaacagcaaagacagtagccaacaccatagacacctcaattgtttcagcttacacaattctgcctaaaaaattaaagttgaacacactttccacttgattggtgccaaaactgttgtgcccagatcagctgcagaccagaccaaagctttcaatggaaattttaaacaagtgggatagagatactaaagcatctctttgaaaaattgtaatcagagatgaaacatggctttacccgcacaattctgaagacaaaagcataatcaaagcaatgaataccaagaggtggaagtggtccagtcaaagcaaaagtgaactgctcaaaagcaaagatcattgtaacagtctttggaatgctgaagatattttacttgtaaactttctagaaagtaaaaaaaaaaaaaaagtatttgcttattatgagaaatttttgagaaagttagccaaagcttttgcaaaaaatctcccagaaaagcttaaccagagagtccttctccaccatgacaatgttcctggtcattcctcttattaaataaaggcaattttgcaagaattttgataggaaatcattaatcatccaccttatagtcttgatttggctcctttgacatctttttgtttccaaaccttaaaaaaatctttaaaggcaaaattactcacttttctttaattaataatgcaaagagactatactgacatggctaaattctgaaaaccctcagtcttttaaggatggactaaatggttggtatcattgcttacaagtgcaacttgactggtggagtttatgttgaaaaataaagtcaatgtttttactttttactttttactttcatgtttttcatgatctttttgaagtcttcttgtgcaagcagcaaagttctaggtcaagtgaacaaaagtctcacctgagtcatggcccctcaatcatttcccatatttgagccagtttacaaacctagaactccttgaatgaaaggtagtccaggtcctcttgaggaaggaccccaatgcacttccaaaatattataatgttaatatttcttctagccttttcccaaaggacctatggcattttatcaggataattatactcaaggaaaccaaaataattcactcacaaatatacttctttgacatatttcaagatgcttatccagaagggctacaaatataaggataactgaaaagctgtctttcgtggaatatatttccacgaaatatatatccaaatctgcatggataaaatcaggctttttcagaggctctccttgtctggatctcagaaagttataacttagagtctgaaacctttaaaattctgaaaggaatatttaccatctatttattttttttttttcctgagggctgccatctgtgaggtttcatctacataataatgttggagcttgttctatcctgtagttcagtgagaggaagggagtagcatccagtggctttccttcttctctcccattgtttggtgagtgggagggagtggtgctcagtggctccttctcctgtttttcacagagcaggaaggagggttacagctattttactcccactgcccgcagcttggcaagttctgggttcttgtcccatgaccaagtggaataaggtacatggacaccggagagtgaataaggcagagtggaattttattgagcagcagaaagaaagctctcagcagggagaggggacccgaaatcaggttgctgtctgtgaggccgagtccacagttaaatgggcttagaatgggggaatgtgtgctgattggtccatgggtggtcttggaaagagcatcattcgattagttaaaagccataattcagaagggagcaatcaagagagagtgggtacgatggggatggaagttctcactctggtcttggactctatccggaactgtcagttgtgttttcaggatttaaactgtccttggcttgaagactgggtttttaccagggacctgtccctgtctgcctaggaatttgtctgtttcctatcgctatcaataagactacctttgttagtcaggcatcttctccctctcccataagctattttgcccgtataacctgtgttgccatgcttcaagctccacattattgctgtaaccacaagatgagtataaaagtgtccaccacctggccttttgagttcttatattttgtaaacctcctttacatgttgataaatttgtatactttccatcctgttaagctgacttttttcagttgatttttcagtgaatcattagagagcaaagggggagttttcccttggtccctacagtacactggggaaaagaaaataatcagacttttggggactgctggacactgactctaaattgacactaatcccaggacacccaaaacatcactttggcccaccagttataacaggacttatggttctcagtggaattttagctcaggttcatctcacagcaggtccagtgggtccccacacccatcctgtggttatttccccagttccagaatgcctaattgtaacagatatagtcagcagctccccacatttattccctgacctatggaatgagggctactattgtggcaaaggccaagtggaagacaatactaccgtcaatatctaggaaaatagtaaatcaaaagcaatactgcgtccctgagggattacagaaattagtgccatcatcaagaacttgcaaggtataagggtggcaattcccaccatatcctcattcaatttgtgtatctggctcatgcagaagacagatgaactttggagaatgatagtgcattattataaacttaatcaggtggttactccaattgaaacatcggtaccagatgtggttttaatgcttgagcaaattaaaacatctcctggtacctggtatagagctgttaatctgacaaaggcctttttctccatccctgtccataaagcccaccagaagctgtttgcatttagctggctaggccagaaatacattctcactgtcctacctcagggatagataaattccccactctgcctcataatttagttaacagggatcttgatcacctttcccttctagaagataccacagcattccattacattgatgacatcatgctaactggatgtaggaggcaagaattagcagctactctagatttattagtaaaacacttgtatttcagagggtaaaaagtaaatctgactaaaattcaagatcattctgtctcaatgggatttttagagctccagtggtgtggggaagttcaagatatcccttctaaggtgaagaaaaagttgttgcatttggctctccctacaactaagaaagcggtacctctaacgggcctatttggattttagaaggaacatagtcttcatttggatgtgttacctcagctcatttaatgaatgacctgaaaagctgctagttttaaatggggcccagaataacagaaggctttgcagcaagtacaggctgctgtgtgagctgccatgacaattgggccatatgaaccagcagattgggatggtgtgaggagcctttggtagaattctattggtgaagcacagtgtggacttttagtattttgatgcaagggcctgcatataattattctccttttcttttctttttttttttgacagagtctcactctgttgcccaggccagagtgcagtggcgccatcttggcttactatgacctacgcctcctgggttcaagtgattctcctgcctcagccttctgagtagctgggactacaggtgtacaccaccgcgcctggctaactttttgtgtttttagtagagatggggtttcaccattttagccaggatggtctcaatctcttgacctcatgatccgcccacctcggcctcccgaagtgctggaattacaggcgtgagccaccgcgctcggtctagtctccttttcaaaaacagctatggtcctgctactaggccccagtgtgatggttactaccgagtgtcaacttgattggattgaagggtacaaagtattaatcctgggtgtgtctgtgagggtgttgacaaaagaaattaacatttgagtcagtgtgctggggaaggtggatccacccttaatctggtgggtaaaatctaatcagctgtcagcaaatataaagcaggcagaaaaggagagactggcctagcttcccagacttgatctttctcccgtgctggatgctttctgccctcagacatcaggctccaagttcttcagatttggcactcaggctggctgtccttgctcctcagcttgcagacagcctattgtgggaccctgtgattgtataagttaatacttagtaaactcacctttttatatatgctatgcttgtctagaggtttggttctagagggagaaatgcttctatcaggagacccaatgtttctactgaactggaagttaagactgccaggccacttggacttttcatgcctttgaatcaacaggcaaagaattgagttacaatgttggcttagtattaccatggcccgtcaatggaaaactacaacaatcccaaccaggcagaaatagtaatggccccaatccttcaggaatggaggtgtgagtcaccccgccaggaaaagagccatgaccagttgaggtacatgttgaaagcaagagaatacagcatgagtagcagaagaaggtagctataaacaccacctaaaaccatgtgatcagctatagaaacaaggaaaaaaggactgtaatggtcataagtgtttcctccttactttgttatgaataagtgtatgtgcatgtgcatatatatatttgattccttcccttttttattcccttatcatgtggcataagacgtattaattctacatcataggacttaagttgcaggataccaaggagaagagtagacatcactccacgaactttacttccttttctgggaaaagaccagcgcattttcagttgtatgcaggatagttgcatcatgttaggcagaattatgatcttgttactgtctttgtttggagattaagaatggtttaaggggtgtgcatgggtgctcagctgacaaggagtggacatctgatggttagctttgtgtgtcaatttgactgggcatggggttcccaaattaaacatggtttctgagtgtgtctgtgaagatgtttccatatgagactagcatttgaattggtgaacttagtaaaatagattgccctccccaatgtgagtgggcatcatccagtctactcagagctttaatagaacaaaaggtgtaggatggaagaatttgtcccttttttttctgcctgcctgattgagctgggacatcttctctcattttctctagtcctgggactaacagttacactatcagttccccccgtctcaggattttgaactggatctgaattaattacaccaccatctttcctggatcgccagcttgtagaaggcacattgagggactttacaacctccataatcttattagcctattgctcataataaattagtttctctctctccccccgatatatgtatatgtgcatgtgtgtatctatatatacatgtatatatatacatatgtgtgtgtgtatatatatatacacacatatacacacatatatacatatacacacacacacacacacacacgcacacacatataccccacacatacacacacatacgtatatatgtttctggttttgttttcctggagagaaacacacaaatatatgctactggctcagtttttccagaagtccctgactaatatgtaatattacgattgctgtccaagtctgggaattgtcccacttatttatagtccttttaaattaagagtgggcttactttaacttttattacaaactataaagataattttaatcattgctaatcttgatttaatttccaatgattccaattattgccaccactaatactgatatcaaattttttaagtagtagttatgtctataattcacttttggctttctcatgttttcttttcttattaattttacaaaagcaatcatttttctggaaatgtccactgcaaacagtaggcaacagtgagtgttatagcatttaaattagtaggcccactaaaagctactcagcttaataaggtcagtagtatgttttctggcttctctcagactattttttgaagattttgcaagtattatttttaatttctgcaatgtctctgaagattttaaaaattttgttaacattcttgatataattcaatttataaaccaatgctgaattgaagtcttaccaaattatggtagatgaaattatcatcctattagaaatatttcaaatatacagaaaagtttagagaataaaaccatgaatagttgtgaacctaccacaaagatttaacaaatgttaaatgtttcattttcttcagttcatttataaaaatcaacataaaaatcacagatttactaaaatctgcacctacattcctcttaccttccctgaaaatagctacattcctgaaagtaaagtgtctcttcgccttgctaattttttatacgtttactgcatatttatatgttcacatagagaatgcttatttttctaatatttacataaatggttataaaagttttcaaaaacttatctcactcatacaattaaaaataattaaaaaatattagaaaacgatagtgctgtaataaacaaagcacgtaaggaaaatttggagtaggtgaactgggagtaggttgcagtttaaatagagatgtcaatgtaggccttttggtgtcatttgcacaaacttttttttttttccatttactcatttacttattttagagacaggatcttattatgttgtctaggctggtcttgaactcctggcctcaagcgatcctcctgcctcatcctctggagcagttgagcttataagtgtgagtcacagcaccagtcttgagcaaacaattaaaggagaagagagaaagtgatttattttcctcatctattattacattggtctgggtctccagatacaaggataaaaccctctttttccttagtgatgcttttatgttttaatccttgcatctaatactaatattattataccagttaattctatgtgagtgtgtttgtgtgtaagatgtaagaagtgtaaaaagtgattacaatgtaactaaacatctctcaccattattttacttttacctgtttatttttaattgtatgtttctcatttgtaaatttttggtcgattttaaagaatcaaatggctttctgtttcttcaacactgttagacactgtccctttcgggctgagttaggtatgtttgaatttattatgattgctttttaatgtaatttatttctgccacctgttgtgtatgcgttttggtctactaagatctttcctcgttcatttgattttcctctctggcttctgaggatagataaagctttctgtattttcttagtatttactatgggctttgaaaactgtgtataccatttttcaagttacttacccttatatgcttaatacaaataatcaatataattttcaacgaagtctaacgtagctcaatatctttattactgttctaaaagatacttagcatgctttattcaaaaatgaacatctcccttagtttctgtggaatcattatccagaattttagtactttcttttgaaacataaagaaattacttattattattatttataccactcaataactcatttcatttgtgagttatttcttcacattgacttcactttttgggtgtgtgtgtgtgtgtgtgtgtgtgtgtttagtaatttttttcattgagagcctatttgtactgaactttgtgactgcatgctttatttccctctattcctggactggttattatcaatttatagaattctattttacagttaatttgcttgacaattttggattatttttccattgtcttctgatgtctcttattgcatgggatatcttctatctttaaaaaacataggtaacatgttttttttctctagtcggttttaagatttttctccttatcctatatattttgcagtttcagcatgatagtctaagtatttattttctatgcttatatttttatctatttctccacaaacataaatacctatgtacgtatgtattattatttcgacctatttctgttaattcatccatccatcatttgtccatgcatgtctgtctttccaggtcagcactaggtgttcagttttaggtagaaaatgtgtgtcctctttcaattctagacaattcatggaaataatctttcaaatatcaactctcaacctccattctctttacttggcactcctaacagtcttattttgcctattttcaaactattgttggtatctgttaactgttcctttgttactttaacttcatctatgctacttttggggaataatcctctactctctttcaatccactaatctctttgattgtttccaatataggcatttttcccatctaatgaggttacagcacctcaatgactatattttcttagatttgtctcttttcaagtacacctgttatttttttcatttctgtttaattcattatttcttattgctgttatctatttatatgttttctttcctacctctcataatgtttagtcattatataattattaattctggtcttagagctgatttttattgtctgattttcattcaattggttttattagttattgtgctttgatgttttaggcacattttgagtagaagatgttcttctccttgtattattctcacttcttcctttatagaaattttttagttgtctccattcaatcctaaatccaactgccaaaaaacaaaatttatgttagtgaattgctatttccaggagtgcagcatagcgctatcactacacaactccaatggacccatttcattggactccaaagtgagtgatagcccagagaattgtgcaatatgccatctacacattgcaggctgctgccttaggggacaccattcaatagtgaaagtgggaataaacctgtgagtggattagtgtaagattctagctgcttctttctttttctctgtatatactgtcccaagcagcaggcacttcatttttaaagttcttttcattaactggttaaattcatcatagtacctggatctgacctttgaacctgcttctggtgtctcacttttcatggtttttttcagttgccatggatttaaagcaactgaagcttcagcctcttttatttgaacaaaaagcaaagtccaacatgtgtgcgtatttggctacatatattactttttattcctcccaatttttagtccatggagaagtctatcttaatctttagagaattttttttcctttttaaaatatctagtttatcaacatagtaaatgtttataataaaatgatatgaacttgcaattctatcttggcaagaatcccaaggaaattatgcttatgcttctttctggttctcaaattttccaagccaaaacttccatatagagtaattttaccaaaaatttagagaatttgagtctaaagtatatttcctttaattaaaatatattttatatttataataatattttagaaaatatcctagaccagttcaaatggtttcagattattctaactttgattctttttctaaaaattttcaagtaataatttcacgaatatttatatatattctaggatattaagattacagttcctcatattttactcagaaagtagttgagatcttttcttttataaatttacattacaaaatggcataaaattctttgcttcccgcgtcgtaggtttgcagagaagcttagtttctattcttgttatgactctagcttaatttgcagtcttcatgaagacctaactttcactcaaagtgctatgttgtgatgtttataaagatcaaaatatattcttcatccaattgatatttgaatggtttcaattaatactttcatatatttgttaggattattacctcacattgtactatatatacattatatggctatagagtctacaataaaattggtaaaaataatctgggtcttgtatacgtataaattaaaatttagttaagctcataacatttaatacctagctctttactgctagtgatgtaaatatgtaatttcaaattgagaaaatagtaaacataaatgggcaattaataattattctctattttgtaaaaatgtgaatagcatcgatattgttttagattttaacgtgaaaatatttaaaataaggcattgtactcatgttcttaactcatgtggcacctcctttatggatatatagtgtgtcttttatatttttctgtagtaccttgtaacagtcacatcttctttttctagacaatgaatatctgttatatttgcctatttggtattcataagctgccctccttttcctgataacatataaatttcctttaagaatccctgatgctgctattctcagatcattttgctccagaagtctcctttattacagggcaacagggataaatataacctaggcccagaaaattagagccagggcatttgttgtagggataagcaagtgtgctgagatgccaatttcaggactttccctgaaaaattaaaaacatgatagcctattctgccaagtttgcaaactagttgggtattcatctatcactgctggagtaatcctgttgtcagaaggagagacaaggaagttcttggagaaaaaaaaaataaaaagctgagagatgaagacaaattcctgagggcatgaaactatgcctgaagctgtaacagttctggtatttttcagttaagtctataaattccctccgtgtctctttctatagtagtcaattagagttttgtttctctctaactgcaggagttctacctcacacatataattgtctggtctttcctctgtttcacctactatattttaggtttcttgagaactgagatgatttcttattatctgttttatgcacagttcttatcctaatgaccaacttaaatttttaataaataaagaatgaataaatacacaaatttccatagatatattactgtagttattaagtaaaattatcattagataattttttgtataattctcagctcaatatattaagttggcagaaaataaacatggtttttctcctactctgtcccatgggaaatcattatgaagaattagaattcaaattagaaaaatagttattaactatggtgtcaaatcatattgattaaataagatcagtattgttgtgtttcacaagtgatataaaacgacgtagaaagagatagatttgaacatatagtcctggaaatagctcaacatgcatcctctcttctctgccacagaagctcttgctttcgatgatgatgtcatcaaccagacattttatggtagaataattttgagtattattgctctttaaagcatctccttttggggctttttaaatttgtttttgttctaaaaaattgtgtattatgaaaagcatgtcctcaaaatagctttaacaattttaatattttgtcatatttgtttatatttcatttgtggtcatttatattttggtgttattttaaagccaggaatagatatcatgatgtctcatcataaattctttaatacataactcctaggaatagagatgttctcttacaaagctaagatgtcattataatgactaaaataattgtcaaccatttacaatgtaatatccaacccatattctaatatcttcaattgtcataagaatgctctttagaggttcctcttttagatagacagaagtactgcaaattgttgttttattatagactaacaagtcttttgtaagtgatgtttatatgaacaaatagattagatgatcatttcctgaatgttccccaaaatactaatcccaaaggtgacaatatttgctctacagaaaatagcattatgaagcaaataagtttttacagtagaaaatcctatacaaaactaataaatacttagaaatatgaaaagggtaaacaaacttgcacattgaggtagttgtagaaaatatcccaaactattcaaaaatcacacattaatgcttcctaaatgttcatcatccttcactataactacgaagagtccaaatgaaatgtaataagataagattaactagaaaaaaagagagatttcactgtaaagagtttcaaggatagaataaggacactgaacttgaatctgtctttagtgaagaagttttgcacaagataaagacttgatggaaataataattgggtaaaaaatgaatgcagcagaagagattgcaaaaaaagaattaaaacacaggctgttacagtaacccaggtggaaactgatgagaatagaatgtttgcttttaattcataggtgtcatttggccagcagacgccaagaggctcttgatgaaacagtggaatgaacacactagggtataggtactccaagtccttatcttagatctgtaatcagctgtgtgaccttgtgtaactcaagaagtaggtctattcctcaactgaaaatagaggaatgaaatagatgacaactaaggtacagctctaaattcctactaattccagaataaccttgccacatcagccatcctccattatacttggagctgcttgaattttgcaaatattgtagaaataaaagcatttatttttaacagaggttaaagagaactctagaaacaaatcatgagaaagtgataactttaatgtaggttgagttttctcttagtattatctttacagctactgcattataaaacaagtttaaaaaagcaacatgtgatcagaatatctcaaaagaaattctatcccgaaatttaagaattctaactatattatttatatcaggcacttaatagtattttatatgtacagactgtgatttaatttacgatagttttaactactcacctggtagcacttggactcctgctatagtcctagtgctcctcaatctctagcatttcaggtcaaatatgaatagaggccatgttttcaaggttatgaaacatgggagtgaaacatgaaggagggaggaagtcatgaagttaaagacttcaagttcaagtgaagctaggaccaaggagtgtacagattatgtaggagatgtcaccatccccaagaacatggaggtcatattttaatagcatccatgtaagaaatgcagggcttttccaagagacatgtaagaaatttggagtcccctactaagtttttatgagtaaagaacgcataacactgggacaatattttttttttgccaaagtatttttcttaagttttaatatctttggcataattaacttgaatctctgcctgacaaacatctcaatcaaatgtgtataataattcagtgccaatggtgtagcagtggcttagaccataaaagtgcaaggaatggggaacattaaaaatggtgaatgtagttgttacctcaagaaaattgtagtcttgttgctctaaactacatgtataaaagtgagcaataggtcctttattcagcatcccctagcaatttttaggaatatcagggtgtttgcacaaacaagaaaaatatatttctgttgattttcaatctgaaactttcaggattgcatttacttccctgttttccactaaatctgatgcacaagcaaatcactgttaaacatgttcggattctgcattaactccttcaaatcagattcttcatttagtcctttaatttatctaagtttttcctggagacttgaaagaattcgtgcacgttgcaaacacgaattactttttatatttgggaattggcctgaaactaggaaatatgatccttaaagactaggctcagaggtcaatgacacaagcacccatggtgccattctcaagatgctacaatgatttggaaacaagtgacctattgtctagtttctaccaatctagtgaaacctagtcactcatggcaattaatctatacccagactgattggatcttggtttaaacttgactctcattgttattctcagccatgtttagactacaacattatgggatagctctctgacatttaaatataatgcaagccacaaatgtgttctgcaaatgtcaagttaaagctttgtagtagccatatcagaaacataaaaacataatattaattttaataatttattttattcaatataccccatatattaacagttcaaaatgtcatttatatttttaaaacactaaggaataaatttttcttactaagcctttctttttttttcttgagacagagtctcacactgtcatgcagcctgctgaagtgcagtggcacaatcttggcacgatcttggctcactacagcctccatttcccaggctcaagcgattcgtgtgtcccagcctctcaagtagctgggactacaggcatgcgccaccatgccaggctaccatttgtatttttggtagagatgctgtttcgccatgttggccaggctgatttcgaactcctggactcaagtgatctgcctgccttggcctcccaaagtggtgggattacaagtgtgagtcacggcgcccggcctacttacaaagtctttgacatgtgatgttcattttatatttatgggacatttcaatttggagtagccacctttcacctctatagccatgtgtggctagtggctaccatttgagacaatgaagttacagtttcagatgttttaaacagtccaagcagagcaccatgagcttgaagattattaaaatgctctttgattttgatggtataactaaaaagtggcattctggaagctcagaatagatctcgctgaaatacgccagatttctcaatatttatgagcataatccctgtaaaaaattatctgtttatttattttagagatgtagtcttgctacgtcacctaggctggagtgcagtggtgtgattatagctcactgcagcttcaaacttccaggatcaagtgatcctcccacttcagtttcctgagtagccgggactacaggagaactccaccacacctggcctagtaacaggaagttttaataatactgaagttgctctcagttttaaattatttactcagaattacaaaataagaaagattacatgcttttaaacattggcttttctagatgaaaacccatgcttctcatgaaattcttattattcaaacgtgaaattattcaagttattcaacgtgaaattcttttcatatgatttgtaattattccaaatacataatcatggaaatggaaaaatgagtatatcatatcaacttcaggtgaaggtgataattcaaattacttatgtaattaattaaaacaatattctaatgtcagaattccctgagctgatcatatttatcctgtcactagagttttaaaaattgggctatcccttattttgaggtaagtaaatatatatatgtaacataaatatatatatgtatatatacacacacacacaaccatttttaagggtacagttatgtgatattaagtatattcacattattgtctaaccatcagcactatgtatctttagaacttttttattttccccaactgaaacctctttactcatcaaactaactccctctcttccactccttctcagccctagcaaccaccattctacctgtgtttctgcgaatttgacgactctaggtatctcgtgtatgtggaatcatacatttgtattttcgagaactggcttgtttcacttagcataaggtcatcaagcttcattcatgttgtagtatgtgtcaaaatttccttcttttttaaggctaatatttctttacatgtataagctacattttgtttatcaaatcatgcttctatggacacgtgggttgcttttggagcttttagttattatgaataatgctgctttgaacataatttccaaatatctgtttgagtcatgggctttcacttttattacctgtctttagtttggggcccagttatttttcatgcttttgtctcattaaaatggtattgaagttttctttcactttagaatgaaataaaataaagccattttgtgtgtgtgtgtgtgtcttgatagtatttatagtccttcttcctaatagaacagatacattcactcacgtggacatttaaattttttctgccccttattttctagttctgattccaccatattttctaaagtcattcttctttaatattaaaccacttcacctgtagaaatatcagcatactgaattccaaaaattaaaaatgtctctagaatattctaagctacagctcccagggtcccagataaattatcccagtgtcacattttctgtcagaatttatcttgtcaaatatcccaggcttcaatctttcaaccctcttcactctattaattcttctcttagctcccacacgtgaactattcttggtattaaaaactcatttttaaagcaatacaatttcaacaactaaaataccatgtgtgcttgattagggtaaatttagccctatgaaactgcaccttagcaattttgcagcatcagttaagtgcttcctctatctccaattcccttttattcccaatccacaactcactttccattgtgattccttcccctctagtaaatatgactttgagaacacatgatccaaaccaaggaaaaacaaataaaaacagtgaagcaacaaatacgatctaaaaataggagagcaaagctcttaaaatcctgagaaaaagtagacttttctctaactttttcaatgccatatttggaatgttcaaagatgtgtgagaggaattcagtaattttattaataaccagaactattcaaaggaccttcaccacctgaatttctaacactcggcgttccttgctttaagctatttttatttgcaagtcttagaaaaaaaggaagagatatatagataagcagtagtaaataatgcaacatttaatttttacttcaacttcaataaataaactactctcctatttagtatacctatgaggattgctcttgggaatgtcaagcaaccacataaatgagtaccaatgagagagataacatggaaacaaagtaatctgcagcacaacctcaggctagcggagtgtgcctgagagccaccagaattgatggctgtggagccctttagcagccaccagatattttctccccagagaacatttctctcctctttcttatctaacctttttgcttcaccttgtattacctttgtctcttgtagactgtatatagctgtatgttatttttaactcaaaattaaactgtatgccatttaatagaaaaattacatatatttatatttattgtaataacttactcctgtcatcttgctttatgcttttaagctgttttgttttatatgttttgtgatatataatgttttctttcattgaatcttttactctagtgattttttaaaatccttcattaacttcagtagttatgatccatttgttatattatttacacattttcattggtgttatctgaaaactaagaaatgaaattatttgcttgtgtttttatattatgtgtttgcttttgatgaacaattttgaaaatttctattctatcgccatattttaaacaaatatttacaatgcattctatttatattcaattttagtaattgctattaatcttatattccatacgttttctcaattctgtattttagtttattttctagttgttggaagaccatagtgaacattacaattgattcctcaatatttattccacccaagatgggtaatccaagccaactagagactggttcaggcatggtgagtgacccaattctatttaatgggatataaaaggatatccttcagagagcttccagaaaaagtgtcttctctcttaagatataaccacaagaaaagttggctcttttctttctctggacattggctacgaccattacaaccactttattaccagagtgaggtcaaaccagtaccaagaacagcaaaataaagtgatggaaaaaaatgggatttttaaaatgataacactgagctgtttttatcaagcctgaagcctacattacctctcccttcttgctgtatgaaaaaacacagagatatgtattgtagtcactttgagtcaggaattctgttattgtggctgaaaacattctctacaataagaattttttaaattaattttttattaaaaatgagtaatcttcaagatcgaaagacttatataaatgtttgggtattggtatctgttacattcatttatgaatggaaatgtgattgagctaagaattctggactcatttcccactcaacattcaactgacaaacgttatttttctctgaaaattggttctgaagaggtaaattatgaaatctgaccaaatattcctcctttagattacttgcttaaggtgcttgtaaatgttttctttatccttcaaattctaaaatgttatgaacatactctaggtaactttattcatttaacccttttgatcaacagaattatgctcttcttcagctcagaaaagttttattctaatacataactaattaatatttgtgatctattccttttgctcttttattctggcattttaattacagcattttatagtttctctaacctccatatttcttcttttttctaatagttaatccttttcctgtcattctacattattacacatgaaatattacgaattgtgaatgaatacagaggggtataaacaggaaatggattgatatagaaagtaagaaaacatgttccactttgtttttatgtttattgaagtctccttgtttccatctttatagtggctgcttatctaactgtgagtgatggctgtcactattcactgtgggacaggtatcaaatgtcagcaatctcttctgtaagtaaagtctgcatccagcgcatcccattcacagaccctgatacggaaaatgtgtctccagctcatcctctcttgctcatcctaaattagtagagtccttgctcccaggtccccttacagcaggtctccctgttgattatggcacacacaaaatatctcaagtctggatatcttttggcaaatccatttaacctatggggaactcacacatccttgccatgccaaaagatgagatacaggttgccccatttctgccctctctttttgcagctattcattccacatgattatttttttctcttgcttacataggtgctatggcacattacctaagtctaaccagagatctgacaaagagttatgtgccttgttctcttctagccatcctgatctctaggagtggctctcttggtgaccccatcccctgggtttagtgttggggatagagaacttcaaaccacagaaccacccaccaagcgggttcagaactccctcttcctccctttgattatttccttattcaacagcagcacaaaaagaggtcatgaggaggtcacagactgtgtacaatcgtgataagaacacattgctgggaacacactgggggaaagcattccctggaccagatctgttgggtaccaggggatggataaaatataactgctcaggtgaaactgaaggaagaatatgcagcttttaaatgtaaatggctcacgctgcaagctgttataatactaggcattgctatattttatctctgtagagagtaaccacaaagtcctattctttcattaaaaattatctcaggtgggcacagtggctcacgtctgtaatcccagcactttgggaggacgaggcgggcagatcacttgaggtcaggagggcgagaccagcctggctaacatggtgaaatcccgtctctactaataaaaatacaaaaattagctggacatagtggcatggtcctgtagtcccagctactctggaggccgagacaggagaatcgcttgaatctttgaacctgggaggcagaggttgcagtgagcagagatcatgccactgcactccagcctgggtgacaagagtgaaactcagtctaaaaagaaaataaaaaagaaataaacctcatgttccttttcattctccacccagactgccaatttgctgtttgtttttctcaactcttctccatgttgaatcctggaagttattgaaacaatccttgatcattgcttttagtctctagttgttgttaggcaaaaggatttgcggctcctcatcagaatagcaagtgaataaagagcatggattatggaatcagaccagatttacacttctgactgcatgttataactgtgccacctctctaaatcttaattttcttggttgaaaaaaatagcaaaaacaatactatctcgtacatttgatgtaacgattaaatgagatgacgagagcaaaggatttaacatgattttttacatatgcacgaatttaattattccaataggatgatatctacattctgtcaacactttgtaatagcaaaaataaaaccacctgtgaaccaacatatgctgaaaataacattgactttctccaggtacccaacatatttatgtaatgttattcagggataagctggtgagtttgtgttctctgctgctagttggacacactaatataaaaacttgcagattattaacacagttttctgtatgtaagatgtttcttttcataatatgcattaatattttatctttttattttcctactttctaatcccttctaaagctcagatccagttccagtttttgagatttcaggaaatagtctacactatattatataagggctaatagtttcctgaagtccatctccaggttattttgattagaagatcatcttcctcggggatcttgactttcacttctgataatattgcgttatggttgcccctaacacatgcatatatctgactagatgttattgagatattttagttacttcttccactgagagtgcatcccattgtctgaggaatgttgtaaagttttaatttgtcaatcataatacatgtatagttacaccagaataagaattgattggcaagtgtctaggctcaaaatttggttttagtttgaaaacaacaaacaaaaaagatgaaatctagccagatgctatgatattttttaaaaaatcaaacaaaaccaaatagaaataaaaacataaaagcttctaaggtattgatgacgataaaaacaatcagaatggtaacaaagtaatttaaaaatgaagtaaacattgggttttgatttgtaaggttgtaaaaatttttctctttattgaggcatttcatatatatgcttctacagtaatttactcatttttagaatttgaataagagttaggtcttttaattaacatacatttttccttcttgccagggaaatgcatgttttcatctaaaataagcacaaatgacacaatgtttagattatattgtcaaaaccaattgtctacttagtgtctatttccatatccctgccacagatattgacaataatgatatagcgcaaagtgaagtctatttttaaatgcttcctattgaaacatattaaagcaaatgtacatgtgcatatagaagcacacaaattatggcatgatgctgacagcaagaatcaattctggtgacaaaaaaaaaaatcagtaggcgtttcatgtatctgccaagcctaattctgactttctctactaggtgctaatataagagaaagcaacccagataccaactgggaaaaactccagattttctcttgggtacacaaattatgacttttgctaggaaaccatgataataacaaaatcccagaagattataatgtgaattcttaagagccttatacctgtatatgctcactgaaggggtccccttaacaactaagatacatttatttcaaaaacatcaagggccattgaataatcctcctacaagtgaccattgaaagtagtttaaaggtattttccagaaatataaataaaatggctaagtcaagggaggtcgaatttctattctttattaattcagatacttaactctgcctcctctaatgcacacagttctagaatcttgaaccagcaggctctgatgggaatggcagcctgcaaacataaagggtgagtgataaatagccaggctgtgtggcccactgtgttccccagcggaaaggagaaacagcccactatacttctgcaggtaccctttcccttctgcttcctgccctattgccacagtatccaaaaattgggtaaaactctgagtagaggacatgaagaaaggaactatagaacagctacgacataatggaaacagaaatgaagcaatggctgtttggaaaagaaaaagaactgaagaatacaatcacctccagtcagattagtttatcagtcaggattctaaattcaacttttagttgtgaaatgcaagttttctagtgaggagaagggaatgaggataaaggcaataatatgttaattgtagctgaatctatatttggactgctgtatgctcaaaattctacatattaggggtggtaggatttgaggaggagagaaaaaacgatagagaggatggtgttatgtggaagcaccgaggtttgaagtctgatttaagtgtctactacacaaataggcatagctctgcaatctaagaatgaatatgatagcaaatatttagttattgattatggaactgagcgtatcaaatctttaggctatttgctctctcctctacacaactcctgtgtccaccttccacttcctgctggttttctcttagtctacgccctgtcctttccagatgccaatgattcattctcttttcatattctatttattttttccactctcttccattcatctaatacatacagagtacctagtgtgtataaccctgctggataattgggacatagggtccctgcatttaagatatatgtgttctttctggataaataaataactttccaagtatataacaatagtgagtaatgataataattgctggctgggtgtggtggctcacgactgtaatcccagcactttgggaggcagaggcgggtgaacgcttgagcccagaagttcaagaccagcctgggcaacaaagggaaaccccgtctttacaaaaaatacaaaaaaacattggccagtcatggtggcctatgcctgtggtcccagctattcgggaggctgaggtggaaggattacttgagcctgggaggcggaggttgcagtgagctgagatcacaccactgcactccagcatgggttacagagtgagacacagtctaaaaaatgtaaaaataaaataataataataattgctagtactacatccctatgacacacatatggtactataattacccacattttacgaatgaaaaatctgagacacagagatgaagaaacttgaacaaagttgtatggtttgtagagttaaaatttaaatctaggcagttaaattccaagcccatgttcttaatatctataccatatatctttaagagtcaaaaaaaagtatatgaagtaaacacactaggtaaaatattaaaactaatagaagggtcaaataaatggcatagccaagaaatgcaatgaattccagagaccaagattggaataggtataaatattcagagaggttttttaacagccaccctccgccccagcaaacacacaatccatattgtgttttgggttcttttagggagagagatttttgaataaaagagaaggtaaagaaaagagaggtagaaattacaatttttttatctctcttttttagtactggcatgagactagctcattgtagtaggaattacctagtaacattcaatcatctaatgatgctttatggctttaagccatacttggtcaccttttatataaataatatagatcctagatcaataaaaaaaccctctaaaccaaatttaaattcatgttttttaaaaacaccttttagaaaatactactcctttattattataataatatctaggcaatctcgtgttaaataaacttggaatttagtaatgttttttcattattttccaaattgcttgtgccatagtgtattgtttaaacgctatagtatggtgtgccaaatgctaaaatcctatgcaacccctggcaatggtattctgcagtgcctcttattacagtgcatgcaacaattttcttgggttgggcatttcaaatcattttaaactgcaaatataatcaggaaattgtgttttaccatttatagtttccaaataattaaagttttacattagctaggcttattgcaaacttcaaactatttcaaattaaatcaagaaaagtacaagaaaacagcaaatgctctaaatgtcattggatggatagttggggaatgtttcatgtaagcgtgttatatatgaaatgctatggaggataatgctccttccttgacatgtccattctgttgggtttaaggcaagaaactctgactatgttaacccaaaattaacatagtgtgttttctcagagacagaactttgaaaaattctgcagcacaatgtggctcggtaattaaatcaagctggacccagagaactgcattgggtccacagaagactttttgggccaaatttcatagttattatcttagaccaggctttttagaaacaacttaggtatatacagtaaatatactgaattgtctgtcctctctaggaacatgtttcaccagattccagaaaggtctatgctcctaccccataatcacttaatcacttagagataaaaaaaggtctattcacatttaagtcaataacatacctttgactaaaaagggtaaaatcttaaagttagaagagtttatttttgtatcgaagcatcttttatcccctaacaagtttctttctatatatgaagactatagctattttttctatttaccctaggtgacattgattcatttgacccatacttattgagtgcctattatatattaaatgccatgtttatacattggatacatatttgtgaataagtaaactatcttcagaaactaaagatgatgaacacaaataatttaaataggaaatacacaaatccaatcacattaactgtgttgaagaaaatgaacagggtattgatgtagataatatcagagaggaggaacttcaagtggccaagagaggtctcatagaggggctggcatttcagccgaaaactgaaaggtgaaaaggaagcttgggaaaaataaaaataaaaatatattcagaaaaagggagcagaatacgacaagactagtgtggctgatcgtagaaggcaaaagaaagtggttttcagatgggtttgaaaggtgggccagagaacatccacatacgtcttacaggacatgatagggattctgaatagtgctttatgtacatcaggacatcaagattttaggcaggggaatgacatagttggatttatatttttcaaggaatttattggcctctctgtgtggaggacatgttggagagagacatggagaagaggcaagaagaccaagaaggaggatcctgtggtagttcaggaaagactggtgactgagcttacagtgggaacagcataaattaagagaaatggtgaaattattttagatagttgacctgctggtagttggtatgttgagagtgaggacaagtcatcttggatgcattaaggttgagtcataactttattttcccccaaagttatggaatgatggtagcacaaattaaaaatgcaatagcctaagggagagacagagatgtatttaattttcagtttactttaatcgggcagaaagggattaaataatgcattttttaactgttaaatgtgtaattccagtgagccatccaattgaagatgtcaattagacagctgcttattcaaacctgaaattgagaggagaggtttgggttagaaatatacatttggaagtcattgtcacacatgtgatatttaaagctttggaacagatgatcacagaggaaatgaaagttaagttttaaaagggaacataatccaggaaccagccaagatttagaggtcaggtttagaaggaagactttaaaaaggagaatgaaaaggataatcagatatagggtaggaaagaagaaattatggatctagaagcgagacagttgaggatttgggggagaaatgattggttactaagtcaaataatttgaagagctcaggtaatgaagttaaaactattgaccattagaaccttagccttaatagttttagagattgttaagagcagaagccagacagctaagtagaacagggagtagatatgtttggtcaagctgttgttatatgacaggctattctacagtgtatttagaggttgatagaatcatagagaaaataagaattgtaggtgtgggtctacagaatagaggaaatccttgaaatcaatcaactttagagctagtgagttgatagaaggttaaatattaactacgaaataacagatcaaagtgttagtttcttccacaattgttctaacaaacacaaaattgcaaattaaagacttgaacttctgattatgacaatctatttctacttaccttgttctttcatctcagaaatcagagatgtcttcaaatatatttttctacataatatcttaattataattggataattcaatccattttcagctgaatttaccaagcatttaacccaatttacctattctattgtaaatagtacttttaaaaaaaatttaagaattacatatatgtctaattatctcatctcatacaattacaaagagtctcagatatctttgtatgttaaaagaaaattaagttaaaaaaactattcaaaatttgtaaagaaacagtgagatttctatataaaataaattaggtagggtatacaattaggcaaattaatggatacagtattgaaatatgtagataagctacaatatataattattaattgatttttaagacctatttctgcttaattactactttttatttctaaaaccagcagattaaaaatattttctcaatttaaaaatttgatctctgtggtaaaactaaacatagaatgtttttgctctgttagaaattagcctttggagagaaaacacagttattgtaacatattattcaaggtaaaaatcactaagacatagagaatttcagattttttttgctaatttctactgagagaactgtttgggaaaactgagagaactaattgaaagagttgactatccatgctttaaaatgtcagattttaaaatctatctctgcactaaagacatcattatttttgacactgggaaaaagaaaaaaacaatgtttagaatttgttaccccaaacaaaataacagcaattaaaaaacacagcaatgaaactgtgattgaaaacatcttagaagaaagtgaggctaaaggtattacatttttccctgcttctccatatactgcaggttacctaaaaggaattcatatagcttttaaaaataaaatgtaatttcatcagttgcccttgcctactaatctatattaacatgacctgtatcaccattgacttttcttttagctctatgtattcatctgttctcacggtgctaataaaaacatacctgagactggatcatttataaaagaaagaggtttaattgactcatagttccacatggctggggaagcctcacaatcatggcagaaggtgaatgagggtcaaagtcaagtcttacatggcagcaggcaagcgagcttgtgtaggggaactcccctttataaaaccatcagatctcatgagacttattcactattatgggaaagagcacaggaaagacccaccccccatgattcaattacctcacaccaggtccctcccaggacacatggtaactacggcagctacaattcaagatgagatttgggtggagacacagacaaaccatatcgctgcataaccttgttctcctcattttttttctctctaaacagtaattgataaattacgttttcacgttaaaaatataataattttgtttttgccttttagaatacttgttttgttctgtctggctttagaattgggtaaggacctagaacgtgtaagggagaaaaagtaggagagaaatagaaataagtgagaagacagactaagcaaaagagagagtgggagatagatcaaatttagatattttgtgaaatgaaattaccaagttatttttattcctaatcagcattcagaaagctacattatataatatagttgaaaaaataatcaagatcctgaaaaatgttttcattagcctagacttaaagaaatattggtaaagatttgctttgtcacagcacgtcacaacatattttctgagctgtgatccaaggtgagttacatgagaaattagaaaatgtgttgtttatgtacatttacccttttaaaaattattaagttgatctagtctttgtctttcaagatcatagtatatgaagttgtataaaatgtcatttagaggtctatttttattgattacaatgttacataattttagatttttttgattattgtaataatataatccatcccatattgaccagtaccaagaaaaatagctgatttgctggacacataaactgaagccaaactaacaaactaatatgtacctaaatccatatatacatatttatctcatatatgtgtgtatatatatatgtatgtgtatgtatatatatatatatatatatatatatatatatatatatatcacatgtactaggtaagcagagatatatagagcattaatttatcaatactgttgttctatatgtgttcctgagtggtgtgaaatgtctggcatgcaattggcttgaattgaggagctgcccttcagagcagggctgtcttctagatcactggtccccagactttttggcaccagggaccagtgtcatggaagataatttttccatggaccagggagtggggaaatggtttcggaataattcaagtgcattacgtttattgtgcactttattctattattatttcattgtaatatgtaatgaaataactatacaactcaccataatatagaatcagtgggagccctacgcttgttttcctgcaactggatggtcccattggggatgatgggagacagtgacagatatcggatattatattttcataaggagcacacaacctagtcccttgcatgtgcagtttacaatagggtttgtgctcccgtgacatctaataccaccctactctgacaggaggcgaggctcaggtggtaatgcaagcgatggcgagtggctgtaaatacagaggaaatttcactggctcacctgcctctcagcttttgctgtgcagcctggttcctaacaggccatggtaccagtacaggtcagtggcaggggtattgaggacccctgttttagatcaactaagctctccataaatacgttagaaaaagttcacaatttaagcaaatgatccaggcaatttttcccttccttaaaattaactctctatgcaaaacaaaactacaagtgagctcttacctctgtattatatcaacaaatgataaactattaggaggaggattgaaggaacacaaacacggaggtcccttgggctttctgactaattcttgtcatttttgtcaattgcattaactctccaaagttccctttgaccacttatgggattataacttcagcatttctccttactgctgctgcctgaggcagcctatttgattttgcctacatcgctctggggcttgcacgaagtagcagtgttaaacttgcagtgaaagtgagccaagcctttaagtgcctactcaaacaacttggctgacctcatcatccttcttcttactaacacctggaaatggattcggcctgggagaaatagatccttttcttcgtggaagcttctgcctataacttctaattattccgtgggactctcgatgctttcaaaatgagtccatattccccgtcaatcagaactatcttaaacctctcttaaaggaaacactttcaaaattatcctttcttggaccagttgattccaggaattaccatactttatattttgtcttagtcatatcaaacattttcacctttcatgaataatttgaacttaaagcagaatggggcttcctggtccctatattcattttctttctttctatttgcattcctgttggaaagcagttttgctagtttgtagtttgtttttattataatgatcacctaaaagataatatatcaagagccagtatagcagagtgactaagagcatggattctggaaacagtccatctgatttgaaccatgaccctgtagtttaagatccctttgaccttaggcaaataaattattgaacttctctgggctttaatttcctcatcggaaaaatggcaataataataataagtactggcttggtagagttgctatggagactaaatgtgttaacatagttaaaatttaggcataatgtgacctataataataagctctttataagtgttagatattatatttgccatctaagatatgctctgagtgatgataaatatcagcatgtaaacactgtttgtcttaaaaatgcactactgtgaatactctaaaatagcctagtgagccatcttttgctcttaggggtacatccatgaataatggctagccctgaaggtacgtgatgctaaaacaatggcattgccagttttaacattgtgggactcaggcagaatggagtcaaaagactaagaatggtctacaagaagaaagaaggaagggaaacagaagaaagaccacccaaccaataaacaagtgttttcacccatcctgtgtattctaggtgtatttttgattaccttctcatattatcatattatttgtggaatgtggactgtacagggactacctttaaaacattgtgtgaactaataaatagcatgagaacaactagataaggcattacccagaatttttgacctgtggaatggtcacacctgaatccaagtatgccactgaaagtttcagaagcctcttctgtggcatttaaactgaataatagagaggcctagagcatttgcggggcagaaagacagggagagagagagagagagacagacacagacagacagacagacagactaactacacggagaaatctcaacctctagcagtggacttgatggaagaaactactctttgaaaatgctgtttctactccaaagtcataactaacccatattatgtatgtttatcagatttatccctcaaagaaatttcttccaggaaatattgggtcaaggagactgttacagaataacttatcccttatttattgtgcattgtttatttttgaaatgtggagacgccttatggagaagaaagacttatggggggtatggtttagtttggtggtctacataatatctgggtaatctccacacagatcctgtgttgtagacaatgatgcataagtagcatagcttctgctacatgtcactaggcactgaaaactcaaaatatttgtcaggctattgagaaagttatagggaaagaaaatttgaacaagcagtagatagacaacagaaatatgaactccgaaatgaatgtgaaatgtgggaggctggaatgtcagcttcaaggtggcttatggaggaaaatctggagaaacttggggaaggtggcagcaccaatgttttgctgaggtctgtgtgatcagtagtttataaagtaaatcttcagtagtttagaaaatgccaagatacatatgcaagttcttaacaacctagacaagagcagataaaataaatgcaattttgtgatatactagaaagttttttaaaaggacattagagaggaaggcttaggaaaatggaaccaattgagactcagttaagagctggtgggagtaatatatagcctagtgccaagctctgcccgacaacataaatctctccaagatgtctgagcatccctgtgatttccattaattcaaagagaagcaagatgggaagtcagaggttactgacaaccaagaaaaaaaatgaaatagttgaagaggcaaagatcataaatcaactcatacgatgtgtcttattgaaagctgacatattggtagatgccttagacagttggaataagaatttccaatcctcaccttcacgggaaggggcgtaacaacatgggcaagctcatgaattcccctcaaaacgacaccccacctcctgctaccagtactatctgagagagtatttagtacatactagtaaattatacttctaaggaattacttcctagagttggacaaaatgtcatggtattggatttgcttgggttctggcagtaacatactactagagctcctatcttgcaatactctgagaaaagtgtaagcagtctaaagtttctgcattaacagatgaagacaaattctggacaaagactctcaagtcaccattattatttagtccatttctgggcatcagcgtccacattttcccacagtgattattgacataacactcagtagtctgaatgtaggacattatctgcatctgggcaaactgtgctgaagagcccctgaagttgccagaggagatcagagaagtgacacatgtggagccagaacttgcaaccagactaatgttgctaagcaagaatgtaagtcagaagtttatcaacaacctagaaaaaaaatagaaatggttcacgaggcaaagatcataaatcaactcagatgatgtgtcttattgaaagctgacaggtgggtggaagtgttagatggttggaatgagaatttccaatctttaccttcatgggtaggggtgcatcatgggcaagctcatgccattctcctcaaaaaggcgccccaccttctgctaccagtgctgtctgcaaattctaactactttttggtattgacccattattcattaccacttatggaagaaagtgtctgacatcttatcatgctccccttaaatgcctttgtgcctacttgtataatcagataaaagtcagaaagtaccatgagaaaattttcagatatctcagcctacaggctgtcgggaaaagaagtcacacacaaagtataagcttctttgacactggaaggttttagatacccaagcacttgaaagaatctgtgacagggaaactagaagggaggaggaaaagctctctcatgttttgcgaaatgtagactcaggaacagtggagcaatatgcaattctaggacacctggagttttatcagtgaacactttaggaatgtctgtttctccaagatggattctttgagggattgcgtgaagcaatccttatgttaatggtgttatttttaaattctgaactccatgcttgtttgatcatactgtagataaggtaacaagaggaaaattaacacagaactctatgattatggcagccaataggagaagaaaaaatccttcaagatgccttcactagaaagcagctttggaaaagacaaaacatattattaattgaggggtatcacagagtagtgcctcataagtggcttgtggctacagttattgctacttcggaaatacttcccagaaatgctgagagcaatgcctcatgtctttgaaaccaagggagggagaaggcactggatatcatctgatacctaggaagagagaaggctctagagatcactgggcagtatttctggccccagaaataaaaaatgtttaaggaccattatctttaattctggcacctgcaaagatgagtatggggaggagagtggaaagtaaaatgtgccctccaggaaggtttatgtaaaatgcatctgaccagtactttttaaaaaaaattgtatgtgttgatttttttcccattagaaacagctaatctgatattagtaagagagttttacagcagtcataccaaatcatatcctatgaataatcagaatctattctctctgttccatggatgctgtgggagtttgttcattacagacttcctctttgaattccttctaaccaaggcagagcttttaagagcccatttctagagaaataatttaataggcagaaatttcaaaaaaaataccatgactattctctaatatccatagtgaggctgtaaaccagaaatatttagcagaactttgtaaatatctggggaactctcctttcaaagtcaaagctgtagttactagcattttattcctttcctgatatcctaccccaaagctttcattttccactgacctcagttttggggtatgtttcaagagacaatggattgccttgattcagtaagaaactaacctgaaaaatattctagaagtttttcatcatttggcagctgcagtcactcaaaaagcaacacagcctgctctaaagacactatgacaccatgtgggatatcaatggcatgctggagtttcattcacttgcaagagttttcaaggcattttacaaaagaagttactgcagctagattagggccatttgacctcttgccccaaattatttatttttctatgttcattttataataaagtactgaaaataacttaatgataactaatatttgtaagaaaaactgtgtgcacacacatgcacatgtgtgtgcatgtgtgcatgtatgtgtgtgaatatctgtgtgttaagagacttagttttttaaaatgaaatggaagaattaagactatttttcatggctaggttctattaaacacagcaattacgtgaattccccttcattcttcctggataaatatagaaaagtgagtaaatctcctactttgaaaaagtagggcacaaataagatgtatctgagaacctagtcatagggcaaagggagaaaaataaacggtgagagaccaagacaaggagacttctgtgcacaaatctgaggatatatttacatggaccaaaaggcaacctgatggggaaatatgtattttgattaccttctggacactgataatgatgctaatggctactatatgctaatatttattgaaagataattctcaatgtttccttcatgtttctgtacatttcacaagcagaagcatctacagcctatgttccagactgtcattccaaggatgtttttgtagtggacaaccttgggagacagagattataactctcctttgagcaaaaagaagatgtgtttgttgtgctttataaaagactcagattccctaaatttggggatttcctcctgacacaactctctgcttgtgcagatgtgacctggcccttttcatgtttcccaataaaactaaagtagggggacagaaaaaaaacatgaggtacatgctgtttgctatgacataattaatacagttctttgtctcagagccaggagtctcatgtcttctcctagcatccgaggatctgcagcaggctatcttattacacagttattacagaaatatttcagaccttccacagtctgggcaatggtctttgttgtaaaatgcctttttgagtatcagaaaataatcattgctcctaacggatttgaagataaactacgcttatttacgttccaagaggtaaaagaagaaaatcagaccactataagcagaaggacatttctcacatagtctcaccaaagcaaattgcaaaattcaataaagaatatatctcggagaagccaagatatagaactatagaaaaagaaaagatagtagaacaataactcagtacatcctaataataacaacgaaagcaataattaacttacatatggtggtttgcagtttacaatgcatttccacacattattttatttgggtcttataacgacctttgaaatagtcttttttattttcttaattacaccgttgagaaaattaaagtttagaaaaggttacataagttgctgacggccaaaactaacaagttaaggaaataaacaattgatatagactcaagcaaactgaataaaaccaaaaacaaaaatcaagatttggccttaggatcacaatcttttgtcacaaattatttcctttctgttttaaatcttccacttgtcccctgtgaacatgtctttctctcctatgcagaagaacaaaatccctctatttacactgtttactttagttataatccttccactttgttttcatggtgaaattatataaagagtagcttacatgtgttctctctgtctttcctgttttccatccatttcatctattattgttttttaaaaaaatccatattaaaatcaccagtggcattctaaatgataaagactcgggatgcgttttggttattatctcaagttcaatctcattttttgaaaacatgtttcttctttggattgtggaatactttcaatcacttattctcttctttctttctggttacaatttctcagttgttttcatggagatctcatcttccaactgtcttataaataaatctttctagagtttcatctccatccttctctccttgctcaatctgcttccactaaaacatctcatctatgcccatgatttgataactactcacaatgcaaaggcacacccattctatatgtctggctctgatttctttcttgagctccagatatgtatttccaagtatcgaatttatatctcaatctgataacctgtgaacttaaggttcaatatgtccaaaatcaaaccactctactttccctctaaattatttctttttgttttcctttcctggattgggtgagccacactgacttacttctaaaagctgaaatgccccatccttcttccttagtctccatattcagttggtgattgaattcggttcattctgcctctagatactccctgtaacatgtgcttatctctctgttaacaatgccttaaccttcatggaaccccacatattcaataggctgccctagtaaaataatctcctaataggtttttagtctccttttcatcaaagatacaatttatttacttctttctgaaatttaaatcttacaattttgctatctccagaattaaaatcttcaatatcttcagatattttactacctccaaaattaatattgaagatattgatttatgtttatgtctttatgaagatttatgtttgtttttatgtttatgtttgtgtttttatgaagattgatttgttaataaataggttcttaatcatgtttcaggaataggaaaagctagactccaggatttggattttaacatctccacaaggaaaggggagaggggcttgacttcttctcaggagtgtattcatttcattgttaggcaatgttgatggataatattttatcaatggcatctaaagacccactttttgtgactattgctaaattcttcagccttaccttcagtgcttagactcatgcccatgtacacacatgcatgacatgcatgctcatacacaaatatgtctatacaccaacacacacatcaagttcttccctgatatgtaacagtcattcctgcttctccacatgctctgataactgcttggagtttcttttcttcccccacctctactcaatactttctattcaaattaaaaccccattccactctcaacttctatccatatgcgcagagttaaaatctctccaagaatcttgcatacgtaacattcagagaatgcatttcattgctttgtcatcatttgccactggatctgtctctccgaacaggctgctgaataatgaatacagttaagttcctctagcttgtgtactctatttattatttactgtggcacttcctataataatgtggaaagtggtaactaaggaaacttggaaaattctagtgaatcacaacctgtaaaccatcactgagttaaggataaagtatcaacttaagatacataagccttagtgataatttttgttataaattgttataataatattactaacaaaaataagagctatcattttataggtagggattattatcttcagtataaactgaggggatgaaatgaaagtataaagaaattgtgatgacttggctaatgtcccaaggtaaatggtaggttctattttactcctgtgataatggccaaattagtagttttcaccaaatagctcagttctcccctggcactgggcagatggaagaaatgctactcccttgaagttaaatatggtcatgtgaattgcttaggccaaagaaatattagcgtatcacttgcagggagaaggtatcagagccagcacacagtcacgagtgctctctctctctctctttctctctctgtcacagcaactgccaatttttaaagctcatggctgctccatctgactgggacttcactgtagacaatgtgagatgaaaccacttgctgactcagattggaaatgtaatatgagcaaaaaatgaacttctgttgtgttagcccactaagacttcgtacatttttcagacatggcatgatttggctcactttgaccaacattccacagatgccattacttcagtatcaatgtttgcttgaccataaattggactcaaatggattttttggggggaggtcaagtctgaaaagagcttacccaaagttttgcatctttagggtacgaaaattatgggagtttagacgttcatagttacttttttcttttactattgcaaaacttaggtattgaaagatttaagacatatggacacagagaagccaccaacaggaaattgtgtctgaagcagtacaacaaataggaaccagagccagagatgaggcaaaagaatatatgaagccaacatatattctagaaatataatctgggtcagagccaggaactgctgagttaatcagtgtgaatcagaagaaagagtcagaaatgagagacatgcactacctaaaacagttgcagattcaagtttcagaccaagtgtcagggtaaagtcaagacatttctggtaagtcaaaacatttcagataagtgttttaactgaaaaggcttaaatattttaaaagtccacatttcatattcaactgcctcagccaccactatcacaatcctaattataacagtaatatattaaattccaagcacttcacatacatttccatatttaatcagcaaggcaactccatgaggaaactgaagtatacatcacagcactagccttcaaacccagttttgtctgacatcaaattatgtgttctcagacactgcgaaatggccctgtgccatttatccttctgtctcatacaaagagggtaattatcaataagtggctgggcttcccaaaatagagccaatctaacacagggctcaggacagaagtaaaagctaatctcagcatgacaaacgggcaagagggctagcgtgtgatctaaatttgcctaaaaataaattgactacacacctgtgaggaggtcaagtctctctctctctcccctttcaggaccgagatatcgtattatctgaatcctggattctagcttttcctattttggaaacatgactaagaacctgtttattaacatatcaatcttcatgaaaaacataaacaaattattcctgttttgacctttgttatcacttattgtgccacagttctggtccagctactctgccataaacagcaataatttgtctccctctgaggcttactgcgaggattaaatgagttaacacttgtatactatttacagtaaggcactgaaaatccattatttagtatgacgctgattatagtctcattaaatcctacaacaagattttgaggtgggattctactttttcaagtgagaaagctgaggctcaggtagtttatgttacattacgaaggccataccactaataagtagaaaacagggctgggattccacaccgtcaaatatttgcctgcaaaaccaaagctctttccactaagtcacaccacatgcctcactgcaatggaagaaactgcacaccaggtccaaacattatgcacattcgtccttattgaaaagaacaaattcactgtaattttgcaactcctcacaatgccagctgctataaactgtatgaaatttatgaaagtttggaaaggttcccaccataataacatagtatttttcgaaaataatttgcatgctatataacacacattatatatagcaaataaaaagctaaccctaagtgacaatacgtgggcagataatgaatcatttggaaatatcacgtagatttcacatagaaaatattgttatccatgaaaagcccaggagtttcttaaccctttgctgtgacgtggaaccacagcagaaagcaccgacagaccaataatgtgataagcttaattctctaaagggcaggagtgagagctttctatcctataacaacagtttggatgactttatatcaagagtgaggaagaaaattatactcctctcccacatatcaagggaaatgcttcccatggagtgactcagcctgaaaccctaaaccggagcacggtcacagcatgctgtaggcagtcacagcaggctccgtatcagctgccttcggcatttgtagggacaacacagagcggaggctgccaattacaccagaagcttctaccttgtgagaagagtctaatctagtggaagaaaaacagacactgactcttcatgctccaaactgtggctcttttctacttgatcatcaacaatatgttcaaacagccagaagaacacactccctctctagtaagataataattgtaaacagtcatatcactagcaatttgccaggcacggctctcattacttcatatatactaattcatacttcatatatactgattcattcaacttaatacttatagcactggacatatttttttccatataaaacacagatatattaagttacccaaagtcagatatctgaagtatggtaggatcagtatttaaacacaagctgtctggtatgctagatacctatccaagaatactgtgccagtatcaccctacttatccttaattatttttaagaaaagcctagcatttaggagaacaatcatagttacagggtgcattctggcaattgtggaggaaatgtaaaatcagataacttgagacaattatctttatggtattctctaggtccaacattgaatgatttggttttgctggaattggtgtcccatgagctcactcatcttgcccaatagttccacagccccaccttattccaagaaagcaaataaaatacttatttgatatataccaaatataatcttagcatgttgcaaatttaactttaaatcaataacttgattttttatacttctttaatgtacataaagaaattcttattaaaagatacaaatcaaactcaagaaagtgaatgcattgtatcatttttctaatagagtatggaggaatgtcacttaccaatactgcattgcaacatgaaaaatctaatctttaaagcccccgataaactgatcatgcatattgaacagcatgaaaaatgaatgacttctataatcttcaggatgatgtttgtttcctgttatattttggcactggcaatttattacacaagaataggttctaatcatgatattctttgcttcctaattattcaggaaagtccttggagcaggaaatctagcacttttcatgttgtctttgttatttaaaaatagcgtaataatcatggaattggcactatttctttaaaagtcacagctaatctgttaatttgtcttctcatagaatccattttaataatgctcttacactcagtgtgacatttcatactaccaatttactgaacaaccattgatctttgtctcagtatattatggattttatatttatgataatttttattaccacttgttttaggaattttcacaaatttattactgatttgtgtattcttatgatataattaaatgtacctccatattcattagccaatgaaatacaagtagcagcctataatacactgaagaatttagtagaaatgtctttcttctaatcaattcaaatggaatttctatatctgagcaatagcaattatgaataaaacattagctatcatagcaataatttatatattttatagtaatgtttcatataatacaggaacttttcttataagtacttaaacactggaaaatatattttaataaacaagccaaattcaacataacctaagccaaactcaatgctttctttacttgacagatatcaccataatcccttcttttaaaactggaggaaaatttcagatcactctctctcttcccctctctctctctctctgtcagttgttgtattttattattttccaagatatcctctgttaatttcaatattataaaatctgaatccccacttttccagtcgtctttcatgatctacgttatgcagtctacaccaataccctactaactagtctctagtctctagcatctttccatcaccatataccatcttctcagtcgtcaaagtaaacttctcgaagcataacattgcttctgtcactctaccacttataactgtacaatgacttcattgtttgactcaagtacggcatattttgatatgcttgcattcttacagacttcactcactcccttcaattgtgatgggctaaatgtgcctcacctcccttcctcaaatttatgccaaattttcctttttatccatatcatttcctttgtcatttaccttaaacctaatttttaaatatttgtttcaaatcctccctcttgtacgaagacttccctttccgttcctatctccaatggaattgtaaaaccccatataaccttaaagtctgcttgtatcacatacaatattctggctagacatagaattatttatctattagtttctagccttctttaaactataaattccttgaatggaggacacatatctcttcatatttgcatctcctgcagcaccaagcagaaaactcactctgaagaagatgctcagaaatatttacttaatgattggattaccacagcagcaaagagcagagcatatggaaatttgaaatcataggcaaatcaatttttaaccaatttagaaagtattgagtataagactgcaagtgataaagaagaagtaggccattctgaactaaattttctttactcttcttcttctttttttttttttttttttgacagggtctggctgtcagccatggtagagtgcagtggcacaatggctcactgcagcctcagcctcctgggctccagcaatcctctcacctcagcctgccaagtagctgggactacatgtgcatgccagcctgctgggctaattttttttttttccatagagacagggtctcactgttttgcccagtctagtcatgaactgctgggctcaagcaatccttctgcctacacctccaaaacctaaatgtaaatattcgtaatatgataaatgcatatattgtacattcagaggctctacacagttttgagtgtgagaaccataagttatgtcaaaatttccaaatatcatatattttgtaatcatatttttattattattgactcagtcaatagtcatagactttttttagttttttaaaatgcctatgaaattatagatttggaacttccttacaaatacccagcagcattctcataccctcattcaatccacagactaggaagcttctagaatacctttgaaactggtcttttcagataatatacatgaagcatttattagtgttcctggctcataatatgtactctataattaatgtgagtgatagtattcgctattaccatcacatctatcttcatgttctaagtccctatatgtgtttaacccttttctctgcttctactttataatatcatccaactaattcctgatacacatctcttatatcccacaacatctttctgcataagttgaccagatgccttaatttttacctcgttcactatcacgtgctgtttggttctttttctcctttccacttcttgcattttattctccctgtcaccatgttattctttccattcttatcattcttattgcattctctatatattgctttttctgtactcatcattttccaagtcttttggtgcctgctattaattagttgtttctttttctctcttcaacacctgacccaactgctgttcatatttatagttgaaagtcactttatgaaatagacatattcctgaaaatctagaataaaaacaaatttcttataaataaaatcttactctacatatgcaaagaaacaatattttctttttaaaacttacagtgaagtgaatgatcatagcctatcacttgtatcaatgcacacactaaaagagttgtgcggtcctaacttgaggtcctgacacctctttcttttacaacctctgattctaattccataatgtatctatgactccctgcttcctactctcttttaacacacacacacacacacacacacacacacacacacacacacacacctctcccttttccctccctcttgatatctatgagtcagaccatactgtctcaagcacagcattgcttttttctcctctttttccttccttctcactctctgcgcccgtttgtccttctccctgtctgttacagtattaccactctccattttgccaggctgtctcatcctctgctttatttctattacagctagagtgttttccaagcctaattgtgcacctaacattttagttcctttccttcaagatgtaatacttgatttaatttaccttttcctttctcttgtgtcaaaaaggtagtctcaagtcaacctgacttgtaaacacaaaaggcagagctggatctatccccatgaagaacaggatctatgatccattcttataaataaatgatactttgtctagcacaaatgtcaaataatctcataatatcaatatgaatacttacactcagcatatttctgaagttgggaaaattccgaagggctgaggtgggcccatttttcctggtttgtcatggtggtggtgagaagctctgtcacataccaggtaaaagattctttattcaggtgttgcgcagaggtctatgcttcaaagattccacatggcatgtttcatgataaaatacctcaggctttcaaaatatgcaatctgtccacatgaaactgctttggatgcttgtaatttcaataatgtgttaaagaa

SEQ ID NO: 2256 - DNA, 2172260 bp, Homo sapiens
tttgccataaagtataaaatgttttaatatttatatcttataataaaaccatgacatgtttataaacactctatcaggcatttttacaatggggccacccaccgctgacaactagaaacgcaataaatatgcacagacacactgagtatgaaatatacatcttgattttataatcgtgtgtgctttattttttacacaaatggaatggaagtgttgaatatttacacttaacaggagtgtaagctgtgcagtgtctctgtaaactccagcctaggcaaggagtattcccacctccctcccatcctgtgctacagctcggtggagaaacatcctgtcagagagaagcacaaaactgtcatattgaaaggatctaacgggtacagcctggtgcactcagaagttaagaaacacttaggaaacacaaactcaaaaaggagagaagaaaagtctgccatcccattgggagtcaaccttgccacttggttgtctgtcctcatgagttgctagggagatactatactctttagatgatctttgtctaaattgtccgcctgtcttagctttgtcctcagctgttacaagaaactgcacagctgtacaagaaatgatttccaaagcacaggtttcagtgaggaaggatatttacagacttgagtgtgtgtgtgtgtttccaaccacagtcattcatactcaatgtaacgtgtgtacatggtatacataccatatataccatacatacacagaagtaaaatgtatatcacagaattctgtagggagtcccctggcaagtcagctgtcacaggaggtactccacatgcttcaagggaattgatctttttccctctaggagtaacaaattaatgtgatcaacttaggaattagcctgagtccttggcttaaatatatttgtaggaatttaggcaggaccaagacaggaaagaagagatttcatttcaccagcaagtccattcagtctcaccagagcaatcaccagctgaaaagcagagggggcttcacataaaaatgggaaaaagaaagcttatgaatgggaaaaaaatgtctctctccaaaccaaggtgatggcatggcttcaatgaggaggaagaggtttgctatcagaataattggggccagagtctgcctttattgaaagaaaatgtcctcagagccatgcggtagtgctgggagtgggctcgcttaggagcagtgttcaggcagaggcactcaggcgccggcagggcccacagcacatgcatcatcgctgccagggcaacggtgcaggctggctccgggaggcgggctggagcaggctccaggtcagggcctcacgctcagctttactttctgggctgagtaggtgaaacggcgacctaaagtatttgtgtcattagtccagtgcatggacttgctgtctgaatcagccatgagccctttagaggacagaaaaatcaatacagggatgtacgggagaagatgatcagagatttgaggagaggagaaaggacagaagaggaataagaagggcagagaaacagagactaaaggagaggtggacaaaaagagaaagggaatagagaaggattataggagaaagtcaacaactcagagatggtgggaaggaggaataggaaaaggagaggaacaaaaaaaaaaagagatggaattagtcggaagtagaaggaggaggagagtaaggaaaagaatgagaaaaaaagtagagtctcgagccagaggttggagagttctttcctggctcggagtcctgaagggccggcagtaggatctaagacagcgcacagaggcacccgagtgcagctttgtgaagacaggctctttaagcagacagagccaacccaagaatttggggctgggaaaaaaggcctgcaaataaatagccaagaaatcccgcaaaaggcctgcaaataaatggccgacaattctgtgggaggagagcaaaaaacaaatgcctctgcacttagctgacaaatggaattttgattttggtaaagctgagacccccgtggtgctacacattgtaccagagcatgaaaaatagcaccagttacacgatctggcacttttctgaaagggcccagcatgtgtgaaggtgacattgcacccccagcaagccttcaggttggagagagctctggacaaagtttgcagtgttagcaccagtctggccccaggctccgagtgcatttgcaccagatgtaatctgggtaactttcatgccatttccatacaagtcatcagatttgctgcaaaatacaccagttcattggagccatagagacatcaacattgggaagtgcaagacaacacaacaaatggaggtgtaaattctattggaaaagaccctctcaccaatttgcttggtgattcttcaagcaaatatatatgtatctatatatttatataaatctacataaaaaaatcagtgcaaatgccaattctaatctgaaagcatctacactaggaaaataaatagttatattactacaaaaccaagggttggtggttcaatttgattgtacttagccacagcaacactagtaaatggaaagcacatcacacgacccgcgaaaacatctactcattaatgacagtcttttaaataaatggttgcatgctcagttgagaaaccaaagaagttatcgtggtggcctaaaaatagagctgggatcaggaatggcattctggtgtcagaaaacttctgggagcaatattgatgaaagtaggccttgacctgaaactggcgaattgcagacatggacatatctttaacattttgagcaatctaaggaagtctctggaaatttaactttcatgagagggagaatgcattgctagcccttccattggcaaaggaagcctcaggactatgggaagatgcataattttgcatttctgttttgttttggtgactgtagccaggcagacaatgatgtttagcgtaagatgaacaatgcctgtttttggaaagagactctcattctaagctccgatgttcttactgtgaagaagccccatcactctgatggctctatctcttgctctcctacccagcctacatgctggtttgctgcacagtgtggcagaatccctgccaggtctggatgtaccccagaaataaggcgatggggcttagtctgggcatgcacagaacccagagtagagtggttattatcactgaaaagtctctccccaaacaccatgggcaaaagcaatgctgatgtcgccatccactctaaagtgggaaaccaactcttctagttcagtttataggctttgggaggtttctttttttaaatcatcgttattataattgttaaaaaataaacttggtccaggtgcagctccaagaaaggcagttcagttggttgagctcaaagtcattaattgtctttccttgtgactctatctctttgctctgtacatagaaacaaaaaagtctgcaccccctcacccccaaccagacacttctcttctctctcttcctcaaagaaatagtgcatctaggaacagatctctcattggctctagtaccatctctggatgttacaaaactctcagttactctgtaaaacaaaaaggtactaatcctaattactcattgttggccaaaatgctaaatggtcctttaagaattgtatgtcagtaactaggaacaaagttattcaactatttgcatggcaggctcaggttatttaactagaggaaagcaaaaacttccctttagatcatttgcataagtttgtctctgaaaagccatcagcataaaaaaatgcattaaccaaatgtcttccaaaaatatccatgagggcaactcattaagggatgtgctgcatgagagtgtatcactaatgtggaagggaggtaagtgaggaagaagtctttgtcagacttaaaaggaactcagatgctcttaacagatcattggcaacaaaagggagagtgcaactttcaggtcttgaatttgatcatctgctgatgttgcatacatttagtctttcaatattagtctttacaaaatatttcacaaaacttttttaacctatagaaatttgtttctatacatttaatatatttttattgtataaattattctcatctttagtgccttctttcagtttataaatggcaaaataggcaatcaacaatcataaagctaatcccaggtggaatcccctcctgtcagtgaggttagtcctccatacacttgcaaattttatgaaattcttgtctttgcagatgccagtcaaaaaactacacacttatccttccctgatagtatgtcatctccaaagggattcctttcttttttccttctttctttcatttgcttgttaagaaatcaaaagatgtgcatagttataaaattcaaagtgtaccaattacagatgtgggtaatgggaaggctgatgaggttcgagtgctggcaatttttctttaaagcaaaagacacagagagctctgcagctaaatcagctctggacatctgctggggtgaggaggctctcatctcatctcttgggcagaaagcccgtcagaggttcatccctacacctggcactttgagcaaaccaaagccttccttcatactgcaatgtcttttctgtcccaccctttggcccctctgtttccttcatggcttcatacagtttgtgttgtacattcgtaagaattcacattgactgcaaaaacataaatgcaacaaaaacataaaagcctccaagtagtatgttatatatattttgttcttctaaatgctcttctgtcgttgtcagaggcgcagtagctaatttataacttttcctttgagggaatccagatgaaaggcccagattgctcttcaataacaagcttgcattggttatatatatcttctaaagtatctccttggacaatagctgtaacaaaagcaaacacacccagaattagaaataatttcctggatggtgaagaacaatcatcacttacacattggaggctcaaatcagtagcagatgactcatcaggaagcttcatatcatttttcattagtaagaagaagcagaaaattcatataagcaaagttacattcatgattttaagaaatgctttcaatggatatcctggatcagtaacaaatgattcacagtctttgcactttctacatgtctgtctgtagtactggacaatttatcactcatctatttaaccaatattttatgggtgcctactctgagccaggcactgagctgggcaatgatcaattttcagactgagagctccctatttagaaaagaaaactggccttacagtctgtatatttacttattttggcagcagcagaaattcagatattgtagacaccgaggaaataatgaagattttagagggaagtttagttagcctcccaaccctcaaagcccttaataggaaaacccattaattccccaaatctctggtaacttgagatttttaccatacagagctattcatattgagaataccataagtccactatttataagaaacataaacaggaagaaatataaacaaactgctcagttgtgtatctcctaaaacactaagtcacttggagtagatttaagtacattttattgtctcatttgaacaaaagttatcttgtagaaagatttccaaaacacatcagtattatccatatgacactaggtcttaaaaataaattactactgaaagatgatttagatatttaaaaacaatcctcagaatatattattgtattgtatacaaaatataaaccactgtcaaaatgtacacttttgtttctcctacctggatgttcttttaggatgaaacacagctcgtatcttggttactgacagaaagattacttaatattacctgattcaagatatttacaaactgctaaggcactgacactttctatattctgaataaggtaaaaaataaaacatctaacttcacatatggtaatccaggaagaaagttcttgggttttttttttttttttttttttttttgagacagaatttcacccttgttgcccaggctggagtgcagtagcacgatctcggctcactgcgacctccacctcctgggttcaagtgattctcctgtctcagcctccctagtagctgggattacaggtgcctgccaccacacccagctaattttttgtatttttagtagagacgggggtttcactatgttggccaggctggtctcgaactcctgacctcaggtgatccacccacctcagcctcccaaagtgctgggattagaggcataagcccagctcgaaagttcttgtttttaaacctccgggaaccaggtgtaaggcaaatttcacaaagtctgattactcagtgttctatgaaagtatataggaatacagaactcagaactcaggctctccagaagaaaacctctattccccttcatgtttccaaggaaacatttaaaaagaaaaaaaaagcagttttggttgagacttgacacagtgaactgaaacatgaggaagttttaagcatcttgttcaggtgctgctgatagggacactgatgaaagctcatggagctggggacggacgcctccaagcttcttctcaagagtaactgctttggacactgaccattttgagccctaaaattttgtttttcaagttttctgatgatatcagggagatagtttaatgaggtagcaatgcctcaaatccttttcatggtaggagatagctcaggggtatctcctgcccatggttttgggtagggctggtgggaacctgggagctggctgcagctgaactctcaggagaacccagggttttacatcaaaatgggtgaagcagagggatactccttgtatatgaaacagatattagggattctcaacaggaaggttttagggcacaagtacaccaggcccagaaccctctctgtgccaaatgtcagacaatttatcccctttctcacactaccagggtaaaagtgaacttacctgtaaaatattctccaaattcttgttctagcttaattgctcgatcataggttttcttggcttgttcctctgttagacgcttattcatctccctgggaaaatgagggtttgtattagaacataaagggaatattccaaatcctaaaaaattaaaatgtatggcaaaaataaatcctacagaaaacatagtgtaatcttagcaacaggtttttagtcttcattcaggactcctctgtgctggaataatttcagcaacaaggactcacggccagaaagctcattctctcaaagggcagtctcttggtcccacattggattgaagccaaatatgtctccttatgatttgtagtcactggtccctgttctgcagggacctaatatcctccatggtaggccctaggatatttaagtaaagtgcttaagtgtgtcttgaggcttctacttcttcagaataaactgtcctattgcttcatctatcccctcattggatgtgatttctaaatctgaactttcctgaccaccctttcttggagtttgttctagtgtatctcagactttctgaaatgtgagagtagaatggtagttatcagagactgggaagggaaggcaggaggggagatgaagagaagctggttaaggggtataaaatgcagttataggaatatttcaaaatagctagaagagaagaactgtaatgttcccaaaacatttctggtgatggatattccagttaccctgatttgatcattacacattgtatacaggtattaaaatatgacatatactccaaaaatttgtacaactattatatataaattttttttaaaaggctcaaggataaatcaaggtgggagagaaatgaaaaattcttgaattctctctaaaacctaatctattgattcttaactactggcagctttatctttccgggtcttccaggtgttaaaaaaaaaatgtcctgccaaatgcaatttggttggctgatcaggatgcatcacaggtgcatgtagaatttctgaaatcattaccgtcttgcatgctgcttaggaagccagagatttgggtctggaacatctggccttagtcaattcctttcgagagcaagtaacagaggcaagaagggatgtgcttaaggctgtgtatttaacgaagagtaatctggggtaagaactcaaggttttggttttttaaaccaattttcagttagacttcctattataccaagacttgatatctttcaaaagaggctatttggaaaaaaaaaaaacaatatattgacattagacattaatggctgaaatacaaagtagtgagaatttcctgaactcttgttgctaaactcatcttgtcctgaggggtgttatgtataatttttcttccaaacagtctcagctgtacatgctgtgaatggatgttactcgtgggtggagaagatgctgggctaaaccaagggacactcttcagagaaagataaatatttgctccagatgtcaagaaatcatgtgggccaggcacagtggttcacgtctgtaatcccaacaccttgggaggctgaggcaggtggatcacttgtgctcaggagttcaagaccagcctgggcaacagggtgaaaccctgtctccacaaaaaaaatacaaacattagctgggtatggtggcacatacctttagtcccagctacttgggaggctgaggtgggaacatggcttgagcccacgaggtcatgactgcagtgagccatgatggcaccactacactccagcttgggctggacagagcaagaccctgtctcaaagaaagaaatcacatagttctggatcatcttcgacctgccttccaagaattctgtcttctctgaattccctttttactgattacagcaatgacttagtttaggtttttattctctgacctgtgaatttattttgtctccttgactgatcagtaattctttgagggcgaagaccatggcttgtttgtcagcatgtggcatggagactgattcaacatttatttgttgaatgaatagatgagtaaatgaatgaatgaatgaacaaatggggagctagataaacataattataagatagttgaagacagaagtaaacacagagcatcatgggagcaggaaggtaaaagcagattggaagtggcagggtgaagggagattgccacatggaaagggaacagaagtcagatggtggcacaatataaaaagaacatccctttcatacacatctttgattttatgctcctctgaagagtcagctatgtatgtgctaataagctctgtgatttgatgtggatgatgcacttgagaaataatgtgtgtgatgatgtatcaatgtgtaaatgtgacagctgtcatgcttttgttccggctgacctagcattcactactctctggggaatgggcaattcatggcagctttgctcctggagtaaaagccttggaaaagagtgaactgtaaagtaaacatccaacctttagtaggtagattgcattggtctgaatgtcaccatcactgcacttgagacccatgaatatggctgcagcaaattatgtcagattcactgtccttattgtgaagtccagcctttagtacatttaactttccttggtgataagtggctgtgacagtgccctaaggcataactaaaataagtcatctcatagttgtggaaggcagtagaccttctcctatggaatgccagatgggactgtctcctaatattgcaccggaccaaatgtgccactgctgtcgttccctcaggcctcattcccctgggaagccatttatcccactgagtgtttacaatatgaagatttatttttctatttctgaaacaggcctttaagatggctgttcccaggaagtaaggactatttttcttctcattaatgttagcattacttatatttatgaggctcttgacagattataaatcaattttacatcatgaaatttgtacttgcttaattcactttgtgcaatgcccgacatagtatcctatacaaggagaaatttaatacatgctattggggatgataatattaagaatcattattttatcattagtacatatttttccatgtgccagccatgggaaaaactctttatattataatttaatacctaaattcatggggctgaaggtactgtcagtgacctcccgatcttactttttttatcctggtaagaatccttgtccattttttatatatgggactatattctgctttcaaggtacatctctggctatttccccagagctcaactatgtatttaacttaattctctcaggctgccactccagctgctgcagtttgctttgcttctttgtcttcagaggagacacagaacagttaatatcctctgtaagcaattgctttcaccactgggattaaataatttctgtttcttcggtccttccataaacattattttccagtactctgtggttcactcctgaaccctgtcaaacactatggtcttgaggcccagatgaaggcaaaatttgatcaaggccctcatgacagacacattggcattatctcttgcactgtcatggaagaggtactgtttatgtgttttataatgataaaatagttttattcctttataatgaagtaattttatatcttttacaataataataggtattatttattgagtacttaccatatgccaaagagtacatgaacagctttactaaattcctaatcttgttatttaacctttatactagctctatgaggtatttattagtatgcctcgtttcgaggtgaggagctaaatcttagaaaggtcaagcaatttgcccaaggttacttaactgatcagtggcaaagtaaagaaccaaatcttgcctgatcaattttcaggtccctgctggtagccccttttctggttacctctatctactgtagcttcacctttgtgaatgggagttgcctatactgactttacagtcagatcgtgaatgtctgcccactttgtttaatgattcttgaaagaagttatttcacaagtcctttggaggggaaaaaaaaagaaaaaaccctgagtgcacaggtatgaagctactggtttaagttacagatgttttactgccacgccactaagaaaactctattaagaacgatgttctatgtatgtaaagttttaattaaggaacatcagaattctattagagaaccaaggaaaatgccaatgaaaaaagtctcaaacgttgtctgctctctctataaaaaatctacacatttaaaaagatttacttatagacctgcctcagaagtatgagacaattaaaaaatgattgcttcctatcatttggaaaacaaaagcaaaccaaaaaaccaaatcaagccaagctatcctcaaaacaacaacaacaaaacctcaaaaactaacaaagaaaacaatccgtgaagtaaaacaataaaaatcaggaaacattattgaagatgttttaaggaattactattattgttaaaatgagggatgttaaaaaaagaaatcactgacattatgtttctagttgtttaaaagaactttgatatatcttcaaaaaaagagaatgctgaaaaatcaacaatggcatttcccatttgtaagcattcccagcaaaatcctgttagtaattttcagtataatacagaacagggagtcagttggatgaaggcctccaatgccctctactcacataagaggttccagagacctgggttttatgaagatggcaatgggatagagctgggcaacttgtaaccgcttgatagcatttcctgatacatcaagtatacagtgtttgccctggtagaaagagaagaaaaatatgaagttaatataggaagcatggccataatccaacaaaaggaaactaatgtatgtaggttttagaggaaggtaggggatgctggatttctaaagtcagaaaaagatcactgcaaagagtaaataaaaatcgatatatagggtcatcattgagtgtttacaataactaatactaactagccccttacaaagtgtctgctactggactggacattttacatatgttctctcagttaaatacctgatgtaacacacaaagatgacatgcagccgtatgttatgtgactgagtctgttctcatgaagtttaaaaaccatctctgaacacaattgtcagaagaaattcccaaatctctgaggtaggtattatcagctgcattttacagaagactcacactaactaacttgcccaatagtttagtgctaggagcatgcaaacccaagtctggagcactaacagaattgttggttggaaaaaatagacacctcattgtctcaccctgcccaacattcggtgtggaagattgagaataatgtgaatttttccaagtacttgtacatatcctgtctgcaaggtactcagtctagtggagggcagacacaaaaatggttaacttaaacatatggttggttgggtgcagtggctcatggctgtaatcctagcactctaggaggccgaggcgggtggatcacctgagatcaggagttcgagaccagcctgaccaaaatggtgagaccctgtctctgctaaaaatccaaaaagttcaccaggcatggtggtgggcacctgtaatcccagctacttgagaggctgaggcaggagaatcacttgaacccaggaggtggaggttgcagtgagctgagaccgtgccatggcattccagcctgggcaataagagtgaaatgccatctcaaaaaaaataaaaactatatgtatatatatatatatatatatatatatatatatatatatacacacacacatataaaatatataattaaaacatatatatatatatatatataaattaaatgcgggttaaatgccaagagagaaaggcttgcatgaggtatgtaaatttcttgtttgttaacaaataaaaatgctattacattatagcacacctcatttaacttggcttccaccacaatgagtgctcagagcaagcagctgctttataaagcatttctggatatgcagatacatttgccacatcatattctacctcctggagagaaatgtcctcattaccctgaggctagaataactttatgcaagaagagaaaaaaggcactttatgcagataggaacaatactaaatcaataataagggctaaaatctcatctataatgttcacatgaaaatgaatacagtccagtgaatacttgaagtcttcttatctgagaaacccactaagatggttcaagccgttattacttaggtaatagatttcaagttttctatctgtgaagtgcagcagccacataacatgtataaatgctggttgattattcaccagtcagaacatttcaagttaacaacatgaacaaagaggaaaataggtgcaattatccaggacagtttgactagaaccagtattcatttagttgatagaactgaacttttgagagggaggaaaatagatgcaacttcttagtgtattcttagatagacatcaaaattacttaattctttagcggtacattgagaaaggtcatggcaaatcaaatcaacccaacaaatatcttctcctatgatactggttctctgtgttcacaggaaataggatccctctgtaggcagattgtgtagccacacccaggtgccttcctatggtaccctctcttgaacattcttctcttttccatgcccctgaagttaccagcaaaaagataatagcagcatctacacctcctctaagctagaacttctgcgagcaaaaggctgggcagcccttctcatctatcttctcttctaccatgaggatgtcaagttttcagagagagagaaaaaaaataacttcctctaacaaaataattcaggaatgctatccccttggtttacaactaaagtagtaaacctgccttaataaaatcaaggttgtgtattggggcctcagatagtgagtcaaagacaaagccctcttcctactttttccaagtcagtgagaatactttattgaaattagaacaaagattaatgacattgctctaaggtgattctctgcttggatgttttaaattattaaatcaaaatttacaattgcaatcaagaaagagtaatgaccaaaaaaaaaaaaaaatgcagtttgcaacctagaaaccttcttcaggggaggtgtaagaagattggtgaacatactctttctgctacaaatctcacagactgcacactggttccatataaattgtcattgtactggccggcttctataaacttgtgctcttggatatctttctccatttgttctctggaaatgacaaagtgatagtctctgccatccacctcgtagtctcgctttggcctcgtagtatctttataaaacaaaaaatgataaaattaaggtgcatttatacccataaacttgctttacacctatattctccaccacatcctcaacattgatatgtagaaatatgtagtatgaagaaatatgacatagtaacaggtactagtcttaccctcccaccataagcaactaaaaaactggacaaaatatatgaaacaactgttttcagatatcagacaacaggaagtacagggctgtaatctttgagaaaagagaaacatatgagagagcattcaccccacctctctacctagaggccatttccaaatggagagtttagacatcacatggtgctagaagacacgggagttgagtcagaacccatggagatcccagaaaggccacattttaaaaggttactctagacttactctacacccatcttcacaaagtctaaaaccatgtcacaaatggaagaagctgctgtgtcagtaaattatcacctgtcagaacaaaaacttaacattctataaaggaccataaaattcagactctcaacatatataaaataagataatcacagttagataggactaaaaatcagcaactctaaccatttcacctaaattttttggtaagaagagaaggggaaagcaatctagcaatatgaataaaagctgttaaaatatttttaatctttgactcacttattttttcctagaaatatgtttttaaaaatgatcaaaacttcagatacagatttatccttaaagatattcattatattattttataagtaataattataacacaattacgatgatatttttgtcacaattcataatagtgaaaaatagggaaaaaccaaaatgttcataaagaatgattaattgggatataataatcatttgaaatagttatataaaattttaaataagcaaaaaaatcatcacagagaaaaaatgcatgcatagaaagaatagatggaaatgtacaaaaatattaacaatgatgttatctctgggtattgtgtgggattttgtatacttctaattttctcgtttaactttctttttagtgtttttgaagttttgtacaatgaacatctattgactatcacaaaatggttctattaattcaaaaaagagagaatatgcaaggtgaaagggaaagcagaaagaatgcttaagtaccttctgttttctttctctcaaaagtggaggagcaagctggaagcttgctgtaaacgacctggagtttcatttgctccttcctgtctgaagactttctcaggatatgttctatggcaggatctcttcccagagcccttgctgggaattgtttcatgagatacagcaatcatcctagtcttttggccatgtactggacacatacaattcctgctattcttaagtatctcatgtaaaatttgcagtactggaatgttagagacacttgaaagcatcaggcttaaaacacatagaatggaagagaaatatttgttggtatcagatgtaagagctccattatctaataaattaaaatttcctgatggacctgtctacatacgtagaaggtctgcatgcatttctgtttgacagagtcggggtgtagacggggtgaatgagtggagaaagtatggtaggggtggggaggggaagaggcagagcagttagaatctaataaggctacaatcagagggaccagaagcctgatgataatctataatgagaagaaagtagtttaaagtctgtaatggcctagaggtcaaattgaagtgttacacattttcttgtcttcaccctccctaaacctgggactgtcaacatgggaaagcctattgggttttgggattgacatatggccctaagtcatcctgagaggattttaatatatggctttgtttccgatctcttccatcctataaaaaataatgtttcagtggcattttgatcaatctatgaaaacatactgatgcctatcataaatcctatgctgttttaaatggttgggggccacaaaaattcatcctgccttttaaggggctacaatcagtttagagaaaacattattatttttattaaatacagaatgacacacggcagcataaatgaaaagtgttaggcaaataaattaaataaggcactcagctaatcggaaatggttggtatttgaattactggagagactactggaggatggaattacattttaccatctcataaagaaatccaagctctttttgtttttcctagaggaaagaaaaatgacacttacgaggcacacaggagccaaatttatcagggaattcagatatcaagtcgtcattgatccgatccttcatgggccccaggataatcaccggccgggtgtagtttactgcagaatgggaaaggaagatgtaggtaaagagaaagagttggaaacaactgcaaaactgtcctgcaagggtgattcttaattgccagacagtaagagatgctaagggcattacttcactggataaattactcatacagccttgcatagggaaattgatgtttaacactcaggagattggcagtgcctactttctggaatctactagcagggaaaggcaattgcagtatctgttgatgaaaagaaacatttggaggagttttgcttactctctggctctgcctacataatgtcaaaacaactgaatttagtcaactgagtgggagaaaaaagaatccaaaccagctgtttggctattgtttagatatgactataaaaagtaattgttagtagtaataacatcttatgttttcatgatttcttttccccagatcaaaatactctctatactttgctacagtttctagatttccttgtatctgggattagaaggaacctgagagttcattgggtacaagtccccatctgatgcttgaattctctctgcagtatccttgtcagtagcaattagcctctgtataaatgcctccaggaaaaagcagcagcttacagatagcctacatcttaggcagatctgctagaaagtcattctcaatactgagctgacatcagtctctcaggagaatttattcaccagtctcgtagctagtgctctttaggtaatttgaatgtgttccttcccattgaggaccactcatctggagggctgcatccttctcttaggtgctattagtgcccatactcagcaggaagttgtctgtttggtgatagggtcaaagagagagaaagtgagagacagcgtaagagtaaggtacggtctcaagacaacagagcattaagccgagtttattctccttagtccttcactctttccctccttcaatgatgtcacctcttatggcccagaaattaggaatgaaagcgtgctgggaaacttactttcctgccttgtaacaggctcataggaaagaatgaggtcttcttgtcctcctgagaagagaaggaaagaaaaccacagtgaactaacagtcatatattacagagacaagccctgctctgaaacacaggaaacagacacagctcagagttaattctccttgctctttctccttgaaccattcaaaaataacttcatcctcataaaactctttagcaccattttagtatcagattttcacagtcataactctaagtaataactggttgctagctatttgctgcagggcaatgacctgtgagacttctttctgtctggcattgagaatggaatgccatggcctctacaccaagcattactacttaaaaggaagccatttagttcaaggaaagggtccaattcaatagatggctgctacataatcagaattgctgtaccttttatttcatcttctattttatttccccaagaagcacactgttcaaaagcaagtatatgcttatttcatttatgatataaaaacttcatcaggacactcagggttttactctaatattaattcgtcaggaaaatgctgtgggtcaattaatgaagatcaaaaattgaggtgtgtcctacatcattggttataattgctgctaaactgtgcgttgaaacttcagatagagaactaaggaagacacagtagtaaaatgtcagcccctccaatgtcatctgctacaagccttctgactcagggtggacctcaagtcaacaaataaccatagaaagtaaattggtttttgccatttattttttcaatcatctattttatataattgatgaattaattggtcagaggattagctcaatttcacctgcaaacccggaagtgtctgcatttttttttgcattgactaacctttggaacagcaataggttagggctgttgaaaagaactttctgtctactagaagaaatagtggagcagaagtggaatatgaggtaacttctgaaaccaaagggcaattcacctttgctgtatatcctcaccacccacccctgaagcacattcatagtctatcaatgccaggttttcctccttcaacagccacagcaccacagaaagagaggtaatttcataagaagagttaatatgatcgactgttttgataatgagactgatttggggaaattgagcaatatgtgggtatagctgcgaagttggatgacttccttggaggctgggtagctggaatgggatggggataggagtgtcttactttttcaagtgtgagaaatggcctcaggctgaagtcatatcttatctcagtcccaaggagggcctgggctcagaatggcgccaccatgccaagctacttcttaagggtacagagagtggaccttgatgctcctcctaagtggtatgtacccatggccaccccagaagtgttcaggggactctgccacattggtcaggggtttggtcagtgaggagtcagattcactatttcttgtactcaggaaaagaatgattccctttgaataaactactgaaatgtacagagcctaggccaaaaaacatgaaggtgattgattactaacccccagttatctaaagcctgagcgatgtagagggtatacgcattcaaggttttagtttagtattacttcatcaggaaaatgctgtgggtcaattaaagaagtgtaaaaattcttggggagaaagtatagttttaatgatagaagcatcgtagactaacattgcaattttagactataactttacaggggaaatcttcaacaattaatgtgcaagggaagaattctgaccatgggataacaaaagctttaaatgtcaggtaactcttggacctccttattaggctgggagtttcataaaggcgagaactgagttttattcatcaccatgtctccagtgccccattgagtgcttaacataaagaaagatgtcaacaaatttgcattctgatttcagtcatgggaaacaggatgagtgatgaggccaacggtaggttctattttgtgtttctgtcaatatggtcatttaactttggaaagcatcgttttctctaaataaatagagcacatcaagttcccataaaaatctcttcccaatggctttgcaaatcattctgatggaacgttctaaaggcaaatctttaataagatatttgatgtcagtgtgtatgattgcgattcagacaactagggcaaagcatagctttgattaattttgttcaagagttctctatctctgtctatccatcacttcttggtttacttttctatgaaaggcactggttctggttctggttcagagcagtagtgttggtagacagcaatggcagcatcccttatgtccgggccaccccaattctcaagaccttgtggcaatcaggtactgtgtaatacccaggaagcctgtggggaaacccgtggaggtgggcatgacataattgctgtgaattcagcatcttaaactaatttttacttccatgtccaagaatgaaaagccctatgggtaatgaggaagagacaaagggaaagagaaaaagccactgtgatgaaggagagaaaattcatgtctttgtggcactttgcgggccttgaggggctttcatacccactggcttttatgtctcacaggcattgcttgaggtaggtactctgatgatccccattttacagatgaagaagctgaggctcagagatgttaatgagccctgattcctcagctagtaagtagtggagtcaagatttaatactgcacctttttcaactcttgtggagtatattgcactgtcttgaaacagtgagagaagcagaattctctgtggggcagggtgggtgggtgttgaggtaaagctaacaaatgaagaaaaaattgaagagagagataggggctgaaaccaggtcggggttattaagaggccatcagatactctgcctctaaacacaagttctctctcttttcttttctctcttctttttttcttttcttttcttttctctctctttctttctttgtttctttttcttttgctgttgtgtcatccccataaaatagtcatccttaagagtttttctattttctgctcaggaggggttggcacttcaaaataacagctgacaaaaaggtacaaactatttcttggttttgttttggcaactgtatggctgaaagtgggagagcagcacagagctgtgtgtggatgtcagcagctgccagagacttcgcagagggttttgtcacagtcgccacaaaacactatgtgtttaaactggaagccagtcacaatgagagaccctagtaacctttatgctagagaaaagcaaattgccattctttaggaattcctggaaactagaaaacagagatgatggagttgaagaccagtggcagtacgtttaatgctcaaaattttgtttttagtgcctgcatatgatgatttttaagaactaattaggttcttagagtcatagaatgctagtgctaagaaagggcttagggttcatgtgcttcatagatggcaagtacataccacacactattactctctgtgatcttgacaggcatcacaaactgatcattgccgggattactgctgagcctcaacatggccttagaatacttttcattacaactcttcaggcagctactgccaattggttcgagtttgaaccttgattaaaatttatttgccatttctattctaattcaagctactcattttacataggagagaactgagtctcaaagactttaagtaatttgtttaaggtcatatagtaaattcatggcaaattgtctccataggatgttcagaagatgaacttaatatacgtacagtccttaaaatcagacttggtgcataatgttatataaatgttgttgtttgtattaactttataggtagtatgaaatggttgaaagttactaggtaaaatgtcaggcttggattacaaactacagggaagagtgaaaaatgaatgggattcagaattaagaggtcttggttggatttgcagtgccactactttaataaggcaggcagcctcttggagcttcggcttcctcatatggaaatggggctattaatgtaaaacatgtctaataaatagttttgttgcagaaattaaatgagataatagatgtaatgaaaaactgctttataaagactaaaggagtaaagacatctaagggcaatagttgagaataatagagtaaggtgaagaatatgcaccattttgactgactccagtggagaagttttgggtctcctgatctcaacacgttagtttcactcagattagttcttcaagatccttgttttgaaaatcctacttaactggtgagcactaatgggttggaaggataattatcagcttgcacacatccatgatgatgtaaagagctttactgagctttgaggaaggcatgtcttcagctttagaagcttgcatagtcctcaatatacttgcctagtatttaccacctcctaatacatgggtgactgtaaggtattatacagaacagccaaaaatacaaggctgaattttactactttattgacataaatctagaattagcctataattaagatagttttgaggtggtgttttgcacaattagacaatgtacactttatcagctgcaattttagctggtgctaaatatagttggaaaacctattttataatgcttgagatgatgcagcaaagatctgaactatttattagaaattgatgtttgtgtgtatctatgtgtgtgtggcctacctcaggaaacatgtaagactttgaagtaaggttgccacgatgtgtaactccaggatacagtgtgaatggtgtactccagactgtgaaacacaatggattgtgaaacacaagggcctaggtctttgtttctaactctgaattattacaattatttagccattttgttcccagagtggatatggaatggtaaagtataacagtgaaatacaacacctggatattggtgaaaagaggggtttttttttgtatttgtttatactatttttagtcataattacagcaaaagccaggaatgcactagaaaaatgcagcctattttgacttcaaagttggtacctcctggaaaatatatttgttccaaacctgtgtgtcttttttcatggcagtgctctttctgggaagttccttcctcatcttgcctagctagcaagttcctcatctttccaaagctcagctcaaagctacttcctctctgaaactacctcttatgctcccactattcttgagccagacatcaatctatcttagtacctgtcacactttgtgcactttttcatttatttatatctctctcctactattatgtgtgctgagatctagagttagttgatattcacaatgggtctcatggtatccaagaagaggacctcatgtatagtaggtaccgaatgaataaataaacattcctctggaattcttcatatttccattctggaggaatacatgtcatttttctcctctgagctgtgataaagactcttcttacttttgttcatttgtaaagaaaacaaactgagtggctggccttctgtaaccttggatgagactcaagccaatagagataattagattccatatttgccctactaatgtcatagaatccagttccaactcttctctcttctcatagataatttgagatgcctgcaagtgtttcctttattcattcaataaacatttatgtgcaactagtatttagagtaaaaataattattgatgtcatcttagaacatcactctaaaaatctgccaagtagttgaaagtcttgggccagtttttataacttaataattctgggaaaaatattcccacctctgaaacagagaagagaagcctttaaaatactctataaaaatgtgatttttataagaaaaggtagttcttgtatagtatatattttccattaaaagaactgaaagataaagcatgatgctttctttttcgatacctgtgtctactggatggaagcacaacacttgaaaattgaaaactgaacatcaaggaaactagtgtcattggtcttcctggaacccagaaaataagttatatttttctacgtactaaattgagggcagcttaggtgttattaacacaagctttggtcaattcttcttggcttagtttcttggtttaaaataaaatgaaaaaggggagaggcaaattttttttctgaaattaggataataataaaattataaaagtataaagaatgtaaaaatgttgacatgttaccgtgttgataacaagaaccttctgaattcttccatcaacaagaattgatggaatttcttctatcaatcaatcaataaaactttcatcaataagaaaattaggtggttcctatatcaatctaacgtttgattgaccaagggtatctcattacaattttcttcattttattccttggtctacatcttccttctctgagcctacctccatctgccatctttccacttttgtgctgctgctcctacttgccacccctctgattttccaaagcctttcttaaaaatccaaattatgtgttgtaccactgtttggccttccacctcaaaaaggcatggttttgtaaagtaccatgctataacgggggggggaaaacctcaaacaattctagttttcaattaatacaatactcattcaaacaaaagacaacaccaatttctgccttagcatctgtgggtcacaggtattaggcgtgctttttgggtaacccatttcactaaggaatataaattaatctcatagaaatcataagaatcctagtaaaaatatgtatctatgttagtcaccaaaaaccagtaagtaagtaggtggtaaaaaaccatgaggactgatcaaaaggatgtgatcggtgtttggtggatagtttcatacactaagcaaatggcttgaggtgaccaaacaaagaccagaaataacttttaaatagttacctaccttttcagctaagttttctgatctaagaagacttggtcacatttaaaaaaattaagttccttcaacattagaggatgaaactcttccatcagttccccaattatcaaaaaagtaaagttagaaatgtcatagtatcctatcttaaaagattaatcaaagagaaagtgatgtaaaagattcaaacctgattttaaaggaacactttatttataaatgcttttcctataaaggggagccaagaacagaaaggaaatggcaaaataagaaggaaaacaataccatgatgattttccacctcctgctgagagtttcaattattttgggggttacaatgtaaaaatccaccacgttgaactttttacacaccttctctgtgagaattgaatcactgagtcacaaccaactgaggttggaattgtttattagcaagaccactactacttgcacaaatcacataagggtgcactgatggctctagtgtcttttttatctttccacatccagtgatttcatttcaagccatttgctttgaatacagatgataaaaggtagcaattgaaaaacaacaacagaaatctgaaatgaccaccacaggcaatggggcaattgcaaagaaaataaccgcaaaccaaagcagtaacttacggtagctactttcgctatcgctggcattagaagaaacatgttctgcaagaacagcacagcaaattaaagagataccaagcattgaagagcagccagaacggaaaggaatacactcatgcaaggctaccagaaatgtgagcgaaaggcaagtaaaagccgcagaggaggctgcattaagaaaactcagataagataaagaagatgaaaactttatctccattttacaggaacccgctgcttgattgctgtttcttctttttagcaaatgaagaaagtatctttaattacaaaaaatgcataatgtcaatttaggcgattagaaaaatactatgacccattcatatacctctgactttcaagatttatgtgacaatgactagtatgtcttgactgagtgttttcttgactataaattcagacgcttctggtgtgtaggcagtgttttcttgcaggcttttttatttctcaattttagcctttaagaattttgctggaacgctgctcaaattgctaattgatccctggaatcccttgaattttatttctatttaaatagttcctaaacacattctcaggatgaaaaggaattcttgaagatcttttctgcttcagtgagtgagttgaaaatctttgaggaagatgtgagtcactgaataatattttacgaatcagctcaatagttccttgtttttattttaggattcttgcttggatagctattgaatactagtggcatggaacaggcaggagataaatggcctgatacacggtacaggttctggctgaagtatgttttttttaaattcatgctgaatgacttgcttgcacagcaatactccaaattgttttttcatacatagttcacctaacttaacagggatgtgttggttatatgccagaatttgagctcttatttctaaaatcattttcgctcatccatactgcttgttaagttatagatgatacactcatcagtctatgaacttatttgtatattactttaattaaatgaagaacatgtgactatttgatttctgaagctcactataaataacatcagttttttaaaaagtgacaatagttatacatttttagaaagagaaaaataatatataaaattattctctaacaataaaaaagtgctttgatatcatacattcttgccaattggatagagtagttttaaagcatgaaactaatgaaaaccaaagcatgggttaaattcacacaaatcatttctctttgtgttggtctgtgatcagaactgcattactaatttgggcacatgttttgcaagtgcaaagaggcaatagggaaagaagtgtggatgaacctgtgcaaatctgttttctgttactaaaatgaaagtcaaggcacataatcaataatagtgcatttcatggagattattatcttaagtgccttgaattgggtaagacagggctttttgttgttgttgcgaagttttactttttaaatttgttcaatttttaaagagcaaacaaacatttgcatattctggattgaaatggtgtcctatttctgacactccaaaagccactactttttagtgatatttattattaacaatatattaagatgtttcttttccctctcaaattgaaagtttacaaattctctctggtggtgcttgatgctgtccagataatgctgaaatcaatatttaaacttcagccactaattcaggaaaaattttctatcatattccatatagtaactcaaaaataaagttttcatctttaagatcagtactcttgatcagatttttaaaaatataaatatcttttaaaaactctccaaatgaacaatttgaattatgaggagtatcaatactcagggttatagaaagagcccttgaaaacaaagtccagttcaatgcaattttgttttatacaaataaacagcttctaaaaatattgcccatagctgttaatttaaaacaacaaaacaaaaaaaattaaacatgtgatacagttgcaaaagacacaaaactctgttctcatttcattggtgcctacacaatggggttagttattaaagaggaaaaatcataatgtagtatattaagacacaggataattattttttagttgcttagtgcaatcagatacagactaaatacatgaacaattagaaaatgtaaaggcttaatatattttctttttcactctatgctataaagtgaagacctgattttataatgtagctaataaatcactgataggcatattattacatatccaaactttaaacatttcaagcaggatcaccgcaagtcagaaaaaaaaatcaaagttaataacaaataaataaatactcatggaatctccagtagcttaaaatttgcttttagagaatgcatgttccttttgactacgaaacagctcctttactaacagcaaagtgcaacccaattatgagatttgacaaggtcattaaatatttccatgtgaaaaggcagaagaaagaacataaagtacatttctgttttgctgttctagaacacttagctcaccctttctttcaacatggtttcttgctctatggaggtattaagcggcagagcaagtgatgctatggtgggcatcaggaccatgttgataatatcacatggtcagaaagggatggtgttaactgcaacagaagttagagtgcctgatacattttgcttttaaatgctgacatgcagaacaaaacgatcgaaagttactttgtaggagcattcacagctaggtaacaaataaaactcgtatcttgtgcatgctaggagtgaaaggccctcaggaaaaggaacaaaagccaaactcaaaaggaaaggaaaagaaaagaaaagttacagtgaccattcctggaaacttactcagagtctttgttccataaccgtcgtcacctaatccggggatgtcctgcatggaagtccccagagagagcaatgagagaggaagaacagccacggaagaggaaggaagaagtcagtggagttgaaatgaatactaccatgacagaccgtgctgccttaacaatctggatcccattctctcttcttttaaaaaaactttcaccccaaactccttgagctgagattcaagaaggaaatttctgatttgcagagcaactcaaggtttaaacaaaagattgtaagaaaaaaaaattcagcaaatgccaattttttgaccatggtcaatcacgttgccacagaaatgtcccacttaaggaataaacttctccaaatttcatagcaaattctaaatgatatccaccattacaagctcagtgctcagaaagtgtttagtgttttgggggagggaaagagtgagcaaatgtgctagtttatctttaaatcaataaagataatttaattgttcctaacattccaaaaaacatatgtggcaatggaatccaatatttcttctcagaaaataatttgtctcaagacttagagggttgcatgatagaaaaggcaaaccggacccagtcctggtcaaagataaatgttggttgggtgcaagtcccagttttggcaagtctctctccaatgccttctgcaaagaagagccatgtgaaaggagggatccagactgtagtcagacgctggtcacagtagtagacctgccctgcctgcctgctgtgttgtttgcctaggtgtgtggcgtgggagagcctacatcctgcgtgttgcctgtgaattttttttctcttatgttgcatgtgacattatctttcagaatctacttacgttcaggatcactggtttcctgctcactctgctccttgttcttgtagaatgggaattttcgtgaaaagatgaagctctttttacgcttgtcattgaatgactgtgaaggagaaaaggcatggggcaaaaacaggggacgtctaattgttgtcacactcatgctgacaaaacaactagtttgtaaaagcacagagagctgtagtgacgcaagtggataattctaaagtggtgccagagagttctaaaggtcgattttattttcaaggagtataaattctgaatggtggcaccttggaaaaattgtctcctaagcaaaagactggttacagataaatggtgatggagggaaagagtcttaaattagaaggagaagacccagaattttttgaattttttgtgctggctctacgtcttgctagttcatcaccttagaaagggaattgaatgtctctgaacctcagtatgttcatctgcaaaatgaggacaatgatagcagctcttacgttgtgagactcacaaaagacaatgtaaacataaagtgctatacaaatgtcttatcaccatcaggtagaaaacgctttattggagaaactggttttcttcttagtgtcttgatgtcttttaaaataatttgaatttgagttacttctgtttagttttaattaaattaaaactgcacaaagaagtatgtagatttatggtataattacagactgacacatgaatatataatcattagaatacaacatttttattcaaaagagatttttaacaataattaacaataatttagccccaagccctcattttatagacagggagccagaggcacagagaagttgtgtcctatactgctatcacagagctagttggtgacagccatgaggcaatcaaccaaaatctgttaaaattgctgctaaaggggtattaacttgatattaacttaacttatcaaaggaaaaatggcagtcactctagattctgatcaggtaaaaaaagtaagaatgactgtctttaaaaattttaactaaactattccattagcttaaatgaggctgaattaaaaataacacatagatacataatacgatacaggcattagaatttattcattcaagtggatatcatgtgcttacctagaagactccctaaggaaattccattaattccactgctgctgttcttatgcaaatgttttgtggggtttctctttgggaaatgtgttgacagtcattttataagttattggccatgcaggtcttactaatttcatattcatatatcattaaaaaatatgtttcatcagattgactactacccttgtttggctgatttggctctgagggtctttcagctgctgaaaaaattaaaatcactccccaaggatcaagatttgttaccacacggctattgaaatgaaggtgccaaagactctgaaggcaatttgaaaacaggtattcaaaaacatttttggcaatggaagctgttaagaataaatgtagagcagcaaggtgacccttagaaggaaaggacacctgtttggatgtgcgcttttgtcccattgctgggaatgagtcctgtgcccttatggatttgaagcttgacaaaatggtataaataacttatcttctttgtatactcatacattcccatatcaaatatccattttggtaaccatgttcatttaggaaacattaaagtactgaaatgttggtgctgtcactcggtaagtaattcattacttttttaggtagtagaaactttcagcaaagtagtagagctcaattgtatgcccattaataaggttttatgaaaaataatgaaccaaataattaataatttctgaaattaggggacatatactttacattcaagtactaaaattacattctcagagggaaaagaggtatcacttcagaatttattactctgctgacagcacctatgttcaatatagttttatcatcaattgtaatttagggttggtgtccaaaaacaaggttgagaactgcccccaaattttcctagttaaaaatgatagtccttaaaagaatactaaatattcttgcatcactccagtttcatgccacttttacatttcaagcatatttaaactccagtaactgaaaataaaagaaaaaaaatcatgtaagaattaatggcatgtgatactgcaaggtatgttagacatttaacttcaacatcaccaatgacttgtcatgcaaaaaaaaaaaattacacattttcatgcaaatacaaaacaatgccaagaggagtaaagcctggggtgaaaatgtagacagagagggacaatgcagaaggctttgagggcccaaaatggggctgcatgcaagccacatcatttaaatggtctcaagggtcaaaggaatatgaaaatgtgttatctgtgattaattcttttatgtttcaaagcaaggactataatgtgttaacatttcccaagtatgaaaatgttgtgtatcatgaatcatctgattgggacataatactactaagcatcacactttacaaaagaacagaaaatacacactaatactttaagaataaaagtatctaacatgtcagtcttattagcaaaagccatttcagattggaattaaagagaagggaatggaagtattggtggttacatttccttacatttgtggacaaaaaaaccaaatcacaatttcagttcacattcacagacttaaaagtcacatgtttaggatcttagctaaacatttcaactataagagagactatatgtggtttataatgctttaacagtattctttattttttattagacatgtgtaataccattatataagcttttttgctgctgtaattttttttcttttaatatagaaaatgaaaatctgttacacgagtgctaggtgagaataataaattagcaattctgctattatttgtagaacacattgttctgaagcaactgatggctgatttacagccctattctcaattatacttgatcaatgatattctttgtctctctagtgacagtatcttagctctagatccattgctttcatagcaggaaacatctttaaatagacactttgaaaataccaatcaaatgtggcatggggcaagctggcaaatctaagaattctattttggaatttgacctaaaatgttgagttctaactattaaagatgataaaacaataactaacaaacatttattgagcacttatgtgccacatttggttccaaaagctctacatgagttaatctccatgctaacttcatgaagttagtaccatcattattcccatattacagaagaggaatctgaagtgtataaatcttctattacttgccccagagtcacacaattggtgagcagagaagtcagaaattgaatttgcaaatattcctggttgcaaatatcactgtttttaagagcatgacaagtttctgcaacttaagcctgcttcaagtttatatttaaaattattagtgcttgactctcttaagtgatatcacagtgtgttcttcccacagcttgatgcttgaagattatttatttaaatcatcagatgctattggattcaacaacatcattttggttatcctgttacaatttttgtgatagtcattcatattttttggactttcttcaatttttctttttatgataatgtaaaaaaggaaagaatttaagtgtgacaggccatgaacggcaattaaaaggtaattgcccattaactggcaaatctgtggaaacaaaggtaaattgtggttgcttagagctggggatagtgggcacagagattgggaagtggcagccaaggttttttttaggggagataaaatgtttgttatacaattagattgcagtgatggtggcataactctatgaatatactagaaaacattgagttgtatactgtgagtgaattgtatactatgtgaattatatctcaataaagccatttctttttaaaaaaggaccctctccccaatctcatagtatggactgagaagaaacaattgtagccggtttctaattttatttggtgtaaataatttttatctttaattgaatgagagtaaaccactcattccaaccctcgcaatcaattagatctacatgtcttttgtttatctgattttgttttgtctctgttaaatgaatacctttcatgttgtgacagacattagaacacccatactaggagtcactattactcagaagtctccaggttgttaggtcaaatggcatgaaattgcccagcctgactctgagatgtaatggcattggtgaactggcttaagataaaatacatgcttcatgaaagaaggaaacaaaacaaaaaactcaaattattttcctactcaaatctcatgtttttaaacacacatgagtgaatcttgacatattttatctttctcatccagaaaaccttaaaactagggacatgttttactttttctcctcatcttcctgttcttatttctcaagctttaaaaaagtttcatagttctaaaatgtcatcttagtaatacaggtgttctctgggcagaatttaggtttaaatttatactgagctcagatacgtcttttctgtgacccccttattgttttatacatgctattttcctctccttgtttctcctctaaaataattgtgttcccctgggaaagttgttactgtacatttgggccactactttgtattatacaaatcttattttcacacacataaaaagagaactttgaaaacaagtgaggtaaaagaacaagtaataatgtaacaaagaggggttaagggaaagataagagttggcttgagatatatctgcttacagaaatgtgtctatgtgaatgcacgtatacatgtgtgtctataacattgcctaattaaaaaaagattacttctgcaaacctaatgaactaatggatgtaggcattgagtatcagtagctgctacaatcacaaagagacagtcagatgtttcacgccttctgataaaagaataaaatattacaaggtagtcttgaaaacctctatttactcccaaaacaaaactccctcaaatgaatcagaatctaaccaaacctctggattgaactaccagtttacagcaacaaagaggacagagaaacatggtaattcctactataaaaatgcaatcaatcagcaaaatccaaaatgtgggaagctctacaagacaaactatctgatttcatctatataaaattgcaagaaaccaataaaaaatggcaggaaaacacatagatcagaagaaactttgagaaggatcaaccagttacaatgtatagacttcattttgatcttgattcaaacaaacaaattataaaacaaaacaaagcaacaattacaacaaccaaacccatctgtgatacttatgagccaatttggccctgaaaaaatactggatacttgttgatccactaattgtcaatttttatgtgtaataacggcattatggtcatgccatattgcaatattaagagctgaaaaaatctgatgcattggattgcttcaaattaatatgggagggatgtagtacttatgtaccccctgagtatattgtgaaggtagatctgtaaagaagcctcgaacttcacttaacaggtttattgctggttgtgatacagggatgacaattctgaaaccatttggtgtgtgctgtagggttgagtaaatgagtaaacacatggatgttgttgggaaccagggttgtcactgtgaaagaaaggtgagatacaaacgtggtacggaggaaggagaggaagactcttaagatggtgaccagtaattagaggcatgagatataaacttaggattttctaaaaagttttatttcttctctatccattaaaggagcttagatgtaatgaaaccctaacagcaaaatgcacattcactactcagattttgtcttctggatgccattttccacaaaagaacctagaatgttttagagaaatggctcattccaaggctggagcagagaaagtataaggtgagtctgaaacatttcgtggggctagaaagtaagcagtattaaatataaacatgacaccaaacacaaaacaaataaacaaaacctaaaatgaatggtagcatatgaaaagacacaaacaaaacctggataatttgaatattaaaatgaataacgacagtaataaagtataacacattcaattaaaaaaatttgagttcactctgattaccaaaaatacataaatgatgtaactaaaaatgggataaaagaaaagctcttctttagagtatgactaataattatagaaggaaggataaagtcaggaaatcaccattttgtaatcatcactataatagtcaagttagggaagaatcatctgtggatgcctaaagcattggttgaaagtttgttggggaataggatatttatctcttcccagattatttaattattaaaaagaggggaaaagatacctttatagtggagaaatctggtaaatatcaccttaatcaagtgatcaaaattagcatcgccaaattgtgggacaacatgacaccatgggcctcctgatggaaaacactgagaagtacacaacatcacttctgtagtatttctgccaaatatgtcaatgtcatgaaaactataaaatatgtcaatgtcatgaaaaccataaaaactaaggaatcattctagattaaaggagataaggaaataggaccaacagaatgcaatgtgtagtcctgagtcagaaaaataaaaagtcatattttctacaactttctctcaattcagcggattataccaacatgagttggtaattgttgaagcttagtaacaggtaaaatatattcataattctactttttctactttttatatgtttaaaaattttcataataaggataagaaaaaagatgaattgtaaagcacttaatgcaatgccttaaaaatacttaataaaagtagctaatagcaggaaaaatgtttgtttcctttttatagttttttttctgtttttttttttttgttactacttcaaatctaacaccaggaataaaaacaattccaactcgcatgaagcacaaggggctacctgtacctagaaataagaaaaagaagcagatcagaaaagtagggaaaaatcaaatcccaacgactatcacttgtagcctagtgaaggctgagaactgggttcattatttatgaaactgtgggagctaatcctcttttgatctcaaaaaatgaaattcaatttagagttctttgcttaggaagaaatcaaaatcacaagatgccaatcattctaattaagttctgtgaaatggaatcccagatgaaacctgttttatttttcccccatttatgttatttctaagactgatcatgctaaataaaagcacatcactcagtcagcagtctaagttggggaggctcaattccagtaaaaagctcaggtaaccaaagggcatagagaccaagcccagtatagctaaggagtagctgaaattatatgctggattttacgatgactctaatgcatatagtaagtaggatgttttccttaacgttgaggcccaagacatctacagcatcactttgtctgagatgtcatacttatttctcccaaggaaatagagaccttctcttctctctcatcttgcacccttctccagccaccactcagatctttctgcttctccttacagcaaaactcctccaaagttatcccttcttctcttcccttctgaacttacttcaatcacacttcaaatatcgtaacatcatctacaccagaggtcagtgacctgtggcccatgaaccaatccagcccactatgtgtttctgtaaataaggttttattcaaggataaccatgctcattccgtaggtactacctatgactagtgctacagcagcagaattgagtatttgcagcaaagatcagatggcctgcaaagcctaaaatatttactctctggcccgttacagaaaaagtttcctggctacttatctaaaccactttattcagggccaccaatgaacttcatgttgcccaatcaaatgttgattctcaggtctcatcttactctgttgatcttcccattagacatagttcatcatatctttcttcctgaaacgcttgcttccttgaactctggtacacctccacattttcattgtcatcctaccccatatagcatttgtcctcagtctgttttgctggatccctcttcatctttctggtctttaaaaattgggggtatttggactcagtttttgagtctcctctccctccctccccagctaggagccttccctgtctccagcttgaaactttcccagagttccagactcatatatccaattaattgcctactcactatctttacttagatatctaatacatagtcttcaaaccaaacacgtggtcttctccacaaaccctcaacaagcaaataaacaccaagcaagcagacaaaaaccttggtcctccctcagtcttgttcaacttgggaaattctaactcttccaattacgcaggctgcaaacttgcagggacgcctctctttctctcataccccacatccaattggttaataaatcctgtgttctcagctttaaaatacacccataatctgaccacctctcaccatctccaccactactaccccagtccaagtcaccaccatctcttgcctggagcatgatattgacctcagctggtgttcctgcttccacctattcctgctgcactttattctccttacagcagccagggtgatcatttaaaattgtaattcagatcatgtcattctgctcgagatcctccagtgacttcccacctcattcagaataaaacccaaaatgtacaacatggctggaaaggctctccataatccagctctagctaccactttgatctcctctgccactgtgccttctttgcctcactgtcttcctgccacattggccttgttgcttttccttgaatccttaaattcaagatttccttgaatcttgattcagggactttgctcttgctgttccctctgcttgtaatcttcttcccttagaaggctgattcctcacatcgttcagagttctactcacatattcccccttatcagtgaggctttttctgacaggcctgtctaaaattgtgctggccctattactatttgccttcctttgtcttttctttctttccttccttccttccttccttccttccttccttccttccttccttccttccttcctttctctctctttcaacatttatcaccatctgcctgcatacacatttgtttattttctgttttccccatggaaatgtaaactccctgaaaataagaaatgtgttttcatccactgccatctctctggtgccttagaacatgtacatatagtatatactcaataaatatttgttgaatgaatacatgctccaactccttttgtgtttccccacattctggcctttattgctctctattttttatcttttacttgactgtcttctactaaactgtagactggctccttaagtaaagtgcttatttttacttcatttactgattattttcaatatctccctaacctagtacctggcagaaagtctgctagtgaataaacaaatcaatgatcaatgcagaaactggcttatttgtaaaaaagtgggaggattttcaagttgaccaattattcatcatgtgtggagctgttcttagggagggactttaacaataatagaactgtcaactaggacctggagaagctgaacaaataatattcaatctaaagagaatgtgatgttttccagtgttaagcaataaagccaaggtatcaaagcagaatgtttctgtgtactcaaaccccatgtttcctatgactgtctaccataaatccttgtctggttttatgaactaaagagacctgatcttgcctcattagagtctgcctactgtggctcctgccacctggccgctgtggattaaagacctgtcacatcatcaagctgctctggcaggtattacaggaactcagagctgaagcaaataaaactgctatctgagtttcactttaagtcctaattatttatagactaaccaaaatgaattgtactgataattaccatttttaaaaacagtattgaatagaagtttcatattaaccagaaacactcaactaaatggcacactagattatttcttgtaaacccgcaaatttagtttatgccagctccaccaccatcccaggatgcaggagctgtcctagctctattctcaaattactcctctgccgggctcttaggtacttacctgaggctatttcagaaacagtgactgactctacgtcccacaagatgaaggaacaactaccatgtttatggctgttttttaggttgaactgcctatttctttttttttttttttacacaatatcctcaaatttgtatggattttttagttaaaacaaatgattcctgtcaaccttgccccagactgcagagacacccagttcaccatccttagcccttagtgatgaggtgagaactctaaaggcttctaggtggagctccctgcctaccagtgcctatgtttgaaaaggatgtctcctgaagttgagcagggcacagactatgtggcagccctgtactaccataaagaaaaggaattttattgcaaggatactagaaaatctcatcaaatctgaggaactgtagaacaaccaaatgagataggccacatgcagctaaaccacatgaagaactagaatagaagattcaaatgcaatcaggacactcactctatctcctggagtgtttgtttgctttatttttctctccctactgatcagacccttttacatggtggcaaacacagctaccactgaatcctaagctccctttcttatagtttctaaaccagtgagtgactctagcactctttgggttcaagctaaaaaatctcagggaagatctctgatgtgctcagaacggattagatgttcagctctgtgtcatctaattatgacagtggtggcagtgggcagggtctatgtggacataaaaattacttcgccgtggtagatgtgtgtgtctgttggagtgggggaggtatagggagaggtattctccaaagaatgacatgctattatcagaaaaacctgagacatcaagcagagaatacagtgagtgcttgccatgcttttgtttatctacttcagaattgtaattgacaaaaacaatctaattttggactgcccttccactccacctcatgtttatcctgctgaagtactctatcttcaaaactgagcttaagggtcatctcattttctcaacttgaagttgagttagtatccttctctaagttgtcacagaactctatatacctgtttttacccataccatagtacttatgacatattattctctgtctgctgctattaaagaggaagattggtgaggttagaaattgtcgtacccatttattaacatagttataataactatggctctccccaaaacaatattttcagcttaggctgctttcctgaacctcactctcataagtccaacctctcactcatgcccacctggatgtcccatagctaaaactgcttcaacaaatgctctggagcaacttgggaaagaataaactttgactcaattcataccaaacaccaaaattattaagggatagattacagatctaaacacacaggcttaaactgtacaatttctagaagaaaacatacaatatacttataatttgaggtaggcaaagatttatggatagaatgtaaaaagcacaaatgataaataaaaaagttgttaaactggacttcagcccaagttaaaaatttctgttcttcaaaagaagtcatttaaaaaatgaaaagacaagtcacaaagtgggaaacaatgtttgcaatatatatatctgaaaagtttttattcaaagtatttttaaagtcctacaattgaaaaataaatagaaaaaccaataaaaaatgagctagagacttgactggatatttaacataagatatatatatatatatataagtgatcagaaagcatatgaaaaacatcattagtcatcggggagatgcaaattaaagccaaagttcacttgatacccaccagagtagctaaaattaaagactgacaatattaagtgttaataagacatggagcccttgcaactctcatttaaattggtggaaatgcaacatgatacagttactttgaaaaatagtttggtatcttcttgtaaatgtaatcatataactaatgtatgacttagaaattcactcctagaaaattacctaacagaaaaacatatgtccacaaaaaggtatctttacaagactgttcacaattacctcaaactggaaactaccctaatatccatcaacaggtaaattaatacattgcggtatattcatacagtgaaatgctactcaacaataaaaaggactgaactattgatgcaggaaacaacatggatgaaccataaaagcattatagaaggcagacacaaaagaatacagatagataattccaatgactgtaagtccaagaacaggcaaaactaagctatggtggtagaaatcaaatcagtggaagagttaggaaggatgtctaatccatatattatcatggttgtaaccatgacacctcccaaaactgtatttccagcccatgctagtctcctaaatatgtatagattaatcttctatatcttgtctcaggaggtggttttagaaactcttttctctttgtccatctcacaaacacttagcatttttaaggttatgcttaggtgttctacccaatgttgtcacagtgaatgccacttatttttatatatttctctcctatcacattatgatctaatagcaggtaacatgttactttcattttggtatctctgggattgagagcatgacaggtactcaatactcactgaatgaatgcaggaaccaaaatgttgagcaatgatttctactatgagtatggagagaaaatgtgggcaaagcaaaacaaaacaaacacaacaaaataactgaacatctggtgaaaggggggagaagtaatggaagaataagaaccataccggctgggcgtggtggctcacgcctgtaatcccagcactttgggaggccaaggtaggtggatcacctgagctcaggaattcgacaccagcctgatcaatatggcaaaaccccgaaaaatacaaaaattagctgggtgtggtggcatgtgcctgtagtcccatctactcaggaggctgagacaggagaattgcttgaacctgagaggcagaggatgcggtgagccgagatcacaccattgcactccagcctgggcaacacagagagacttcgtctcaaaaacaaaaaacaaaaaacaaaaaacaaaacaaaacccacatagtttctttttattgcatttctctgcagttatctcagatttgtctttttttcatgaatttaatctcataattcttatgctcaatgatctcatttacttctagctgccttttattactagtaataaaaatgaggtggcttagctatttgcttgtatgcattttttcatagtgtcacattttcagctctatctattgtccacaattcaataatggaaaacttttaaagatttccagtagcattaataactccaataaaatctaccatttaatttttcttttctaacttttttcccaattaacctttactccctttcctaactaaaagcttaatttattaaaaaaaaaacaacaacaacttttttccattaacaaatggaagcttccctttttagaaaaaattcaaagggaattgaggaaaaagttatcatcttattacagagatacaaatatcccttagtattatttcttcattttaaaaaaatgtatcctgtttaaatttagttgtactatacttttctgtataattttaattccgatttttaagtttactatttcacataatgaagtgttatgggcatagactttggaatttggctgtatgactttagaaatattatttaatctctgagcctcagttttaggtatttaaatgtgataacatattaatagctctcaccatagttgctgacactatagttcaataaatagaagccaattttaatagtaatagacacactttcccaattattagaaaatctttagaagcatcagttttaatgaacatataacaatgaaatgaaattaaaactcagtaacataaaggaatttggaaaattctcaaatgtatggaaattaagcaacactctcctaactaaccaatggatcaaagaagaaatcacaagagaaaatgaaactacttttagatgaatgagaatgaagacacaagataccaaaatttataggatgtagctaacactgtacttagagaaaaacttatagccatatatgtctatactaaaaaaagatccaaaggaataatctaatcttctacctgaagatactggaaaagtaagaccaaactaaacctaaagcaaggagaaaaaaaaaaacaataataaatattagaacagaaattaatgaaacagagaattttaaaaattgagaaaaattaacaaaacaaagtggggaagaaaaatctttttttttttttgcaaagattgatgaaattgattaaccttagctagactgaccaagaaaacaaagatttacattgcaaacattaggaataaaagaagagatattattattgaccttacacaaataagatttaaaagggaatactatgaacaattatatgccagtaaattagctaacttagataagatggactaattcctagaaagacacaaactaccaaaattgaatcaagaaaaaattaaaacgcagaatagacctataacaagtaaagagattgaatcagtgatttaaaaaattatccacacagaagcccatgcctagatggctttcctggtgaattctattaaacaccatttaaaaaagaatgaaagccaattctcacaaagttttctaaaagatagaagaggagacatttcccaacttattctatgaggccagtattacctagataccaaaatttgacaaagatatcacgagaaaagaagactacaaaccaaggtgtcttataaacataatgacaaaatagtatttcaagtgaatttactgcagtggcttaacattcctatgttgtttgttgttttccattttctttgtagtctatattgcaatgaatataccattcagtgcattttggattattttcttgggatagatttctaaaggttaaattattgagttaaaaattatgaatagtttaaaagttttgacacactgccaaattgctttcaaataatctgtacgaattgacatttccaccagcaaccatttattcgtaattaataactggtcccaagaatgtatcatgattgctttttttttccctttcaacaccctctacactctccgtattgcctccttataaggtaagtcttcctgccctcgaacatcagactcaaagttcttctgtttgggactcggactggctctccttgctcctcagcttgcagactgcctattggggtatcttgtgatcttgtgagttaatacataataaactcccatatatatatattatatatataatatcatatatatatttcctctaataggatatatatatttcctccactaataggagatatatatatatatatatatatatatatatatatatatatatatatcagttctgtccctccagagaactctgactaatacgacagtcaagagctctgcttaattccttttgctggtaaaataacctccctatcttgctccctattctacttggtgaataatgatctattctttaatatttagctcacatgtcccctcttgcttgcatatactcccctccatagcagaacttatcctgccttcctcatgccccttcggtactttgcatgcactgtcacattgccttagtaacttagaaatctctgtcattgaattgtgaggttctttagtattgtagctccagttcctagcacaatgcctggattatgcatgtgttcagtatatatttggtgcatgaataaatggatgtaagtatctaggacggaggatcctagagtaattaggcaagccttctaacaaggtgccgtcattctgaacacagggctttggcagactaggtttagtattaatttatttgctaggattcaaagtattccagcatggatatgaacatgaccttaaattgggaatatgagagaagtatcagagaatcaaatcccaaagatgatgttgttgcactgtattatccaccacggctacatttcttccaacatccatcctgccttgcaaacatcaaactttgtgtggtcactgggtcataggtccagtttttggaaaaaactgaaacagctttcttcaggttcattaaagctgatggagcttttatgctactgtcagctaggggggttatttgttcatttatttatttattttatttactaattaagttataattattattcctttattaataaatttatttattgaatgcctgtatgtcccactatgtgtcaaggcttccactgagcccttagcaattttatcttcatttagatattcatgtttggaactagtgcaagagatgataaaatttaataatagattctgaaagtgtcattttctttgccaatttgtgcatcattctgtgtggtagattccacaggaaattgccagctttgtgactcctattaattatttcataagcctaaaattgtataggatttcatcattaagtttcaaaatactatggcttatactacaactcaaagggtcagaaagcaaaacaaaactaagtaaagaagaaaaaacctttattccctactttgctcactttacagttattctcaccaattggacatgttgaaattatttttaaattcccatatgttagatagagaaatggggctcagaacatacgttgttggtcacattgctaatttcttgatttctatttttttctgtttttcttttcttttttttttttttggatattttctaaaattcaaaggttcttgtcaatgcctagagagctacctaatccctcacaatatggctgtcagcccacaatggccacagtaggttacaggagcaaccactggcaggaaaagctctagggtccatagatggaagtccgactaactgatcagtgttgggcagggagaatggctttcagaatccagtgaagcccaccaatgtccacagggagccaagaatcagactgagaatgaggagacctggttctccagtgcaatttgaacaagtcattcatatatctgggcctgtttcttcatatataaaagacagtgcatagaccagttgatcgctgaggatctctgaggtttctttcatctctaccattctcaaatcctgaaacctcattcaaggtcaagctaaaagataaattccttttttcccttttctattttagcattctctaaatgcattgctaattgagggtattattttgttcctgtgattgtttccccccaaatccagagactgacataacagttaataaaatcctaatgtgagtgaaaattctgtctgggttatctttaatgaatttaattgagcacccactaagtacatatcaccacattaggccccttctctgactatcctgatcctttccttcctttaaccacagttactcagtttggacttaagggttctctaattgctctattgatgctagtttttcgtttcatcttcagcttaaccctgtaaggaggaggatcttatcttaaaattttcttttgcactcttcaaggtaccccagaataatgtgtggaaccaaatagataaaaagtacttgtcaataataatagcatttgttggtaacatttgttaaatgcttactcatatagcggatacttttataagtgctttacatggattaatcattctaagtgctttccacatatcaagtcctattaagtggctacaaatagtgttcacaacttatacataaggaaactgagctagagaaaggttgagtcacttgcctaagggtttacacaactaggagtcacaagccaagattcatacccaagcagtttggctccagagttgcgctcttatctattatacgatactaccttttctgtgattgcttgcaaagattccaagtgtgcattttactctgctctcagtggatagccacaataactactgctgagaacttctccaggcaaattacttcctataaaattttataccttatttctaaaatataatctctatttttttcaagtgattcaagcaatgagattttggtgatcaatccccaagggctatgacaccactgaatacttttgatgggtatgaagtaatatgctcatttgcagggagcatgtcttgcctcaatttcatttcttcactcccaggaatgccacttcttctgtagcttccctaagggctcctctcctcttctggtaatctctcagactagtctttactggctggtcttacatacctatcctaaaggttatgtgactccatggggctggccaaaacctataagctgatttacccttacctgtgtaaggaaattaccctcactgagatccatacgttgattacaccaatttaaagttacaggatccccattctttttctgtttccattgctgtctccccagtacttctgaagttactcatttctcatgaactttctcttgttagaaggctttcctaattactgtagataattaggaaataattatcagatagttacatccatttatgcatgtacctaatatattttgagcacatgaataatccaggcactgtgctaggaactggggctacaataagctctaaaaaacctcacaatttaatgacagagatttctaagttactaaggcaatgtgacagtgcacgcaaagtactcaaggggcatgaagaaggcaggataagttctgctatggaggggaggataggcaagcaagaggggacatgtgagctaaatattaaatagaccattattcaccaagtagaatagggagcaagatagggaggttattctaccagcaaaaggaattaagcagagctcttgactgttgtattggtcagagttctctggagtgacagaactaattaggatatatatatttatatatatacacacacacacccatttatatatatatatatatatatatatatatatatatatatatatatatatatatagatagatctaataggatatatatatttatacacacacacacatatattattaagtattaacttacaagatcacaaggtctcacaataaggcatctgcaagctgaagagaaaggagagccagtccaagtcccaaaactgaagaacctggagtccgatgttcaagggtaggaagcatccagcatgggagaaggatgtgggctgggaggctagaccagtctagtcttttcacatttttctgtctgctttatattctagccatgctggcagctggttagatggtacccacacagattaagggtgggtctgcctttcccagcccactgactcaaatgttaatctcctttggcaacaccctcacagatacatctaggatcaatagtttgcatccttccacccaatcaagttgacactcagtattaaccatcacaagtctaccccttgtcaacttgaacccatacacatcttctgagattatatataatcttcaaataaagacaataataaggtcataattacacctaacataatacaactatccttcgtacaaccagaaatgcaccaatctccaacccaaatactattaaagttaacaatacttctatgctgatgtgaggtcaataaatcttatgtcacatgataaaggaaaaaggaaataaaatgaagatattttcttagtacaggttacatgcacaaacatgtttttaacaaaagaaggaggaaatccttatgacaattacactcctagtttctgcagctggtcatgtggtcatagctggtattgatgacttcttctactacccattcagtattccctttgccttcagcaagcacctcagcaggtcatggtttttttcctggtagagtgacctaaaccttgattcctaaagggcctgggctatcccttcctggattgggttattgtagtttcccactgaccttaatcacagggcacagtaatactaagagacaccctaacgaatctcctgtattccatgcatactcttccttacctccattatgaagtagtagactgatttcatcttgacagtctgggtcagtcaccccagccaacactgtaacttcctttttagcctgctgacttaaaagtaggaggagcccaaagtgtccaggtggcaatcttaacttcccatttaacagaatcgttgtgtctcctggtggcagcattcctccctctggaactaagactacctaggccagcagactatctaggccagcagaatgtaatgttgtgggaggaggaagcaaaaaatttgctagtggatcactaggagtgatggtgagtggtgccgcttccacttccacccgttgattcctggacccgtgaatcctggctatgggagaaacagtaccatatattagttgctgattcagagcatacgtggccttctggagaactttgccccagccctgcaaagtattgtcacttagttggagttgtaattgtgacttacaaagctatttcaccattctatcaatccagttgtttcaggatgatggggaacatagtaagaccagtgaattccatgagcagccacacttctttagccataaagtgagtgccttggtcagaggcaatgctgtgtggggtgtgtgtaacaatgtgtgtaccatgacagtggataaggcacttcatgagtccacagatggtagtcttggcagaagcattgtgtgcaggacaggcatacccatatccagagtaagtgtctattccagtgaggacaaacctctgctctttccgtgatggaagaggtgcaatatatatataacctgccaccaggtagctggctgatcaccctgaggaatggtgccatattgagggctcagtgttggtctctgctgctggcaaatggggcactcagcagtggctgtagccaggtcatccctggtgagtggaagcccatgttgctgagcccatgcataatctccatccctgccaccatggccacgttgttcatgggcccattgggcgatgacaggggtggctggggaaaaagactgagtggcgtccacagaacaggtcatcctatatacttgattattaaaatcctcctctgctgaggtcacccattggtgaggactcacatgggatacaaatatcttcatgtttttttacctctcagagaggtccatccatatacctcttccccaaatttctttgtcaccaattttccaatcatgcttcttccaagtccctgaccatccagccaaaccactggctacagcccatgaatcagtatataattgcacatctggccatttctccttccatgcaaagcgcaaaaccaggtgcactgctctaagttctgcccactgggaagatttcccttcatggctgtccttcagggatgtcctagaaaggggctgtagtgctgcagctgtccacttttgggtggtatctggatatcgtgcagaatcatctgtgaaccaggacccagtcttctcttcctctgtctactgatcatagggaactccccatgaggccattggtgcagggtggcaggagtggagaccatggacatttgagccacttcatcatgtaacttacttgtgccttcaggacctacttgagaccaatcatgtatataccacttccatttgctgatggaatgctgctgtgcacggcccactctatggctagatgggtcagaaagcacttagttcatgattggcagttcaggtctcatggcaactggatgacccgtagtcaaacgttcagtttccactaaacttggtcctagaatttccagctcgctcacagtgggccatcttttaatccatatttcagctaaacaagcaaacaaactactagaaccttttctaagtccctgagctgcaacattaaatgcagagtccctagtgggcccaaatcaataaattcagcctgatccaactctatgttccttccaccattatctcacacctttaatatccatttccatgcctgttctccagatttatgtttatattcaaagcattgatttttgagtgtagtgcacctcctcatgggtcacactctcaacctccctctaggcaccagccagaagtttagtctagttataggtctagacgcaaataggggtgttggaggtggctcctgaggagaatcaacattatcttgcctggcacctgcctcaggggaggccatcacatttgcctcaggcagcacagggtttatctcctcagacaaatgtggaaaggctgatggcagcatgggttgggaggggatgttgacactactggggatggggaagctgtttcttctggcaaaaaaaggttcatcagaatttacaaacttagtgtccccagctttatcagggttctctcacacgtttctattgtaagttgcagggtcccattcttttccaatcaatgccctcactttaaccatagacatctgatgagactgtgcatgcacctttcattgcaggtcagccactcgcatgataagagtttgtgcctgtttttccacaatttcatctttcacataggagatgagactctcactcagggcaatcttagcaatctgaggctcagtgtctgcctctgaagctgggagttagaatccctgggttcatccttttctttcatcactttgtctactgaacttaggagcaaccaagcagcttcattatgttccttggttctccacatatggtcaaaagtattatgtatagagtcaataaactccttgcctctcacaaatggtgaatcaggaatgtcaaatgcatttattttgcataactctctaaacagttcatgccaaggactatcagtgttctccatgctactagaagtagggtccttagcatttttgggtctaatcatactaagaagccaattccaaaaacccccaaaactaatgaaagaactccatccttaatattctgttcctttagaaccactcctggtaccaaaatctgtattagggttctctagagggacagaacaaataggatatatatatatatacacacatacatatatcctatatatatatctgtatatatatacacatatatataccctatatatatatatccatatatatacacatatatatcctctatatatatatccatatatatatcctaaatatcctaaagatatatatcctaagtatatatatcctatagatatctatatagatatctataggatatatagatatatataaataaataaaagagttaaatggggatgtggtgggaatcaccacccctgcatcttttaagtccttgatggtggcactaatctccataatccctccagggatgcgatattgttttttatttatatttacatatatatttttattatatatatatatatatatatatatatatatatatatatatgtatatatgagtttaacaagtattaactcacaagatcacaaggtcccacaaaaggccatctgcaagctgaggaggaaagacagccaatccgagtctcaaaactaaagaacatggagtcagatgtttaagggcagaaagcatccagcaggggagaaagatgtagtctgggaggttaggccagtctagtcttttcacatttttatgactgctttatatactagccatgctggtagctgattagatggtacccacccagattaagggtgggtctgcctttcccagcccactgactcaaatgctaatctcctttggcaacaccctcacagacacatccaggatcaatactttgcatccttccatccaatcaagttgatactcagtattaaccgtcacaactgttctttgataactcaaattgtgtctttttcccatttagaatatacatctttttttttttttttgagacagtgtgtcaagcccaggttggagtgcagtggcacgatctcaactcactgcaaactctgcctcccgggttcacgccattcttctgcctcagcctcccgagtagctgggactacaggtgcacaccaccacgcctggctaattttttttttttttttttttttagtagagatggggtttcaccagttagccaggatggtctcgatctcctgacctcatgatccacctgccttggcctcccaaagtgctgggattacaggcgtgagccaccatgcctggccagaatatacattcttaatactagcaactaatacttattgagctctcctctgtgccattgtcacaacataccttcttaaacattttgcactaattatctcattgaatcctccccataacactatgacatatacacatacaggcaaacacacacacacaaacacaacacaaatacctttttctatataaatctacaatacaaatgagaaaactgaggcttagagagataacataattttgcccagccggcaagtggcagaactgggattcaaactcagctgtctcggactccaaagaccaaacttcactactgttttgttttcggtttggattcttccagggcttagcagttgctgagtacacagtagttaattgcctaagcaatgttggctgacggaagaattggttaatagctgttgtctgcagtagaggaacagatgctgtgacctattacaggcaggaagggagagctcaatgactgtttcataatatagtttgttcaaatgtagtcacgtgatgttacggggtgaggccagtgtggttatatgctcccaggcatttgttaagtaaggaaagtgcacaaggcagggacaagagtccaatcctggtgtcagacgggccaggcacactgcttctctattagacacattttctttttgagagtccttgctaataagtttgattcaaatcactggccatctgaccttggactagttatttaacttttttaggattcattttcttcatctgcatcatgaatttaataataatgcctacttcacattatcatcaccacttgtaatgaggctcagtggtaacttgttcaaggtcacaaatctagaaaacaggaaagtcctaactggaacccaaatctctccacctacagagcatattttccttcctctatcacaagttactttcagaaatgcagtagctacgtgcctacttcagaagacaaaattcacagtgcttttttcctttttgactactcatggtactccatctctcagacttatggtaccccatctcttatggtactccatctctcaagccatttcttttgtctaagtcaaattaaccttgctcgcatttcaagactgaatcaagaaatataccttgtgagttagtgtatgttgtaagtaatgggttatagacaaagaacatccaggttgaatagatttatttggaacagtttctacttttgatacaactcccccttaatatactgttaaaaactcacaaggcatatcagagatgtcttgggagaaagtgcaagctgaaagggctgagagatgtgagacctgggcgtaagttttggttcatctcttcattcatcagttatttcttgagcgcgtagtatggaggctcacactaggggacggaatatagctgtgaactaacacacacaagatactttgcttgtggggcttaatgtctagtgaaggccaataggcaaatatttaagctataaatgtggtgcaaatcagaggcaagattcctggccctggcctgggtcctccttatctatgtgagcttaggaaagtcacttttgctccctgaacatcagcttccttttctgaccatcagggagttaagtgagatgaccctgatggttctttacagcattcagactctatactaggaagatgttctttctttctacctcccctcattccctccctccctccctccctccttcagataggagagggtattcagctttacccccttggatgttgactcagtttcaggagctgacagtgcgctctttaccccccaccatctgatgtcactccagactcagagagtaagaggtcacttgcagcattcatgtcctaggagtgattgagggcaaaccaacaaatcaagtgcaataataaacagcattcattataatgttgtgactgattgaataattctcacttcttcctacttcaatgaaaagagggggaacttgcaaatagaggcaaatccattacagctgagactcctagcctgtagtcccgttttagcaggatgcatcacggggattaggactctcgctagggagtttggtcatgcagtaggagagtggaagggtgggatgagaacacaggccccttgttttctgtctcaggctcttcggtatagctctcacggtgtctcccatctaaatatttccttgaggtatctttcagatgctaaatgcaagtagactgtgttttctatgacaagcagggccagtcagaggagtgaatcacatttacaatgtgagagcatgtgagtggctcaaaagtttctgaaccatccgtttttttttttttttttttttggaagggaaaaagcaaacattgcttgctaaacttggaatactagctgataaaagtatatatcctcacttggctaggatttaaattcctccaagattttagagataaaagccatgaagatacataaacacacttcaaggaaataaaacaccgcaaactgccctccaatactacgttttgagaaaaaaaaaaaaaccctctctgtcttcctctcacttgctcaaacacacacacacagacacacacacacacacacacacacacattcttttctatctatgctgaattcatagcccagcaggttcattcttatttctgtactagacactagtgatcaccgggtgagtctgttactgtaaaccaattgtcactttaaagccagagagaacatgctattgttttccttcaatgcttcttctgcctggggaggaatttttgcaccttgattggacatgccattcacataacaattgcattccacttatgagtaaatgcacttgcagtgcttagtacggtgcctggaaaattgtgtctaataaatgacatttttacggtctactcattctcaagtctcatgtcagtggagctcaccctagtagaagataatttatttgacagcaatatccactatgtgaagatttcagagaaatggggtgctgttacctccatcataggctattatagtgctaaatggaaccacgcatgaaaggggttagcatggtaaatggttaataaatgataagtatttttattattattagataagcattgattgtttttgtcaaatattacactcagccctccaatagcaaaaagtgcctgtgtaaattagaaaaagcttccctctctgggaagagggaatgtaaaagaagcaaacttttttttttttttttttaaagagccagggtctcattatgttgcccaggctaggctcaaacccctgggctcaagcaattctctcacctcagcctcccaagtagctgcgactacaggcaggagccactgcacctggcttaaaagcttaccatttcttatgctggctgttgttgaatgggatgtgttgctgagtcttatttccctacgtgtgtcccttaggcagcaacatggctatagtaagcatagggaacacaaagggaagagctcacagtgtgcaataattgctatgttggaaatttgtaaacagtttgtgagggcaccacggagggagccaggggaagctgggtggggcagctggagacagctcaaaggcaccattttagcgaattaaagaatgagtaggaaattgttaggtagagaactagcaaagcacagttcaggcagaggaaaggcctgcccaatggggaggtgcaaagccaccccttctgccctcttctctcccccaatcctgtgtgactgagcaatggtgagaagctgcactgataaagagtaggatttggagagggctggagctcagagaaatggtgggaaatacattcgagacgcagttctggcttggattgtgaggaacaccttagttacaaacagtaattctaaatatctactcctgttcaagaaataagcaataaacgagtaatacaaatttttctacagaaatcacatgtgcagttcagaaactattctttcatcatttaaccagcaactttatactgtatttttatttaattattgcatcattttatttatttatttatttatattatactttaagttttagggtacatgtgcacaatgtgcaggtttgttacatatgtatacatgtgccttgttggtgtgctggaccaattaactcgtcatttaacattaggcatatctcctaatgctatccctcccccttccccccaccccacaacaggccctggtgtgtgatgttccctttcctgtgtccatgttttctcatttttcaattcccacctatgagtgagaacgtgagctgtttggttttttgtccttgcgatagtttgctgagaatgatggtttccagcttcatccatgtccctacaaaggacatgaactcatcatttttatggctgcatagtattccatggtgtatatgtgccacattttcttaatccagtctatcattgttggacatttgggttggttccaagtctttgctattgtgaatagtgccgcaataaacatacctgtgcatctatctttatagcagcatgatttataatcctttgggtatatacccagtaatgggatggctgggtcaaatggtatttctagttctagatccctgaggaatagccacactgtctttccacaatggttgaaccagtttatagtcccaccagcagtgtaaaagtgttcctatttctccacatcctctccagcacctgttgtttcctgctttttaatcatcgccattctaactggtgtgagatggtatctcattgtgggatttgcagttctctgatggccagtgatgatgagcattttttcatgtgtctgttggtagcataaatgtcttcttttgagaagtgtctgttcatatccttcacctacttgttgatggggttgtttgttttattcttgtaaatttgttggagttcattgtagattctggatattagtcctttgtcagatgggtagattgcaaatattttctcccattctgtaggttgcctgttcactctgatggtagtttcttttgctgtgcagaagctctttagtttaattagatcccatttgtcaattttggcttttgttgctattgcttttagtggtttacacatgaagtccttgcccatgcctatgtcctgaatggtattgcctaggttttcttctagggtttttatggttttagatctaacatttaagtctttaatccatcttgaattcatttttgtatgaggtgtaaggaagggatccagtttcagctttctacatatggctagccagttgtctcagcaccatttattaaatagggaatcctttccccatttcttgtttttgtcaggtttgtcaaagatcagatagttgtagatatgtggcattatttctgagggctctgttctgttccattggtctatatctctgttttgataccagtaccacgctgttttggttactgtagccttgtagtatagtttgaagtcaggtagcgtgatacctccagctttgttcttttggcttaggattgacttggcaatgcgggctcttttttggttccatatgaactttaaagtagttttttccaattctgtgaagaaagtcattggtagcttgatggggatggcattgaatctataaattaccttgggcagtatggccattttcatgatattgattcttcctacccgtgagcatggaatgttcttccatttgtctgtatcctcttttatttcattgagcagtggtttgtagttctccttgaagaaatccttcacatctcctgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatgagcttaaggagattttgggctgagacgatggggttttctagatatacaatcatgtcatctgcaaacaggcacaatttgacttcctcttttcctaattgaataccctttatttccttctcctgcctgattgccctggccagaacttccaacactatgttgaataggagtggtgagagaagacatccctgtcttgtgccagttttcaaagggaatgcttccagtttttgcccattcagtatgatattggctgtgagtttgtcatagatagctcttattattttgagatacggcccatcaatacctaatttattgagagtttttagcatgaagggttgttgaattttgtcaaaggccttttctgcatctattgagacaatcatgtggtttttgtcattggttctgtttatatgctggattacgtttattgatttgcgtatgttgaaccaaccttgcatcccagggatgaagcccacttgaccgtggatatgctttttgatgtgctgctggattcggtttgctagtattttattgaggatttttgcatcgatgttcatcagggatattggtctaaaattctctttttttgttgtgtctctgcccagctttggtatcaggatgatgctggcctcataaaatgagttagggaggattccctctttttctattgattggaatagtttcagaaggaatggtaccagctcctccttgtacctctggtagaattcggctgtgaatccatctggtcctggactttttttggttggtaagctattaattattgcctcaatatcagattctgttattcgtctatttagagattcaacttcttcctggtttagtcttgggagggtgtatgtgtccaggaatttatccatttcttctagattttctagtctatttgcgtagaggtgtttatagtattctctgatggtagtttgtgtttctgtgggatcggtggtgatatcccctttatcattttttattgcgtctatttgattcttctctcttttcttattagttttgctagtggtctatcgattttgttgatcttttcaaaaaacaagctcctggattcattgattttttgaagggttttttgtgtctctatttccttcagttctgctctgatcttagttatttctcaccttctgataacttttgaatgtgtttgctcttgcttctctagttcttttaattgtgatgttagggtgtcaattttagatctttcctgctttctgttgtgggcatttagtggtataaatttccctctacacactgctttgaatgtgtcccagagattctggtatgttgtgtctttgttctggttggtttcaaagaacatctttatttctgccttcatttcgttatgtacctagtagtcattcaggagcaggttgttcagtttccatgtagttgagcgatttttgagtgagtttcttaatcctgagttctagtttaattgcactgtggtctgagggacagtttgttataatttctgttcttttacatttgctgaggagtgctttacttccaactgtgtggtcaattttggaataggtgtggtgtggtgctgaaaagaatgtatattctgttgatttggggtggagagttctgtagatgtctattaggtctgcttggtgcagagctgagttcaattcctggatatccttgttaattttctgtccctttgatctgtctaatgttgtcagtggagtgttaaagtcttccattattattctgtgggagtgtaagtctctttgtaggtctctaaggacttgctttatgaatctgggtgctcctgtattgggtgcatatatatttaggatagttagctcttcttgttgaattgatccctttaccattatgtaatggccttctttgtctgttttgatctttgttggtttaatgtctgttttatcagagactaggattgaaacccctagtttttttgttttccacttgcttggtagatcttcctccatccctttattttgagcctatgtgtgtctctgcacataagatgggtttcctgaatacagcacactggtgggtcttgactgtttatccaatttgccagtctgtgccttttaattggagcatttagcccatttacatttaaggttagtattgttatgtgtgaatttgatcctgtcattatgatgttagctggttcttttgctcgttagttgatgcagtttcctcttagcctcaacggtctttacaatttggcatgattttgcagtggctggtaccggttgttcatttccatgtttagtgcttccttcaggagctcttgtagggcaggcctggtggtgacaaaatctctcagcatttgcttgtctgtaaagtattttatttctccttcacttatgaagcttagtttggctggatatgaaattctgggttgaaaattcttttctttaataatgttgaatattgggcccgtctctcttctggcttgtagagtttctgccgagagatccgctgttagtctgatgggcttcccttttgggtaacctgacctttctctctggctgcccttaacatttttttcttcattacaactttggtgaatctgacaattatgtgtcttggagttgctcttctcaaggagtatctttgtggcattctctgtatttcctgaatctgaatgttggcctgccttgctagattggggaagttctcctggataatatcctgcagagtgtttttcaacttggttccattctccccgtcactttcaggtacaccaatcagatgtagatttggtcttttcacatagtcccatatttcttggaggctttgtgcatttctttttattcttttttctctaaactctgcttgcttcatttcattcatttgatcttccatcactgataccctttcttctagttgatcgaattggctactgaggcttgtgcattcgtcacgtagttctcatgctgtggttttcagctccgtcaggtcctttatggacttctctgcattggttattctagctagccattcgtctaatctttcttcaaggtttttaacttctttgccatgggttcaaacttccttctttagctcggagtagtttgatcttctgaagccttcttctctcaactcatcgaagtcagtctctgtccagctttgttccattgctggtgaggagctgcgttcctttggaggaggagaggtgatctgattcttagaattttcagtttttctgctctgttttttccccatctttgtggttttatctacctttggtctttgatgatggtgacgtacagatggggttttggtgtggatgtcctttctgtttgttagttttccttctaacagtcagtaccctcagctgcaggtctgttggagtttgccggaggtccactccagaccctgtttgcctgggtatcagcagcagaggctgcagaacagcggatattggtgaacagcaaatgttgctgcctgatcgttcctctggcagtgttgtctcagaggagtactcggccatgtgaggtgtcagtctgcccttactggggggtgactcccagttaggctactcgggggtcagggacccacttgaggaggcagtctgtctgttctcagatctcaaggtgcatgctgggagaaccactactctcttcaaagctgtcagacaggaacatttaagtctgcagaggtttctggtgccttttgtttggctatgccctgcccccagaggtggagtctacagaggcaggcaggcctccttgagctgtggtgggctccacccagtttgagcttcccagctgctttgtttacctactcaagccttggcaatggcgggagcccctcccccagccttgctgccaccttgcagtttgatctcagactgctgtgctagcaaagagtgaggctccatgggcgtagaaccctccaagccaggcgcgggatataatctcctggtgtgacgtttgctaagaccattggaaaagcgcagtattagggtgggagtgacctgattttccaggtgccatctgtcaccccttttcttggctgggaaagggaattccctgacctcttgtgcttcccgggtgaggcaatgcctcaccctgcttcagcgatgcctcaccctgcttcggctcatgctcggtgcactgcacccgctatccgacaatccccagtgagatgaacccagtacctcagttggaaatgcagaagtgatttgtcttctgtgttgctcatgctgggagctgtagactggagctgttcctattcggccatcttctaaccagcaactttaagtgtctgaattatatatcccaaagaagcagagctgcacagttgacagaaaagtcacaaaatctacccatcagagtcttagcatatatatatgtatatatttgtacttactatgatgtgagatgaaattaaaaatggtaaaaatgagaattaacgataaataaataaaaaaaagaagtttgttcctggggtttctcagctcgtagatttaaaatagcaaattcagtgtgggagggggctggactgaggggctgctccatacagctatctgctgacagtgccaagagagtacagctgagcactgtgcaactaggcaagaaaacccatcaagtgtgggggtcaggaacttaaaacacagtgcagagagagcagccacagagggtgtctgtagtataactgaggtccataattattcatttaatgactccaaggtgtcagtctcagtactaggggctgggtaaatggtatggagtaagacccagatggggcctttgcagtggttctgcagcggggtgtactgtagagaaacagtggtgagagaactgagtcttccctagcactcagcaggtgcaactccaaaatttccacacagcagccacaaccacgattacattgtggaagaagatttagttttactaaagtatcactaatcacattaatgctgtaattttgaattttattgttacaatataccactattacatatatggtgtttaatttgtaaatttatttgaacatgatagatgatataagagctataaggtatttgcccctaattttgtgttttttatgtatttaggtaacatcattataaaaagatttagtcaacacttgggggcatgggtgcccagaaatattattttctttaaaaggggaccctatattcttcacctcatgggattcttgtgaagatttaatgagaaaaattgttctatttagcaaaaacacctggcttatatgtaatcttcaaaaaacatcaattgtattgttatcacatttaaaaaatactaatcaaagtcaaattctttatttgccaaatgtgagctttgcctattactgcgaagggcataaacacagaagttcaggcagctcatgggatgagctgggtgatggggagcttttacctgcaacaaagcaatcattccatccattggcaatcgtagattcatatctgtctttttctgactgtcatttgggcttagactccacttcacctagagccattagacttgggaggtgttcacagaatccttctctatgaataaggagtgaccaggtttgtcattcacatttacctcatgccccaaattcattatggtattaattctttgggcaggtgagcacaagtcaattacagagcaaaatggtggcttcttagggccttccaggaaaaaccaccacatcaagagtgttcaaacaggacgtgttagtaaaatctttacaaatgttcatgaagttgtcaaaacataaaaggcgaatggcatatctgcaaactttttacttcttttcaagtgagataggctttcacttatattgacaagtgcttgtaataaatttgagacagtaattggaaaagttctcactttgtagttgtgtcactcagatttctcagaactctgtgaatgaatggaaactgcattacggttatcactactaacaaataaaagatgtttctcatagcttccccattgttgcctatgtataccaatagccctggagtcatggaaattatttttctctttttctcttacagggatttcaagtgcacagaaagggaaaaatcataatccttagtcatgatatacctttcattgctcatgctttcacattaggtggcaggttcatggtgcttactgcgttgtcatagatagaaagatagctaactagctaggtaggtaagtaggtaggcaggtagatagatagaaagacagacagacaggtaggtagataggtaggtaggtagatagatagatagatagatagatagaaagaaagacagacaggtaagtaggtaggtagatagatagatagatagatagatagatagatagatagatagagtgggctacacatggatgtttttcttgagaggtatacttttgatttgactcaatagccttcatgctatgactcttgtgtagctcgcatcttaatgaggtaagtttaaccctcttacatgtcccactttacataggagtaactggtctgtctcagatgacacagccagtggcatagctgggatggcagtactaagtttgttgactgcctaagaagaatagatcatgtatcgagactgccaacttcaaaggaaatccaaatgtttgccagaccatttaatgtttgccaagagcatgggcaaaggctcaggcgtccttgttttcccccaggccctagaacagtgctgaacatgaaagacgtcttgtaaaccttcacaaattaaatggaactgtatactaaataaatattcatggacctccaaagaacagtgtctggctgtgtgactgcacacaggtcacttatttcctctgaccctgcctctttatttatcaaatgggtaaggtacaaaagtgctttgcaaatacaaggacttattttccagtatccacaaagaattttagtcctgggggagaagtggatttatcacagccagctttctggttttaacctggcaatcaatctaaaattagtttcaattttaaaaagtttactttagtgacaattttttttattctgacctgggttggttttcagtttaatttggtggttattccagtatcatgtataaactgccattgatttctgataacacgtagcaattacttaatgctgcagacttgatttaccaggtaaggcaaatgtgttggagtgaggtgttggtgagatgcctgctagaggatagatttaaaagcatacatacaattttaatttccggtctggactctgccaagtttatttcccttccactgtcctcctagtgggcagttactttgcaccattcgccttttaccccttctctaccaattctattcagggtcccccacatgttcatgaatgacatttttaacagtctcccctacatgccattgccatctgtgggctcccttcaattcctaggatgtaggctctatgatttctcccctgagtcatcccaccgtccttccctaggtgtctccctactccagtccctcccaagtccccaccatccatcctcccagcaagagtcaacctctttatttacaaacacagcctgtcactcctccatccaataaccttgaagggctccccagtacccaaagaagagcctcttcaaaaattttaaaggaatacttaatgccctctgttactgggcctcaagctatgtttacaaccttaccactgccccattgtgtgtgcccattgaatggaatactcgctggtcaccagataccctctattcgtttacttttgctcctgctgttttctaagtgttaaagtgcacttactcctcacagagttagctaaaatgctaccttttcttcggaccctttcttaattgctctcacatggagtaggctctcccgcccatttgaatacctgttaagactctattcatgttttgctaaacttttttgccttatgctatagctgtgtgtatatgtatgtgtgtggtgtgtaccaaaagaaagtcttgggatggcagaggtggggtcttattcatctacgtctccacccagtggccagagcggtatccagtgcatacaggaaactcaaaacctatttattgaaataaaaggaagtaacactcagatcaagagaaccttcctctaaaggcaacaataaattatttggttctgcattcacaacctatagaaaaaaaaaaagtgatctgtgccttctaatttacatgatttttctcctaatacaccatgttctttcttctcacattatttaattcaatacttattggttgagtgccatgaactattttaggccctaaataattcatagtcctggccttcaaggaacttgctatctattctccagagtttattattatagttgaaaaatcacatctcagaaagagaagctatttgctccaggtcatgtagtcagaaaagttaagaataggatagtctaattttagagcccccccccccttttttttttaatcaaaatgcaaggtaattaggtatttttataaatattaagaacatattggaagctgttgctgaaactcttttcagatattacacgtgctattattttttaaaaaaacctttttacccacatataaacacaatgtatagttaagaggcaagatatactctttttacttgctaagagtctggcaataattaccatagtgagcaagtcagatgactggacattcacttctgcatctttatctttcagtgttgatgttttagctttgagatagttaaaaacttttgcaaagtgaaacctgcaagctcaacggtatgactgtaggcctattactacagagtcagatgaaaggaagtcctatagtgaatcagaatttattctttaataattcccaaagtagaaatgggttgagctaaattttctgaataatacttaccttgaattaatgatgaaaagaagatttaacaaaagctcagtgttatctgataaaactatacttgttatttatattacataaccacatattatacaactcctatttatattactttagtcttaccatcagtacttgaatggatagaattagctatgctactaacatctggaattagttcatatgtaaaaatcttctaaagaatcaattattttgatttgcttgcacaataacaatatgtaatgcagggcccagctctgccacttactagctgtaggagcttgggtaatttatctatcctttcttaacttcagttttctcatctgcaaaacgggcatatttataatatttacctcacagggttactgttaggagcaaatgagcaatggttataaaaataatatgtagaaaataacaaatctacagatgttcagaataactggtatcctaaatgagatgcaatggttctccaaagcagtaagcactgatcaagtgtgttcttctagaaattcctgtaggtagctacacaagatagcagagaactcagaaaccatctggatttgcagccaatggcaggggcagggggcggggtttagaatcagtcctgctgccaagctccatcttcctgcccattagagtcagccagtggtaacttctctccccaactaaacaagcacaaggtcaaaaacaccgtatgcaaatgcacacagggcagttttggcaactctcccttcttcctctgtgcaaaaggagatttggaatctaaagaaaagagtagtgttaggaagttgctcattctagccttataagggtgagagtttaagaggtatgtgcttgtgggtaggggtgggcaaaagatagactaatatttcttagtactttacatatattgtatcttttaatatgatttctattttcacatattaggcttagataagttatgataattgataggagttggttattctgtctgattccaaacttttccactgtgcctgtgtatctcaaattagtagcatgcctaacaaaatctctggggagcttgttaaaatgcagctttcctgcccccatctccagagattctgatcctgcaggacaggggttgagcctgctcacctccatttttaataagcacctcagctgattctgatgtagatgctgcaggatacactttttttttttcctgctgaaaattttctggtttcttctctccacagctactctatggtcctgggtcaggtcttttccatgtcttacctgaattactgaaatggatccctgccctctggggctgcctccctctggaaatttatttcacaccacagcaaaatgatctgctaaattctaatctaacctctgctgaattcctcccaaggctttccactgccctcaagatggaggaccttcatgacctggtttccaacttctctgcgttatctctggacacttgaagctttgtacttatgctttgcacttacgtaatattaagcttccttggcttccctgagcacaccgggctgtttcctgatttctgccaacaacactcttttcatctttttacacctgattagattttactgattcttcaaggctcattttgaacgatatctcttttagaaactgaaatatattgtaaacatgagtatgtgtgtgtgtgcactgtgaacagatttttcagttataaattataatacattttgtatataaggttgcagattaacttgacagtttcaatggcagtgctttgtggacccaagtggcagaaatgcctgtgcacaaaaatacataaggaatgtagtttattctccacgccattccacagaatagcagtttcgtcatcagcaacttgagacaaatagactatgaggaatacataaaataatatgaactttttcatcccaaaatgttccttgagttccatcggctttcagggtttacataggacacaccttaacatgtctcagacatggagacttgactggggtttcctctgagaaccattttcagaaaagccactagcacatcttgatcagacagttatctgtgtgctggctcaggtggttctcagtggacaagggaactcaaggtttggatagatgtgattatcacattcaaaagaaaacataacaagttataaagtgtctccacgttgggctattgaagctgcaaaattccctggacatatgcctatctttgttctttatacataaaaatataagaccagttaaaaccacactgcatgcagtatagggaaagaatccgagaggaaaggtgagccaggaagaccagtgaggaaggtgttagaaggcttggaataagaaaagtaataacaaagacatcaaagagtagcctcttctgagtttattcaccttgagggcaaagcctgccttcctgatgccccctggagtgcagcagtatggctctccttccacctctcctccatggatctgtagatcacctctggacatttgagatctttgcctggctctggccattccaagaccggctccattaaagagctttctttcgagggcagtaatgacatttcttttgtcaaaatgtcactttgaagctgtgacaaaatcaatccctataactcactctggtgaagcaaataaaattcccatcttgctaacgaaatactgactgtcacattgattttttgataagtgacacaatagtaggctctgctaccagctctttgtgtgtcctagagaaatgagtctcagtttcttcatttgtaaattaagtcaatggccatatggaaagttctaagaatctatgaaatagaaatgagatttctcaatgccagctgcagtttgattttgggagtttgctatcaacctatccctgtagcttctgccccatcccctctctcataatcaacatctgctcttaaagggagcgtaaggctttggaaaaggaaatagaatattactaggaacagtcgggacaaatgtccaaggatgatagtcctctctgatctctttagaaatggtttcctattttgctttcctattgccacttttgagttcaggttttcagaatcttacacccagaatactgtaatagctttctcaaacatttcctattgccagtctctctcctccaacctttccttcccacagctgccagactgatctctcagaaacccacttctgaacattccattccctttgctctatgtgttgagtagctagtatgtttaaggtagacatcgtgctaggtgctggggcatacagatgagtagattcagatctttgcctagaaggacctcataatgcagcctgtataggcagtgatataggtaccttcagggcattagcccagagaaaatcaacctggtctggttggtcacaacccttaaaattctttattgcttacaggataaagtataagtttcctggaaaattttaggcatcaaaactgacttgagtctaactttccagttctgattcttttcattctccttcacaaattgttccctgtaatgaaagtgaaccatgttttatttcatacttattctgtatcttactcctaaccccagtccctattttcctaatccttcaacgccccctaattcaagctggaatctccttttctgcactgaaaacgtgttttctgcccttctcctttggtattaatcacttcctccctgtagacactcattctgtcccccagaagacctgctccgtcaggaaagtgaccatgatttatttgtctttacacctccacattacttatcaagctgccttgtattggatctaataaaggtttattaaataaatgaatgaagtcattcagcaagacttgttccctcattttattttagcaggccacagtgagaaagtgtgtatatctgagctcactttagaatgttctccttcagaaagatgtgcatcatctaggaaaaccagcttctcctcaggatttaagtttatgcccaagttaggttttgacaaagctaaacccagttcaatttacttctttatttttcttaaattgcacaagtgttacatgatgtcaataaaaaagaaagcatgctatagtaagcagattgtgaactttggaatcagtcagacatgaatttttcttcacctctctaagcctcagtttctttaaatctataaagaggaaataaatgatttcctttgaagtcttgtggtgattaagagatgtatgtatgccgggcattgtgggattccagcactttgggaggccaaggcaggaggattccttgagcccaagagtttgagaccagcctgggcaacagagagagaccttgtctctacaattttttttttaaaagagaggtgtatgtaaactgtctgggtttttataatggctactcatattacttcaaataacaactatcatctctgttctgtcccagcccaaggataaataggatgatttatttgtttataccataccttactttagaaagggtttacaacataaaagagacacacattgcacgttgctgacatatagtaaggatactgatagctctctcatactctctcttacatatatttccctttcttaaattatagacttaaaaaagaagtttggcataaatcactaaatagtcattgatttttcagtgcagaacagcttgactctgaagattatgcaatttcctaaacctctcaataagtaacagaatggctggttaacggtgaaattgatttaaaaaaaggtagaaggacaataaaagaaattaaggggtgcttaagttttcaccagaggctggtttgactagagactcattagaaatttaatagacattcccaggggagcttgactgcattgctatctggggcactgagatgggtcttagggagacctatccaaatagatggctgtttgaagtttagggatctgcataggttggacttatctaggctactgacacaatagcccacttttctttgcatgtgtagacatagactttgtaaaggcacacagagtggatagaaatcctgggtatttcatttgtagcagatgagcactttcaaatgaagaacctcagatttcttcatgtatactttcaaaatccaataagcttctaacctgatagccaggccttccatacaagctttctggcctttctgaccttctttgtcaacctcatttgctacaattcccaccatgacctttgcacactggtgtccttgacttgcttaaccctattccaacatgtctgcaatttccactatcgtgttcatgctttttcctatgtatgtggcaaactcctactgaaaatttaagatctcattcaaatattgcctctttgaagccttctcttttacctaaggcatatttgtaatgctttacttcctctggcttcaacagaatcatgtatagtgtagagtaatggaaagggcaggcttctgttgtcaaaatgatctcaacctgatgcttgcacctactaactgtgtgatcttaggcaagctagttaatcctcctgaggctcaggctcctgatttttaaaataaagactgttcattccctaaattgatggaaaacattagtgatgctgtattatcattgtttgcctgcttatatttctctttttgagcctgcctggtgttttgcagcactcggtgttattgcaatcaatgaagagttctggaaaagtaactcaagcactgacagtcacattaaagtccaagttcatctataaagtgctctctggttattcctgcaacctttaatttaaattcttatagctcgtgtacatactactaataaggctcttgtcacagcctgctttcacagatactaatttaatctaagctcctccagggcagtaaccttggctttcactctgggctcctcaggacatttcacaatgctctgaaaatgccagctaatgataaggttatttaaaacaccctattatccttctcattccagacaattttcctcctcactttatgctgaatttatcccaaggtcccagagaatgaggcccctgcatcaatgacttattcctgtagtccttgcctttaattcaaagtgagtggcatctcctgacccagctttcccaactctccacatagttgttctctcctttcctcagtgcattttatctcttgctaatggttctttgctttctacttctggacaagtcttcttattgacgtattttctcataaagatttgaaaaactttgatttattaccaattaatgcatgagtaaatcttatggagagttactaacgtaaggcaccttaaaaaatcattgaatccagtaactgcaaatagagaataattcccaatgttgtgctagagatgactcaatcatggcactctttttttttttctgaaatcatttatggcctcagaatcctttttcaaaacaatactccagatataaactatcaatccattagtctacacaggagatgaaacttgtttgacatccctgatgtagtttaaaggttttattttggtaataaggcccaaagaacaacagtgacttagtagtgagctgaaaccagaacccaggttactgaccctcctgattttccattcagggcttcccttcccagatgattactcctttctttcaatagcgaagtcctataatttacaacctattcattggcaaatacctaatggtgtttaacatgtataattagaaagcacatcatatatatttcagccttactgaaaagacatctggcctctcactgatgttaggagctcttggggaaaagggcccatgttagactttgtgtccttctaaagttctagtcctgtttctggcacatggtaggtattcagtaaaaatcctctcacatatatccaactctatctgtctgtctgtctgtctatctatctatctatctatccatctatctcaaacaaataagaggtctatccttaaattctcaccaggaatcatggaaaaaaaacctacctcttgtatacaagtagtatttgtttgaaaggactttatgtcatgatgtcacataccctcacttctatgtagaatgacatcctatgtttcaataaattttcatttcatttgaatattttaggggagggtaaattattatgtcaatgactgggctcccttatgattctagaaatagaaagggcagtgctatgattcgggcctcaaaatccctgagaaattatagcttttttttttcttgtttttcatggtgacagcaattgaccataacttgtgattctgtatgatattcacaagctacaattgctaggatagaaagacgaaagaaaggatatgaagaaaaagagaacgggaagagagaagatgggaaagttattttacaacacagcaataagatacagtattatctcttcaaagaatagatttaaaaaatctatacaagccacagctaacatcacacttcatggcgaaagaccgaatgcatttctgttaatgtcaggaacaagacaaaaatgtctgctcttgccatttctaacattatactgaaggttctagctggtgcaattaagcaaggaaaaaaggcatccatatttgaaggaaagaagcaaaactctctctttttgcatgtatatcttgtatatagaaaactctgaggaattcactagaaaactgtggctttagcaaggttgcaggatataagattggtctataaataattatatttatgtacatttgcaatgaacaatccaaaaatgaaattaagaagacaattcatatgcaaaagaatgaaatcagaaccctaactcatacaacgtacaaatactaactcaacatggatcaaccacctaaatgtaagagctaaaattataaaactcttagaagaaaatatgatataaatcttcatgactttcattaggcaatggtttcttagatatgacaccaaaagcaaaaataacaaaagaaaaaatacacacattagacttcaccaaaattagaaccttttgtgtaccaaagaacactatcaagaaaatgaagacaacccacagagtgggacaaaatattgcaaagcatatatatctcataaaggtttaataacccaactatataaagaacttctgcaactcaacaataacaagacaacccaatttaaaaatgggcaaaggatctcaataaacatttctccaaataatatatacaaatggccaataagcacatgaaaatatgctcaatatcaacagtcattaaggaaatgaaaatcaaaaccagcatgagataccacttcgtaccaactaagatggctgtaatcagaaagacatataataacaaggatatggagaaattgggaccctcatgcattgttgtggaaatgtaaaatggtgcaaccactttggaaaacagcctgtcagttcctcaaaatgttaagcatagagttactatatgacccaacaatctcactcctaggcatacagccaatggaaataaaaatatatgtcacagaaaagtttgtacacaaatgctcacagcagcattatccataataactaaaaattggaaacaattgaaatgtccatcaactgataaatgaacagattaaatgtggcatatccatataatggaatattatttggcaataagaagaaatgaagtacttacacattctacaacacaaacacgtcttgaaaacaatgtaagtgaaaaaagcagccacaaaagaccacatggtgtataatttcatttatataaaataaccaggataggcaaatccatagggacaaaaagtagattagtggttgcctatgttggggtgggagggtggggaaatgggaggtgactgtcaatgcatatagggtttctttatggagtgatgaaatgctctaaaattgattgtggtgatggttgaataattctaaatatactaaaaaccactggattgtattttttaagtggttgagttacattgtatgcaaattttatcttataaagctattattttaaaaacatgtacacatgtatatgtgagtaaatattctaattttgatggctaaattttagtcattaattctcttctatgtctgtcacaacaatccgtgtattcattagataatccatgtttctatgactactgtcttagcttcataatgtgaaacagactagatatattttctgatgagcagatactttttataaaatccatcattttagaacattaatttaaaaggaaaaaacttaaagaaacaaaaaccacctaaactatcttgttcttcttcattgtagtcattacatcaccttcatcaacacactgcttctgctaaccacttgcagctttactcccagtgtttaaatatatttaccataaatccatttcatcagaaatcacattattaacttcagcaatatatttataacagtgctctactgtctggtaccttcataatttgtttgctactgaaagcctaaatgtgttaattatagttaaatccatggcaactgagagaacttgatgtttccatcattttgtacctacccctttcgaatcaatcactccaggtttggcattaaacttcactgtcttcaatcgggcacgttcctttctttccaccctaaagcaaattgagaataaagagtctctcacgtgacaaggcatttatgactaagttccatattaagtgaagaacattttttcctcctatccttgaagctcaaataaaatgtgttctaaaatatttctcttcctttgttccatataaaaaatcttggtacaaagtctctaagtttctaacatgtcccttgaaattactccgatacgtatactgagagtcacgtcatggtatttgtaagcaacagagaggtagaaaaaaataatatttgctatttaaatgcttaaataattaaatcaaaatctatttcaaatctcagttcataaagatgaacacctatattggagactaaacaagtttctcctcccctctcctcttctctcctccctttttcttctttgtttttccttctcttccccttaagaacactagtgtatttagcttcactttttaaccaaacatgttatatataatcttgagctttccttttccccaatgtccttctgtcatctctgcagattcattgttttcctgctacctcatttattcattaaacacttagtgactgcctaccatgtatcaagcaaggagctgggggacaaagaaaaaatattctaaaagcatgactgcaatgaattcttagcaagaatgaatttggcaagaacagtggtgtaaacaaacacagaaaatgctgtagaacaagatggctgatatcaatgtgggagcacctatctcactgggagggtgcaaaggaggagtagaaagcattaggatgggcttcttggaggaaatatcaatgtatctgagattgaaggattagaaagagtttgtcagtagggaaatttcagggggatttttcacagaaggaacaacacattcctcaacctgaagatatgagtgagctacaagattgcagaaagattctagtacagggtacataggggatatataggatagggcagtgaggctagcgaggtgacagactccttataatgggtattcatccacattaaggacttgagtttttttccttgggaatcatcataagctcttagaggatatgaagcagtgaagtgataaaatcagatcagcatttaaataaacaaccctggtcgaggtggaagatagactgaaggagggaaggagcagaaggaagctgggggcctatttagaagctgttgccatagtccaggtgagaaataatgagaaatgatagtggggtggagaagagggaaaggcttgagaaatattaggaaaataaaattgggtggactcccgcctgtttgaaggccagggttgaaaaagtggaaaataatctaaatatttccttgattcttctgagcccctccagtcagacatgattgctcctttgtaactggaacagtctccatgtcagcactacctcttgatttccttgtgtttacttacatttgcactgcatatacagggttgtatgtaccttaaggtaaaagcccacttatcacttgatggtgttttatagcaagtcctcaataaataattgtccagcaaaaataatattcattgcattgttttaacatgacttcttgtttaaatattgctagctttaaatttaaagatgtgggggaaaaaagagaaagaaaaaacccgaacctacagaaacttaatagtttatggagtctaagctattcatagatcaataattaacagcacactcctttctaactgagagctcttttgtgttcccaactgaaacacagtgaagatcagggtttctatagttacagaatggaattgcagaatatatttatttcagtgtgagagtagaatatctgagtggaaacagctgaacaaaatttttcaactctaacgtaatatattaaaacaatgtaaggccgggtgcggtggctcacgcctgtaatcccagcactttaggaggctgaggcaggtgtgtatcacctgaggtcaggagttcgagacccgcctggccaacagggtgaaaccctgtttctactaaaaatacaaaaacaaaaattaaccgggtgtgttggcggacacctgtaatcccagctacgcgggaggctgaggcaggagagtcacttgaacccgggaggtggaggttgcagtgagcctagatcatgctattgcactctagcctgggtgacacagcgagacttcgtctcccccaaaagtaaataaatataaataaataaataataagtaaaacaatgtgttccaccaagagtttctacttgcaccaggcatacaacagttggggagaaagcaagacagatttcagataagataagctgccaagtggaaaatgctcactgataaaatgcctcctttgagcttcatcacttcatcaccttttctcgattttaatccaagggcaaatgataatttatattgatctctttgtattcttctaaaactgttgttacagccctaactttatttcagcttctttgcattaactgggctatagtcaatgctttggcatcattcaatgatgccaaaatggctgtagtatgcagagaatacatggttatttgatcagggtatgcaaataaattctgcataaacccacagaactcacacaggttccaaacatacagaatgtcaggaggaactcagtattcaactctcagaactgtttggacagagcattctaatactgtcccctgccctgcaccccaaccccatttctatgtttatccttttcaattttcttgagaaatgtctctgttaggaagattttaatggttcatcccttaaatcttaaaatggttgcaaagaatattaagtcagccagacacacacacagacacacacacatacactcacctaccatttgctatagtttattattaatcttcaaatgggtaatagagaaagtaaaaaaaaaaaattgaagccatatggaggtcacatacttccagttcacccatgaaggaagttgaaaagctttgcttcctatttgggttgaaagtttcattaataataatataagtggctgctgaagttgcaacatataattattaataaagttccttcacatttacatcatctcatttggtccccacaacaacctaaggatttaggtattatcaatctcattttataactgaagaaactgagacttgaagcttgccagatcagaaactggtagaaacagagcctgaacatacattctctgacagctaacttcagtgtctgtccacagccactcagtttgggaaacagcattcaggtacctcccaagcctgcattatccaaattctcaacaaacgtgagatttttggagcagcttccacagtatgaaggcacatacatatccttagaagtctaggctgaggttttcacaaatgataaccaatgtacccttgcatccccatctccctaatgtcctgaatgctatgaatattattaattattaaataaaccacaaccaaatttaagcatacaatcgagttagtagcataccacaagaagttgacctcaaaattcagaataaatttactttaaacatggaaatctgcttagttaaatccctatttgagttgatccatctcctcagcacaccagcaaccctaatagtgcattcccatcacagaggcttgcagtactgcttcttggggttctctgcaaacctctttccttgagagggaggctatgtctgtggcttagcttcctcatctgcctcagccctttcctctctcctagctctttctgggatgcatgtgaatgatttactgttgaaatgagagttaagtctggaaaataggggtctaaataacgtggtgtttttttttttttttctggcaactaaagctcaaattttgaaaaatggaaaacagctattattggaatgtacactaagttttagaaactgtgctaagcacttcacctataatagctataatccaggggttgacatgagctgggtacatagtagatgcttaatgagactttgttgaatgagtaaataaataaactctcaagggggctactagttctttacctaattgtgaaaacaatcaggtcagggagtttaagtgaattgctgaacaaccagtttttcccataaaaagtgatttgccatttcacaacttactttcccggtaagaatctaggtaaaagtctagcatcactttttcttattgttttactgagtaagacttctttggctagtaaatattaaggtccaaaggctttcacctaaagaaattgtggaccacctgaagagacagaccaaatctcaatgacaacaactgccttccttccccactcacacttagactcaagcaattaattagattgtttgagcagaaataatcctccctgtccaagtctcatcactgaccaaaataccaaaaacataaatggaatggcaaaatttgagcaatcaattctgacatttcacatctctagagagcaccaaatggccatgctttaataagcccaactgtcttcctctccctctctcccatctggtatttttaggttctggccaaacccataattgggtcaggcttggagcattggacagtgggaacatcatttgtccttcggagttcctatccctatgctccacaggtcctgttggagggagaattagaatgtcacccacattagtggccacaggcttgctgtgacagctaggtgagtaaactcttatataatgccagccatatgctgccatctgagagcccaagtgaccagtcactagggaacaatgaataatctctttggcttaagagagcatgggacagccaggcgcggtggcttatgcctgtaatcccagcattttgggaggccgaggcgggcagatcaccagagatcaagagtttgagaccagcctggccaatgtggtgaaatctcgtctctcctaaaaatacaaaaattagccaggcatggtggtgggcatctgtaatcccagctactcaggaggctgaggcaggaggatagcttgaacccgggaggtggaggttgcagtgagttgggattgtactccggcctaggcaacgaaagtgagactctgtctcaaaaaaaaaaaaaaaaaaaaaaaaaaaagagagagagagataccatggaacaaaacccagcttggcctcttatacactacataatctcagaaaagtgattctatgctaagagtccagattttaaagtcacacaagcctgggtttgaattctgcctcttccacttactaggtctataatttagggtggtcctcaacctcttaggatttcagattttgtgttgatacaattagaatagtagcgcagacttcaaaaatttataatgaatgttaaatgagataatacaagaaaattgtttagcacaatgtctgatctatagtaataactcactatacaaaaggctgctacaaagatgattatgataacgctgcccataatgtcacttctcattactggtcccagtttccttacttgtaaaaaggaagtaatacaggtaccctacttcaggtgctcactgccaagtcagtccctttatgctaggtgggagcaagacatggacttccatttttctctcttaaaagaccctgccaccagacttgagagctgtagggccaagaagagccccaaacctttgcagttgctcatagagacatcagaaaggcatgtgtttgaatctaggcttagccctctgctgccactgtaattttggcaagctacttgaattatctgactttctatttccttccttggcatatgctcctagggtagtttgttcctggtgtagtgtaaagccacctggctttgctatcaaagagactggtgtttggtcagtggctggctgtgtatttttgggtaagttactcgacttctctgatcctcagtttccttatgaggtttttgtgtagattaaattgaaatgatgtatttgaaagcacctggtgcaatacatgatcagtgctgttatcagatggaattcactctctgtctgctgccgtttcactttcctggcctttacaatatagcctgcattgccctaatcgcagagtagctgtgccacagttacatgttggtcccacaagtgatgggctccaggtagtgaaccaacaatagtacgtggcactcagatgctgcccaagcaatgcttgctgaattgaattttgctagctcttatttttgtatctgtagggggcaagatttcatatgtcttaagtgcaattctgtagcctggattcaaattccagttctgccacttactacacgggcaatttcaggcacattaatgaacctctctgtgcctcaatctcctcatttgtaaaataaggataataacagcaacttactcatagggttctaatgaggtttaaataaattaataattgtaaagggcttacaacagtgtctagcgtgcaacaggaatgttttgttcaataaaatttattcaccatcttcagaaaaaaggagggggaaggtgataatattcatactcttcatctcatggtttcatttgggatgattaaatgacattatcaatagagaaacatttttgaaaaggatataaagtcatacactgatgttatccattataagatttaaaaaattttccagatcagcactactaggtaaattatactcaagaaacaggctagaaagaaattaatgattgaaaaataacatcaacctaataaatgtacgtttttaaattacattaaaataagtacatgggtactctttgtggggtagaattgtaagtgatttttatgtttttctaaatgttcccacctttctacaataaaaggtattacttttacaaatacttaaaggaataaaagtaactattttgaaaataattaaaatcctaaaaagaaaatttggcagaaatgtatttacagctatacattatatgtatataatatatattatatatatgaggtggagctactgcacccttcataaaaagtagaatgtaaataaatatcaaccttgcagtcactaatcaaacttattttccaggtcagctatactctggttgttaagatggttctcttccaaaataagagagaaatagctaattcaagaatgattaccagcaggtggaaaattattcaggaggaatagcattgagaatgttcttctggagaaaaatgatgagctaattgaacaaacaaatgacttgataagattggttagaatcatagaacctcagggttggaaagagtcagaaaactgtatagttcaacccctgtatccaaaatttgaatcccttttctatcttcccagatagtccatgccatctttaggcagctccaactagtgagaggatttctttaaaatgacctgacatctatttccgcatagctttccttcctccaccccattactatctttggggccataattcaacaagatggctctttcttctagagaacagctcttcagacagctcaaaataattaaatcaaagcaaaccaaaatgcacgttgtcttgacattttatttgaagtaaatggaaatggagagacccggaatataaacaagccagtgctgagtcaatgctttaaacatgtaacctttcagaaaacacacacagccattctacagtcagaatgccctggaaaagcaatgttaggcaattatccaggagccaagaggcttaaagaaacccagagaactctgctggtgggagatctataggcactggcatgggggagggagaggctccctggaatttcggcaccttcactgtgactcctcctggctaaaggtaagagaacagctgaggaccagtgagccctctgctttccatgtcccattctttcccaggctgtgcgaccacaggcagagagaagagaggatcagttgtctcgggagcacaaataccccacagagttattctgaggtttaagttccatctccccattatggtttgtactagctcaatcacttgatgtgtagtagcacttgaatgcccagcttcactgggaatattttacaaaggcattttgggtgtttggagatgaggatcaaagccctttgagaaatctgcagcttgagaaaagctagtgcctgcttttattaagcataattcctgactgattttgtactatatctagtctctgggatacagccaatttctgtttcttggacatcttggtgccaaagggacatttgtgagaaggaaagttcctgtctggtgatggatctgctgggacagattaaggagttggctgttctgaagcacatttctgcttttcaaaagcagagctgaagaaatgcttggaagagaaagcatgatactcttgatttaggaaacacttacacagaactaaatatcttggtggctattggaagttgtgaggtggggaacaagagtaaagaaaacagtaaaaaaagaaaaaaaattgtaaacccagtccttagacctcaccagatgtttgacagctcacatcccaagcacctgaatttgagatgaaggttttccatttttttctactaatatttggagatatcacacagccaggaccttagcctagtaaattgcctacttcatttgccttcgacttggcctttctataacattcattggtaaatgttgaaactctggaaataaatggactgaatttgtaagtcggcatatgagctgataagcacaagtttgcacatgcacacactggtaaaagttttaggaacacagtgtaagctgatcctctttcttcctttatttcttgtcacagtcaccaattttggtaaaaccctaatataggaaaaagaggatttttaattcatgtcacctgtcaccactgacaattttcctgcagattgactatcccatttaaataaatttaattttgtgaacagtttctcccaccttcttcttccctcatctccactcgctggatagctgacaagcaaatattctagtacaaaaggcattcttacctccttttgctggggatgacccccatctcctcactgtctccctccagcatgactctcctggcttgccaccactcatcatcagaggcattgataacgtggagaatatctccatatttaaaactaagtccttgacttggcagcccactgtccttgctcttgtcgtagtcgaacatggctctggaggaaaggacaaaagaggacattgttaggaatctctggcagcacagatttaggatttatggtttcaaatgtttgctcttgctctgagaacctatcatcacttgatatcaactcccggaatgattccctggatcacagtccacactctcactgctttggcaacacactaaagttagttcttgcttcttcttggaggttacaggggtggcctatagattcccccaaactgagatctgcttcttttcttggagaccatcagatgttagaaggtgataatagaagataagaaaggtactttactacctagttgagatttttttcccctcccattacaatcaaatttttaaaattactaaaaaaagtaaaataataaagagaaacatggctatatttctaaatgaagcattttgtactgtaaacaaatcatctcagatgtatcagcctgtagaactgtttcttttataatgggaaaaaatggtaacaaatgtccacccatagtaggcggtgattcctccactcaatgaaatattggaccaccactgcaactggatgaagaggttaatgtaatcacctgaatacatgcttaaaatgcagtaaattaaaaaatctatgcgtatgtgtgtgtatggatagacaaaaatcatataaacaacacgacaaatatttgtgcttccatacgatgcctagcttacctcatcatggcacttatctgtgaattacaattgctttctgtatcatgctgcccccactaaaaagcatttgctaagcatttgttaaggccaatgcactgtaatatgtatgagtggcagcatgagggaggtggaatcagaatcaaaatgatgaaccagaccttagaaactagctgtcatcattaagaggtgaacatttgccaccactcctatattgtccacatcctgctgtatatcccattttcaaaaatcaccaccccacacatacagcatatgactttcccagagaagcagatttcactacctgtctatctattcccctttgatttcattctaagaatttccttagagtataaccactatgtatgcaaaactagcaagatctggggaacagatttttctaaaaaatttgttttattttagatttttccacactgaggaccaagtgtggtttcttcttcttttttttgcccatcaaagaaatgtcacatctgctgccatggcaacaagaaagagctgaagacagcatctagagctctcaaacacagcaggaaaagtataattaattgcaacgtagtcccttctttcattaacactgtctcccagagatggaatttggagagggtttcttggtccaagctcccggaatgaatcattttcaccttgaccacccctgccaaaggctcagacaaagtaccagtcaggaacagggagctggggaaaggccaatgcccactcctgaagctatcacttctttgatcctgtgatgtgacatatattagttaacattcttgagccacaggttttttgatgcaaaattagtctagtaacaacattcacctagatttactgtgatccttaatgaaataacacatatgcagcattaagcctatagtatgtgcagtctagtgtattacagtgtggttatgaatatggactactgggtccatgtcctgctcctactatgtcttagtcttacagctagtcagctgggcaagttacttagtctctttcaggcttcagtttcctcatatacaacatagtgataatgatgacaatgatgatagcaatacctccattatggagttgctgtatgggtaaaatgttacataaggtaatatatataaagcatgtacaaatggacctggcacacagtgacaaatagtaagtatgaactaatgttattattattatctccctttttccttttgggtagaggctaatacaaatcttttctatagattctactctgtgcaaaaaggagttaatgtagcaggcctgagactgctgttcttgcttgtaagggtggcccttggctgacatctggaaagttagattttgggagggttcccaccattttctcataagaatggcttactgtgcctaaactgtttgtacaaacaatatcatttatactgaacacctgctttctttctgggagtctgatattctggtatgtgctaggcagaggctgcctacatgaccagcccccagtaaacctggacattgagtctctaataagattccctggtagataacatttcgcacctgttgtcgcaatttgttgctggaagaattaggcacttcctgtgtgacactactgagagaggactctcggaaacttgcagctaattttttccagactttgtcctatggtcctgctcccttatctgacagtttcatatctttttgtggtaataaatcataatcatgagcatgatcatgctgagtcctgtgaactatcctagtgagtcatcaacctgggagttgtcttggggaaccccaacacactctctatagattgcaaagcattttcacaaaagttaccttattgtgactcaatcagttgctgtgaagaaggtatgacagacatagtactatcctccccacttttttttgttgttgttaaaagatgagggacagatctagtggggcccactgactaactccagaatatatagcttagtggcagcaacctaggaccagaacttgggtctccagatccaagtctagttcagtgctcttcaccttgccccctcattcatcctgggaggtggtgatgataaggtgttgaagatgataaccatgatggctactactacttacgcccttattaggtggtctggcacttcatagtcatcgtcttatttgatgtcacagcaaccctaaaggtaaaaattagtatccccactttatagatgagggaaggaggctcaggaagttaaggagcctggcccaggtcacacatacacatgtggtggaggttgaatataaaatgaggtgtatctgactccaaaatctgcttccttagccattttattatgtggctcaatttccccacttgttgccctctggccatgctcacgatctagcagtgccaaagacttttaaccttcccttcagggctgacaactgcttcttccctaaattcctgaaactcccttactgctcagtccttgtccaagtatttcttatccccaaagtccttgaactgctggcctgactccaggctccttctggatgtaaactatggggagttgaggtagagaaaccatcagaaaggctaacaagtagtagccaaggaggcaggctctggagccagactgcctaggtttgcagttttttaactatgtgatcttaggcaagttacttaacccctctgggcctcagattttcttaactgtaaaactggcataaatcataacaccatctatctcaaaagagttatggtgaggattaaatgaaataatatatgtaaagtattgtaacactagcctggcactagtgagggctcaataaatgtaagatattattataataactgttattctgaaaaatatattagaatttgaatcaggggatctgtgtgccaattgtgccacttaaaagctgttttctggactatgtgaaagacatctaaaatatctctgtatcctcaggacctggtagtgtgccggacccaaagtagaccctcaatacaggtctgtgaaaatgtttcaggtgacttttgaaagcccgtcttctttcatgtctctgcattcccatttgaagtgggggtgggactattcctggaggtccctaccaggtcagacattcactcgcctgtgttcttctattcccaagagtccttaaggggaactttcccactcctgctgttagctgcaggtgtccttcctgaggagctcagcaacaggttctttccacgagctctattgatcttggacaatctgcccctctaggattacatttattcagacttgtcaggtccctaaaaccaagcagctgacacatttcagcagcttctggctcctttggatattaatggatcctcacatctgggaaaaatgctacagtgccccatcacctaatttaacaagcgataagctgtttttaatttgctttatgtgttaattcatcacagcaacttttataaaatgccattaagactcacactttccatccagggtgcttttagcaaggccattagacaaatagaattggacatgaataatgtaacaactctcccatccctcctacccctcctgaatttcaatgtgtggtggccccttgccaactggggaagtctagtaagggaagagtgaagcagctgctcatcctcatgactatgcaacatggctgtgagatacctgggtaccctaacaaaatagtgctttttaggtgtcgcacaatgtagtaagcattttatattcattgtctcactcaatttattgggtaggcaacatagcatatgggttatatgccaggcttccaagacagaggagagctgggtttatgtcccagttctgccattcttaactgtataatttgggcatgttacttaacctcttagataaccactttaccatagatggccattctcttatttaggaaattcagatagtaatggcactaacgcaaaagggtgctgcggagatacgacaatgggatgacacatgtaaagtacccaacacaggtgagttcctctttgttattatttctgacaacaattctgccatgtaagcatttttggtctcataaagaaaatgagatataaagagctgaaatgaaaataagatactaagtagcagaaccaggattaaagtataggtagatgtgtctcactcaaaagctcatgttcctaatcttagaattcttggaattcctgataagaaatgttgtacttagatcttatacctaaggatttcatgatttgatgataacacttatagtgatactatggactagcctgcaaaaaagatgcatgagtagtttttagaggacacattcaattctcacagctatcctgcagtgcatatattagccttgtattatagaagaggaaatacagatttggataatttaaacaacatgttcaatgtcatgccatctatcaagtgatggggcaggactcaaagcctgtctgcttctaagacctatgaatttcctacgataccaacctctatgctcttttgcaagcaactctttccagctcaaaacactcacactctccacttggcttagactgaggtaatatttaacaatcatggaccttaaaagtattggtgtttactatgtagaccagggaatttagttttggctataccactttaaagctaggatagcagcgaatgatgaggatggaaagacagtatcactaagaataggaaaaattatttgatgtgtttcatagttaacaaggatatgataggagaaataatatccttaactcactcccccaaaatgtccacactttaattctcagagtctatgaatatgttatcttatatagcaaaagggacttggagatgtgattaaggttaaggatcttgagaaggggagattatcctggattatccgggtggacacaatctaattacatgaatccttagaagtggaagaggaagacaaaagaatggatcagagagatatgacttgggaaggacttgacccaccactgctggcttcaaagttagaggaagaggaccacaagccaaggaaaatggtggccttttacaaactgggaatggttattaggttacagccatcaagaaaacaggcaccttagtcctacaaccatatgatgacctgaatgagcagaaaacaattctcctattgagcctctagaagggttacagactgctgaaagctttattttagtctggtgagatctgtaccagacctacagaactataagataataaatttgtgttgttttaagtcattagttctgtgataatttgttatggtagcaatagaaaactaatatcaactttggtactggaagtgaggtgctatgtaacaaatacctaaaagtgtagaaatggcttttgaattgggaagtggacagaggctagaagaatgttgaggaacatgatagaagaaaacctagattgcttctaagaagagattgcagaaatacagactttaaggatatttccagtgaagctttaaatacttcttatggaaatctggacttggagaatgctgagggtgacagctcaaatggaaatgagaagcatgtcattggaaactgtaggaaagggatcctggttacacagtggtggaaagcttagtagaattacgccctgtagttatgtgaaaagaagaatctttgggggccagagggcagactgtggtaggaagaataatggttctccaaagatgttcacgcctgaatctctagagccttatgtggcaaaggaaacttgtggatgtgattaaggtcaagggtcttgagatggggagactatcctagattatgtgggtgggcccagtctaatcacatgagtccttaaaactagaagagaaaggcagaatagagatggaacatgaaaaggacttgagtgccattgctaagatttgaaaatggaggaagcaaatttgtcacggcagtaatgtaaagctaaaacagaggacaagaaacaacatgctttaatagagggcaggtagaagacaagggccaccagtttgaggattctgtcaaagattctttggaataaaacaactactcagcaacaacaacaacaacaacccactgagtgcctgttattggccaggttgtgtgcaaagtacatttatgtaattccatctcattgaatccctgtaaacagtttgagatataggtatgattatttctattttgtagataaagaagttaagaactaaggttttaattctaattctcacaaaaaccttatgtgataaatataattttccgtattttaagataaagaagctgagatacagaagaagcagcctttccttctctaaaattgcaaatcactctgctcttttacctctctgggaagcctacagcttctagtcttgagtgggaatatgtcttatctcctttactacatcagaaacaacatcaggagctcccagaccaagtctcagcacagagttttcacagatggatttataaatgaacaagtgaatcagcaaattactcccttctgtgctgtgaacttgtttggtctagggaggcctttgctttcctgacaacattaagatgcaaggaacagagtgctttgactcaatttccttcatttcttgaagttgaggcctctgcttgattagaggagacctggtcctcacctttctatgcagcaagagaaagaacactagcaacggaaaataaagtctgctctctgctccatcccactgtgcctggcttggacacatatgacccattttcacattgtcaaggtaagcacatatgaatagtgcaagaagcatagatgttggaatgaagaaacacacggttaagtcagtccactctttctagctgattgtcactgagaaaataagtggagtaatctgagcttcagttttatctataaaatgaggtttgtcattcctacatctcacatatttgcagagattcaatgagatgataaaggaagagcatttcacataataactggcaaaacaaaagttcctttacttcacctcttctctactctaaagatgagcaagtgtcccacaagtactggaagggagatgaaataaggatggtgtttttacaaatgtgacataaaaatgcatatgtagtaaacttcttcaaaacattttctcactagaggggtatgggaaaggatgctgggagcagagagatctaaactttagttgctcttattttataaaaatcacaattttctatttgtattatcttcttaaaaacaatcattcgtccactcgtgcatttagtgcatatttgtcttgaaaacagaggaggcaccctggaagtaaaaagaagcttagatggagttaggagtgcagatttctagtcctggcttcaacataattcactatgtgatcttgagtaaggtacttaacctctatgggcttcagcttctataataattaatagaccaactgcatttctctaggatgtattcaactgtgacccaaaagatagctcccaaaatgtaggcattattctcattttatcgaagggaagatttattatgttctgtggattgtatgacatgggttataccacttaatcaaccttataaagcagattggtattatttaaagatactcttcgtattacaacagactgcttctatgttttgagggtgttggcaaatgtccatttctattgttcctaaaaaatcaggcaatcactgtcatgactgcagatagaactaattggacaccaaccagaagcccttacaggttgggcctccctgcagctatagcttttagagtataatcagggaagaagcataacttccagggggaacaactttctctttctctctcttaagtcctcagtgctcccaattcaccaagagatgtggtatgagcagatttcacatgtccgggggcttgcatgttgatcattttggacaagtcatcagagtctccagggacggggcccatttgagcccaccttctctttcaggctgtcctggcagtctgtcagattggctgagctccaatgttgactcataagtctcttatctgagggaaacagaggcaaatctgaacctgcgcagagccagaactcactggaccacagtgaatggcatttcaggtttcagggctgggtgaagctgcaaagattaatcatcttaaaatcattttcctttcccccaaatgccatcagcttgctactcaaaaattaaatgtgggtaagaggaagactgcttggatgaacagcccaggttttatgacactttcaagagctcttatgttctgggtctgtgtataaggcaattgagatatgttaactgagatatttcagagaagctgacacagccctgattacagtcttttatttctgaattgggctaaaaatgtagatcaagctttgatattcacctttcagtattttactgccattaattagtaagcttggggtgggaaaaagaagaaataacctggcatggaattttattattgctaatagtcgattatcattcaaacatttaagtttatatatgcatgactcgtgaagatcatgagatggtaaactcagatagtcctggattcaaatattagctcactattttaagctgcagtatgattttcagcaaattacttcatatctttgtacctgggcttctgtatatgaaaaatgaggggcaagaatccctgtccgacagggtccttataagaattacacatgagagcttttagaatccagtaggtactcaatatttgttaattgagtctaaaaaaatctaaattttttcccctgtaaattctataccctggttctactgttactcactggaatataaacaacttaagcctacctctgctatccagtagcactcttttaagtgtttatggactgacaaatgataaagctagtacggtccctagctcagcagaggtgctggataaaactcgttttactcatgagtatatgaaaaacgggagaaagacattcaagagcatctgaaatgactcctccaaatccttagtaccatcatagcagctcatcagggtaagtaatgacatttacacaccacaatatcagacagttgggcaatcactttgcctgccccaatactgagtttgttactttgcctatgatttttcagaaaactggatggaaactacaggctgtactgtagcaggagaagacctgaaattagggaacttacccttctaaatctcatatgcccgtaaagtttcccattatcacctgttgactagagatagagaggacatatggttccttactcacccaggcaaaagcattgagttcagaatgtaatcaaattcccacagatggaaatgagataatattcatttaaatattaaatgtgatattattttcatagtctctactatgtgccaggcactctatagtttgttgggactcagcaaaggctttcttcctacagttgtacagcttgatgtttggttgggaatatgggtaagaaggtacattcatttggccacttactcattttcattcagcaaatacttttgagcatttactgtatgtcagtgatggttctaggagcttgggatctatcagtgaataaaaacagataaaaattcctgccttcatggattttacattctagtaaaacgagattggcaaaaaacaataaacataataaataggcaaatagtatgataggttaggagttgattgttgctatggaaaaagttaaaaatagagcacggtaagggggatcaggattctggaatagagtagggctatggtgacagtgaaggctgcattttcaaatggggtgttttttaaggtaggactcgctgaaaaagagatgtttgaggcaaggcttgaaggaggtgagggagttagatatacaggcatctgaggaaagagtgatctcagagggaacaacaagtgcaaagcctgtaaatacagttacagttgagtctcatatgtgctatgttaggaattagtatagggtgctgctctgggattgtagagctcctaggaagcctcatcaggtgctcataaagaagttggtgaatggggagatgattcatccagatttactagcagaggggtggtagcacatctgcccacccctacctactaagcagcctgatctttaggcattttcttagtggaagccgcctctgtaatatagtaatctcatattcttgagggctcagcttccttccttcagcctctcccccttcctaagtctcattggaaacatgcacatgagctggaccactgaacagcttttcttcttgtagacacacatgaccacaatttataaagtgcaaatcaaattctttggccaagaattttttctaacattgttatgaaagtagaagtattgatcaatataaaaaattctgcaactttcattttttgaaaaccatgactttctctgggaatccttcctgaatctatcaagagaaggctatttcttccactctctgtgccacattgtaaccttgtatgtggtcttattcttatgcttagcaggctacatttcagttgatttatctgtaggtgtatctttccttctagacttcttgactcatgagagttaggtgaagtcttacttatctctgtgccccttgcaaagaggaaaaggtgctcacaaaaccaggctaaactgaactgaactaaattcagaacacaaactgtctgaacttcagaaaattgcctcatcttgtttggtctcttgaagtttccccatctgtaaaatgggattaaaatattgtatgacatcaactctaagattttttaaaatttttatgtctaaaatcaagatgtttttccactatcaatgccatctcataattgaattggcagaatttttccttttttggtaacacatagggtacatcttaaaatcaaggacaacctagattcaataaaacatggtagaaactatctcacaagttgttgtgaagattaatgaattatagatgaaaagccctcagatcagtacctggcacaaagtaagaagtaagcaccgtgtgtgtgtgtgtgtgtgtgtgtgtgtgtgtgtgtgtgtgtgtgtttgctgctgctgctgttgtgctattacatattgtaagtcacttggaatcacctcatcattctcttctcttcttgtacacatttttgcaaacacttttagtactctttcctcagtgactgttcaaaaattgctgatagctgaaacactgtgctgcagtctgactttcacccagtaaggttctgttcagtagctctatttaactgaataaaatgtctgtagaaaatgtccctagcatttgccaatagttcagaaatttagaggaaaaaacctaaagagatccagtacattatgtttatacttttagtatttatagtttatgtgaatattattagtattttattccaatagcacaatcttttctttttttttcttttttttttttttgtgggatagtctcgctcagtcacccaagctagagtgcagtggcgcaatcatagctcactacaaacttgaactctggggctcaagggatctttgccttagcttcctgagtagctgagtagtaaccatgtcgggctaatgttttcatgttttgtagaggctaggtcttgctttgttggcccaggttggtcttgaggccctgggttcaagcaatcctcctgccttggtctcccaaagtgctgggattacaggaatgaaccaccatgccaggcctatagtctttaaactttagcacttaggttttcaagctgggacatttttccatgcacctagtgtaagtcatccatacatccactcattaatttactgaacattgacaacatgtttggcaacaggataatggaaaatgtttgtaagacttgggaacacttgttttgctgtttacttgctctgtggctatagataaggttcttaaattctgtttcctactctgtaaattaaagactaatcctgcctgaatagatattgtttgaattcattgaggtaacatatgtaaaactcctatatcagggaggctggtatacagatacatgaaaaaattgcaataataatatgtatcagcacagaaacctatgtttcaactcaacttttaagggatgcaataatgatttagtacaaatttgcatttattttaatattgatctatctaacaatatttacctcgtccttcctcagtgccagatctgggactagtggttctattggcaataaatactatgggagcttggagcagaagatgttccattgggctggactgactgggcaatgggccttgctctactccacagtactatctttccagttggtaaagcaatcagaggctgtaggactgctctgaaaatagtcaatacagtgtaacttttagatgcctgaaaccatgcaatcatggcttcagtcatattcaataaatgctcattatgtgccatgcattatgttaggtatttggggatacagtgtgaataacagaaacaaggcacttttggaatttagagacaaaacagatgtagaagaaataattaccagtacaacacatcataaaaagcagatgggcaagtaatccatgagagtatacagtggagagaaatggaaactattctggagggaccaggttgggaaggcttccaagaggagctgctgtctaatctgagcacagcaggagcagcagggtgggcagagggagctgcacaggcagaggctctgcagtgggaaacagcaggcagcaaacctgaaagaagatcaatgtctgggatagtctaagatgagaccagagggaaggagaggccaggtcatggagaatcctgtagatcttatgaaggatactttctctttttagagtaatgggaagcctttggggattttaaacagatgtgagatgatcagatttacatcgaaaacagatctttctggctttagggtggagaatggattggagaaccatagattgggcaagacaggatgttgagatcccaggtagtggggaaaggtagtaatccaaatgatgatggtttgggtacagtggtggcaataggatggacagaggtctcagatatttactttggccaatacctatctgtttgtcagtctgtctgtttctctcaccaaaatctatgggcaatgttttcaaaattttattaccagaatatatcatttttttttcttcaaaaggaaacttctagaaatataaaaataaaacatttgattgcagacaggggaaacagaatttctggtttctcttccactccaactgcagagcatacctcaggtccctaagaagaattttgggtctacttaaatcagagcttgaaaatcttcaatctagtacttagttcccaaacactgtaaatgaagaaaatcttctcttcttttattgatatcatgacatctctaaacctgtttccaatctcacagccatttccaatctcacagacatctatttgtttccaaaatgaaagcttgatggcaattctccttggagcatttttagcaaatataacaagtctccttgagattactagagtaacaccagggtgtcccgaactctaattacaggaactctgcaggatgaaactgtgattagtcctcacaggagtaaccacagccactcaacagaattcagtagctatttatggcacgtgttttgaggagaagacttctttctgctcagaggctgtttatattaataagcagaaggtggttccttggaagaagagaaatctcgttcgaagtttgacacattcatagaaaacaagagaaagttcccaggaggaagtcaatagcacatccagcgaaacatgcgtatggactgagggcaatttgacaggcagggaaacgtttctactgagaagaaaaaaagaaagagagatttctatttgatatatacatattttcagttttgtcctttttctttcttttttttttttgagatggggtttcactctgtcacccaggctggagtgcagtggcgcgatcgtgactcactgcaacctccacctcccgggttcaagtgatcctcccatctcagcctcctgtgtagctgggaccacaggcgtgcgccaaactgccagctaatttttgtcttttttgtagagatgcagttttgccatgttgcccaggctagtctagaacttttagactcaagtgatgctcctgtctcagcctcccaaagtgctgggattacaggcatgagccactgcacccagcccgataccattttttgcatgttagcaaaagctgggctttgataaggaagtaattgggaaacctgaagttggccagtcagctctgatagaagtgtataaattgggcagaaaagcatgagaaactcagccacattaattattgctacaaaagtcagcatccagtggaaggcaagctgggatgatgcggggaagatgactagacaaggaaccagaggtaaaaggcattcaggctgtctaactgacccctggccagtggtacttcaaaccagcaagatccagaactctaattatcagcccataatatgaagccatgactgtgtttttccatcccacaatctcaacaaccatgattacaattgtctggggaccaccttgaaactggcctatgtccctttatttgttctctgttttctcttcttacctgggtcccagtatttcttaggtgtttcttaagaactccaaatagtgtgttcagtgctgaaggcaaaagatgaacaagatggtatctctgccttcacacaatttatgagactaataggcaaaaaagtactgtaagcaaattctttctatttggtttgtttgttaaatgcaacaataaaagcatgtacaatctgtagagaaaaacaaggacagtctactctgaatgatgaggtgatgagatgacaggttcctgttctgcaagaccccaggctgcttttgatggtactaagagttaaccacagagcgaagggaaaatgttctgtaacctaagtttggagtgataactttaaagttgagatctcatctgtctttaggaatttctcgttacctccaattttagcagggatatttgacacaaactgcaaagaattattaatcctctaggctctgcatcatggcaatacacttggccagtgtgcttcctgtcttgaatcaaaggttagaaatcatagataaatgaaacctgcaaacaggcttatgttgcttgtaggtgtttcatctttgagttttaggcataaccgcaattggcagtgaaataattaagtaaaatgaatacttgattcctatcaaatctgccaaaaagaaagcaggtattgagttttgaagaaatgccctacagattggtaatctggggtggtggggaggaggatttcctgttttacagatgggtgagcgctctaagggaactaacttgttgtgaagttaatcaaggcagactgtttgtcaaggaagaggctcattgcctaggacagatttagatcaattctggcaggaaggaatatccacaaggggcctttttcaattttatttaatcagttagagaagatggagttaccaactccaagcaggaggacaatatggaatctataaaataggcagagaaatatgtattcaagtgaagtaatttgtttgataatccacagacatgtgggtttctgtaatttcttgataaagtcatatagttcataatttctccaaactggctctagttgtagtcccttacttagtccaaaacctcccactgggattttatgtttctttgctgttctgtctctttcattcctctcaacttttgctttcagaatctcatacatttaatacatcttcttattggctttaaataattccttagtgttgttttgataaaactgtcagaaatttaaaaaattttttatttaaaaaacttttatcttattatcttctgtcaatctttatagacatacaacatgaaaatacatgttatgtatttttttcaggcaaagatgccttagtctacctgttatctgttagtatggtgttcaagaggaatagaaagtgaggaaggaaactaactgttattgaatgcctgctattggttaaccgctacagtaggcactttatataccttggcactgaataataagagcactgtaaatttgttaccattctctctatcgtacaaggttcacagacatcaatttcacctagcatgtaagtgggaaagttaggaattcaacccagatctgtttgtgatatgtgtctggacttgccactgtatctctacctctggagggcatcttttctcccagagaggaggatcacatcattagccctcagaggttgactgactaattaaagcttctactttcatgttaatttccatttacccagcatacatgaattaactacctactcccggtaaaaaacagtgctagatgtcgtgtgtgtgtgtgtgtgtgtgtgtgtgtgtgtgtgtgtgtatgagtaaaatctggccccctccatcaacgagattctcatctagcatggcagatgagatgtgcataaatacagggcaagacatactgtaaaagatgcataagggaatgatgaacaacatgctgctgaataaattgaagaagaagtaacatgaattccaatcatggggaaccagacaaggcttcatggaataggtagtatttgttgcaagcctagaagaatgaatacaagttggccaaagaaagatgaaaataaaagcattagaggttgaggaaacagaatgaacaaaggcatcgacttacaaaagaatgcacttggtttaggaaattatgtattgtacagaatctctggagtctagtgggtttgcttgggtgtgcaggggggaaatctgcctggaaaagtagatggaggcctgatcagggctttcaaatttgtcattctccatgtgaagggagaattactcgcataatcttgttgttcctgttgtgtgtatcaacagccttcaggtaaataggagctttttattcctttatgcatgagattcaatgaaggtactttgttttggatatggtgttagtggagaaatcaagcaggtggctggaaatgagaatttacacttaggatcaggttgtggctagagacagatttaagttattggtccacagttgatcacggaagccatgtttggccatttatccttctctctcaaattaacagaattccaagttttaaccaggtacgttgccatgtacctaaaatactatatttctttgcatctagctatatccatgagcctatagtctgacacatcaaatgtaagcagtaggggtatatggtacttccagaaagtcttcttcaaaggaagaggtcatatttatcttccaagctgtttgcttttagcaaaggacatgatgcctggcactccagcagccaaattggatgctaaagacaaagaccaaaccctaagaatggcagataagggtactggaaggaacctggaggtccttggtaaatctgtaggtagagctgccatactcaccctgaagagcctaccctgatgcttcttatatataagaaagaaagtaacttcttgtgtaagtcactgctattttggtatttctgggctttttatatgtagtcaaacttaatcattactgatacatggtgaaattagaagaaattttcaagagagtataatgaaagagaggggaaggatgggggctgaactttgctttttttttttttcttcttgagacggagtctcactgttgcccaggctggagagcagtggcaggatcttggctcactgcaacctctgccttctgggttcaagtaattctcttgcctcagcctctggaatagctgggattacagctgtgcaccaccatgcccagctaatttttgtatttttagtagagatggggtttcaccatgttggccaggctggtctcaaactcccaacctcaggtgatccacccacctcagcctcccaaagtgctgggattataggtgtgagccaccgcagctgacctgaactttgaagagtgcctacatttggaggaaaagtacaagaacatggagagttgagagtcaaagctagattaaaggtggatgttaatgtgagcttgtgttggaggagtgggttggggatggtggtggaaattctattcagtctaaaatgtctgtttctcaaaataagaaataaagggctgattaaggagccactaaaaactggagtgatccaggctactcccaagacagaggattaggttatatatgtccaatttctgcaccttaactttccaatctgttaattcattccattgctgacgtagaatgatcagggattttcttccacagggaaggtaaagtcaagagggggaaaaaactatttcccaccaataaaacagggtcctcgattgtaactatacttaagaataagtcctccgtaaatcattttccccctgtgtattagtccattctcacattgctataaggaaatatctgagactgggtaatttattaagaaaagagaattaattggctcacagctccacaggcagtagagaaagcatgatgctggcatctgctcagcttctagggaaacctcaggaaacttacaaccatggcagaaggagaatgggaagcaggctcatcttacaaggccagagcaggagcaaggcgttggggaaggtgccacacacttttaaataaccagatcttgtgataactctatgagaacagcaccaagagcattgtgctaaaccattcacaagaaatcgcccccatgatccagtcacctcctaccgggccccacctccaacattgggggttccaattcaacatgagatttgggtggggacatagagccaaaccatatcactctgcatctgacaccatatatgaataccccttttttgttctagcagaggctatttggaggacaaaacccacccatccaggactcagaggggttagtggtgagctatttagtgcctgctccctgtctcttgtgctctacctgtgcatgctgcatcccatggaccttcagatcctggcactgacagtcatttgtaaggagactgcaagtaaagagtctctgtaagttctgcaagtgaagagtaattttggttttccttaaagatcatagactctattatttgtactgtagcttagtggaaagagttttccagaggctccagtctgtttgttaattattctttttaagaatcacatacagtgctgagagttgttgacaaagcaccttcacctgtgttatttagtccttgtggtaatcctttggaataagcaatgttattccctttgatttacactgagacctaaagaagatgatgaagagaaggtagattacaaagataataatataaatagctatcatttactgaattactaataagtaccaggtagggcagtaggaacataatatttttctaacataaacaataatcctgcaaagtttgacttagtatttctttcttttttttttttttttttttttttgagatggagtcttgctctgtcaccaggctggagtgcagtggtgtaatcttggcttactgcaaccttcacctcccgggttcaagcaattctcctgcttcagcctcccgagtagctgggattacaggtgcccagcaccacgcccagctaatttttgtatttttagtagagacagggtttcaccatgttggccaggttggtgtcgatctcttgacctcgtgatccgcctgcctcagcctcccaaagtgctgggattacatgcgtgagccaccgtgcctggccttagtattcctattctgtagataataaaactgtgattgtaagacttaaagtgactctttatatacactcttatatagttaaagtgacgctttaactcttagaatcaacacaagctttacattaattgaacatgacactaagggagcatctgtggtgcactgagactcaccccttgcaacattttgattcgcataaatgtcataactgaccctgtgatgccctgggtgggggggtaccatttacccctgaccaccctggggagttgttagatggtgatgatcctagtacaggcactcagttcactgagactctggaaagaactctgagatagaaatacaaggctataattgataatcattattaaggcttttatttgaataatgagaagaataaagaacagggaaaatggttggattttattagtttatttttattattatgccaatagaatttatattgtttctaagcaaataggtacatatcagtacaatctgtgttttcagtatattgaaaaaatacatagctaaggaaaatatgataacttagtgaggttgaagtaggttttttctataaaattttgttgttctttcatgttactttttattctaattagaaatcaaggataaactaatatggaacaaatctggatggcaaactccacttctttacatttcttgagcgccttaccaatctgcatctggtctttaagatttccctagtaggttgttctctgcacatggggagttggcagtaatgtttctgtttttgtttccctaattcttttttttttttttttttttttttttgagacagagtctcgctcagttgcccaggctggagtgcagtggctcgatctttgctcactgcaagctccacctcctgggttcatgccattctcctgcctcagcctcccaagtagctgggactacaggtgcctgccaccacgcccagctaatttttttgtatttttttagtagagacagggtttcaccatgttagccaggatggtcgcgatctcctgacctcatgatccgcccgcctcggcctcccaaagtgctgggattacaggcatgagccactgtgcccagcctccctaattctttactactggctttaactctgaaacttctaaattaaacgttctttgatcatccccttactgaagtagtgaagggtcttgtaaataaaatccacaggactttgggatggttctgacatggtttcttaataaagaaaagtcattggaagtgttaacgtagctgcaggtgagggttttggaagctcatgcttcaccttacctgctctctatattctaaaagttgcagaagtaaattcgaaaacacaactttctgtaaaacttaatgatgggactgaagagtacaatcgtgttaaaagctacttttatatagcaactactaggtgctgggtcctctgctaagtacttcacaggcattatctcgagttctcaagagagaattcaagaatcctacaagggagtagggtgaaaaacatccttattttatagatgaggaaattaaagcctagataggtgttagccaagattcatctaattaaaaatgagagcttatcttacagagtcattgtgaggactaaatgaaactgtatttatttaccaaatgtttggcatggtatagggttgctgtttaaattatgttcatcttatttcaatgtctctttcatattagtctcaagcacttcactgtcttcgtagcatttgggttcttgaaatacttctgtctgagagaaaactgacagtgatattatccattgttttgatttattttttatcaaatagcagataattagactgttggccagaatttttcaattgctcaccatgggcctgttccaacatattattggaaatcagtaatataaacctaatttttcatgtgtttttttttttgttttctatgataaaatcattggtgggaatgtttatgttggatataataaatttgaaacatatgaatatcctcttgtgacaaggtaaggtattagttagggattcttttttaacttccacccaattacttattttagaaaaatgttaaattcattagatgaaaattgaaaatattcacaagtgtcctaagataccatagacaggagcacgatacagtgcactggaatggggggggtcaggagccctagatctcagtcttgcctctgtccctgactagctcgtggccttgcttaagacactcatcccctcattgcttcacaaggttgctacctgtaaattggatatttcactccaggatctaagtttcattttctgtttagctgttcataataacccaaaattcattaggggaaattctgctgctttggcaggtaacatatggggatgcaaaggaaaaaattctggcatctatgtttttggggtttactgagggatctaaccctccatccactgataaaattcttttaagaaagttacatgagtgaatgattgtttgcatttattattggtgggttatctacttgtttagagaagattgataatcttgcaacaaggattaaataaaaccattccatctctcataatgtcttataatgcctccccattcgtcatcatcatgatcattatgctggtcaagacaaaaagttaatcagccacaaacaaacataagaagaatttctttttttttctgcactgattggatcaaggaaggggatttgcaaatatcttctagtcaaagaacttcattccaagttgccattgcactttatgcattacctaatccaaacagtttacataactgtattataatcaatcatgcagttctttatctgtttccctcactggactatgatctccttgagggcaggcgcctatcttaatgactatcatgttgccattcactagcatagttcctggtacaatccctcatgataagataattgtatttctataatttgactttaagactacaaatccaaaggccacctcagtactctgttactgagtactgagattataatatgaccattgtgctggagaatcagttccaactgcaatctgaagctcccagaagggtggatatctgcatccttaactcacatctcaaactgttcactcagcaaacaaagcaaaaacaatatatcttctcttcttcctacttcactacctttagagttatgtaaaacactttaatttgcaccagaacactggggaaagagaaaaaggcagccaggataatataacagtatctttattaagcccttgtgcagttttaaaacgtcagtaacttgaattgagaacatggtagaggcaacttacaaatcatatttgaaagcaaactgaattttctcagaactgccagaaatttctattcagtgcagagtacacagtgaaatttttcccagagtatgtcttgtcaaataattatttaaatgttggattaatcactgttgaattggtttgttttctacagggccatcagagatttcaatgcactgtcaatctacaagaagggtatatgatatgcagttgtttcacaaacactgtaacaaatgattttgaagaggacatcttaggatactctgagttactccaacttggacatttcacaggtaggagaactattgaatggttctgcaaggtaaagacacttattcaagaatatttcaataactgtacttagtacaaagccaggactgaatttaggtagtctggttcccagtccagaagagtgtacctgttttctgtatgccatattgcaggcccctacttgccaatgagagagtttctgcaatagcaacatcatcccttctgtttcatgaagtcctactggttggattaataaataatggcattttcagggcagtgggttgcacccactaagatatttttgatttctagtacaaaatgactttcctagaaatataatttcccagaagaagggtacacaagaaatgtgtggcttaaaattcaccttttagtcattgtataaaagttgaaggataactgctcagttattacacgggagcagctggtggaaaaaccacaggcccagtgatgatgatagatactggacatagaggaatgagatccattttcctaataggtcagcaactttatgttctatctgtgggtgcctgtcctgaagcctgtgctcccactgaattcccgaattctgcccatctaatcccaatcacattttcacactggaccgactaagtcttttccagcaatttcattccttttcccctgccctctgcattcctttgtgatctcatttggtctaaatatcatgtgatggaattggaagagccaagtaggctagacttaaattctggctctgcctacacttgaccacctagaaaacctcatagagttcctgtaaagatttaaatacacctaccacacatttatatatagtatttaacatagtgtctagcacaaaagtgttaaagaaataattctctttctctctaattgttgtttatatagtagaccaatttgcccaattagataaaagctaagggcagagggcatggtgtgtgtgtgtgtgtgtgtgtgtgtgtgtgtgtgtgtgtgtatcctcacaatgctagaaacattctttcattcaaaaacaatctgttaaatgcctcacagtagcagaacatctcacagtaggtgtttgcaatttattttatgataaagcttatatgagagtaaataaaatactgtatgcaaatttctgaaaacagtgcctaaacaactagtaagtgctattatgatcactagaaagtacacaaatttattttagtgctgtgataatacttgggatgagctatttatcccatcttgactccgtctcatggggtaatgatttttgcacaggaacggttaatccagttgaaaatcatcacctcctagaaatggaaacagagacataaacaggaaggagccatctaattcttaagtttcgggtgactcgttgaaagcctggagtaatcagggatgacaaagctcagcattctcaacctcagaagggtggcacaagaatgagtcatatctaagcagatcccaagctataatattttcttgacttagccaagtcatgttttctttgcaaaggcttcatggacttaaaactaaactgtttataaaagcccctttttagtctatgtttaaggctactgttttacagaaatagcaatagaataaaaaagttggagaaagaattggaagattgggaacctggttttgcctctaccatgtactcatgggaagatgttggcctttctctatcttcgttttcccaactataaaatgttattttatccaaagaacattaagtattttatatgtgctaagtatttactgttttaggtggtggggtgctggacataaaaaaggtaagtaaggcagagtctagtaggaaagaaaattaatttgataattgtaattcagcaactagtgctaaaggcgtagattgcaacagaggacttaatcccaagaagaaagagttcaggggaaacctccttcaggacctggagcacagtctgtctgggtaggctgtcataagtatagtgaagatggcagctgcatgcagagtgagttgcattacaaggtatagagacctgagaccaccttgacaaatgtagaaactgcaaggaattcagtccagctagatatggctagataaggatcatacaaagcaatagatttgagaatgtcaaaaactgaagaattgaagagaagcagtaaaagctagattagagagtattttgtgtatcctgctacaggaaatgagggactctttctctccatatgcatatatatgtaaataaggcgtatgatcttatatatgtaaataaggtgtctgtaaggacacagacaggtaagcattttcaaggatcattctgactgcagtatgattggcttggcaggtggcagagaacaaaagcaagaaaaactattaggatgctgttgcaagaggacgcaagtaatgatgagtgtccgagctaaggtagtagccatggggatgagtatttgagagcttttaaggaggcagagtcaacagagttaagtgaattattgaatgaggataggaagagaaagggaagtatcagggatgatgttgaggatttgggctaaggtaatggatggaaagtgttgtcatccctccagacaaagtgatatagaaacttggctgggagaaatttgcaaagggtgagcatgaggtacctaggggcatacaaattaagaagtccagtaacagtgggatggatatcaggagctcaggagagagatttgggctgcaactaccaaattaggtcgaaattaaagctaatggaaatcattcagtgaactgagattgcccttagagattaaagtaaggaaaaaagctgaaggtaaaacccaagagaataacaacattttagaggaagagggaagagtcatccaaagaactatggatgagagtgggcagacacatgaagacaaccagaggaaaatgtcacagaatgcaggggaggaggaagattcataatgtgataatggtcagtggtgacagatgatacaggagtccaagaagcttgaaaaatgtccaatagataattctatctctcatcccctcccaggttgtcatgagttcagaaaagatcatggaaggaaaaggctttgtaaaatcgcattcacatctgtgattcattattatttcttgtctgttgacctatccacagtgctgcgctatcagaggacttaagatgtttaagccgaagccctacttccataatcatttactttcctgtttcttcgatttattaatgagaaatcaaatcagaaagagttaaattacttatcactgtctcaaaggaataatgttggttttcacaacatcccagtttcaggtataccatcagagtcattcagagatctgaagtacagatttttccttctttgggtggtagtattcctgaaatatcattaataaattcatttaaaaaatctgttttaagtacagaaaagtaggttgctattgaaagctttatgctgttttttttaattctgaatttgattcgtttaacaatgaaatacatctaaattcttaagacagtctctgaaggccattataaatcacagtgctatttctttctgacaattatgtcagtaagctcatgtcaggaggcatatgacaggcagaatggcacagaaaaatggaaacagtacagatcaagtatcagaataaaaatcttaataatagcagccatcttattgaattttttgctatatgtcaagtcctttacatatattatatccttttttctcttcaacattttaatcctcattttacagatgaggaaattgcagatcagagtggtgaagagactttaggttatacaaaagcctctggctaagaagctgatctgggatgcaaacccaggactgttatgtaatgattgttccaggatatgatgccaatgtaggaggcagagagagtcaaacccagggatagtttctcttatccttgtaagtcaggcagtgaagaggagagaaaggggattttgagttaatagaggacatgtcacacaacaaagatgaaaacactgcctagacagggggctggttaacaaagcagggtattaggaagatctctgccatggcaggggccatgtggagagactcagcaagccagtcagaaaaattcatcccatctgaaaaattcttcaagctgcagcagaactgggacatccgtttaaacaggacagctccatgggactagcttcatgaggacatgttgaatgagagtcagactttccatcacactcccccatgaaaagagagaatgagctaagcttatctgccttgtctgtaaaaaagaagttaaacctatggctggtcacttcatgcacttagcagtgtctgggacatggtatctacttcatatccagttgttactattattctaaatatctatcactatcaagcacactagttatgggtcccatcagtctagcaccttaaacatgtaccccctcaaactcatatgccgattacaagagtctactggggggcatcaaaactctgcaaccaaagttcacaggtaaaactctgagacctgtgatgtgtattaacgtacagaatattattaacgtacagaatagagatgaaaattcttcttagttcccaggatccatgtgatgaatttaaagaaataatgtaagcaccctgtaaactgcaaatgactatccaaatgtgaaggaatatcattactattactactattactggttatggctatttttagaatactcaggaaaacacatattctcatcaaaacacttttcttaatagtttagatcaatttcctttatcattttattctgaagcacttcagaataaaagtaaaggaaggtaaataaaagtaaaattaaagtaaggaaaaaagctgaatgtaaaacccaagagaataacaacattttagatgaagagggaagagtcatccaaagaactatggatgagagtgggcagatacatgaagacaaccagaggaaaatgtcacagaatgcaggggaggaggaagattcataatgtgataatggtcagtggtgacagatgatacaggagtccaagaagcttgaaaagaataaaatctgaagaacttcaggtaaatagtaaaggaggaaaagggtatagggatctatgctcaggttaaatgacagatgagttactatagttatttatttatttattgaaatggagttttgctcttgttgcccaggctggagtgcagtggcccaatctcagctcactacaacttccaactcctgggttcaagcaattcttctgtctcagcctcccaagtagccgggattacaggcatgcaccaccacgcccggctaattttgtatttttagtagagacagggtttcaccatgttggtcagggtggtcttgaactcctgacttcaggtgatccacccaccttggcctcccaaagtgctgggcttataggcgtgagccaccaaacctggctatttactatatttaaataaatatgggtttttttctttttgaaatacatttgttttgtttattcaagtactttaactcaagcaatttaacaaatgtttattaaatcaagataccatgcaagaggccaaagaataatatattaagaacactggaagttaaaaattaaaaaaaaaatctggcctgaattctacctcctccacttatgaactttcaaatcttttttttctagcaaacgttgtccatcgctgttaagatgaccttgaacactttacatgactttctgagcctctttttcctcattaaaagagagattgcatcacccactctgcttactcacaaggaatttgtaaggattaaattaaataatgactatgcaaataaaagtactgttattcgagcgagactccgtctcaaaaaaaaaaaaaaaaaagtactgttattcagcagaagagaggcatgtgcattaataagcacgatgatagtttgttatatatagtgagaaatattactgatgagcggactgaaactgttcattgcatattctctctgtaggaaattctaaatggaaagctgattatagtcagaaagatgccagagattggtatgggatcaaaggtgaattttaatggctaatgtcaacatcattgtctgatgtgttgatcttaatatattcatatttcatgtttatcttttattgatatcaagcactcatttaaaaaatcatatttctaaagtatatataataatatggagaaatgatcacaatataatgctaagtaaaagaagacagaactctctgtatggtgtgattctaattttgttttacatattatatataaagatacaaagcatatatactaaaagaataatgtttcctttgcagtggtggaattatgagtgggttatctttggctttatatttttctgtatcctcctaattttatatagtaaacattttttaatgttaaaaatatttaaaataaagaatcttagaaccttcactccaacttactataattcattattttatatttttgttttatatttgaaaagcatacaccctttgggcttgaagtcatctattacagacaagtattaaggactttgtggggtatggcaaatagaaacgggaatgtgagaagatacaggtgggaagattaggagtatgagtcagtgataagagacataatctgaccagctgtgtaactcttaaattttgagaaaaggaaggttggaaattgacagaaaatcacaaagctagaaaacaagaccaaatatcttacctttcgaggtcagtgataaaacctaggagcttctaagaaaaaagtaagatgatacagacaggtagcagacctatctccccctattcaaggcaattgaatactcagtacagaatcccagaaagctacatgcgcagtgaggatttaaggccatccaaaatcagaaggtctatggaaaactctagtctcacactcaaccactgaaggaatgccttttaccatgcataatggccagctatgcagcttctgctggagcatctgctgaggtggagaggcagctcactccttagtgaggcaactcactctttgttggatgggtctcttggttatacaagagtcctttcttactctgaatgaactccttaattcgttacagagaataagtccactccctcttctgcctgataaccatctaaataatgatagtgacactaaggacttgaacctgactcttctaatttcaaaagactacccctgccccatcactttacagcatcattaaggctttctggttaattggaattattctgccagattaaatgtttcatgtgccatttagttttttagtagctttttatgatttgaaaacaatatgcttttttactccttttttccccaactaattgatatgttggtctaacctaattaataaatcttttggtttatttactttaggagtaaaaaatatgcccgattcacatgattagaatcaatttatgactaaataaattatgaagttatgtaacatgtgatttatcctattaaaatgattacgaaagagcaattccaaatggtgattatagtctccaactgaagtcagatttcggtcttagtcatctctatgtcatcagttaggcaaacaaatgcctaaattatcactaatataagagatgtggctataagtgtcttagtactgagttcatttgcagagtaatataattacatatttggcataaatacaattcagagactgttcagaactctcttctttctcatatcaaagtctatttactactaaaatgattctgatgaataatgcaaccttattcttttatagaacagactaacaatacactgcccgtcccagaaaaacacaaaaatcattaccttcatttctaggaatataaactttggaagcctaaggaaaatctaacctaataaaggtaacattttattgagaagagtagataattgtcaaaaattgggcattttattatttattttcattttagcatcaccttttgctaaaatgtaggaaacttttatttatactaagcaaactgagccctggtattatgtatcactgggtgcatttgaatgaacaacagataagtttgtcccccaatacaggataactacatgtggttcagtcctggagaagcacaatttacaacagtgcttcgaggcagtataacacattggaaagagcaagcttttgatatggatagatttggattgaattctagctttcttctgtattgagttggtgaacttttgagtctcatgtttttcacatgtaaaatagttaaaaccttctcatgtggttgttgtaatgattaaatggggtaatatataaaagcatttttcagagcctggcacataataagcatgttagacatgttaattttcttattctaaactctgtaattaatcctagagaagccctcccctcaccacattcttttgcaggcacaaagttatgaaactggagttggagaaaggtggagggtcccttgaagccaaaagtgaagctcaaatgacagtgtctgtcttttgcagaaatagctgttatatcagcatgtactgattttaaagatgatgtagacatacttcaatcaatttaaatttcctttatggttaatacaggggagtataaaagatatatatgtagggactaaacttatcccaagtatatttgataaataaaactacaaaaatacaaatattgcatataagacagtattttttaaggttggaaataaatgtataaggatatacaatatagtcattttctgatttaaaaagccttttaaaatttttatgtgctgtgatctgatcatttctcaagtcacctttgtaagtgcctgttttctgacggcctctatacattgtcattctgacctgaacaagcagaacaattaaagtattataggttcactgtatcctgagctgaaccaaactcttgtgattccaaagctgcaggatgagctgctacctctgccataactagaagatgagtaatcaagaacctcccatcagaactgttgtttccaagaatgtactttttagctaagctacagggatcaggaggttgtctaaaacgattggatccagggacatgatacagttcctatgtcagcacagctaaaaagaagatgccctaggcacaaccacttggcacttgtgaaattattgactaaagaatggagattctgatagcacagctcagaaaaacccaacacatcttacaaccactgtgtatgccagaaaaaagtagcagatgaaaaggaagtacaatttctaactcatttccatattctaagacttgcctaagtaagtttgattagctgaatctaaattatatctgataacctagagacatggcatctgcaagggtatatgagataggtagtgagcagctttcatctttaaagatgtaagaaggaacttcaatttctatgcaagatggaatgagagaaatcagctttaacctcctgcttcaaacaaccaaaagtaaataaaatcagacaaactatagggaataatgatttcccagacaccagacatcagacaatgaaggacaagaatctttagtagatgggaaacaaatgaggtaactgccccagctttctgccttgacagagtctcgaggccatcaagcagggacaaagaacccaggagaagcctggcagactctcttagttgaagacatggaactgagaatctgaagagatcaacatggctagagtttgcagaaaagagtatcagaagagagctgcacagaaagaaaattctggaaatatgctgagaaccactcttgagtatttagcagagtactgattggcatctgtgtgcatgaagaaactacaagaggccagagaaagaaccattttgaaggatgagtaggatcaatacttggcatttgtaaagggctgagatcagtgctggttctcaccagctaaactagaaaacttcacaattcatggggcattaagtagtatgctcagaaaaatcttgcttcagtagtaaaacataattacccctaaatgctgccctcccatctaaaaaaatttaaaagcaaaacttgaagagatcagcaaaacttgaaaagatcagttccatgatacatttcaatatttacagaaatgcaaaaatatctggccccaataaagtaaaattcaccatgtctggcatttagtcaaatattaccaggcataaaaagaagtagaacaatatgactgacaatgggagaaaaaaataaccaatcaaaacgaacccataactgacacaaatgttagaagtggcagaaaagaacattaaaacaattttataattgtattgcagatggtcaacaagttaaatagggacatgaaacatataaaaaaaatccaaattaaacttgtaggcataaaaactacaatgttgaaaatgaaaaatatgctgaatagaattaaaggcaaattaaacaatgcctaaaatattaatgaacataaaatacatagcaatggaaactaaccaagttagttactaaccaactaaccaaactaaccgtgaaaaaataattctaaagaatgacaagagtatcaaccaactgtgagacaccctcaagtagactaatagacctctaattggagtttccaaagtgtaggaagagtgagaaggaaaggaaaaatatttgaaggaatcatgaccaataattttccaaattttattgaaaactatgaatattttaatccaagaagcttaataccacagaagcacaagaaacataaagagaaacacaccaagatacatcataatcaaacagcttagtagcactaataaaaagaaaaaatttatttatgccaggaaaaagaaacatgcttcatgcaaagagaataaggaagacaaggatgacaagaggcttctcatcagaaacaacatgggtaagaaaacagtgaaggcaacatctttaaagttacctgcactgtaagggtcaacttaaaattctatatccagataaaatatctttcaaaaataaaggcaaaataaagacttttttcaaacataaaatgctgaaagaattccttagtagcagatgtgcacttaaagaagtagtgaaggaagtactccaggcagaagtgaaatgacacctaatggaagtctggatatatataaaggaagtaccctgggaatggtaactatgtggatgaatacctaagccttttccttgttatttaaacttctttaaaacaattgtccactgtgatggttaatactgagtgtcaacttgattggattgaaggatacaaagtattgatactgggtatgtctttgaaggtgctgccaaaggagattaacatttgagtcagtgggctggggaaggcagatccacccttaatctggtaggcacaatctaatcagctgccagcgaatataaagcaggcagaaaaacgtgaaaaggacagactggcctagcctcccagcctacatctttctcccatgctggatgcttcctgccctcgaacatcggactccaagttcttcagttttgggacttggactggctctccttgctcctcagcttgcagacaccctattgtgggaccttgtgatagtctaagttaatacttaataaacaatagaatatatatatatcttattagttctaataggagatatatatatcttattagttctaataggagatatatgtatcttattagttctaataggagatatatatcttattagttctaataggatagatatataatagtttatataggaactaataggatatatatatataaaataggatatattatatatatatataataggatatattatatatatatgtattagtcagggttccctagagggacagaattaatagaatatatatatatatatatatatatatatcctatttataataggatatatattataacatatatatgttatttataataggatatatttataatatataatattataaatatatcctatttatatcctataataaataggatattataaatatataattattaaattatcctataaataggatattataaatatataattattaaattaaaaatattaaatatattatattttatatatttatattttatatataaatacaaaatattaaatatatattatataattataaatatataattatattataaatatatataatataaatatataaatggaagtttatatatgtataattatatatatttataatatataatatatatttaatattttgtatttatattatatataaatatataaataaatatatataatacatctacttaacccaaaatactaacaatgtgtcatggggtttattttgtgtgtgtgtgtgtatacatatatatatgtatacacacacacacacactgtatcatataaaatatgtgacaataccacaaaaaccagaagaaagaaaactatactttgtaaggttctaatgcggtacatgaagtattataatattgatagtaatgctagaatgggataagttaaacatgtacactacaaaccctaaagcaaccactaatataacaacaacatctggagagttatagctaataaatcaacaaatgagataaaatggagttataacaattatccagtaaacctccaaacagacatgcaaagagaaaaaaagagaatagagaacagtaccaagatgattagacttaaacctaatgacaccaacaatcatgtcaactgtaaaaagttcaaggcacttcaattaaaaggcagcaactgtttgttagaccggataaaaaagaaagatccaactatatagtgtttataagaaatacactttaaattcaaaggtacaactaggttaaaattaaagagatggaaaaaatatataccatattgacactagtcaaaagaaagttggaatgactgcattaatatataaaaaaagcagatttcagagcaaagaatattatgagcaatgatgaagccccaaatttatccagaggatataaaaagcctaaatctttattcatgtaataacagcttcaaaatacatgaaacaaaaatgtgaacattagcaacttgacttaattagcatttatagactacccatcaacaatatattcttttcaagtgcgtatgaaacatttaccaacaaagattattatatttctgggtcataaaacaagtcttaaggattcaagtcatacaaagaatgttctcagaccacacagacagtgagtgatagaattgagcattcaagacctgcctagtatagaatatttgcttccccactgtgttttcctccttgttgctttacatgtgtttggatttttctctgatatatgtggctctgggcttctttccttgcctcaacaataacagctccctggtagggaagaggcttccactaacctcttccacaaaactccaggaataaacactttcttcacaatcagtcaactgaagcaatgtgttgtggtaagcaaaattcttaatgtaagatatttggactttgagagagtaaatatctaggcaaataaaatgttgcatttattctacacattaatttcaagtatgaaaataactccactccagaagctgatgcaattatatcatattatgctctattttctcagctgttcttatttgctatttgatgtttaaaaaactacctctttctcacgtggtccatgccttagactacgtagctatggcaattttgtttctggccaaaccagcataatggatatcgccacattcctgtgactgtatctagattttgaccaaaaactaaagacaaaattaatgcaaattatgtgcagattttatagacgtttattttacttgtggtattatgccttaaagctctttaataagcatgtctaaagtgaaagtagacattttaagattgaaaaaaactggccattttacaagaaacaataaaatgcttaaaaaaatgaatttgaaaaaaaataaataaaataaataagtaaatttgggccaggtgtggtggctcacacctgtaatcccagcactttgggaggctgaggcaggcggatcatgaggtcaggagatcgagaccatcctggctaacaaggtgaaaccccgtctccactaaaaatacaaaaaatgagccaggcatggtggcatgtgcctatggtcccagctactcgggaggctgaggcaggagaatggcttgaacctgggaggtggagggtgcagtgagccgagatctcgccactgcactccagcctgggtgacagagcgagactctatctcaaaataaataaataaataaataaataataaataataaatttggtcagtatgtgacactgagggagaaacagctacaacttatacacttttaaagtcacaatatatagaacttccaatgtttgttgttaattttaatggtatcattcctacaaatttcatttgtatcatcatacaactttattcattgatcttttttgtgccattactaatagaaatatttgcaacatcattgtactcatgtacagtgtaaatggaattggactcttcccatttttcctctactttggttccttccttattaaaatatatgcccatggttaaaatttaaaagacagttaccataaaaatcataatttgccatccctaaaaccatagatgccacaacttttaggaaaaaaaaaaacatttattgagcactactctctgctaggcactagggctaacaaagatagatatgggttctgcccacgtgaaattaggggctagttcaataaagttctgccatgatgtctataagtttccttttctctcctaccaaggaaagatatactggaatgcaagcaattgaaagggctgtccataaaagagttattttaaatctgacccaatttataaagaaagtaatttgcaaaacttacttacttcattaatagtaacacattacattgggtgatatatttgtctacttagtaccactacccactcctatctccaactttcaacataaaaattctcacaggaattgctgtgttcttacataaacctgcaccctggtttctgtgggagagcacttaatacaggccaggagaagcaaaaactggccctccctccctcccctgccccgccaggcttcctcccttcccccctcccccattctccccttccccttacttcctccacccttctctcccctcctctcccctcccttcccctcccctcccctcccctttccctccctcattcctcccttcctttctccattcctccctacattcttctctctcatccttctttcattttggcaatctttctcttgtagcagaaagttcaacatgtactaattaggcactctgagagacaagtttgcgaattcatgaacaaacttgtccacagttacagatctcaaacctccaaatgaagagggtgagttcgaaggctgagagagtcttgatggcactcctatgcccaatatgtgttggtgacacacaactctaatcctgcccttctgtccattccatggagacatattactcccattttgcttaagcttgtcattttctttttaaaatcacctggaataaaattattgacataaaccagtgtattgagacagtccagttgggaactgctgccttaaaaataattattcttctctggaaagtctcagattcaagaaacagaacacagaattacactgttaatcaaagagcttagtaataattctataagcaagatgctctgttttatgttaaagaattaccctaaaatacatgtcaagaggaaataacattatttcagctcaaaaaaaaatacattcttgcaagaagacataagagctgtcatacacttgaattatggtgttcatttatcaaataattttgacttggtttaccacaggtgaaaatagatatgattctacagaggaactttttgtttttccccagcaagacttgtcccaaatttaaataaaaattaaaaagatcctatgtggaagttttgaaacgatataacattgaatctggagtgtgcctcaatgtaaagagtaagagtgcattaatcagagctaaaggagatttgaggaaatacctactgtttcttttcaaacattccattttattggtcctagcatggaaccacataaaaatcctaagagaacagtaagtgaaactgagtttagggagaattacatactaggttcccatatttccttctacttttcattttgatgttcttgaatttagaattctgagtttggactctttttttttttttttttttttttttgagatggagtttcactctggttgcgcaggctggagtgcaatggctcaatctcagctcactgcaacctccgcctcacagattcaagcgattctcctgcctcagcctcccaagtagctgggattacaggcaagcgccatcacacccggctaattttgtatttttagtagaggcggggtttctccatgttggccaggctggtctcaaactcccgacctcagatgatctgcccaccttggcctcccaaagtgctgggattataggcatgagccacctccccggctgactttggaatctttgccatggtgaccacaggaattactgcccctggtaatagtgctttggttccaagactgtccaggccaaagttactggaatattacagtcagactctagacttttccaattcaaggatggggatccaataaccaaaaagacacttttcacctcaggtctgtgtacatttactgaatgctgatcatgtcccaggcatagtgcttgatgctggggatgcaattatgaattaagacattctcagtatcctcacaagaaaaggaggaatgcccacagctcatcagcaaaatcataaactggttcatacttagcactagtcattcctgcataggccatccccattccccagcaatattattaatggattggttgtatttgtgggatatataagtctgctataggccttagtagataagattctgattttcaaacaaaatgtattaataatgatagttcttcaagggaagattagataagtagtaacaggaagcatacaaatatctttcagcgacaagcattctactatatgttttacttatactgtatagttacagagaaataatgtatagaaaacatctagcttagagattggcacagagatgcattattatcattgttgctaaaaagtataacaacccagcaggagagataggtattatttccatttaatagaggaagaaatgaagattcaaagcggcaaagtgacttatctaaatctcacagataaaatgtataagagcagggtaccagcctgagggtgtctggctctaaagctcttgctcttttcaccccaatgctattggatcagtgcagaagctaatttgcataatctctcacttgagagtttcattttagtaaaagtgcactagttaaataagaagaaatacttaattctgttcaactaccatttgttcagcctttatttggcaaaagacaaaaaatattctttgaatgctaaatattcaaaggggaaagtcagaaatttcctctgtaatctttaatcatgtcagacagagcaggtctcctccagagaaggctgccctctttgcactgcccctcacacatgctcatgaacatattaccgaaagcctgcaagcccgggcattgcccttcactgtacttttggttgagtccattattaggggcagtgtggcatggtggctaagaacaccaactatgaatctgagaaatggattctagacccacctcttccttttattctctggggcctggtattaattcttcaactgactctcagcttctttatccataatatggaagatttggagtggtttatctctaaggtaacttgcagttgcaaaatgtcagggcttcctttttgggttaaaagtggtcttaaatgagtcaactgatacagttttaccatagggatttcaaagacaagcctcagttcttcttctggacgataagtttcttgagaacaagaacctttaactattctctcacatcaccttgcaaaatacctattatttaattgttgttcaattgatatgtttcattaataaagtaatgaatgaacactttatatactgaaagaaaataggtaagattcaaaatgcaaaattcaacagaaatatgtttgtagtgtatcagatgttttgacacatctatttcttaatctagcccaagaatgacagaattttggctgactggtcaggctccattgaatcatgaaaaagaaatctgtattttttttctataattaactcagtgtcagaaagtgtatccaatgaaaggccaggcttagtcttctgattcacattaattttgtggaacacttgtaaaggacaacatcaagatacttatatgtgcttctgagaaacaaaacacaaagcaaaccaggtctctgtttcctattatagacttttgtactgagtcacttgtctgagtattagagtcacaatgagtcactaagggtctatggtggaagacactatcttactcatttattcctagcatctaacacagtgctaagcatgtagtagtgtttaaaacattcgtcttgtcaatacacttacgaaaatatgttcggtaatgtttgttatgatgtaaaggagttgatagcccagttccatataacaatacggctagcataagtgagggattactctaaatgtcatgaactcaatcagaatacgcttcaccaaaaatgaataacttaaggtctatgtgccaagtctgagaatgaagttactgaagttgggtcaataatcaggtcatgtactggaatattagttggttgaagaagaaccatcaaactggaataatgttctcagtgaaatgaggattgtgtgatgaataatagagtgtcatataaaatagttttagatcctggctgtaaatggaagcaaaaattagagataatagaaatgaaactctaaagatagaggatttttgagcaatacgctgagccattgccattccacagaatgtgttctgtcctgggccagcagctgatggagaagggtgagaatggagaaggggacaaggtgagaatggaggcataaagcagattgtagtgtcaaaatcagtaatttaggcaaaccctaagttaaaaatcattcattcctttactcagtcaactgtaggtgctgggcacagaactgggcattgtaaaatatgaaatgtgcataagacatgattcctgccttcaagtagtttatagtgaaattactcctctactttttaggactgaaataaaaaggacatcatgtaactgcttctgtgctttaaatttttcatctgtaaagtgacctccctacctcagtagagtttgaagataaaatggtagcattattgcaaatatttgtaatgttattacaaaataacattttgtaatcataaaatattacatggaaataattaagattcttctactatcactgtgataataacagtggtagtaaagaatcaagtaagatctttaaatgataatataaatgttgaaataagtttttaaaatagtagtggttaagatcagttccccaacaggatggagacattgatctgggcataactaacaaccagtaaccaaggccagggaatgtaccatacaatcacaacaacccacaaccctctctgctacttttggcccgtttataaagagatagcttgtgtagcttctctataggtgcccctagatacagccatacttaaactttctgagattttccccctacacacctcaactacttatactggtgtcatcctatgatgtagtacaaaataatagcttctatttattattgttcatttcatttaataatcatctcttgtgacgtaggatttgggactcaaggatgaataactaaaacttggactgaaacaagaattaacacatgaacaacatttggatatttttctgattgaaaacattacttgaatagtatttttctactgaagtttgcaaatgaaaatggtgacattctaccttctcaaagagaatttctaagcatttattactagacatgtttaaaaaattctgaagctttgagtattcctatcagagcacactggaggaaacagaaaagtcaacattcaaggctgaaaatacacgagaacaaggtatatcattaccatggtataattatgtgccatgaggatggggcttgggaaacctgacaatgcctgaagaaaaaagagaagagatagaagaaatgagaaaatgtcaagagacaaagagagaaactagggcaaataaaagccaaccttctcctagtgaaaccagaaaggactcttcaagaaataagattttgagagtgggcatgacatttagccaaaggcagtgtgcaagtgctgagcattaggtagaagaacagacaaaaacaggtgcttcaggacagctagagaatctggatggatgcaagccctcagcatcattcaggagtggggcatgggcattgcccaggtcaggagccagaaaaaagggctttgccagccttttggcatttgtgtggagtaaacttaagtgtcattctgtgcccactatgtttaccaacatagggagaatctttttgtgttctattaaaaacacaacagtaaatatacttcaacatttctgttatagcacagacagatgtgggataaattcctggttttgccacttaccagctaggtgactgggtcaattattttgcttctctgtgcctcagctttcacttctcttatgagaataacccacttaatgaggctgttgtgaggttgaatgaaataactgtgtctataaaatatcagcgtattaggttctttaaaactatcattttcttcctgctttttacctatatccctgaggtacagggtcagaactcaaaattaatagccagtatttattgagtgccacatactgttctaagtttgttacttatagtaactacttaatctgcatagcagctctatagggtagatactattttattaacattttttgagagagaatacagaggcactgagaagttaaaaaccagcttgcgtaagttttcacagctaggaaatctcagagccaggactcagttttacaacatcagggaacctagcaccaaagctggtgctcttaactactgccttgtaatgttttctctaacccacagcaggtattgttatcatgaattcacaccagggttgtgaaaatcgaagttggtagcagagcaatggccacagaagctattttccttgacactagtaaatgaggctttcaaagaaaaacaatctgactttaaatcctgactcctcttcttctagttatgtggctatgaataagttatacctgttcacaaagggtgttgtgatgattacatgaaatgatctttgtaaagtgcctaacacagagcagccattccagaatgtagttcctattattgttatgctttggattaaaaaagaaaacaacacatctgctgcttatagttttttttaaattatcttttaatgtttggctataagcagccatatcagctccagtttctcccatctaacattgaatttgctactttttttttttttaatttgagacagggtcttgctctgtcacacaggctagagtacaatggtgcaatctcagctcactgcaacctcaccttccatgctcaagtgatcctcccacctcagcctcccaagtagctgggaccacaggtgcataccaccatgcccagctatttttttatatttttaacagagataagatattgccatgttgcccaggcagatctcgaactcctgagctcaaacaatctgttctccttggtctaccaaagtgctgggattataggcaaatgtgctacttttaggagatagtgaattagaatttatatatagagagagtttctctctataatcactctatgtatctatagaatttatatagagaggaataggaacagctccggtctacagctcccagcgtgagctacgcagaagacgggtgatttctgcatttccatctgaggtaccgggttcatctcactaggaagtgccagacagtgggcgcaggtcagtgggtgcgcgcaccgtgcgcgagccgaagcagggcgaggcattgcctcacttgggaagtgcaaggggtcagggagttccctttctgagtcaaggaaaggggtgacggacggcacctggaaaatcaggtcactcccacctgaatactgagcttttcccatgggcttaaaaaatggcgcaccacgagattatatcccgcacctggctcagaggctcctaagcccacggagtcgcctagcacagcagtctgagatcaaactgcaaggcggcagcgaggctaggggaggggcgcccgccattgcccaggcttgattaggtaaacaaagcagctgggaagctcgaactgggtggagcccaccacagctcaaggaggcctgcctgcctctgtaggctccacctctgggggcagggcacagacaaacaaaaagacagcagtaacctctgcagacttaaatgtccctgtctgacagctttgaagagagcagtagttctcccagcacgcagctggagatctgagaacgggcagactgcctcctcaagtgggtctctgacccctgacccccgagcagcctaactgggaggcaccccccagcaggggcacactgacacctcacacagcagggtattccaacagacctgcagctgagggtcctctctgttagaaggaaaactaacaaacagaaaggacatccacaccaaaaacccatctgtacatcaccatcaccatcatcaaagaccaaaagtagataaaaccacaacgatggggaaaaaacagaacagaaaaactggaaactctaaaaagcagagcgcctctcctcctccaaaggaacgcagttcctcaccagcaacggaacaaagctggatggagaatgactttgacgagctgagagaagaaggcttcagacgatcaaattactctgagctacgggaggacattcaaaccaaatgcaaagaagttgaaaactttgaaaaaaatttagaagaatgtataactagaataaccaatacagagaagtgcttaaaggagctgatggagctgaaaaccaaggctcgagatctacatgaagaatgcagaagcgtcaggagccgatgcgatcaactggaagaaagggtatcagtgatggaagatgaaatgaatgaaatgaagtgagaagggaagtttagagaaaaaagaataaaaagaaatgagcaaagcctccaagaaatatgggactatgtgaaaagaccaaatctacgtctgactggtgtacctgaaagtgatggggagaatggaaccaagttggaaaacactctgcaggatattatccaggagaacttccccaatctagcaaggcaggccaacgttcagattcaggaaatacagagaatgccacaaagatactcctcgagaagagcaactccaagacacataattgtcagattcaccaaagttgaaaaaaaggaaaaaatgttaagggcagccagagagaaaggtcgggttaccctcaaagggaagcccatcagactaacagcagatctctcggcagaaaccctacaagccagaagagagtgggggccaatattcaacattcttaaagaaaagaattttcaacccagaatttcatatccagccaaactaagcttcataagtgaaggagaaataaaatactttacagacaagcaaatgctgagagattttgtcaccagcaggcctgccctaaaagagctcctgaaggaagcactaaacatggaaaggaacaaccggaaccagccactgcaaaatcatgccaaaatgtaaagaccatcgagactaggaagaaactgcatcaactaacgagcaaaatcaccagctaacatcataatgacaggatcaaattcacacataacaatattaactttaaatgtaaatggactaaatgctccaattaaaagacacagactggcaaattggataaagagtcaagacccagcagtgtgctgtattcaggaaacccatctcatgtgcagagacacacataggctcaaaataaaaggatggaggaagatctaccaagcaaatggaaaacaaaaaaaggcaggggttgcaatcctagtctctgataaaacagactttaaaccaacaaagatcaaaagagacaaagaaggccattacataatagtaaagggatcaattcaacaagaagagctaactatcctaaatatatatgcacccaatacaggagcacccagattcataaagcaagtcctgagtgacctacaaagagacttagactcccacacattaataatgggagactttaacaccccactgtcaacattagacagatcaacgagacagaagtcaacaaggatacccagcaattgaactcagctctgcaccaagcagacctaatagacatctacagaactctccaccccaaatcaacagaatatacatttttttcagcaccacaccacacctattccaaaattgaccacatagttggaagtaaagctctcctcagcaaatgtaaaagaacagaaattataacaaacagtctctcagaccacactgcaatcaaactagaactcaggatgaagaatctcactcaaaaccgctcaactacatggaaactgaacaacctgctcctgaatgactactggatacataacgaaatgaaggcagaaataaagatgttctttgaaaccaatgagaacaaagacacagcataccagaatctctgggacacattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggtaatagagacaccaaaaacccttcaaaaaattaatgaatccaggagctggttttttgaaaggatcaacaaaattgatagaccgctagcaagactaataaagaaaaaaagagacaagaatcaaatagacacaataaaaaatgataaaggggatatcaccaccgatctcacagaaatacaaactaccatcagagaatactacaaacacctctatgcaaataaactagaaaatctagaagaaatggataaattcctcgacacatacactctcccaagactaaaccaggaagaagttgaatctctgaatagaccaataacaggagctgaaattgtggcaataatcaatagtttaccaacccaaaagagtccaggaccagatggattcacagccgaattctatcagaggtacaaggaggagctggtaccattccttctgaaactattccaatcaatagaaaaagagggaatcctccctaactcattttatgaggccagcatcatcctgataccaaagccaggcagagacacaaccaaaaaagagaattttagaccaatatccttgatgaacattgatgcaaaaatcctcaataaaatactggcaaaacgaatccagcagcacatcaaaaagcttatccactatgatcaagtgggcttcatccctgggatgcaaggctggttcaatatacgcaaatcaataaatgtaatccagcatataaacagagccaaagacaaaaaccacatgattatctcaatagatgcagaaaaggcctttgacaaaattcaacaacccttcatgctaaaaactctcaataaattaggtattgatgggacgtatttcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaattaggaaaagaggaagtcaaattgtccctgtttgcagatgacatgattgtatatctagaaaactccattgtctcagcccaaaacctccttaagctggtaagcaacttcagcaaagtctcaggatacaaaatcaatgtacaaaaatcacaagcattcttatacaccaataacagacaaacagagagccaaatcatgagtgaactcccattcacaattgcttcaaagagaataaaatacctaggaatccaacttacaagggatgtgaaggacctcttcaaggagaactacaaaccactgctcaatgaaataaaagaggatacaaacaaatggaagaacattccatgctcatgggtaggaagaatcaatatcgtgaaaatggccatactgcccaaggtaatttacagattcaatgccatccctatcaagctaccaatgactttcttcacagaattggaaaaaactactttaaagttcatatggaaccaaaaaagagcccgcatcgccaaggcaatcctaagccaaaagaacaaagctggaggcatcacactacctgacttcaaactatactacaaggctacagtaatcaaaacagcatggtactggtaccaaaacagagatatagatcaatggaacagaacagagccctgagaaataacaccgcatatctacaactatctgatctttgacaaacctgagaaaaacaagcaatggggaaaggattccctatttaataaatggtgctgggaaaactggctagccatatgtagaaagctgaaactggatcccttccttacaccttacacaaaaatcaattcaagatggattaaagacttaaacgttagacctaaaaccataaaaaccctagaaaaaaacctaggcatcaccattcaggacataggcatgggcaaggacttcatgtccaaaacaccaaaagcaatggcaacaaaagacaaaattgacaaatgggatctaattaaactaaagagcttctgcacagcaaaagaaactaccatcagagtgaacaggcagcctacaaaatgggagaaaattttcgcaacctactcatctgacaaagggctaatatccagaatctacaatgaactcaaacaaatttacaagaaaaaaacaaacaaccccatcaaaaagtgggccaaggacatgaacagacacttctcaaaagaagacatttatgcagccaaaaaacacatgaaaaaatgctcatcatcactggccatcagagaaatgcaaatcaaaaccacaatgagataccacctcacaccagttagaatggcaatcattaaaaagtcaggaaacaacaggtgctggagaggatgtggagaaataggaacacttttacactgttggtgggactgtaaactagttcaaccattgtggaagtcagtgtggcgagtcctcagggatctagaactagaaataccatttgacccagccatcccattactgggtatatacccaaaggactataaatcttgctgctataaagacacatgcacacgtatgtttattgcggcattattcacaatagcaaagacttggaaccaacccaaatgtccaacaatgatagactggattaagaaaatgtggcacatatacaccatggaatactatgcagccataaaaaatgattagttcatgtcctttgtagggacatggatgaaattggaaatcatcattctcagtaaactatcgcaagaacaaaaaaccaaacaccgcatattctcactcacaggtgggaattgaacaatgagatcacatggacacaggaaggggaatatcacactctggggactgtggtggggttggcggaggggggagggatagcattgggagatatacctaatgctagatgacgagttagtgggtgcagtgcaccagcatggcacatgtatacatatgtaactaacctgcacaatgtgcacatgtaccctaaaacttaaagtataataaaaaaaagaaatatattaaaaaaaaaagaaaaaaaaagaatttatatagagagatcatttctctctataaaaatcatgtggaaatccagtcctggcaagtatgaagttgatatttgtaaaaacacgaacataaaattgcctagctgataaggataaaattataatattctccaagtcacaatattctcactgcttgaaaaaaaaagataaaatagtgctgtcatttgacagattaaacagcatgcaataattccttttctccatatagcattgaataagtccttattgagactacttaaaaaatggctatatatatcgtaaaccaaaagtaaacctaggtaagtgtaatagcaaataaaaggttaaaatgggaagtaaaaaaatacaaggcccttagatttgcttagccttgacagaaatactgggaaagagacaattatggcttgccaaatactgatctgttccctgtatttcctggaccctttaggcagggccctgtggcatgtttcagtcaatggtctatgagcaagtgtgtcaggatgcaaccctttctcttctgccttggctatcaaggaactgatttctaatggtgcagctctaagattgtggcccctccatcattgtgagtactgagtgactgtgtggagcagagcccttcctcaagccctgattggtatgtactgtggatgagaaataaacttttatgtgtgaagctaatttaaggattgttgcatttaagaaatatgttgcatcattgcctgtcttagctttgttaatacagtcttgagtaattttatacagcactgtataatttacacagacatttcagatgcatgatcttgtttaaactgacaacatgcttaaagaacattcatttggtccaaaaagcataaaattagaggctgtattgtcgtacattgaagcaatcaaggtttatattaaatacagggaaaactatctaagaatagaggttgttgaagagaagccatgtataaaggatacttagaagaggatttataaattggatgggaaggaagggtaggactagaagaggtggctttgggttgcttctaattcttgagctgccatgggaattgtgaaatgtccattcccaggagagttgcaatacttggtcttggaaggtttgtatggaatttctcagcaaaagcaagtgggctcccactcgtccctactttaaagatggtccagattttaggaagaaatagaataggcttaggctccatacagctgagctgagtttgaactaaaaggtagatcttccactttctgtaccacagcaattaatgaaattcctaatggctttatgtcatggtggtaatgagtttctcagcttttcacattatacagatatttagacatattcttttatcaatgcatatggtataaaagctcattctgactacagaagttatttaaattatctcagagcaaaaaatctttacaagcaataaatctatttatgggaaaaaaaaaccacttctttctaggccctttgtttctcaaatgtaaataaaatgtgaggtgagttttctcccagctcttgggtattaaataaagcattgctgcactggggtttcaactattaatgaaggcattaagtgcttttatgctagataatgtattaagtcttttctcttacaattctcaaaatccagctgtgtaaggactattatcatttgcattttgcagttgaggaaactgaggacaaactgttgataacttactgtgttccaggcattaaatgagataaacagggcatcctcctcatttttcttaccattaagaatccatctaaggaaccaaattaatggcaggctttaatggctaaaacattcattgtaattaatgttactgcacaagtggctctgtgaccacaattaaactgaacaattcaggctgatttgctgtaggacttctccacaaccaaattactttgtacggaactaaaaatgctgttactgatgcggtctcaggctgatcctcagcaaactgaattactcctatttttttcagtctttgattctccagccttttggagacaccatctaaccgaaatgcaagttcattttaacatgtaaagtatcacattgcaaacaatttatagaagaacgtaatgaacaaaaagaatggatgacaagagtttcaaaaacaaacaaaagtctgccattatcaatttactggcccttaatctcataactatgcccttgattaggtagagatgatgtcgtaataggtgcattataagacaatatatcaaaatgttacccagatgcaaataaatttgcagatattaaggcaagaaacttatacaacccttaaaatgcatttattcctttgttttgcatattggcaagaacatgatctgaacataaaagtctcacagcacagtggaccttattttaaccctaaaattagctcaaacaatataactgaatcaaataaaatatgcacaaaaacaacaagatttaagattaagatttaactatgactatgactgtcatcacatcaaatcatcaaagttggcttcaatgatctgatgtaaggggaggatgtccattcttccctcccttaaagttgacataataaaaaataattttcctcccataacactggcttcttctcctgtgtttcctttcctagttaatgacatagccgtgtatccaaccacccaagccagaaacctcaggctcatcattgacttctccctttccttcaaatctaacattgctatcactattgaatataatttagaatgttgccttgctcctcttcatttattcccattgcctgtgctttaatccaggtccttctttatccttgcctatgttattataataatccccaactggtttaccaacctctggtctcagccgcctatgatccatccttcccatcgccattgggataatttctaaatcaccaatatgtctacatcactcctctgctcaaaatccttactatttagagtcccaagttactttacatgatattcaagattccattcacctgaacctaatctatcttaaaaaaattcagtctgcagtttccacgttttaatcccattatgttcattgttcccaaacataacatttacctgttcatctccacacttttgtacatgctcctcctgcttatcattttttctttttctgttttttttctggttattcttcctaatctatttcaaatgtttcttcttatgaaaatacattctgagaatcgacctaatctaaaattaattgttctcctctctcagttctcatagcttttagttcctaccttagattcctcactgtcatcagatttttaccggagctcattatgaatatacttgttttcttcactgagacagtgaagcaattctgtgatgatcaaaggagatctgagtttagggagtcagaataactggggttagttccagttcagtcattgccaaggctcaacagttgtatctataaaatagggatggatagatacctacttcaaaagataaaataaagattaaattaggtaacatcagtgacagcatgatcaacatgtctcatgagcgggatcaagagacatcaaaattaagtagcaggatcatgagctatctgagagtgggatatatctctaattcaactctgtgcctccactgtacccacacatggtatgtgctcaaagaatatttggtgaagaaaataaaaagaatgagataaaattttctactttttaatctaggaaacatagagtaaaacttggtcagacacagtggctcatgcctgtaatcccagtactttgggaggccgaggtggcaggatctctttagcccaaaagtttgagaccagggcaatatggcaaaaccccgtctctaccaaaattaaataaataaataaacaaaattatccagtcatggtagtgtgtgcctatagtcgccccagctactcaggaggctgaggcaaaaccccatctctaccccaaaaaaaaaaaattagccagacatggtggtgtgttccttagtcctagctactcaggaggctgaggtgggaggatcacttgagccttggaggcggaggctgcagtgagctgaggctgcaccattgcactcccacctggaagacagagtgagctccctgtctcaaaacaaacaaacaaacaaacaaacaaacaaacacaaaaaccaaaactggcttatagaataaaaataaactctacaattgtaagaatatttgacctttcaaaatactgacattcttatgcctatctttacaacatcttaagaaggccaatattatcatcttccttttgcatctgaagagactgaggcataggacaattaagtggcttgtttaggatcccaaagtcaggcaagagagagtcatggtctgatgctccctattttagtctacaggactaggttgcctggttgatttgctatttgctccggggtgggaattaatttacatctcaaaatcatttcagaggatatgtgttttgcatgggcaagatggcacaggtttaattctgcatttccgagaagggaaaaaaaatgagatcaactgttactggaatacttttctcagctccacgcatgttctgtctgtcctctttggctgttctttcagagaagttatcatcgtctactcattcccagcaaaacgtttcagaaactcctgagcaccatcttaaagtgaaagatgggacaacaaaccccaagcacatatttcagttttacaatatttaatagcttctcatttcagtcagaatatggctgcttattggaaaagtttaggctaatgacagtgtagtagaaagagtctggatttttaagtcaaaatggttctaatactgctggccgtgtgatcttcaaacattgatttcctctgtcccagctttagggttgctcatctgcatttggattcaagagtactttcccagcaggttattttgaggctaaatgaggtaatatactgatagagaccctttaatactagctacttaataaactttagatcttcatatacactaaagctcattattaggatctttgggagtcatatattaaatgtaaatgaattattcaggcagaactttctctaaaatagatgttacgcttcactgctttagcaaacagagtatactgaacataatttaaattcttctgaagtctcatgactatcattcaacatgtcatttttggtactgtgtatcatgcagtagtatcttcaaggctactgaggtgtataaagctgtctgcccctgccctaaatctgccacacatttaaatcctgcggccttacctccagctggctttcatctgccccatattctccagtcccattgcttaggcctagtttagggcctcacaatttctagcttggattgctgcagcagccaaacaggttcccctatttcctattcctattctcagcatccccaagtccttccttggcacttagcaagagtagtttttccaaaaccacatctgagtacttgacatgcttgcttaataaacaaaacaattctttcaatggctctctatgaactacagccttaagtccaaattcagcatggaaggtatgtaaatacctctgtgagctcaccttatcacctctcggacttccccttccctcatgcctaacccctccagaggagagtaggcttctgtcatgctgaaccaggtcttgcatgatagattcctgagggccttaggctatttcacacctccttgcttttgcttatccagcttcctctgattggaaaactgttacgtctgattggacaactatctatcgcctccctccctatcattggttttctaataaacacttaccaatccttcaaaagatccaaaaagcatcttaggttttaggaaacccatcttgcccttcctttgtcaattccctgactaggagtgaccacttacccctttctttgtgacaccatggggcactgaatagctcttcataacagcgtaatactgtggaattacctgtgtaactcccaccgccactagacattgtgttttttgaggacaagatcctgtgtcatttatcaagccccaaccacagggcaggcactctataatcactggttagtatctttttgagtcctactagttctctctttctctcttgctctcattatcctatctgtaacctacagtgagttgaaaagcagtattagtagtttggaagaactaaactaatgttaaataggttttgcatgaggggctgtagagatatctttgaattaagttcatgagcttggaaaatctatatttctaggaacatttattttggctactgattagttcttaatagtgttttgatccttgagattgttagataaattgcctacagataagctgagtgtaatctgatgtgattgacatttattgaaaccctccctaatgtcccaggttctgggccagaaactgagaacataaaggcatggtcaacaaggcatttaagaggctcatgtatacgtctatgccagttaaaataagctcatgatagagagattattcacacacacatcctatttttttcaaagatgaggaaaagatgagttcacacagctagctatagggtgtgtgtgtgtgtgtgtgtgtgtgtgtgtgtatgacattcaattccaggtctgtgtgaatccagctgagctctccattttactctttcctgttcctattggaaccagcctgtgaagacaagaatgcaatgtttctcttgagaaattttatacatctccttttctgctatcacaacttaaagtccattcctgaatataaaaaattgaatcacaaaatttggcagcctgtatttaatgggacttttagaaaacttgtttgatgctgtggattactatcgtagctacatacagtcaaggcagacaggaagagagagagggtagtgtctgagtgccaaaagtcatccatgttcttagtctagcaatagcaaatacacggccctcctgtacagagagatgtgcagactggggcctctgccctggggtgcattactgcccacacaccaatctcagaagcaatgactatctctgaaaactcctacctttcctaaagcctgagcacatgttcagtcacctcagtgaaagtgaaggagggaggaagggtattagtttagtcttgtcaaacatgggctataacagaggctgcaaacagactttgcctcacatgccaaagcagatggtgtgatagaggctgttgagaaagcttctgaagttgtctctggactcagtgggaagaatgccgagtgcaatgataaacaatgtctgttctggtattgagggaagcattgcctataggtatttactatccttggtagaagtttcagttgtcatttagcataagccaggctgtgctattacttagtgtagaagttctgaactcaactaagagcatgcaatgatagagtaagatacaatctataatacctgtcaaatctggcacatagcagatgctcaataaatgtttactgaagaaatgaatgcaaagtcctatggctttatgttggaagagaaatagagttcttcccctcataatcaggggaagtggggtacactgagattactttgccaagggtcctcaatgccatgccgaagagttgggggcattattctatatgggctagtagtttccaaacttagtttaattccctaaggtgttctgtatgtagaattcctgtgatgtatgtagctaccctgtgatgttctgacttggtaagttggtaagtgtggggatggagccaacgattctctttttgtttgaaccacctgttagcttctcaaacaacttgtataatcagccaaatatgagaattacagctgcaaagtaatatgtgatgttctttttttttttttttttttttgacaaggtctcactctgtcgcccaagctggagtgcagtggtgcgatctcggctcaatgcaacctctgcctcccaggcttaaaccattcttccacctcggcctcccatgtagctgggactacaggcacatgccaacatgccaagctaatttttgtatatatttctttctttttttttttggtagagatagggtttcagcctgggctgatctcgaactcctgggctcaagtgatctgccggcctcggcctcccaaagtgctggggttacaggcgtgaggcacagggctcagccgtcaatgaagttcttaaggagaagaacaacttgctgtgatcacagatctttgcttctggttctccaagttcttagtgttttctgcttattgagaccagaacgaaccctgctttgtagagacagacctaccagactgtgtcctggtgaatcagactccagctcccaaagcactttgccacagacccctcttcctcaggaagaaggatgaagattgagcacttttgcaaagcaaccaagagagtaatgtgctgcagtgggaataaatcatggacagaggaaatgaatgaaccacatgtttctggatttcaaatatcacttctggaaatgagcgagtctttctgctttctgatttcaattaattttcttacaaactctccctagcatttttcattgcagtcaattatttaacttgttccagtatgaaaattgggtccttacaaaacacttaattgatttgacccgtgctctgacacaacactttgcaaaatgcatgtgcgttcatacagattagtcatctgagtcattattttccagcaaattacagcaccatgccggcagtggatggcacctaatattgtgaaaatatgaacttcttattcttgtggagagttacaacaaagaaagggtggttggaagtccaataaggacatcatttgtcctaagactttgactaggagtctattcatctctaacactgcctccctgcaggagaaaacgttaaaccaagaaagagattggggcagaatggagagaatggggcctgggcccggcagactgaatctgaatttcagagcagctccttggccatgtttcagtcttagaactggacaaaatttttttttagctgttttgattcacagcacacctctgtgtaaatttggatacattcttacctgcctcatagtggtatagtgaagaacagaaaaaatgaagagagaacctgaatatagtaagtgctcaggaaatggtgacaaggatgtgatattgctgacaaaattagtttatcattttttattccaattttacttatttataattcagtctcacctatttatagaacaaactgaggcaatatgatcacattttaaagagcattcttattattttccttcatgattctattttctatatccatacactcagtctaggcctatgctttaccatctttttttgttttagggataaaacccagtgactgtgtgtgtgtgtgtatgtgtgtgcatgtgtgtgtatgtgtgtgtatgtgtgttcgtgtgtgtgtgaatgaatgcatacaagtgatggtagtgggagagagatagatcgcatattcaataaatcatataaaatctctgcacaattttttaaaaataaaatagtattatacaccgatcaccacgacaaagaatattaacagtgacttagattccctcaggatgccattttttatataatttccttcctaagtactcttcttccataagtaactctcctgaaattagggtaaatcatcctctaactatctttctttttttggcccatccatgttgatgtatataacagttcttcattcattctcacagttatattcattgtataaatataactcatacatccatcttacattgttatctttagattttattaacagtatcagtatatatattgttatacatgtcttctatccctgtatacaaattttccctaaggtacatgcttaaagaaaggagtcgctgagtaatatttttaattttattaaataatgttaaactgttttccaaagtagttcttccagttgacacagtggatgagaattctaacagtttcatatcctctctaacacttgaatcaactggacttcataatttttatcagtttagtaaatgtgagtggtgccttattgcagtttaacttgtaattccttgattatcaatgattttaagcatgttttcatatgttaataagtaatttgtgttttttcctctttgttttaaaagtccttacccattttctatagggctgtttgaatctttctgattgctttatagttctccatgtatagtattctagaagtgattttttaccagctatgcaagttgcaaatatctgttctcttttattttcaattcatgtcacatttcacctcagaaaagtcagatataagatcccaaaggtttttatttctctaaactgctggtatgagtagctaaaaatatagatagatttcaaaataaataattcattactgtggtttagcagaaatatattcatgaatatctttgctcaagcttgcagaaagtgctgaaaagctaattaaactaaactaaactaaactaaattaaaaacaaaaagacagcactgtgatgatgaaggctttcatgccaagactccaaatatactagaaaaatttatcttcagcagtttactatattcacaatgacaatgcttcaaactgcttcctttattcataagagattccacctatttcaagtgtgtttatcatccagccagcacaggcaaatgttaccaagttaagattgaatttcaagtgtgttcttggaataaaacttctgagaatatatttttctttaatacaattctcttggagtcatatttttggtcaactcatctttgggtttttgaggaactgaatatcctcacctgcttttttctgaaacaagtgtttctgggagctgaaaaatacactttgtcaaatttcagggttttttagggtagtgaaagtactccatacgatactataataatggatacatgtcattatacatttgtctaaagccatgtattgttcaataccaagagaaaaacctaatgtgaaaccatagactttgggtgataatgatgtgtcaatgcaggttcatcaaccgtaacacatgtgccactcaggtgtggaattttgataatgggggtggctacacatgtgtgggggcagggtatatggaaatctctgtaccttcctctcaattttgctgtgaacctaaaactgctttaaaaaaagaaaatctataagacaaaaactaatttaaaattttgttttaaattcaaagggtgttaaatgaaatttatgggaggctattgtttggactaagctcctgcactaggcccaacaggccagagcaaatcagaatagagtcattaatgttaggtgccatataatcaaactttgaaatggaccagttttcaaagacagagagagagagagagagagagagagagagattgattgattcacagcaaccaatcagaaggggcccagtttaacagagccagaaggataaggaagtttcctctgatttaaccctatgaggaggacagctttaaaatgcccaattcaattttgtttcccatttctgctttcttgagccattttctgcctataaagccaatctcctctcctcagctcactggagtgccttatctaagtctttggatgagatgctgcctgattcatgaatgaaagccaattcaatctttaaatcaaattggttaaaattttgtgttttctaacaggggaaatgagctttttacgacccactcggcaatggtatttaataacgtggagaaaaaaacaaaacacgtaagcaagcaagcaaagaaataaacataaatgtcccaactaatttctaaagcagtgggaccagggaaataactccagaagagacaacagtggtaacagcaacaacgattgattactaagtgccacataatattctgaagagctttaccagaataagcttagttaatcttcataagaaccctatgggataagaactggttttatactcactttaaatatgaagtaactgagactcgaagagtttaaaaacttattcaaggtcatgcagcaagttaaaggtgcagctgcttcctgcagttcttactttctatattatcagctatgttctaaaggactgcaaaagccaggtttgtgaatggaacacagaacaatacatgcaagagtacttgcagtgttccactattgtccacaaatgtgagaacttcatacttcttccatttcatggcagtcagcagtcagcatttttctgctatcaagccatgaaaggtagcaataaaaacattagtatctcataatgcatagcatttaccgctctaaactgtcgctgtgatttacttatctgtgacttgagatactaggagaagggaacatacatttgttgagtgacttcactatactagttgttatgctactttttagactcattccacagagtcatcggtgattctttggtgtttaactccttttcaagaaagggaggagctgctacttaaaaacataaattatcttttcatacttaaaagatttacacaaacttgagatccacagaggatttaagctcttaggaaccagaggttaaaaggtagtcagtatacactactatacatactagcatatatgctaatatatgctaacatttatagaatatatgtatatatactatagttgtagtcagtaaagaaattttaaaacacaacataatgaacaaaaacaattagctaatctgtatctatgtatctaaatccgtaggcatttattgttttattaagagtgaggaaaccttagatgggtgcagccagaagctaaaaacaatcttatcatagtgaaagatgcatcagaggtactgaaagcctttaacatctccactagtatttctcatcatctttgaaatcagaaaaaacaattttgcttccctttaggaacgtcagcccatacagttgtcagggtcttcacggagttgacctctgtttaaaggaatagagctactgctacttgaaaacatacgttagtgtttgttaaaaaaaaaaaaggccgggcgcggtagctcacgcctgtaatcccagcactttgggaggctgaggcgggcggatcacgaggtcaggagatcaagaccatcctggctaatacattgaaaccccgtctctactaaaaacacaaaaaattaaccgggcatggtggcgggcgcctgtggtcccagctgctcaggaggctgaggcaggagaatggcatgaacccgggaggcggagcttgcagtgagcagagatcgcgccactgcactccagcctgggcgacagagagagactccgtctcaaaaaaagaaaaagaaaaagaaaaaaaaattcagctgaattaaatttaaaggagtttaattgagcaatgaacgattcgcaaatcgggcagcctcctgagacacagcgggctcagagactctagcgcagccacatggtggcataagatttacagacaggaaaaggaaagtgacatacagaaaacagaagtgaggtacagtaacagctggattggttacagttggtgtttgctttatttgaacacggtttggatagttggctgcatttgattggccaaaactccatgattggcacaagtgtaggctatggtctgtttacacctccacttgttatagttcacgatgtacagagaaacctttaggccaaacttaaaatatgtaaggaggcagctgtaggctaaacttaatttaacatgtttaaatctcatactctcaattcacagaagaaccgtctcagttaatgtattcatgaaatattgtctatgggcactatggtggggtctgttagttgtctcccagtacccactgtccccgctgttctcttttagtaacaggactcctcccgtccatccacgacagagtcttagcaaggcacatggacacttactacatttcctacaactactattagcaaatggtttagcaatttatttaaagtatttgattataacccaacaatttcactcctggatatacccaaaacaaatgaatgcatcttttaaaaaagatttcttcaagaaagtctgtagcaactctattcataagagccacaaactggaaataatccaagtatccttcaacagaagaatggataaacaaattgtattatattcatgtaatggaataatacataaagtaataaaaagcagcagactactcaaatacaaaacaatatggatggctcttataaatatcatgttgagccaaggaagccagacatgaaagaacaaagactgcaagtctaaatttacatggagtttaagaataggccagggctaatctatggtataaaattcagaatagtagttatttctcagggtaggggacaaggtctaggattgactgaaatggggcatgaggacgtcttacggggtgttagaaagttctgtatcttgacctgggtggtgactacatatacatgcttttattaaaatccattgatccatgcatttcagtgtatatacagatgctccttgattttggatggattgtgtccaaataaacccactgtaagttgaaaatatcagtaagtcaaaaatgcatttaatacacctaacgtaccaaacatcatagcttagcctagcctacattaaatgtacttaaattagcctacagtgggcaaaatcatctaacaatgaagcttgatttatagtataggttgagtattcctcatctgaaatgcttggggccagtaatgttttagatttcaattttttttttttttagattttgaaatatgtactttaaaaaatctgaaattcaaattactccacaatgagcatttcccttttcatgttagcacccaaaaagttttggattttggaacatttcagattttggattttcagatttgggatgctcaacctgtaaaatgttgattatctcatgtaatttgttgaatactgtactgaaagtgaaaaacagaatggttttatgagtacttaaactacaatttctggtaaacatgtatcatttttgcactattgaaaagttgaaaaatcctatgtcaagccatcataaatcaggagcaatccataattatacttcagataaataaatcaggacacacacacacacacgcacacacacagagagagagagagagaaagagagagagagatccttcagatactacagctggttctaatataaaagctaaaagcagagttgattatgctatttgttggggcagcaggctaatgaatgaactgctttatttcatttttagctctatcattataatttaaaatccaacaaactatggtggatttctattacacagccaccattttgaaccctctgctgtccaagaacctttctagccaaccaaatgatagcaagccgtcagcacattcaaacagaagcccccctttaaagtaaaatactaggctgaatcatatgaaaccttgatagtttcatatggtttaacctaatatttacatcaaatcataggatgaattaaatcagagatgaaagtgaccaaaaaggagatggcaagaagaagagtacttcccttggttcgacttatttcattatgggcacaaatggcctacaaattgaaataaacttagaagatttcctaagccaggcaatcttttaaccctagacatgcccttctataccaacatacaggcttcagagacctgagataaccatttccagccttgtagccaacctgccccagcagggcttcatatgctgtcatattcttggtccaacaggtttagtgctaatgagaaatctggctctgtgctcctttctggctccaagcacaactagggcagatggaggagccctgagagctggaaatgacagaattttgaaatttcccattaagctggcttgagttttagttacaatgtacacaaagtaggagaatctgattttacgagattatctaacaattgattttaaacccaaaaacgaaaatgtatttcccattattgacaacaacctaggagtgtataagggcatgtgtgggatctttgcatgcatcctcccttctccccactctcatccttaatctctctgccaaccttggagttgaaataacctgaaatttgaaattcatgacatataatccctttctatttccaagcaaaaaaaaccctgctggaaaagtttgctcctaaactagccatgttggagccctatcgttttctactgaatttttcttattaattcagaattatgtcctcatgtaaaatagaatttgcctttcttgggcaaaggcagccacatagatacaggttggatatcactctctctgtaggacatgtggtcaagttttaaatacttggtacttggatttaaatgcttgtccttttgggaaagctgagaattattttcatactatgaaattttgacagtgtaaccccagggtctcaacactcctcaaacatcacactaggtaaaaatattgaaatgctactggtaagaatgtccccttttcatgtccagtgtttatatttactacaaatactaggtctctaagacctgggctcctgtactatgcagcgtccccaagaccatgactaaaaccgagcgtgagagtcagtggatgtcggacaggaagggatcccagagtttacctcttcctatctatgtggtttacgtgaaaaacatctaaaagccagaaatggaagtaattggcacaaggctgcccagctaacaagaggggcaccacaactcaaagctaggtccatggtgctgcacgaatctgtatcagtgtgggaaaaaggaatgtttcgacttgtgagacatgattgaaaacagagcaaaagggaaacagtaagctaattaaacatctgtggaaccctgtgatttgacgagaagtaaacaaagcaaagagggaaaagaagggaactttagggactggcagtatagcaaccaactatcgaacagacagggtaacagatctgtggtaaccataatggaggtaatatttattaagcacattcaatctgcctagaagtgtgtcaagcaatttaatgcatcatctcatttaatcctcacaactatgcaatgaggtaataataataataataataaataatgactaccatttattgagcatcttttacatatagactgaacactatgctaagcatattataaatagtatctgattttatttatacaacatgattatgaggttggtactcttgttatccacaatagaaagaggagaaaactgagacttagagaaaacaacattttccagatcacacaaccggtaaacagaagaaacaaattaaaacccacatcattttatcaaagaacctaatcttttaaatgcatcattttatcaaagaacctcatcttttaaatggatcactattctggctctcaagtacaggttgcttaaaaattaacacaaaaacattatttatcaatactcatggtcttttattttccacaaaaaaaatcagatctaaaataaaagtcagtattttacaaagaatagtctaattgtctaatctatgttgcaggctggagtgaatcacagttttggcactggatctagaactgttattgtctgtggtgttaaaaaaattatgtgtattaacatgggaaaacaattgcatagcccttttgaacgtaaaaggaaatatgtttaatgcatgtatattgagaaggggggaagggggagagagagagagacagagagaggcaatatgacagaattcaattcactgcttccaggattctgtaggaggccatgctgttcgataatttcagaactataattttaaaatgagtaatcttggtaaccaaatccattagtgaagcatgctatagaaaacaaacatcgtgtgatgactggccctagacaaactgacaagctttgttttttgcttttgaaactccaggcattatttacatacactcagctctaacacaggatcctttaattaagacttttacacttatctgtacataaaaatggaaattatttcaataacagcacatctttttcttttgctaaattgccagttagaaaggaaaattatagaaattcactgaatggtactgaatgattacctctaaaggttaattatgtccccttaaatgggactcacttaactattctcttctttgtccgctgaagcagtaagggactgatactgaactgaaggacgggaacaggggacactgagggcttgttgccaggtggcagctgtcaaggtgatttaatagctattcaaagatcatttctttctgcttttcagttctccaggagccagtttacctttagctgcttttgaagggggggcaactgtttgagcgggagggaagcatgcatttgaagtagcacacaggtataaacatgggtgatagaagtcttatatacttgacctttaccacacacttggagaaatggtgcacattaggcctagactagaggaaagagtttaattttccatttggatccccatggagtgcttaggatcatactttttccaaggcaatttatcactaattcttccatccattatctgtccccaccccctcctcaagggcaggcacagggctaggtgctttacttgcatatacaggcactagagcagagtaacagagttagattttggcttgactattggctttgccacctaagagctgtgtgatttagaacaggcttctcaactctgagccatattttcctaattgtaaaaataggtcaataatgttttatctctcaccgaattggtgtagggattaaataaggttaaatgagaaaatgcctaaaacatagtcagcatctgataaatagtaggcatattaggtaccatcatttccatttcaggtatgagaaaactgaggcttaaaaagataagtgacttgtgcaagatcttaattctagtaatgaacagagataagatctcaccccaggagtatgagaaacatactcctcacagtagcatgcctctcctttaataaactcaccatctagggaggaaaatagtcccttaatcttggaattttctacaaccattataacggaagtgctatgagagtaggtgcagaggtgaaagcctctaggaaggcatggtgcctgaatggagtcttgaaaaaccattaagaaccccataaactgaatgggaaggaggaagagacagtatgcagattgaagaaagggcctgtgcaaaggaaaggagaaatgaaggaacaaagtgcttcctgaggctccatccagggcttttaggggaagcagcagaggagggtgtagaggtaggcagagtccaagttaaaatagtcttctttacctatttggtgatcaagagcagtgggtatgttttaaatagatggagaaactcaagggttaaaatggctggaagcgaatgacacttgaatcttttccattttcacgtggaaacagaacatccctcccaccaggcaggctggcctaatgtttccatgccaaccaattgcagaggcctgggataggctaagcctaagtcaggggagtggcatgggtaaacaagaacacagaggggaaaagctagggttagggtcaaactatggaggcaggcagcaaggggagtgaggagcagtgtactatggagtcgggaagactggagcagtaagaaccagaaccagaaatgaggattgggtaaacctagttgtacctgaatttactgcaagcccagtcattgctatatacacatgtgcacacacacatatgcgcacactcaaactattaatatgttctttggcgctcagctgcactctgaacattttcaaagggacctcatgaaaattaagaatttctaatcagttcatttcatcactggaaatcaaaatgtaaatgtgagaactctgattttcaagaaatcttaccaaccttttcaatctgttttacaaagttatttatttttgaaacagggggttctatttttgctgagtgttagcaaattgtagcatcagattcaaggttggtttccaaattctgagtcaactaatgttaaatgtgattaaaattgaaagtcattttaggaactggccttctcattagctagctgcaggtttgcactagacttccatgcaagaaatctgagactttaaagaaatgattattttcagcttaaacatgagctgaggaagtaaaggtaatttttttaaaaagaaaagaaaccaaaaaaagaaagaaaagataaaatagtggttctcagatttgctgcatactgggatcactagcaaagctttaaaaacactaatgcctggggacccactcccagagattctgatttagagtaggtctgggctggggtgagacatcaaggttttgaagagctctacaggtgcttcttacctcgagctaaggttgagatacaatgagataaagcagagaggcagctagtaaacaaggcgatttttggcccctccctggaaagaaagccagtgtgaacttgatgaagtaggaaagaggctgagacctgatttacaatggcagtggctccctgctcttgatcaatgtgagttccaaattcagtgtagggtggggaggtggagttggaggttcttttattattggtccctccactacactgggagtaccctaaagcaaggactgagtacttttatccttgtattccttggacatgtctaactgtctgcaatatgggatatcaacagttgtttgtaaaacgaatgaatgaaaaagtttgaggtcgagtatgtgaaatgaatgttacagagactcaatttttaccagatttctttcttagcacattcaagaagtcatgcgcatgggcaactgcagcgtgctttaatagaaaaaaataataaacaagctgggagcgatagatcatgcctataatctcggcactttgggaggcggaggtgggtggattgcttgcacccaggaatttgcaaccagcctgggcaacatggccaaactccatccctacaaaaaatacaaaaattagccaagcctggtggtgcatacctgtagttgcagctagtagggaggctgaggtgggaagatcacctgagcctggggaggttgaggctgcagtgagccgtgatcacaccactgcactccagcctgggcaacagagcaagaccctgtctcaacaacaacaacaaaccaaccagatgccgtctttaatttcagtgaacttaacaaatatttatgcaactttctgtttgggttctgtgctagatccttagaaccacagactgatacttccagcaaaagattaagttctagaatcctatctaattagtccaatattttaagaagtacttgtttttcaatggcatagcacagctgatttgctttgggtggcttaaaaagggtagcaagtggtattctggatggagctagggcagatcattcagcatttctttgtgttttcaacagcgtttcatgtaagcaaatttctaaaagcagtgtttcccaaacttccttttacctaagcagcacctggggttcttgcttatatcttcatttctgaggaatattcattaccaggcaagtttaggaagcaccattacagagggtctgcaagtcttcagaatatcttattctgcatcgaagtcctgactgcagcattattacaggtgaaatgatgaaggtggaattgggagaagggaaggaaacaggaaatgacaaataacagggctatgttgtgacaggcactttacaaggcaattgacattactgttggctataatacttgcaacaacgctttattaaaatgaatactgttattcctattctagcaacatgacccaagggtcataatcgctcttggcttccatcatcatgggttcattttgcctgttcttgaatgttatataaatcatattgtggtgggcagaataacaccccctcatccctaatccctggaatctgtaatatgttcccttacataacaaaagagactttgcagatgtgattaaggttaagaaacttgaaatgtggagattatcctggattatccttcgtggatccaatctaatcacatcaatccttaaaagcagagtatcttttgcaagtgggtcagagagatacgccatgagaagcactcaacttgcaattgttgattctgaagatggaagaagggggccacgagccatggaatgcagcagcctctagaagaggatggccctaggctgacaggagcaagataacagggactttggtcttacaactgcgtggaattgaattcagccaacaattcaaataaacttccagaaagaaacacagcctgctgataccttgactttaatctggtgagacccatagtggacatctgatatacaaaattgtaagatgataattacgtttttttaagccattaaatttgtggtgatttgtttctacagcagcctagaaaactaatatgcatatagtagtgtgtatgtgtgtgtgtgtgtctggcttattgtacttaatataatatttgcaagattcctatctgctattattgattttcattgttgtatattatccttttgttcaaatatgccataatttatttacctattctattgttgatggacatttggttattcccaggtttaggctattacaaacaatgctgccatgcacatccctgtatatatttttgttgaacacatgtactcattactattgggtatatacctagggatagatcatagggtatatgtttggctctgatagatactgacaaaaaatcttccaatgtggtggtttacttcccatgagcaatgtttgagactctctacatgttcacaaacacttggtatgaacagtctttaattttagccattctgggagtaccaccatttcatgtgaattgaccgttttacatatcctcttttaagaaatgcctgttcaagtcttttgtccattaaaaaaaaatgttttttttttctcaaagacttgtagctgctctttacatattctgaagataaatttcttttccagatgtctggattacaaatatcttttcctgtgctctgtcttgccccattctcttcatggtgtctttagatgaacagaggtttgtattttaatgtagttcatcaatattttcctttgtgattagtatgctttgtgcctgtttaatacttaatctttgcctatcacacacttaggaagttatttttcaatattatcttctagacttttattgttttacattttatatttttatctataatccatgtagaaagatttttgtgtatagtgtgaggttgggtcaagagccatttttaaaaaagttggatatccaattgatgcagtgtcatttactaaaaagatcatccttttccacttcagagcaattttacttttgtcataaaatcaagaggttgtatgtgtgtgttattgtttctgcactctatattattccattggtctacttgtctacacttataccaatttcatactgcctgtaattatgtaacctcataataaatcctaacatcatataatgtaaattctctgacttcatttttctgtgttttgcctattgttggtcttttatatttccatattaatattagaatcactttgtctaatctatcaccatcaccaacaaataaataaaaaatatcttctgagatgttgataggaattgcagtgaatcaatatatcagtttgggagaaatgaaatctttgccacattgcatcttcctattcatgaataaggtataccccacatttatgcatcttcctttaataacatttgtggcttttttgtatagtggtgctcttttgtcagttctattcctatgactttaatgtttttcactcctactgtcaatgatatgtttagttttcttattgtttagtattgttatatggaaatacaactgattactttgatattaaccttgttatttagtaaaattgctaaagttactttttaattatagcagtctatctagttattttgaattttaaacatacagaattatgttaccagaaaataaggatcattttattgttttccttccaatcatcttactttttcttgcacctccccttaatagcagtagtgatagaagggtagagtagtgatagaaggtgtctcatacctgtttccagggaaaaagcttccaaaatttcattactaagtatggtgtttaggctggctccctggctcacacctgtaatcccagcactttgggaggatcacttgtggccaggagttagaacagcctgaccaacatggtgaaactccatctctactaaaaatacaaaaattagccaagcatggtggtgcatggctatagtcccaggtactcaggaggctaaagcatgaaaatcacttgactaggggaggcagaggttgcagtgagccaagatcttggcactacattccagactgtgtgatggagtgagactctgtctcaaaaaaaagtacaatgtttgccttttattagatttaggaagcccattatttttcacgttttctaagaacttttgttcacagatgagttttgaattttattgaatggttttcctgtaatatttagatgatcatctgaatcttatcttttattctgttaatgtgattttctaatgttaaagcgttctttcatttctgtaataaattccagcaggtcatgataatattattctttctgttttgggaaatacagtcatctaatatataaaatatatcactagatataaaatatatatcactagatttattttgctaatatttgatatgtttaatttgatgtttatgagagagattggagtataaatttcctttcttacaatgaccttgttatgttttggtatcacggtgatgttaacattgtaaaaagctaggaagtaccctctcttttctaatttctgaaatagtttgtataagacgctaggtgatttacaaacgttattcctcataaactttaaatgagtatttctattatacccattttatggaaaaagcggaggcctagagggagaagaattatgttactgaggtcataagaaaggtactaagtggccaagccaggatttaaggccaggtatttctgactccagaacccaagcttttggcctactctactctgctgtgaactcataaatgcatggctgattgagttagaattctacaggacttatcatttcattctatggtagtgtatacctcctatggaggggaaatatactgccaaagataacaacaacaacaaaaatacagctttgcttttggaacctactacaagagactccatcatagttagcttctcaaatctcccctatttcctaccctctgcataggtgtcagatcctggagcagaatttgtgttcacaataatagcttattattttcctctgtttttttgcaactaacttcagctggatcctcaaagacatgtctgattcatctttttacccctgacagcatcctatgtagtattttataattaatactcactgaagaaaaacttaaacccgtatccattccatcatacttgctctaaggcagtcagaagatcctgcaatcgtcttatcctctgtgtagcatcctgtagcaggaaacctcatgcctctttgctaaggatgcatcatcaacgaatgcatcccatggtttacatctgaactagtataacttcatgtcaaagatctactcactgaccatctttaacgtcctcatttattactgagggagttgcactatatattagatgactatatttcccaaaacttatagaacttgctttaacaattttaagtacctacaggaatgagagagcatatatgaaatcaaatacatctaagaaaatgtggtatttctagaagccatggaaattaaggttaagagccggtatttggcataggacagaattgagtttttatcatgttgtccttctttgctgtgtaaatatgggtgataacttcagctatctaaccttggtttcattaactgtaaaatgggaatagtaatgatgctccctcatagatactgtgagaattaaatgttcactgccagctcctcatcctcaggatacttgaatctatcatgtaatcaagggctcataagaggatttgagtgtgttgtggaggtggaagtatcatggaggcccccatttatgaggaaaggggcaggaacacagaattttaggaaaagagaaaagttatcttatgaacagccagcaatggtgttcattcagcataggccttttaggtggagaaactccccactcatctggatttacagcaaccagaaacacaagcagagaccccttcctgatgattgcctaggaaccctcattaacagaaaaagtaagatgacactggctccaaagaagccactggaactagtaaagaggtttgtctacagtaagagctacaaagttaatttaaatgagaattagattttcatgttagagggcattagaagctattaaataccctgtttgttgcaaacttatactcaattcacaccacattttctcattatgttacctgtggaatcagataattgtatgttttttcatatatataaaagtatggaatcctgagtttgaaaggacatgtctgccttttaagacaattaaggggaaaaagtacatgaggtaagcaatctggtttgaaacaatgtagaatatacaatgttataaaatacaatgaaagatactataatgtgatgatatctttaaaaaaaatctgtttttttaaacacacaaaattgtatgtataaaacgtgtaactttttgcatatcaattatatctcaataaagctgtcaaaaagtgggtctgttttaaaatgtagaaagaatgacaactttaaaaatgaaaaataattttgatgatgaaagattcctttttatcttttaataagtatcactgaaaagcatcagcttatcacagaagatgggtctgggcttattatttattgagaaaatggcataaaagatgaagaaagcatacgtacacaaagaaaaagaaaatctaaaagacgtctttctttgtcaagaaaaggacaaagttaaaaaaatgcattcctcctgtaatcccagcactttggaaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccaggaggcggagcttgcagtgagccgagatcccgccactgcactccagcctgggcgacagagcgagactccgtctcaaaaaaaaaaaaaaaaaaaaaaaaatgcattcctaaggatcttagaatgatttagatccaaaatactcaagattaagaattaaacaacttagtcatcatgatgcttactttaatttttttagctataaggtaagattatatggatagaaaaaatatggagatctatctagtgaggttttaaaactacaaatttataatatttggaggactttttctgatgctcagattatgttcataagtttcttctggcattaaaatgccctctcttctagaaaatgatggcaatattaaagagcaaccaattcaaatatatattataatttgcctttttgtttattatttttagaattcttacttggtgcaatttagttgtcaattccctatcaacgccatgattttttttttcttaattgtaatgttgccagtcaggggaatttacaaatcttgcaccctctgaattttggcaatgacatatgggaaggacacaagcatccaaccggtctcactgtttttcaaagtcatctgaggcacttttatgcattttctttaaaacttaggcctgaagagaagggccaagaggcagaaacttttgcagaacaagaagaccaaagtgtcctgcaggtgctaaataaatgtgaaatgatgctacttagcttttgaaagatttgctttagtgaagacagatgactcaaagtggccccttgacagtttagggcaagtgggaatgtagtttctcaagcaggaagatggctggaagaaaatgtttctacatatcataaaagcaggcatatgcttaatttgtaaaaaatactcttttagaaaaagaataaggcctggatccttgaaaatgttcccagtgctgattttgtgtttcttacctctactatactacatattaaggaaaataatcatgcttttagttttgaattaaatgtcctaagtcgggggtcaacaggaatggcttcatgggtatgagacctgtgttcccccgtcccacacctggcattatgctctgctctcactgtcttgctactaattttttattttgattgactgattgattgagacagagtcttgctctgtcacccaggctggagttcagtggcaagatctcagctcactgcaacctccacctccatggctcaagcgattctcctgccttagcctcccgagtagctgggattacaggtgcctgccaccatgccaggctaatttttgtgttgttttgttttgtttttggtagagatggggtttcaccatgttgcccaggctggtcttgaactcttgacctcaagttatctgcccaccccagcctcccaaagtgctgcgattacaggtgtgagccaccatgcccggctttgctattaatttgtgaacaagaattgagcattttcattttgcaccgggcccctgcaaattatgtagcaggtcctgggcaacccattgtgtgataggcacttcaactgtgctctttaatgtgggaattcataggcatagagctatgctggctgtagaatctatcctggaacaagagaggcagggacctggctcatacaactgtaatgatcacaactcattagggactctctcaatttaatcacaaatccatatgctctgggcatcttcaaactcaactgtccattcgacatttaaatttttgatgtaggcatttagtgctataaactttccttttaacactgcttttgttgcatcccagagatttttgtatattgtatttctgatttcatttatttcaaatatttttttatttctgccttaattttgctgtttacccaaaagccattcaggagcaagttgtttaatttccatgtaatcatgtagttttgagagatcttcctggtagtaattactatttttattccactgtggtctgaaagtatggttggtaagatctcaattttttttgaatttattgagaatcactttatggctgaacttgtggttaatcttataatatgttccatatgcatatcagaagaatgtatatcctgtgtttgatgggtggagtattctgtagatgtccaattggttcagtcacattgaagtcaagaattaaatttaagtcaaatttaagtccagaatttctttgttagtttttctgtgtctatgatctaaagctgtcaatggggtgttgaagtctccaactattattgcgtgactaagtcttttcataggtctagaaggttttatgagtccgggtgctccaatgttgggtgtgtatatatttaagatagttaagtcttcttgttgaattgaactcttaatcattgtgtactatccttctttatctttttttttctgttgttggtttaaagtctattttatttgatataagaatagtgactctggttaaataatttttgaaaatttaatctgagatgattaccaaatagggttccatattaatttgattaacaaggggcaaggagcctagtcagtaaaccatttgcaagccatgacataattaggtaaaatattaaatacagttaaactctctccaatttggtgacatctgtaatccattcattttaattgattcagcagttactatatgccagactgtccggaagcagaatttaaggagatgaaatctccatcttcgagatactcacagtccaatggagggagcaggtgagtcaacagacaggaaagagcacgtgaagcctggaggagagctgttctgtgtgtggtccacaggaaaacagaggagcatgtgcttgactccagcaatcattggtggctctcttaataccactttctatttaatcatcatctttaactgctaatcaaaaagttcattccacaagtatttaaagttaatttaaagaagtgtcagacactgttcaaacactgagacttaaggacaagtgatttctgtctatttccttgttcccttgaaactaacctaacctacatgattggcagttgggcagggggaagagggaagctccctcaattttttcatgccctcccctctcacctatcctcctgtgagcattctgtgtcttactttttactattctgttctcctttttagctagagctgtctagtttgttctagaaagtagtcattttgggttatgaggcaaagtacctcctgcggagatgagagatttctggaaatatgattaccatgggattagtggagaggtaagcagaatctaggttgtaggaatgatctgtgggctccttaatggcagaaaagaagttttattaatctttttatttccagagtctagcagagtgtgaggtagaggtctgtggctcagaagaggttttctggatgaatcaattaatgacaggccaaccattaacagtaatgagatctggattctagaccttgaagtagaagaatggaggaaaacgtgatggtcaatggaagagtcacttatgatacttttgttcctcttcctacagaaatataaaaattaaaaaccttttaaaatcaggtagcctatgattgcaggggaaagaggaaactcccagatccacaatgactcctccttctttctatttctggcataaaattagctgcctaaagacaaagccttttattccacaattaaggatacaactaaaaatgcaaatccctgaaagagtaagcattatgctaatgggtctcaaaatataaatgaagaatcaaaatctattctgctttaaagaaggcaccagtttaggaggcaggctctaagtacttgaagcaataaaaggaactcccctttgcctaacaagtcccatatagcagcctccttcatacattcagtttaacgtcatcctaacaacaagcctgtgaactaggtactatgtccattttataaatgtgacactcaagttttagcaaacaataagctatgcacgactatcattatccataacgataagttatgaattctggatgagaagccagatctacttggaggaaatcagtacaaagtataaaacagaagttatataatcaataggaatttaaccagtgccttgacaagtctagactctgtccagacttcctgcttcatcctgttaaactgtttcaggtacctgatcatgttcccctcccagttacctttgcccccactaagtttttaagagagaaaagtaattctgaattcaagaagtttctatttcctattctgctgcaacatatcatagtcaatatgtttctaagtgaataactaatgatcttgctaaataagaattatgaggaaatgaatgtgtgcaataaaaataccactgtcagctagccctgtgccaagtactgggcaggggggtgcacacagctaactgtggcatgttctctgggaaacagccaacatgttgggtccaagattggaggggaagaagacaaaaatgtgacttataacacagtccacggattttatggctttgccttaaatgttctcaagaaatccatcgccaagtgaagctggaagcagcttgtaccactggagtgaagaatcctgccattccacactcttctttatcatccccaggatactaaccagcagttaaatggggcaggaagtagagtgaaaagacatgtttgctactatagagaaaaataaatgaccagagtgtcttacctgcatgatgatgtagcttttccctcccaccaaaatcaatcaggtgggaccacccttcccccagaacaaaagctcaaaggcgaagtgtctaggatggaatgtgttttcttgagactgctcttgacataacttcaagccttagttcccaggaatagaacgactaactgtgttgagaatgaggttcaccctgggcccttcccttacttcaagttgtctcactaagaggttatgggctgtgcgtgcttgtctaaatccattattaaattaggtcccaatttaaagagtttgtcacacagtttagcaaacaaatgaaacagcctgaaaggccttgcagcaccacatattttctggaaatcccagtagcagcaggtagagcctgcatcctgaggatgcaaccagactcgatgcacttggtgtcagccaagctggtactggatttccataggattgttcaaataccttggcttatattttaatattttctctcacatttgtgtaggaaagatagtcttggaattaattcatttaacaaacgtttcctaaggagaattctttatgccaagcactgtggcataatgcactagagctatgaaacatcaagacattactgggatttgcaggtccagtattgaataatactgattcatttcaaaacattttatcataaatgcttaacaaggaccagagcagtcactatcttaacaggtgagtttcaaatattagtggtcttctgggcaaatttcacttcagggagtcaataggcatgttgtaaaaatcaaaataggataataattgcaaggcacataacacatggggtatcaggaaatgaattaccatttctatggtctgcatactatttggattgcctatagatctagactgtgagaaacttgaggaaaggggttctgtggtcttattcatcactgtgcccttaacatctactacagactggtacattgcaggtaagtacaaacaccatatttattgaatgaaagaatcaaggcatgaaggaatcaatttatgaatgccttaagttaaacgaggggcaagaagctgacctgagtgcgtttgtcatattacatagcctttgaggcaaaaactgtctcaggtagtagcaactttgagtaacatatagacttagaactactgtaaaagaaataagactttgaaattcagaacgaaactatgagcagagggctggaaaggggtgaagaatgccgaggggaaatagaagaaatcatgtggttaggaagactgataacatatatggagacttggaatggcctactgtatatgcagtgagtctttctatcatgtggcttctactgaattcctttcaggttctgcctctgggtagagccttgtttggatgagaaatgctgatgagttgacagagctgagcattctggagccatggaatgctggccatctccttcaggcttcatggggtccagaggagcaaaaatctaaaagtcatcagaaagtctatccttcttcctttgctgaaggcaagcaatgggatgagagaggcttatctcactgctgagaaaacagcgtcttagtcacaaccaattctgtggtctctctgtctgacagggaaaaggtggcttcatagtaaatgatgaatattaccaacatttatcaacgacttcccatgtgccagatatctaaattcactattttatttaattctcacaaccacttattttattttatttattttttatttatttattttattttattattattatactttaacttttagggtacatgtgcacaacatgcaggtttgttacatatgtatacatgtgccatgttggtgtgctgcacccagttaactcgtcatttagcattaggtatatctcctaatgctatccctcccctcttcccccaccccaccccacaacagtctctggtgtgtgatgttccccttcctgtgtccatgtgttctcattgttcaattcccacctatgagtgagaagatgcggtgtttggttttctgtccttgcgacagtttgctcagaacgatggtttccagcttcatccatgtccctacaaaggacatgaactcatcatttcttatggctgcatagtattccatggtgtatatgtgccaccttttcttaatccagtctattgttggtggacatttggattggttccaagtctttgctattgtgaatagtgccgcaataaacatgcgtgtgcatgtgtctttatagcagcatgatttataatcctttgggtatatacccagtaatgggatggctaggtcaaatggtatttctagttctagatccctgaggaatcgccacactgacttccacaatggttgaactagtttacactcccaccaacagtgtaaaagtgttcatatttctccacatcctctccagcacctgttgtttcctgagtttttaatgatcgccattctaactggtatgagatggtatcttattgtggttttgatttgcatttctctgatggccagtgatgatgagtattttttcatgtgtctgttggctgcataaatgtcttcttttgagaagtgtctgttcatatccttcgcccactttttgatggggttgtttgtgtttttcttgtaaatttgtttgagttcattgtagattctggatattagccctttgtcagatgagtaggttgcaaaaattttctctcattctgtaggttgcctgttcactctgatggtagtttcttttgctgtgcagaagctctttagtttaattagatcccatttgtcaattgtggcttttgttgccattgccacaaccactttatggtatcctattactatactcatcttcacagataaagaaagtaagcccagagaaactgattcgtccatggtcacagagctaggatgtggcagaaccatgattcacatgtttttctacctggcagaagctagcaactgtgtgcttaaatgctgctctacaatgtctcacaaataggatctgaatgtccatgctcatgttgtctagctgtgggatcgtgggggaatcatttaacttctccgagtttcagtttcttcatctataaaatggaggcaatatcccctgaatcatagtgttttggggagaattctatgggataatacatgtaaaacaatagaataatggttgacccatagaaaatgtctgacaaatacttccctctatttctacctcctcatctgcatcagggataactgccttccaagctggctacaacaccaagggtctaaggatcctcgatatgtttaatataaggtagtaaagacactctcttttgtttgtctgtgtaccgtgttatctgcctggcatgttccctcttgtctattccatctgtaagccgtaaatcatgacccattagtgagttattaaatcaagttaatgagctatgatctccattttttaaaaaggagagaaacagaatggaaaataacaaagtacactgtatacaaaaagtgttattactatttaacaaaaatgttctttctgttttatgtgtatatgtatttactgggtcaggataaataatgtacttcttactttgcttctaaatatttgaaaggctcttggttacctcatatcagagcttcaaaaattacttagatatctttccatggaagcaatcaagattccaggcctttctagagctaacagatcttttcatttcacattgcatttaattatcttcccttcgtctgtcttccccagcagacataagttttttgcagacaggaaacatgactgttactgctgcgtcctcagtgtccattataggtcctggcacataatatacactcaaaaaatgtttgatgaaggtctgaataaatcacagcaactgtttcttaaatccacattcaaaactcagaggttatttgcttgaactctgaaaatcgatacgttttattaacaagtgaacagggctgagtttttcttttacattctttcctgtgacctttttctccttccccttggtggaatgatttgctttttttccttgccctccccattctcccagcatcctgggtactctagctttccttttatcaaaacaaaggattgttctttagaaatctgcacttttgtataaatttaacccccatatctttggcttctcctagtagcatttatacaaaaggtgcatccctgttagtagcaggaaaagccttgttctttctttattataccagcttttatcagctagtagataagaagggaaaaggatattttagagtagggagatcttcatgagctcataaactcactcttccaaggcagtgaacgagagcctcaaaatacacgcaataaaattcatattccagtagctcaggagcctaaatgcatctatgtttgaagaattgataatgtacttgtgcagcattttgaaaaacattttattcatatttgtaactttatttacttttaaatgaactacatgtttcacaatgctttactgctatatgtttcacaatgcaggaaatacacaatacaagtagcatattaaatcaaacatacccaaatcattcccacagaacaagaacagttaacattagcaataatcagttccacttgcacagcaccactaaagtacttcaagcacttcacacgaaagattaaaggaaaaaaagtataactagattagaaaatagagagggttggctcatatttaaaatactgcctggctcagagagtgctggttaccactcccttcaaaatttcaggtaaacaaattgctactacctgggaagatcatttctagtggggaaatgaaggcagcttctgcaagaccccaggaaggtacattctctctgacaccaccaggaccagggctagagttgggagcatgcttgtgagcatgcgtgtgtgtgtgtgtagggtatgggaggtaaatccaaggggaagaatggttttttggtgcaagcaaatattttactaagtcagctaaattgtttctcacagaacaaagaaggtgcttgctttctgatttaggttttggcttcacagaaaactataaataataccaaagaaatcccacattcctacagcacagtttatcctgtgcaaaaacctcaaagacatttgtgttagaatttctcctctccttattccttaatcaaagagtccagcactgtgctgacagaagcagattgggaatcacagctaaagtgtattcaacagctgacaccacataaactaggcccttagggaggcagagtgatgtggggagaagtatgggactgggggtaggagagctgattctgccacagatagctgtgggatcacaggcaagtctctgtctctgttctcctcaggtctcagtttcctcttctgtaaattaagcagagggcccaatgatagctaaggttccttctagccctagaattacataaagctaagtaaagtgaggagaataacaccattttcaggatgttattctcagatttgagacatgatcatcctcttatatttatataatcagagaaaccctgctagtaatttattctgagagagcaagtagttgactttctaaaataaacacaactgaccgtggtcctatacaagcactctagacaaagcaagcatctgtatgaaaatcctgtagccaaaattagtattcaagaagtacaaaggtacaaacttgttgaatcctttttggtaagaatttcacttaggccttgcttcttgcttttttttttttttttttttggtctgttttatcacttttcatgagaataaggccagggggctcttgtaagttctttctttctgatttgctgatatgactatacgcatggcccatatttcttttaatttcatgtctcttagagtcatttagatgctaaagtcagccctctaggtacaaaataagtagtaataattgaacatttggaaactaaataccatatttgtatattacagagatttcatttggggactttcttatgaaatgtcaagtatttttgagtctcattaaaaagaggttcctcctttcaatacaatctccaaccattactttgttactctaagtctttgtctcttctgtacgttatacttttatttatgattttagagaataaagatctgaatctaattactactctttcaaataagtgtattagttttatataatatcatatcacttcatttaattttcttaatcttccaaaacttaatagctattagcaatatatttcagcaaatttcttctagtatctgaacaatttatgcattctatctcttaataagacacttggtaattttccctccgagctttattatatatataaccatttcagttacactaactgatttagttctatcctattaacccagctgactttttccaatttgctaccagggactaaaacatttcaaaatttaaaaatactttgtagcatgtagaccagcaatacaacacaagagagaagaagaaccacaaatggagcttgttaactttccatcatatttgtaatgtcactacaagacatgttttagggtggttctgaacagtcacagattacaattaagggtatcaaaataatcttttgaaatggagttggccaaattcatagggttaataacttgtttttcttaatctcagggcttccctggaataagaagggactctaggcttatcagttcagtcgggaaattaagccctatgagaacctgtgccttccagaatcccactcccttcttagccctgctgtgaataccaaatacatacaaaacttaactttagagccaaagtggaaccaacagcaaaagttcaactcaagcatgtaaattagtatctataacatatacgtcatgcctaaaatttcaggtaagaaggatatgacctcaggctggagtcagattgaattcaggccagagtggggagtggagaatacaataagaatgggcatggttcttccatatggtacatagattcatgttgcccgttaattaggcatcactttcttccttttgcctgttagtacttatatatttttaaaagtacagtcagcactgatgaagtttggaagtaatacaggaagcttgtcttggaagaggagcatgttatagttgagtgttgatggatcttactcaagaggtagctactaggatgaaagactggaaggcatttcacattcaatcaatcatttatctttttctggtaaattgatgagttttgtcagacaaggaacaagtaacttctatggtctgagaaaaaaactggtagcgagatgacacagaaggaagtctttctgccaaaacttgttagagaaaagcacataactctttagaagaatgccgtggattttaaactgatgcactaaagttaatgcaatcagtatcaggcaggttaggagataatacaggaatattttcttttcacactgatggtaagtaaatgtccaagggtttggtccacatatgccatttaagatttattagaaatgaaaatgtttcttctcattatttttattgcaacctatgctgagcattttatcctgaatcataactttgccaaagaataacttgataaaagcaggcacctttaactaatttaatctaataacatttcaaacatttattccaaatgcttaaacacaaggtctttcagtagtgtactgatgaaagtgggttaagtgggacacatgttctgttgctacatggtgttgcctttgttttctcaagttgaattgctcacaaagtgcagatagagaaatactcctttgcctacctgacgtagagggagcgtttctgattggttcgcagggatccggacccggagctcatgctgtggttcatcatctgctctcgtaggtcatggattttggcctcaaatcgagcgtaatctgggaatgaaaacaaaggtagcaaattttgctctgtgccctcaagagttggaaatgctgcacagcccaggcagcccctcacccacgttgttggttcctttgccaaacaatggggagatgtgcaactcaagggtatgcctgtttcctattatttattcacagacatttataagaggaaaatgataaatcagttatttcccaaaacgtacctggaaaacacaccaccatcaaattcccaacttgtaaaaagtccatgggggctgggagagggaggatgggggatcatgggaaggcagggaggtagatgtggttataaacaggcaatgtaaagtatccttgtggtgatggaaatgttctctatcttgcctgcacggtggatattggtaactgcacgtgtgataaaattacacagaactaaacacacacacacacacacacacacacacacacacacacaactgcggaaaatctgaataatatcgatgaattgtgtcaatgtgaatatcctagttgtgataatatgcaatagttttgcaaaatgttactattgggagaaactgagtaaaatagttatttcttacagctgcatgtgaatctataattacctcaaaaacaaaaagcaaaaagcaaaaaacaaaaaacaaaaaacaaaaaaaaactccatgggaatcccaactcaatagggtattgaggagagactctagttactctcagcctgatagacctgacaatcaagagtttggtgatgaattgtgtaagaaatttcatttaatttaactaaattttgttagggggtgggggtctgctagaagttgaccacttgggatcatacctcaattttgtcctatagctttgcccacatgccaaattttagaaattttcaaacattaaaagttatggggataaaaaaatcaaagaaatctgtatattataacattgctattgtttcacagaaaaaaatatttttggcatgtcaacccaataaagataaagaaagaatcggttctaaggtacttattaacacaatgaacatgtaaaaagaaacggcttttgatgtttcaatattttttatcacaacctagaaacttctatcatttccttggcaaaacaatgtcttgctttagaaaattcagcaggcttaacttacccacaaataaacttaaaaatgttaattggaattataaatggttcttttaattacaaagaaactcaccatgaagaattttaatagagtatatcagtatatttcagaaaacaatttgattttcaattcaatttattcacaactttaataaaacaaggatgaatgtatacaataaaagatgatctacttacagagtgtttcaaattctttataagaaaaagttctataaaatgtaatttcatttcaacttactggatatgtattgattaatgtagggatagcttttctaaaagatttgaccttagttttcagcaataaatagataacaggaaaataaactctgaatattaaatatttttaaagtttagtacacaacagataaagccataatagttggctggaaatttctggtgcataagcaaagtctggtattatccagatttggaaggcttcctgctcatgcttagctttgaataaataagtcctaaatgattaaataagtagaacacatatttaacaacatatttaaggtaaaaatctattgactataatttaggaaaatgtatttcattttctagcaagagaaaacatttatttataaacatcaatatgatactgtatgcaggccaggtgtggtgacacacacatatagtcccagctatttgggagaccgaggcaggaaaatcacttgagcccaggatttcaaggttttagtgacttatgatctcaccactgcacaccagcttgggtgacaaagtgagaccctgtctttatttaaaattaaggaaaaataaagatacgatactgtatgcagatttaaatcattttgagcaagtcgtattttcttgccaccttggaagagtcaattaacatttattgctggccacatggcagacaatatgctcaatgcttcatgggcattatctcatttctgttttaaattacaaaatgaagtctatggatgttgaaaattttgaaagatatagaaaaacacaggataaaaattgagaggctctcgtctcttctgccttcccttaccttctctctcactgctctctttccctacagcttaccctagtggtacatgtatggttgtgtgccggatatgtatgtgtgtgtttgtgggtagctgtgtgtacatacacacataaccatacaaacaagaccatagctatttattgtattaagacttttcccccctttttaatagtgtaatttggatattttcctgccttctaccaaatacataaatatcatgtttcttaatactcttaatagtctattccatagtttagactgtatttaacaactcccttatcattagatatttaggcttgtccagctttttgctatcacaaacagggatcttggtgtatatgtgaatgttggcagcaggttagcagagcaccagaagtgggactactggtcaaacctttgcacaaaaatcatacagcctctaatagcatttcccagagaagaaaagggccttgtctggaacacagatcaagaactcttaactttttctgatccatgctttacattgccacttgataaatactacatgtcatctctaagtaccactaaatctcccatctggagagatgggacactctcctttatacctttgatgactttactacccatgataaaagcaggagatcccaccttccagctgccccttcttaaacatctaactctgtgcaagtcccaaccctcatttaatcactttgctacttcattgcattcatcacaccaacttgcagttatttgtacagttgttcatcttccattagactgagccctctgagggcaggaaatatttttcattcttcttggaacttccttttcctaacatagtgtctgagatgctcaataaacttttttttgagtgaataaaaaataaatgagggagtagaatacctagatgaattcagttataaaatggctccaggtactgaaattgtccattttcatttttatgtttttgcaataagaaagatgaacatgcatctcccctagtgctacttttttcaaaactaaatattctaattccaaggctttatttccgtcaaataactaccacttccaaattcttctgttatttttattgttctccaggatctctccatctcaatcatgtcatacattggaaacaattctctgacacttcatctatatacaatcaacactttgttaggctcttgtagctgcctcattttttgtaacacaatagaatacttgccttaataataaattatatttgccttacagtatggcttattagatacccaaaatgttttctgccatgctttcgaaatgttttgactgcatgacattctatggtgttaaaattccccaaaatgaatgatttatactgcatttgccttaattggaatctatcctgttttcatctttcctactttgacagtcatctcaatgtaaatcctgtgtcagaggtgcttatctgtctctttgctacttttctttgaaaactaaacataaacacaagaaatttcacatagtaaaactagtaagatctgggtttataaatataaatggtgcatctgtggcggcagagctctgtctccaacttcttggagataaacaagttcatagttagaaatgctctagaagtaaacaggaaacctgctacacaaattgtgaaatataagtatgttttatagaagtcctgaaattgtatttttcaacaagttaaaacagaaaaacctaacactaccatatccattaaatattaattctctcttcctcaaatgttttactcatatctatgcctgtccctttggaacatttttcagtcaaattcataacactgtcttgattccaagcctcaggagaacatttgaatgaaattttcaaatgcttcaatttttatatcatccaatgtggaattcacatttactgagcacctgcaatgagctaggatctgtactacatacttttaaaaatacattatttttcctaagaaagttctgaggtagatatattattttacagatgaggaaacagaggttcagagaggttaactgacttcacaaaagtcatagagctactaggtaacagagctcattgaacatggagctaggattcaaccctggatcgccgtgaagccattttgtttccatgacatcatgacattggttataacaccacaattgtttagaatataaggcttgtttagaatgcaaggcttcctcaattctccacccttcccctcttgacatcttgctcttcttcccttcatctattgtgttagtcaggtgcatgctggtcttccctctatcaaactgtaagctacttggagacttgggatgcctcactcatctctattcccaaacctcagggtctatcattctaccttctgtatagacaggactttcatagttttgaacaagtcagaacctgaaagaatttgcttccagaacaggacattgacaggaaaattaagcatgatcatgccgaggtataaaacaatattaaaattgcagcattttcttctgtcttgctttgcatgaaatagatgtttggtaaatgctttttaaattacaagttgttttatgttttggggggattttcttctgtaacaagaagcaaaccactgaaacccaactcctaagcaaacgttttagaggagcttcatgaaacattacccccagctagttctttctccacctctatatatgataacccattttctcctccacatttttgagtatgtaaagccagttgttcctgactaggtgcatttaatttggggttctggcatttgtattcacttgaacaagatggatgataatagtaaaaagtgtacaagatttgggttatgtagatggagtcaaaatcctggttgtgccactaaatagctatacattactgtgaaagttattaacctttctgtgcttaattttctcaagtaaaataggaataagaattggacctacctcaagatctgttgagaagattatgagagagctgatggatctaaaagattggcgcttggtaatgactgtcaattctttctattacttctgtgtgtaattcatcacctattcttgttcatcacttgcgaaaattgtaacccctttctgtactgagtaaaatggaaacctgtgtctgctcctagagccccctgttacggcctccctctacttgttatgaattgatgtcttcaccaggtcaaataggaatgagccacagatggccatactttgggacacttgccatcaggtggaacttctcatctgctaggcaaccactcagggtactctcataagttcatagtgacttggagtccaggagaataatgtccaattccaaagctgctgctattttcaggaatatcagtgatttcattcatcagtattatctcaaggccttgagctactgatggacacttggatggagcaaggtcataggtgtgaacaccacaaactacacagtgaggggggctctgccatacacttgtttgcaatttgttaagggtaagtaaggcgactcagaatgcaaatctaccattcacacagaaaaggaggcattgcctcctgtgagaaggctggcattgtttaatgcagtaggattaatctgcattgattaaaactgcccagctgctcatgtcttcgagactcaggtggcttactttggttctgagataagaaaacaatacactcagtgggttaggcaatagcatgaggccatggcctgccctccccctttcccaagtgagatggtgggcagcatgcccctcgatcagtcacgacctcatccaggggtctcatgattgccagataagaggaagccataaacggagggaacagggttagaaactctatgttatggctggctgcatagtattccatggtgtatatgtgccacattttcttaatccagcctatcattgttggacatttgggttggttccaagtctttgctattgtgaataataaaaaacgatgagttcatgttctttgcagggacatggatgaagctggaaaccatcattctcagcaaactatcgcaaggacaaaaaaccaaacaccgcatgttctcactcataggtgggaattgaacaatgagaacacatggacagaggaaggggaacatcacataccggggcctgttgtggggtggggggatgggggagggatggcattaggagatatacctaatgttaaatgacgagttaatgggtgcagcacaccaacatggcacatgtatacatatgtaacaaacctgcatgttatgcacatgtaccctaaaacttaaagtataataattaaaaaaaaaaggtactgggagtaaaattaaaaaaaaaaaggaactctatgttagaaggccagcttttagtcttaatcttgtcatttattactagtggggccttgggaagttactgaacctcagtttgttcatctacaaattgtgaggttcacatcacaaagtggttgtgagactcaaaatgagatttgactgaagtgttctgaaaatataagataggtgttgctgttattactttggtgactcctgtcaggacaaagacatatgcagttcttagtggtactaatggtgacagtggcaccctctttctatttgttcattataaacgtgtgcagctttaacaacaactggtaagatcactgagctgtaaacaggactctgcacatccaagcaacagagactgctttcctgctgagttatccatttccacactacaggagaattagtttgaagagaccacctgctgtacacacgcgatgctttaaatagacacatctgaactagaagctcttggtgtcttataataaaggaaatttgtgctttaggacaacttccaatatggctggggtaaatgtcaatggtgtgtagtctgttgggggtcacaatattgtttacctggatgtgaccctcattgtcactgaggcttaggaagggtacatggtaaggatgaagcagaaatggtttacatctattcttagcagagcatgtaatcactgctccagggatgagatgctgtgagcaattataaatgtttccatttctttggcggaaacatccttctttcatttattcagtaaatatttcttcagggtttattacatgccttgcacaatcctaattgctggggataccgaatccactgaacagatttttttcctcaagaggctcacaggatagtgcatagttacttgtaattttctagtttcatcttgtgaatacaaaaagagcatttggtatttaaatatctgctccatttgaggagtatcatgttctttttagatggtaacaggatatcaagaaacccttctatcatggaaagacgctaatacagtcagttccatgttaaaatggacaaattggggcaggttaaatctttgtgaactatctggttacttatagagtgagaagagcaacttggggttcaaagcagtaccttggaatcagagtttctggatttgagtcctggctctgagagatgttaagaaaataccatacccactcagagatgctgttttctcatttgtaaaatatagaaatcatccctacccccatacattgttgttctgaatatccaagagagtgtaatttatttccatccttttaagcagtatcgattttaaaaagcaccatcaatgaataaaagcatctttttcttggagagggtggacacaagactcttctgatttcacaagctgaaatgtattttgtagagaggggaagatgtaagtcttataatcaatgaaatatgataattcagaatgtttaaaactagaaaatcccaaacaaatatactactgctctctttccaccggactcttaaccaaatagtcacacataagaggattagccatagaacactatttacacctcaatttcaagaagcaatgctttgtcaacattctttcatatgatgatacaaaaataattttaattatttggagctcagaaaatattagacggttgccatttcatcacctcttctttttctagttttcctgggatttcagagccagatatgcacagaaggggcccagtcacattactttaggctttagaggtacacttagagcttttctcaccctggctgcttttcaagtcatcctgtcaggaaggacgtcattaggaactatttgaggagcgtggctcccctcccagatacgcactggaatgctcacctccgtcaagagcgctgagctctggtgactggaaggatttggggtggatctctccaggctactgcctaaggattttactagcttttacttcaacccgacttagctcatctctcaagttgccaacctgcctctgtgttgaagtggtgacgtggaattttccattgctaaagacttacagatgtttggcttacaaatccaagagagagggagtgtgtgtgtgtgtgtgtgtgtgtgtgtgtatgtgtgtttgtgtgtgtgtgagagagagagagagacatagaaaaagagagagagatacagagatggagagagacaaatagattatgaactaaattcatcagaatccaacttaaccagaaattctagacaatataaagagtctatcttttctgcactccacaaaggaagaggatgtatgcacctatctcttgtacttctttgctactgaccattaataactcagttatggataccatgagggcaaggatgttatcatgttttcttctgtatcctaacacctggcatagcgtgtggcacacagttatcagctaataaatgctaacgtaagtgcttgctgaattggatgagttaaatgaagagttctgataaacagaaatgatcctttagcttaccagatctaatactaaatagatcagccttttagaataatttttaataacacactgaattaaggtatgtctttctccattcctcctcaccccttctctgttttcagatagaattgggatcatttgttttgactagaacaatctcttgcagcttggatggagaaactttacagaggtttcagccaaacactcatgaattctttaatgtgtgaaataaagtaagttttataggcaaataacaatctgaatccctaactagctatttcatataatatgcatataactctgaaaattacatacatcaaatttcaatttggcttcatgcatgctttgttttatagattcataaaggcagattttctctgattatcagacttattgcaaaatggagtcaacacagaaacttcctgaagttggcaaagcttgttttctttggctgacaggagtaactgatgtattattattttttaaggctctgagataaatctgattcatgtttgaatcataagtttattattgatttttagtgtggattttgcataagatactcaatttagagaatactcagctttctcatatgcagaatagaaaaaaagtagttacctgatcagattttttgaaaggtaaatgcaacagcagttgtaaatggcatagtccattgttaggaatagactaggtgttcaataaatgaataaaaaaaaaccgtgaagctctcctgaagctttatattccctgtctataaaatggagacatcactgatttcctgcttacattacaagactgctgtgaagatcaaatgaagaaacagataaaaatgtttggtaaactgaattgtacagtataaatagaaagcggtgacaaaagtaattcataccaatgcagttttttaaaaatatcccaacctgcctacacaactacttcctctctctgagatttatctcaaaagtggaattagattcctgtcttagctgtaaaaataaagccacaaagggcatcatgcatgagagagtaaatgtgaaactctgtgggggaaaatggaaacttcagatattattagggcctagctgccaatggtgattctctcaagattttattggcaggttgagtgaaagtgccagagtgtggatgcacaaattgtagtttaattggtgtgatttatagctaatggtgcatcagaaggaggaactaggaactgtgccttctaatttaaggcatagtacctaagactgcatccactaggtaagaaaaccttccttggcaaactcaaatattaaatcttcgctgaatttgtcttgttcttttatataaaaatcatggagccaggagctaaaataatatctaagtttcctctttgcctgacgccatccatgcaaaatgtgacttgcttcttcagcagcagcatgaaaacaaactaatacaccactattcctaggtaagtagagccacaatgggaagaccactaagggaatatggaggctcacagaggctagtcaatttatccaaggccacgcagcaaagctgggactcaaactcaaatcttctagtcctagtttcattcagttttttttttttcctacattgattctagactttgttctacaagtgactacttttctgttttgttcctgacatgaacatgtccatggctgtctcagacttgtttggttaccctaagtaaccatttagcagccaatttctgatatgactatagatacatctctataagtgaattctataggtgatttggcatgatcaaaatgaaaaggctttgtttgagttccccaatatactgctcaaatgaaagcttctcaaaatatcattttgagatacgacaggtctttccttcaaatacaacagatacttttcttttgcagcactcagcatacatacaactatttatttatctgtaagtacttgcttagtatctgtgaagaacattgcaggtacctgacatatgtctaactgatggagtgaggctgctaatgtggccatctctccctcttcctgataagaaagtgaaccagccatttcaaaatgtggagaattcgataaatatgttctactcctctatagccctcccactaaaataattttcaattttcaattgaggtgaaaggaagaatcggcaaagagacggattgagagaattgtttatactcataacttcgttctcaacataattatctatttctgaatcctaaaaatcacctagctagattctccctcaatctgaagattaccttttactccttgagatgctaaatgtgttcctatttatcatattaatattgcgagtattttgtgttatgcagccagaaaaatcacataatgggaacttacccacagcccccaaactcataaacaggagctgaatagaaattcctcagtgcaatttatggtaacaatttcatgctcagtttagttacttccatgactcagaaaagaaatttcttttgcttatttcagtaatttttttctaaaaaattgttcccctaatttttggcaaaggatctatgagaaagtgaagaactccctggttgtacatggatttggaattgtcacttaagtgaggccaaaatgtaaccctatgccattcattgcatagtaccatttgttataaatttgacctctaaaacaaagatattacaaagccattgagtgtttttttaagggatatattatatttgtcacttagtccccagtattatgatggaaaacctggatagtggatagaaaacctggaggtcatttaggcatctctttcactggttgggtgagaaatggtgaagaagatgggaatggagaagggacatacatttggtaagtgtaaataagagtctttgctgattaattcagtgtggcccatgagaaagagtggaagtgtccaaggttccctcaggtttacagcttgggcaactgactgagaacagaaaggagctgccattgagaggaagaaaagaaaatgacactgagtccatgttgggacacattgggtttaaagggatatcattatgacctaagctctctgaattccagtgactgggaatatgggaagatacatctttaacagttgaagcaatttatacactttaacaattgaagcaatttatacaccagagcctaaggaatatttatagatgagggctgtgctgcaatgacagatagggttgtatgaaacatacactaatctgaccattctatcctccagactcagggaaggaaataataaaagtaagtaaccataaaaaatagacttttatgcataaataaataaaaatcagctaggagacagttcatccctgtataagtaaaacaggcaaatttatctttcctctgattaataatttaagaaaaaatcccaagcaagctgcctatggaggtgtaggagtagctcctataattagactccaatttgaaccatgagggtgaggatcagaaagctgactcagagcctggtgtcaattatttgcagtttgtacaacgaaaggctaaaaatttgggagatgcaggatgactgaagcccgattctgggggttgttacagcacagttacagggtaagttttttccattgttatttgctggaaaatttattctccatctcctttagtctgtgcctgaattttgtgggacttgctcgagaatggtattcatgctttaaatccaagagccaggaatcatcgcatttcaacaattttcctatttattttaaccaaaacagagctggtttctataactcaatttaagaaattatcctctttgatacaatctacttatgtttgattgattttagaataaactaacagatacacaagagcttatcaagctagctcggttcagtggagaactatagcagaaacagcaggtttctatttggcacattttggatttatctggacgcaagaggatgtgaaaagaacacctttcagacaaaagccagtcttgagtaggaatttagtgttccttgcccaaacagcttagtttgtttcccattttgagtcactatctgaatccttttttatctcctatatagaacaaattctctccctctatttaataggctttcagatatgaaacagagagagagagagagagaggaaggaaggaagggagggagggaaagagaaagggaaagaaggaaggaaaagctctaatttcttctgttcttttggtaacacacctccccttcacatccttcagctgctccccttagggctttttgtagacacttttggtggtctctcctctcacacactgctcaccactgtactttattttgtatcatctgtctccatcctttcccaactcctgagcactcagcctcctctggatcttttctggttccttcgctcctagaactgtgtctgatggcttatgaaggcaaatgacaaatgtttgccatatgcacatgtatgtgcatgaatgaatacatccaggttctgacttcctcggggcaacctctactttctcaatgcccctcttaagatgggggtgggggagggtcctcctagaactgaacatgatattccaggtgtgatctaatacatttaaatgtccaaaagctctttcttccctaaacgttcctttttaaaagctactgttctcaattaatgggtgtctcatcttcttaagtatattaataagaggtattttgatgtttccctccattctgtggattacctcttgattctctggattctttgtgattccgttttgttttaaggatgttctcaggtgtctggtgatccttgcttataagtccaaattaatgatgaggcactaaaatgctgattggaagctctctgtgcaggcaggtattgttgaatagtggtaaacaggggacatgttcattttggagacactcaaatatcaggacctataaatctctatgccaagtcagtttccccagagtctcttaatatcatttctttcaggttaaaagcctggttaccaggttctgggagtgaagggaggagtggggcttagacaagggtgggggcgggggtatgtctcacaattcactaaataccttcttttatatatgtgttctctgtgcagcattttacccccaccatcgtccatgtctgatgcctcaggttcaatcttgttcagtctttccaaagaggaaacattggttgggtgggaatgattggcaggtcgaagagagaatttgaagctatagctgctccttttaaaacttctaactcatctttgttttttcaggccttcctcacacccatgtcttcagatacccaaggcctttaatacccaagtccttccaggattctgcacatctcattagcttcatattcccgtaagtacttgggtttctgctttctcagctctgatgtgtcattttctaatcaatcatcagcattccagcttccaaagttttgttcatatatcttacatgtgttgtcttgaccgacttctttttggaccttagattatttacctatttaaattccttaattgttactttagtggagttttggaagggaacaaaaatataggcaggtgtttatcacatttaacaaggaactcaaaatttatatttaattctatttaatctggctgccttcttgccatcagtctatttgaaaagttcatatggacccagctctgtcatcatcacatgttctatatccccaaaccttgtgacatctgcaaagaagtacagaagacctcaagagaagataagctagaatttatttatttttataccttttattcagtttttattaaagctttcctacctttccagattgacacagaattattccatgaatctgtctattaatccatttacagcaagtgctggggatagaaattaaggtttaaacatataattcctgccatcaaaggactccctgttgattaggggacacaggcaagaaaatagacagtaagtttgttaaggcatgaacaaagaactgtgttggtacacacagtacagagaggaagtacaaagaggatggtgcttaagaagagttaacacctagacctaatcttagaggatgaggaagcattgggtagactagaagactaggtgtaggggtaaaggaaggcatatcagagaaaagggagcagctacatagaggcaaggactatgcctcttctgcctctgaagaggagaaatttctttcaatcaatagaaagtgcaggacaaagggtactaagtcatcttttgatgggataacttgatgttagtgtccttccatgagaaaatgggaagcagccccttataataaaacctctggcttttgaattaccaagtaaaactgaggtgtcagcaacccttggctgaatgtggaacttgctaatagaacccctacattcatgggaagggataaaagagctttaaaaagtacaaaagcattgtgtgaatatatgggattaatattactactacaatattgcctaccaccaccatccccagccctgaggagtcttcttaaacttacaaaatgaagctgcttctctatggatgtagacatttcctggtttcaacattgcaccatagctatgcattatgtcaacattgggaaaaggcagggtggaaggtgcacaggagctctctgtacatttctttgaaacttcctttataccttttaaaagttaaaaagcagcagcagtggcagcttctcaaggccaaagatggggagctctatttcatttgcatttctactcagggctataatgaattgaactcaatgtgttgctaaagattattatgaaattaaaatccaattaggatggtctcgtgggtctggtaaaagcttggattagagaccaggcacaacacggggttgggggagatggactgctcaatagaagtagggctgagtggggagtttaaagcactggcctctaagtataggaaccactgtacaaattttaaaatatactcaggatagttaatatttgatcaaaatccactgtgaagtgaggaatttttcctgctgggcattctattttccagttctatgatcaagcccagtgactggtaaatacaatatgccccactagcccccagcttctcccagctcctgttccctcctggtgctcaaagggagaaaggctaagaaattccaagccctggtcaggaaagtgatcttgaaatcacacacaatgaatagtgccatcactaatgactcagcttgtaaagaaccagtgaagtgaggaaattctttctatgcacagaatgtctagatatttaggcaaaattgaaggggatgaggcaggaataaccaggacaaactcagtaagaacttcaaccctggttttctcaagattcagtttatgtgctgatcattttctctcatatctaattcccttacttcccctgctctgttttacatcgaaagtgctgacttcatgcaaattacatgcaatttgcatgtaatttggaatttgctccctgggaaaatcacttctgactaggttcagccaatgggaggcactaacaggagattggagggtaggaggaagggaggcataagggaatttctttcccctctctgtttcaggtggcatttcaagaatgtctgtttttcctccatgatttctatagatattccttaattttcaagtctccattagcataggtatgaaggtttctcaatgtgctcttgctttggcttcctttagtcagaatagaaagagaaagttttttaactttattcaaacatattaggggtttgctagagaatacattatttgcccctagttatcctgatgttataaaaggaggcagacctggacaagtgtaaattagcacagacattctaacaatcaccagaaaaatgcacccataagtagtgccaatgcaagaagttttgactgtaatgcccgtgtgcagtaggctgaatgatggcccccaagtatatctatatcctaatcccgagaacttgtgaatgttacttgctatgctgaaagggactttgaaggtgtgattaagggttttgagatggggagattttcctggattatatgaatgtgtcctaaatataatcacacaggtccatgtaagaggtaggcaaggtcaaaggaggaaatagaaggtaagataatgaaaacaagaggttggagggctgtgaggaagggggtcacaagccaagaagcataggtggcctagagaagctagaaaacacaaagaaatggatttcttatagagtcttcacgggggactagccttgctcacaccttgactttagcctagtgaaactgatttcagacttctggcctccaaaactgtaagagaatagaactgtgctgtaataagccactaaatttgtagtaatttattatagtagcaataggaaactaatccaatgttcccagatatgaaaaaaatttctttttctttaaacacgccacctgaatgtgaacatattcctcttgctttaaaaattccacatctaggctattagcaaaattcatacacaaattctagcttactataaaataatcatttaaggaagtgtataaaatttctttgcctcagatatcatagtgcctcagatcccctttcaagactgaaagactttctactccagatgccattggctgaagacagcttctattcaaacagggaaatggcctgtctgcaacatgcagcctttattcttatctgcatggcatactccttctccttctttaaaatttgatagtaagtcttttatgattttgctcttttaaatgaaattaatcatgcccctcttcatcttacttactctatacctcatatatatattcatttttgcatttatgacatatcttttatgtttattatacctgtttcccctgccagcctaaaactctatggaggaagacattatgtcttatttgactgtgtatactcagctcttagtacaagtaagtacctagtacataataggtactcaataaatatcaattgaattgaataagaaaactgagtttaggttaaaaaaaaatctcagatggaatgtcagagagtaagtacatacctattgctggggtgaccaggggcaaattacttaacatttctgagttggaaataatgccaactacaattacaagaccattgtgaagataaataagatgacacaggtaaagaagctgtacaaagtaggggtctagcttgggtgacagggtgaaactgtccattcttctcataataaatgcccattctcttcacaataaattgaaaattagtttgcaacaaacttattcctgcccttttttgtattcagggtttggcaagaccttctgagttaatttaggacaacttagtgtttagcataactctttcacagatttgctgtattatcagtgtctgatgatgttgacaatgttgaagaagaagaaagaagaggagttggaggaggaggaagaaaacatccagagcattcaatttattctagttaaattactaaccagaaagagaatgccctcggaagtctactttataatgctgtttggttctaagtaaagagcatctaatagggagacatgtaaatcctgtttccaaaacacacttagaggattacagcatgtgaaagatttgctccctacctggctcagagctacgaaggtcacattggctgtcaaaggacatgtcttctggctagaagaagccctggtgaaatcttatgtgatatcggcacctttgcagaaagtaagaaacaaatcacctgaaatctacacacttaaattcagcctgtgttggtctaatcaaatttggccctgttagagaattgaattcacagcagaaaagagaaaaaattatgctcttttctcagtataaattaaaatgtagtatcatcgtttgcccccaaatgctaaaaggttttgtaagtgatgttattttgtgtttttttggtgtggaatcttggcagcgcaactggaccccagcttggagccacaaagcagcgactgtagatcatgcaggagggtatctatctggcaatagcctgcacttgttctgttttttctctgcttgctcttgaaaagggggagaggaacaacctttgaaagctaattattcactttgagagatgattaagatgaatagtcctcacgtgtatatttgaagtgcagaggtgtggtttgtttttgtgtttttgagatggagtctcgctctgtcacccaggctggagtgcagtggtgcaatcttggctcactgcaacctccgcctcctgggttcaagcgtttctcccaccaaagcctcccaagtagctggaattacaggcgtgcaccaccacacctggctaatttttgttatttttagtagagacggggtttcaccatgttggccaggctggtctcaaactcctggcttcaaatgatctgcctgccctggcctcccacagtgctgggattacgggtgtgagccactgcgcctagcctagatgtgtgttttttaagtgtgttgtcttaatatcattgtggtatgattcacaattaatgacacctgagggtagcccttctgtgtatagtgtcatataagtgtggttgtcacttcctcctcaggctgatctccctttgataagactaataagttatattttgggtttccttattcgaccctttttgttgagtttcatatcccaccaagttgtacattactagctcacaccttctaggttttatatatgctctcttttaattctttcaaaagctctgtgtggaagatagtcttattccactgtacatatgtgaaaactaaggctcacactagttgtgaaatatgcccagtcacacagctagaaaatgttggtggcagaagtggaaccccaatctaataacttcccaatgctgtacgcaacttcattcatgtacacaaaatgactgtaaatatgagaaattacctgaacaacaaagagaagacaatgacttttctatcatagtcccaattatcataatgatttaatatccatgggggctgcatcatatctaaatgtaacaactacaaactgaagaaacctgccatggggctgacaaaagtggatttgcagtgaatctcccttgctgttatttattttctcctccagagataaaagacacaattcacaaatagaccgtctttcaaatgcaagcaacaatccctcctccctgtctcctgtgtccatatataattctcttaaacagcataaatctcttttctatgcacgttactatttgtatgcattttttcttggtcccaaattaaatttattttgtctgtaaatgcaagcaggctacaccttgggcccctgagaattccttgatttataactgtcactgtacatgtcatatccatgcataaagtccaataaagtattaatcacttcatctccatcacaggaagaatttctttggggccattttccccaagaaatacatacattttgtctgttgataaagtgaccgcacatgtccaaggagcacaaaaataaatcacgttaagaggtagaagttagatttttattttttttttagatggagtcttgctctgttgccaaggctggagtgccgtggcacgatcttggctcattgcaacctctgcctcccaggttcaagagattctcctgtgccagcctcccgagtagctggtattacaggcatgcaccaccacacctagctaatattttttttagtagagatggggtttcaacatgttggccatgctcgtctcaaaatcctgacctcaagtgatctgcctgcctctacctcccaaagtgctgggatcacaggcatgagccaccgcgcctggccaagaatttttttttttaactagtgaatattaaattttgaagtgctgaatttattctattctgtggataagactggctgcccaccagtctggaagttcttaaagcagtgattgtgttctttccatgctattgccacttctcacccaatctggttctttgcccccatacaagataaaactttcaccaaccaagttaaaggatgatttggactctgtcatggagctacattaggattagaataatatcagagaatgtgccttgaatgaattagcctggcattcgaggccaatttgatctgccctctgctttcctattttatcccctcctgacaaccttcctgataacactccaagtgtaccaagtgttttcagagcataccttgtactttcccattcatagtccttttagttttattttttcttccccttacaatgatggttcttctgtcttgacattctaacaaatcttcatgactcagaacaattaccattttctcttcctgagtcctcaggtccaaaagaagccacttcattttttgtatacttacaaagcactccattatgacattcaggcattttgatgtattttggttctatgtgtgtacttgttctactggaggacacactctagaaggataggagacacatcctagctattgctgtaacatctaatgccccagcagagagtcttgtatgagcgacttaaatacgtctatagaaatgaagtaattttatttaatgcatggcagcattttcttaggatattgccgaatgaggttacagcatgctagtaataattaacatattcattagaagataagaccttagtcccagaatttggctgtgtggtcttcttgaggacatctagagatgggggcatggataagatgtcttggggactggtccaggtgcaggacaagagaaacaactatcacaaataactgtacattctgtatcagggtgttgtaagattccagcccatgtgagaatgaatggttgtcttcatgcccaggtggcatgaagtagacgcttaataaatgaggtgccctctgtgctcccacacatccatccagtgcttttctccatcttggcatttactctccagttgtattgtaatgagtggcctctctgtgactcattactaaagactagggcattacagtttaaaaacataatcttaacacctagttcagtgcctagcacataatcagccctagataaatagatatttattgaataaatgaagaaaagagtataagaagaaaagaatgaaagacaataaacatgaacatggaagtttcctattcagccttttgaagaatatccattggaatcattgtggagattatgagcattatgatatagacattgttactggcttcactgtaatattactcagccttttctgtttagaaaaggctaaatttcagggagagcacttgtcagagtgcttatattgggtcagctgggacatgcttgggagcagatggattaatcccatttcctgcccagacctcagtagcactttctctgtaaccctgagagtttatgtgtatatgtacatgcttgtatggatttaaaagaagcaataataaaaattctgaggaaagtctgaagatatttgattttatcatttacattgtattcctttaaagaaaagggaaattttaattgagagtgtttaggccaactaatagctcaggaaacagctccccacacccatataccctggcctaccaacccctctcccattcttattgccaaagtttcattctccaaattcatatccaaaaggacctattccactgcccccaatgtgtatttcttttccctgaattgctgtcacatactgttttactgtttcagctgtaagctgttggcatcacagtgctctggggaagttgtgctaatccaagtcctgacatctcctcaaagatgcctaaacagtgcagtaggaattctgcaggtgcaacttgagccttctaggaaaggctgtgccacaaaggcaccctggtcagcaccccactcatctggccataacatgtctgagattacgcaggtcagggaacatcttgcagcacttgctggttttgcagagaactcagaaatgttaacagatggcatgcagaacacaaccctgaacagtcagcagggtgacactcattaagagtcatcactgaatctatttccaacaaaatctcattccaatgaaacatcgcttttcaaaaagtgtcaatctgcttaaatgaaagtgactacagggtactatgatgccaggcccggttgaatccctgcaggcaacaagaactgtcttagagcctcagggcctttccacccatcatttcctctccaaggtgggtcctggtcagatttctctccagcaatcttagcctctgcagatgagacagaatgcctggtagcactcagaacttctcctcctgagcctgacattcattcctctgcctacttttcctccccagtagaacacttggggaagcaggagggagggaagaatgagtagaggaagaataatatagaaaacttgttgttcctcaagtcagaattccttccacggtggaaatgtatttattcttacctttcttcaagtatatgaccaattcattcttcaagaaaagtcatttcctctctctccctctattgattcctaaagggacacattgatcccaatgcaatctgctaatctacattttgttgtactttagatatcactaatgaattaaaatattaatatgtgaaactgaagtcaagtgtacacaacaccaatacgggatgatgatgcttaggttgtcaacccctttgcttagcactcactgatgcagaggccaacatctccctttccaccacttgcttccctccacccccaccaagaggtggaacctccaatagtcacgtttttcatacttccaggtcttctccctacaaggcctttgttacccccatgagtgcctcctgaaatcctactcagtcatccaagacccagtgcaaatgccacctcctctagtcaacattccataaagcttcagtcagcaagagttgctctcttatcagtgtttccatatctctttattataacatctagattaaaacttgtcttattctgtctgtaatttcctgctgctacaactccaatgaaaacgtattaaacacacctagtgcctggcatcatgagtcaattggatgggctaacaaaacaacagacctcttgaattgatttccctagctcactaaccccatcagcaggagtgaggtgaaaaatcacgagtgaggccttaacactgcttagatgaaaggctggtatccattagttggtacatagcctaggagctaagagactttggttctaatcccacttctggcactaacattttccccaagctcacaccatggtaaaccaaaggtatcagttatttacttacttggtaaatgttatcagtaaactttgtcttggttatactgttgtttaccagtagtccgtgcttttatatattgtctattcttttttttttttttttttttttgagatggagtctcgttctgtcacccaggctgcagtgcagtggcgcgatctcggctcactgcaagatctgcctcccgggttcacgccattctcctgcctcagcctcccgagtagctgggactacaggcacccgccaccatgcctggctaattttttttgtatttttagtagagacggggtttcaccgcattagccaggatggtctcaatctcctgacctcgtgatccgcccgccttggcctcccaaagtgctgggattacaggcgtgagccaccgcgcccagcctatattgtctattcttaacaatcttcttgctaccaaagcattgggccaagagaacaccaatagttgcctataaaaaatagactcagatttctttcatgagcacacacatatcaaagaagacatggctgcagaggaaggaagacatggctctgctgtgtgacctctgtggaataaggataatagccaaaccagtcttggctgcatggttatgggcataccagagctaaattctggaaaacacttagcaggaagtgcccccacaatattagctacttctattactatcttttaattttactccagcctcataatgttccctgattcttatttgcttatagtgaattcctaagagattttaaacttgatactttctatatctaatgggctttttgaaaaattacatttttatgttcttgttttcttaagaaggatggaaacaaatatatagagactttattatttccaaaaagtgcttctttactgtaataatctaaatctccaacagatagatgagagaagaaaaattcttgccaaaaatgatcagtccaaaccataattatgttaattatatccaactgtcagcaaagagatcaaaggttaagtctgttctctgcttcacagaatgacaatgataataaacagttattcttagtagctaaagtatattttgcaattgtaactgacaccatttgactttcatttttttataagcgaaatgatttgcaatgaattttcatgcttgaaacaataagtgcttttagcttagtaaaattcacttttgcccagcatgacccaccttcctattcacagtctgctctagtacttgaaaacactgcttgagcaatgtaacaatgaacttggaaaaatagcttatcttttggaaagccctggaattgcatatactcttcagttttctgcattttaagcaccttaaagaagtttaccacttctctagtggtttcatcactctttctagtattgagcatttacaatgtaccaggagctatactgaatgccatatgtagcaatttatctcagttgttctcccaacaatcctgtggtgtgtagtagcatcacccagtttacagaagtagacacttgctccaggttacttaggtggaaactaaatgaagaatcccagatctgaaaccaggtcctcctgtccagatatggtactctcacttactgtcttgtattgccttggctgcccataatattctgtacttccatatctcagtgcctgtcgtagtttctgatacacataaggaatacaacaatgattatgggataacagtcattataatggccaacatattttaagcatttacttttgtcatcaaatgttctaagaactttacctgtgttaactcatttaacaagtctataaggtaggtactgttatcccattttacagatgaagaaactgagacacacggggattagttaatagttaataaaacagagagagagagagattgagggagagagagacagcattcttggaccacacccagaccagagcatctgcaggagtccaaataatcctctctgcccatacataaagcatacaattgcactccatctctttttgcttactcctttacccttctttactcctgaatctttcagtcaaattctggaaaacttgggtgattatttcccccaggtcctataaggctactcacctggcaggccaataggtttggcctgtaaggttttcttacaatcttattcatccaggctaacatgtcaatggggctctgcctttctttgtgtgcaaccctggtggtgtagggattactctcatgatatagacaaggaagctggaaagcagaaaggctaagtaagcagctgagctgggatttggtaggagacagtctgcctccagagcctgccctttaatccacacactataagaacacgcccttcctgaattcccatttgcatactaaactgtattgtattatattgtattgatcttgtactaaattgtattgttatgtaattgtttctaaaatacagcccatttgattatcaagtgtttaaggggtcatgtcattcttttcattttgtggccctcagagtgcctatctcaatgctattatttgctgaatcctaaattggaggttctgtcccagactggaatatctgcttaagcactgtgacttctgacgactagaactttacaaataaacgttgtatagctgagaagactaagatacgaaaagattgttctggagggtaaatagagggtcatactttaagaaaaagaaaatgtgcaaaaggataggtttttgttattttttttcttttgagcatctactgtgtctctgatttttgaaaaataagacataacctagcccttaggagctcttagcccagtgggaagaatacacagaaacaataacatgtaataacatgtaatctgaaagattctgtgacagagacgctatggaagaggtcataagtcagcagactgccaaccatatgtgacccacaattatgttcccttttatttcacagtgtcttcagaaatatgaatcaagggttaacatttaaaaattaaaaattttacaacaaaatccacattggtggctacccaaaaagtgaaaagtttgatgccactgaacccccattcctgcgcagccaccatcagcctgagtccagtagctgctacctccaggggtggtatgtgcatatatttttatggatggtcccatgtttctttaacaatgtttaggacacttacctatagccattttctacaagaagcacatatgatataatacgtcaccttggtaacactgcccatgtgactatagataaagtcacacactaacatgtaaggtgacataaataaaaattatcaaggcagtatagacagaaggagaaagacttgaggtacataagggggtggctgatggaaaaaagtgatggaaagataaacagaaagttgataaaattgtactatttgacctctctccctcctcccatcttggtctccctccttctgtccctcatctcatctctccccatatgtacacttcttcttctgactccccccataataataatatccacaaccctatatcaagcacctgcttagtgttggagattatactaagttttgtgaacaacaaccctgcagactgatattactctacaacaaagatgtgtttttaagattccagtcatcatgttctttgcatgatgccctttgcttgctctgcttgtagtaacagaaaattcaaacaccaaatataccagttctcctgctttgcccgaggttagtgggagacaaccttgtgctgtgggggatgtgctggctctggggaaaaagcatttgcatttaaattccacctataactctgaattagtgcaatgatcttgggtgagttattcaacctctcttgtgcttaaattcaggatctattagatgagaatataattattattcagataactattcataataactatttatatagttgttatggagacaaactctgcataggatgcccatgtaaaaagcatctactattcctatcatttttcagataaaaaataaattgaaataacaaaggaaatatctacaacaatatattattagtgggtaaacaaattaacgtgtgtggagcacctactatgtgccagataatatatattttgtctcatttaatcctcatgctgctacagcaagttagattttataatattaatttttttttggttagaaacagcaacagaaagaaagtactttgccacttatgactctaatagtagagccagatttgtatgactccaaagctcatgtccacctgctgtgacccacggcttggaataaggacaagggctactgcagtgctcaagacagcttttaccctggactccaaagggcactgcaaggctccctcaatgctggattcaagtaaatccgctacaccttacacttccgactcaagacagaaatcaagacatagtgacctcctattgggggcagatatgaaggtgactgacaaagcatcaggacagagcgaatgaatcattcatgtaaatgacaacattaacacatgccctgacatgttcatctctcatcctcatgcctactgtgaagaggcaatgtttgtatctctataggacatttgtattttaatatacttggagtgcatttaatatacacatgtattgaaaaatgtcttcaaagatggtctaccttaaataccaatttttttggtaaggaaacagcagcagaaagaaagtactttgccacttatgactctactaggacagccagatttgtttgactccaaagttcatgtctacccactgtagcccacagcttggaataatgacaagggcatctgcagtgctcaaaacagctttcaccccagactcaaagatggcctgaattatctatggaaagaatacatgctctgaggcaggtccaaatgtctttcaaagtcaatacagattgaaaatggctctatctgcaaaaagcaagcactgtattgaaacctcactatttggccccaaagacacgacccccagctcttctctctctaatctcagaattatttaccttgtcagaaatctcatggagaggaggcggagtgttatattctcttgggccaatatatagaactttaaaaaagggaacaaatacttctaaggaacctgctataattctggctctatggaatgcatcaatacattaactcaatgaatctccaacaattaaatgtgatccacatgagaatatttgtctcttctatttatccctgtactctcagaactgttcctggcacataggaggtgcctgttctggctcttgctactggtcctctgcactgttccttaactctgccaccaccatgcttcccactgtattacaagatcaggaagcccgagaactatatgctcagaaccttttgtcagtagaattgcagtttagattctctcaaccacagtaacttctgttaagttccaggatgttaaaggcaagtagcagactggcacaggatcacaggattttgtggctctcagcactgctacagtatcttacagtttcctcagactccacagtccactgttggtctctagcttcagggctggaacaaactgtggctcaggaaacggcttcctgaggttacctgatttggttgtagctgcctccattcctaactagcagtcttcaaacaatttctaagcacattattaccctgaattacattgctttctgcttaaaataataaaggtgctatctattttcctgactaatttaatgttcaataaatatatgttaaataattgagtaaacaacccattcagtgggcattattatccctgccttacagttgtggaattgaggctcctagagacaaaataatttaagattatacagcaaagtattaaatgtcagatctgagagtagagccctggactgtctaattcccaatgtgcttttgctttttccattcaaggactgctcacagtgggtataatataccacgttgctgtcaaaatcttatctcagaggttaagagttgtttgtatttctcctcctgccagagcaccattgcagctgaaaacctctctatacataggcaaaggacattcattcccaagacaagtggtttattaaatatgtattaggtctggcaagacaccctgttaaaaacatacattgtatctgcagcgtcattgcagatacaatgtgtgtgtggcacatagtagaagcttgccaagtattaactgaatgaataaatgaatgaaagttcactggttttgttccgccagacattcctttgcagattgtatgctctgactcaggggtcacctgggccataagccatctgtgggttggtaatactattatccttaatgcctggttccctcctatagttcagcaaagtaagaatacctcagaggttcctagatactgacataaggctgttgattttccttggaagcctcagttgtcaagggcattgtaattccgaggcagatagaaataagaatccatccatccctacattccaaataagattgaggcactgaaaactattaatctgccttcattgtaatgtattaaaaagagtgtcacatttggaatcaaactgatctgggttttcatcctgattcctgatacttactagacgtgaaacattgggcgagctgtttctgtgacctgttttttcatttatataatggtagagatgatagctctcttacagagcttactgtaaggataagctattgtagacagaaagcatctagttctcctggcccatgttatggattcagtgaatgaaaatagtattgtcttcactaacaccaagagtctgttgacacataggctgtcatcctgcaggctggtccacataagccaacaaggctctccagtcccaaataggcagcagtggtgtgaaggaatacttaaaagcatgttttttactagagaggttatgtagttgcaaggaattaaatgtctgcatattttgtaagcttcgcggtgtctgatgcctttgggtggaggggagtgggaatggctggtagagagtgggtagagcagaatcgtcaaacctcacttttttttttttttaaatgggaaccaagatttgacttactgaaagaatctgaggggtggacaggtagagttgggtggcttttgtacactgggaggtagtagttaaagctgcaggaatgaatgaggtcatggatggtttggaattaaatgagggaaaacgaaaccacacttgacttcagaaaactcacagtactagtctctagcttggtgcttgggatacagcagatgctcaatgaatatttgttgagttaaaagcataaggttaaagagtgcatcacccttccttaaaatgtctgtgtgtctaacttatgatccaggttcattttacctttgaaaagctaactgatgtctatgtgcttcctaaagattccaagtttctcattctggaaaggtcctcttctgaaagctcatgaagccagcactaacatttatttagcatttaactgagtcctggaagacactatgagttttttcattctacttatgtatcttaaacctcaactagagtttgaggacagagaccacatttttttgcatggctgaaaatttctcagtatctagcagagtgtttgactatagcaagtgctcaataaatagaaatgtagcacttgattaatcaaccaatattaaagtattgttagggaagaaagaaataaatagaatgccttgaaactttagatgtgtggaaaaatgaagtgtgtgcctgtaagagatgactggtactcagcttgaaagagagaaggcttaagaagccttagaaagaggtgccaagctaccgtaaaatagaactggggtgtgagggggaatcttgcatagaagaggctggtagagttagttctaggagagaagcaatgggctgtcttttattcttcaactatgcatgggttgccttcttatgtcaagtagtgtgctaggcaatggagatacgacagtgaataaggcacatcatctggtcataagggctttacgttatgctataagagttaaaccagcaaacagtcaactacaacatagtgtcacagcatagagcaatatagagtacaaatgggggttatactttctaaatattagattatctcttatgtactctccctctgcagggatgacctgagggattcaacagatattgtgattcaagggttaagcaagctcaaaggaagagagatcggagagaatttcaagactatagagcttaccattttcttttatctttttaaatgttactttaactacaataataaatattcaaaccattccgtatgttctagagaaaagaaaggcagatcagacgtgccccttgtcaaccactaggcaactcgtctaaggaaaaatgaataatttctactaccactttggagattcttgagatttttttttttagagaacggggaatgcgttacaataggagcatgagattggaattctctatcagctgtagcagttaggagtcaaaaacacgaagaagtgatatatacaagggtgcatgggaattggaagataaataaaggactatcacattccacgggaatttttctcaggccccctccaacttgacccactatctcccccatgatttttttttacaaacatgaatgtcaagttctctgcttcctgtcttcactagcattattttcaagattagccccttccatttgctagatatatctcattattcaatagttttttatacagaactattttcattccaccacatgagatctacttctgccctttgcagttataaaataaatttataatctcttatctctttaaaggctgtcttgtatttgaatgttattgtatttgttgttcttatcccttgaagctaggcagccgtggtttctttaactcagaggtccccaacccccagtccgcagactggtaggtgtccatggcctgcaggaactgggccgcacagcaggaggtgagtggtgggtgagtgagcattgctgcctgagctccacctcctgtcagatctgtggtttcattagattctcagaggagtgcaaagcctattgtgaactacacatgtgagggatctaggttgctgcttcttgtgagaatctaatgcccgatgactgatgatctgagatggaatagtttaatcccaaaaccattccccttacccaccccatccgtggaaacattgtcttccacaaaaccagttcctggtgccaaaaagttggggaccactgctttaactcattttatccagtaagatttccagacttttgttccctacgtggttacctcttgaaacagcttaattataactatctaataaagtgatccttgtaccaagcacaagactccaccatgagttgaaaagaactgatacccaagagaggtcccatgacttgcccaaagtcacaatgctggtaagtgaagggggcaaaattcaaagcctgggctttggccttctgtgctagttctcatccaacctctaaatacagagaaagaatggagtccctttcattccctctccaacagatcttaaacaacaccatactctcattccagccccatttgccttgagtctgtgatcttcttccaaacccaggcatacaccggaactggcctgggcaaactgcgatatacggtcaacgctttatctttccttaggcatgtttgcctttgaataattaaagttgtatctattcatagacataagccaagacaatgaaatatataaaaatatgaataaaggatatttattttaaggaagaatttcttaaaatatgcttttgtcttctgtctacaatgaagtttagataaccttttcttagtgtatccaatgagttttcaagtgcatttttcattcatttgccctttgaaatggacttattaccatttaatggtgataagcaaactctgtcctacctacgcttattatagctgtctaaggatatgacattcagattgacatgcattcctggagggtggtgaatatgcagctggcatgatgttaatagattttctcattcacttgtaaacaattctgtttttatttctgccgatcccaaggtttggattgaacttttgttttctagtcttaaaggaggaatttcatgtgagcttcacaaatactcattacctgaatataaaggtctcagcacggtagttggtccaaaaatgcagccagcttgttcaaactccttttcaattcagaaagccatgctaaggaaattagtgatgttctcttcagaggtggctaacttccttctagttggtctaggtcttgctactaatcatgtacagaaattaaaggaagaggccgggcgcagtggctcatgcctgtaatcccagcactttgggaggccgaggcgggcggatcacgaggtcaggagattgagaccatcctagctaacacggtgaaaccccgtctgtactaaaaatacaaaaattagctgggcatggtggcaggcgcctgtagtcccagctactcgggaggctgaggcaggagaatggcatgaacccgggaggcagagtgcagtgagccgagaccgtgccactgcagtccagcccgggcgacagagtgagactccgtctcaaaaaaaaaaaaaaaaaaaaaagaaattaaaggaagagggaaatgacggcccctggctgccagtcactttgcaattttctggggaaatgaagtaaaaaaaaaaaaaaaaaaaaagcagaaacaaaaacaaagaaaccaaacaaacaaaatgagggcactcaggctgatgttcatggaagcaatggctatgtctggcatcacagacgtggtggatattgaagcagggtcagatttatgtagaaacaaggtagaatggagggctttcagactgatgcataaaaatatccagttgtcaatttgccaagaaaatctattttcaattcttcctctccaggctcatctaccactcttctctgcaaagacaacacattttatagcttaagaacaaaaagctatcagtcccaggacacatcttgctgtttcatagctccatacttttgtataggctgctcattctacctgggatagccttggttctttaaaatactgcaaagacattcagagaagtttttcttagccctactaagtagaggtaatcactgttttctctgggttacctctgtacttttttaacagtaatataattgtactcatatgctattactgtaatttaaattacaataaaatggaagaaaaactatatatacacacacacatgtatatatacacacatgtgtatgtatatatgtataagtatatatgtatgtgtatatatatgtgtatataaacacatatatatgtgtatataaacacatatatatgtgtatataaacacacatatatatgtgtatataaacacacatatatatgtgtatataaacacacatatatatgtgtatataaacatatatatgtgtatataaacacacacacacatatatatatatatatattttttttttatgatagactatgagcttctaaagcccaggaacagttattcgctcagcaccaaattactagtccctggtaaaactcagaaggcaatacatgtttgctgagtttaatgaaatctacaggcagcaaaaatttcttctttattttatggccaaagaatttcctggcccatcaaaatgctctattggaatattttcccaatcctgagcttgtactaattgatctgtttattcactgaacccctgctactgtgtgccaggcagagtattatgttaggtcccaggaatacagtagtgggtaaaacagtcctggtccctctcctcatgaaccccctctccctactcacactctttcaaattactcattcctattaatttactgcaaaataatattcgcacctctagcaataacttttcaattcagaaggccacatataaaagcaaattgatactgagtatgtttctgctgaaaagtctataaagaaacattctaggctgctgtgtctcatggaaggtgtactccatcttcatgaatacatatatagatgtatgtatttctgtctacatgtacatttctatgccaatgtatacatatattatagatatgcaatacacaattaaggctcacaaaagaatacaaccctcttataaacagaaggatcccttgacctttcaaacttaggtccacttaattaaaaacgaagcataatttgtacccttaatataatggcctatgattttcaagtttaactattttcatgttgattgctatgttttgactctattttgaagggaccacaagggtgtttatgccctgaaataaagaggaacagacaacttttccaaccctgaaaaacaaaggaaaaaatttaagacaaacaaacatgaaaagctatcatgtatttctctgcacccagaacagtgctaaacataaagtaagcactaaatgaatactttctagataactgaataaatgaaagagcaaacacttgcaattatgcagttcctcgttaggacaagccaaaggaagagctatggatttaagagggaaagatagtttaaaaccaaatcttgacccaaatggtgaaaagatgattatctgaaaataattttaatcttatagctatgctttaaattctttggtctcttagctctcagagcagtgatgtatactgtggtgggtgcaatatcacatctacctaactcaaccagcttatccagctgaggacaggcatcataaatattccagtgagttccatgaggattaggagtaaacagatgtctagttcacctctgcatttctcaagagtcttgccaaactctgtagacttttctccagttaatgtgcttttatcatttccaggcttcttctacgtgttacaaatagagtggatgcttgtggtggtaggtgacaaggttcccaggagaaggtgaaagcaggaaaaaatgtcaacaaacatctaccaagcacccacaggtttcaggccaaggctaggttctggacatacagaaaaaaaaaacccatcactggtgactctatatatggagtctcaatacttcttggtcaccatgataggttttggtatacattgtccttatttgcaatttaatatcaggaattttatctctaccacagaagaaaatgaatacctttgggctcactcacaagcacatattcatgaaattttaagatgtaagaaaattcattgtgttgtcatagatgaagacatttctttaaaaaaaaaaaccaaaacacaaaaaaacccagcaattccatctggtctgctaaacaggttctcttgggaacatcatgaatgttttaataaatttatctcattgcattgctcctgggtgggtaactaagaactctgaaggacagatatattcccaaattctttctcaggcaaatttttgggcatgtacatgttaacattagaagggaatctaagtaaattgatatttccaataatagtatactactatgaagtgatttgattaaaatattctccttaaaaataaaaaggaggcaaacttttgtttctataaagaaacattctaggctgctgtgtctcatggaaggtgtactccatcttcatgaatacatatatagatgtatgtatttctgtgtacacgtacatttctttgtacatattatatttaaaaagtagattcaaataaccctaatttaatttttaaaaattttaaacacaaggaaaatgttttcctttatatcttccttatcactatgacaactaaatgggtttggtacaatgctatcttatcctaattaagaacatggccctgcaacgtggtattctattaatattaaatgaaaatgtgtgaattatctagttttaattagagtgctgcatttatggctttccgttgtgagcaaatgctgtgtggtatatagaacataaattgagatttatttcttaagaattagatgaatgtaggggaaatcaacgtgaacccacactgcttgaatcacacatcctgatgtagagtctgtatcgattcatttatcttttcatccttctacccaatactattgagcccctcctatgagcagtcaatggaaggacaaagaaaaatctgtccttactaatgagctccctctggtgataagatccaccaaaacagataattatcatataataagataaatgtagttaaagaaataagctgtgagtatttgggatatagcaagaaagacccaactggtggggaggaagggaagagaaacatctttcagaaggacaattaatcaataaataaataatgcttatttattttttgtttcatcaatatccctactccctttccctctcttgtattattttgaggcaaataatttcatccatgcctatgtcagcgtgtagctctaaaagataagggtgcttgtttttaatataagcacaatacaattgtcacatctcaaatattaccaataacttttcaccacatatataattgatgtccaaatctccaattgtctcattgtcatgacttgttttaccatttatgttttgtttgaattgaaatacacaaatgttcattgcttacaatttgttacttttaagtgtttcccctatgtctcttttttctttgccaattatttattgaagaagcctgagttttaaagaatgaatggagggtaagacaaataaaggggaagggagtaaggaaggaaatctagagaaatgggacaccaggagaaaaaaatgttgtagaaacattgaggccttccttgatttcccttccttcccttctttcctttccttcccttccttccctttcttccccttctttctttctttttcttcttctttttgatggaatttcgctcttgttgcccaggctactgcaatggtgccatctcagctcaccgcaacctctgcctcccgggttcaagtgattctcctgcctcagcctcccaagtggttgggactacaggcaccacgcccggctaattttgtacttttagtagatacagggtttctccatgttggtcaggctggtctcaaactcctgacctcaggtgatccgcccaccttggcctcccaaagtgctgagattgcaggtgtgagccaccgtgcccggcctccttgattttcttaaacatgcaaactctgtgagcatacttacttattttgggaagattgctcagtgtactcctaacaatactcttctctatatatctagtaaattcctgtatcatcttctagttcagcttcagaaattcttccccaccttttctatctcatgttgtctccatcctcctttgaaggatgtatcagctggcatttatcaaccagtatttttggtgtgtttgtgttgaggcatcatgtgagatgctaggcatatagggatgaatgaaatcaaatccctgtcttcaagaaactctcaggctggatgcggtggctcacgcctgtaatcccagcactttgggaggccgaggcgggtgaatcacgaggtcaggagtgtgagaccagcctgaccaacatggtgaaacccgtctctactaaaaatgcaaaaaaattagctggatgtagtggcacacacctgtagtcctagctactcgggaggctgaggcaggagaatcacttgaacccgggagtcggaggttgcagtgagccaagatagcgccactgcactcactccaacctggacgacatagcaaggctgtctcaaaaacaaaacaaagcaaaacaaaacaaacaaaaaaaactctctgtgaggtattttagtaagaaatgaggcaatgcctatgttttggactaaaaacatatatttgtccatataatttttagtcatgacaaacacatgctcattgttgtgcagggcataactggagagttttttaaaaaagcaatatttgccacagaatcattaataaataggctcgctctttcagtttccatttaaagatggaaagcaacactttgtcaataggctaaacattttgactgtgttttattgctttttctaacgtcctatgttatgaaaaggtcatgagaagactaatgttggaagatcagataatcaaattataatgagtttagctagtaccctatggctcacattttactctttatgttgctagtggggcaactgaagcaagcaagacaataatgcattatcctgtaatattttaaaatgaggttgttgatggtagaaggcccactagcacttttttgttcgattaaggggctgccaatatttccttgggtttgctactggcccttacaagtagaaagatacatcttcatattcaccatgccagcacctaatacagtgtcttgaacattgtgggaaatggtgggtatcatatgtgctgtcctgctactttccaactgtgtgaacaagcctcattttctcctctatttttatagtgctactgtgagaagtaaatgagataacatgtattcagtgctttgcacacagcagcagtaaacaaatggagaattttgttattatttgttaagtaaatgaattttaaaaattgtacattctgccattgtcttttactcctttacctctgccctatccaaatccctgacctgtctttccagacaacctcaaatatctcctttaccactttttaaaaactcatacatggctgccttaaacatcttaatacttagttacacattgtttctgtgtctaaatgttattctccctaattgtagccgtaagttctttaaaaataagatgagtattacatagaagtgatgtcaaaatatttacaactagctgtgccaggtattaatgctttagttgctcaatcatggagatgtgtgagagtcctagggaagggattcaggggttccagtgtgaagcagcttgtagaggagcactcagcgggcccagggtagaagctctttactaacaagaatatatttcaatattttaagaagcagaagcactgcctgcagccagaatattagtgctggcatctttgatacttctttggcatcctctatttgtcaggaactcaacacacttactgataaggtaagaaattcatccaaggaacagtttctctatttgtacaaggaagccacaaaacaagacaaagaagattttatctggtttgtgctatggggaaatgaagttatgccatagtaataatggtaccttttaatgcttatatgacatatgacatatgtgcttttaaataaacattatctgtcacccttccactatttttagttgcttctttctctgcactgaagaactgtctaatctgaagaggaagaagccagtgccctgggaagcatttcctacctggtcactgcacccttctctgactcaagcatgttttctgagtgaaaacagaagtcttgggctcctcagtgacacagctaggctgggagcacttactcatgcctggatgcaggttttatgaacagattttatacaccagaagcaagaggcaagaagaaatatactttgattctgtttattgctattattgtctgttctttggaaagaagctagatagaaaaatgaatatttaggagcatacccaccaggtaggtggattgacagcactgagacaagcttcatgagtgaaaaaagaatgttttatcattgcatttggatgccagaaaattgtgaactgtatgatcacgcttgtgatagaaagtaaataacagttttgtcacttcctcttctatgctgtaaaagtggaaaaacaatccaaagtgtagttaattaaatttggagtcagaaattttagcggaaaactattaccaagcccattaagtacaatcttaatgaaggaactattctacttcctcagtggaaagaaatgattattgccaaaggctgaagaacttataaattatataaactttgaattatccagaaatcagagtgaagtctaatttttctttgaagcattgacattttgttaacaaatattttactctatgtctcattcgcaaagtgatatacaccatacaattagcaaacacatgtacaaaaatatattcttatttgtcttatcatattttttagtatcacaaacatcatgatatcaaaatccaaatacacttgagttactgcataagtcattaatcttctctgagcaggtttaatcagaagtaaaaaggagaagaagaagatgatgatgattttgttcaaaatacaataattcttgagcctggtaacatatattttaaagttcacattgattgactccaaatctgtatccacattgtaaagaatcagaacatttgactgtggtttagcttataattcaacggtcatttttcaacaacaaatttttgtgagactgatactttaggttttctgttccttattctactgggcacatggcttctggctgtctggtgatttctgcaatagtgccaacgtaaagataggcaacgagttgaacaattacttcattagcttttgtgactgcaaagagcatttttctctacctcaaatcctttccttctttcttctcccctagcaaactcctactcttcctggaagccaatttaaggacatgcaccatcatatgcttggccttcattccattatgttatgtactaactctagtagacatttgtacattatgtattgtacatttcacaagttatagatggctgctggatgcttttccagcatccttccccaccaccatcccatcctaacagcaacagctgccaaatttcagttaaggactcataatgtcctggggagactgtctttatcctacctaagctttagaatggggctggagatttggtctcatgttcaggggtggatataagccagtctcttcaaagtgaattctaggaatcattgccaggatctctttctagctggatgtgactatgaaaacaagttgtctaggagtcactggcaactgtcctggggccatgagggcaattagtcttggtatgaagctaacacaaagacaggcagtgtggcaggaccaaaagggatttcttaacaatattgtgagctgagctacaggatcagatctcttgaagctagctttactgatgtacttttaagttataatcaccactatgagtatatattccctttgttgagcaagtcagtttgagtcatcagtttaactgctgtattttcagactgggtgggcacttaatgtaggcatactatgtgttaagtatttactgtgccagatactttcatatgcatgagagcatagcttatactgggaaataaacttatctcatttatatcttcccaaccgcctgtgagacaggaattgctatgtctgctttatagcaaaggaaagcaagggtgcaaggtttagtagtagggaatacttccaacaatgcattctgcctttccacctagaaaactactttgttttgcaagcttggcactacttacaatggaaagcagccttatctgttactgtcatggctgagaaggaatcacacttgcaactaagggcccatttatccatgtcccttggattataaactcctcgagttcaaagattaaaatatttcatctttgttatctcatcacccagcagagcacttggcacgtggtccatgcttaataaataactaataatagacaaatgaactagaaaacgaccgaacaaagcaaggtaatctggattattctgactagaacacatggctttcccaagtattttgcattttttttgatatttggcttgactctttcagagttagatgttcacaatatactaacagctattttctcccctaatttcctaaaagtgtgttttcccttttcttataatcatatgaatgattcatgtttattaaaagttcaaatgataaataaaacataaagaagaaactaaaaataaaatggagatactaccactaaaggcatgctttgtcttgcttttgtttgtttgttacctctttgcaccatccctactaccaactcttccaggcaaaataaatatggcacccattagtcttcacagagtcatcaatttaactgctgtattttcagattgggtaaacacttaatgtaggcatactatgcgttaagtatttactgtgccagatactttcatatggaggagagcatagctaatactgggaaataaagttatctcatttacatcttcccaacttcctgagacaggaattgctatacctgctttatagctaaggaaagcaaagttgcaaggtttagtagtagggaatacttccaacaatgcattctgtcttcccacctagaaaactactttgtgaaaataatactaaaagaaataaaaataaaaggaaaaaatcattcatgttaattgcataatagctttcatttcattaaaaaacaaaaacaaaatcccccaaacctcaaatttcttagtaattacaaaaagatttgttgcttagaactcctggctgttaattctccttaggagggtctttgtctccaatgtgacataagatgaaaaggaactattgggagaatgatgcactaaacagaaggggctgtagtaatggcataaggccacacaaagacattgatagccatctctgctttgacttgactcttcctacaggcggaacctcccctgtgaggcagggttccacttggatgcttcaggcagctttctattagtcctcagctctaagtgttacaattgcaatttaaaactagagataaggaaaatacacctgaaattagctagggtctctccaagcaactgttttcaagtgccctaaaagacaaatggcagacagttttaatccagccaatcctaaaattgctttccaaagtaagactatgccctctgaactagaaaagccaatgtcttcccttgaacctgagatcatcattgttttgaccacttccttcttcaaatgatttcttttgggttaatggaggaaaaaagtcaaaagcaaaaacagacaaaagccccacaaaaccaacgcagtggaattttagtttactactctgaaatagaagtaaatgttctgcaactcaaggtaggctgactcatatttttgggacccagaacaagaacataagcagaagctcccagtcctgggctagcccttcttctttttcatagtttcttcctgcactacaaaagacctttcatgcagatgtgtggacatctcagctcatgagtgcaagcagtgattaacagcatccatcccttgccctatttcctaccctcatgcaaatagaaggctcttggtttcccctcagactcaggggcaacgggttggggaggcacatcatacacctcttgaaagtgagcttaggaatgtttggggaaaaaattattgggtcctatttaccctgaatgtgatccagaagggacagagagcaagatctaagtgagcccatcctcttggcctacagcctcctctaaagccacagatatggggaaatttgctcagttcaaagggtggtactgatttagggtaactttcagagcttgccttgaatttggtagatttacgaactttttatgtttcattttttatatcaaattttatacttcggtaaaaataggagagatggctcaggaaaatgtgatcttaactggcatagaccaaaagtgagagcaaggaaatccccaacttcatttttaaaatattccctaaactctgagagggattaaacatatgaggagaggaatcaaagcagatatggggccaagatcccaaaatggaagtgtgaagagctgggcaaactctattgcatacttccaacatgttggtcatcgtgtggatcctgaaatcagacaggcgtgggtttaaatcctagcactgctatatgccaatttacattagtagtatatttaaacaaaattttctttatcaattcctcatttgataacggaaagcaaaataggatctacctggtagggtagtgaggaggattaaatgagaaaatgcttgtcaaaccattagcacagtgcctgggacatcataaactatatttactagtattgtcaggtattttaatacaatgttagggctggaattctggcctagttgttatttggcaaataacgtggaaagctatgatatgttatttggcatcagtttatttccatgttctctatttgaaataaaatgtattctttgaataattatgtaaggattttggatactatcctaggaattagttaaaagtgaacagaaaggtaataaccctgtttttactaagtttccaaaataaaaacaaaaacacaaaatgatctagttataagaagtctatctggttaatttaaaaaattgtataatcttcctgtttaccatgccaatttctttcaaaatcaacatctatcaaaatgagttaaagtatttgacaaaatacaatttacaacaataataattacctttcattgggcatcactttgtgctaaacagtatactatttgctttacctacatcatcaatttggtttaattctcctaattttcccctcctccattttacagataaagagtgtgaggtgcagacaataatacttggttggggacacagaacccctgccctttccatttacaccttgctgagccaggtctttgaacagcacctttaaacctgtcctttttgccaccttccctaccctctcaaaggaaattatatgtgtcacgtaggcaaaattaacatttgcctctttcgcttttaatcctgttttgagagacatggttttgtgtgtatgtgtcctgtaagagggttcttgtcacagcttatatttgccttgctgtaaatttaattgggaataactcatactaaattttcttttgttgctataaatagagttcatcacgggtgggtggagaaaatagaaaaaccaccaccaaatgagaagaaattcagtttgttgagattggtacataggtttatttttccataaaaccacactgaatcaaaacccagatactgctgtaaaataaaccgtggagtgtggcgtgtaattttaaaaaatttaatgtacagtgcagctcaaaggtactttacaacaaataaactaccttgttcttggcattaaggtatattaacacttttaggacccttcagctgtgtgacctaagctttaaaaaatgtcataggctggctggagcatcaaacacagatgttcatttgtatctgtgatgatttgctgaatctcctatcttaatcattattgctctatccagaagctttgagccaaacataagacattttacagaccccttgtggggcagccgcttgtggattagaaaccaagtctcaggttacacacccctaagtgccaaccacaatacatcactcctctgctctttaagcagaacttattcagagaaacggaaaatatggaaaagctatttatggacaaaagaagcatgaacaaaaaagtgttcctgaaaaaatatatattccattttcaaatctgccaagtttttggtataatcagaaagtatactaagaaaggagaaataactttattggaagtgtggtggtgccgataaccaaaatatttatgcaaaaaataaagcaatgagtaagctaagtctttggtgaaaaaaatgcatacatttttttcaaagagatgctaaaatgagttgctttctttgaggttaaagaggacatttgtcacatctacagattctacatgtaaagagaaattacaatagtgtacaggtaaacactttggacaaacaattatgggtttagaagacagtagctacttgccagtgaaataaagcaaatgtcaacaagctagacacacttgaaacatttgaaaaaaatgtccttgctactcctctccatatataatatgccatatgacaccagagttaaatctgctattgcaaaaaaaagtacgtcaagctgtcggtttccatgagatttggacagaggcaaaacaacacagcagagagtctaagaaggtacagctttcacttctctttccttctgaagaggaaatgacttcctatagttagctgaccaggagttagcacgcatcccgcctggagctaggacctggagcaaatacccggagcccacccaaatgagaccaaaatgcagcttcaggtaattgttaatggtgataatgaaactagagaaaacagccagccacaagtcatgcaaatacaacagtcatgccttctgcatttgtccgtcctgcgggtacgtcgtacagctctttccataacgatctagtcttttctttcactccctctcccacatcatcaacaggcacgccaaatgcaaatctcattggattctgatcccatcccggcaaaacgcaggactaccaccatactgagtttcacaataatcgccacaatgccaattattcacagcccctctgttctgttcacacaaaagattgcaatttgaatcttgccttgcacaggttcagctcagttggagctggttaccaggcaaacagtctgttttaagatttgccgattgctgaggagagtgaattagtggggtggggatggacaaaccaccctgtacatacctccttttggcagctaagaaaaacaatttcgtgacaaagagacttgtttttttcaaagctcacccaacaaatgaaactgatagaatgaaacctgagaaactttagcaaccaaagaaagcagccttccaaggatcaaggtgaataattgattcatcggcttttctttcatcttttaagctattttgctcgttaaaaggaaattgtggaatttgtcaggagcccaaacactgacacacacttctgacagcaagtgcctattccaaactatgggtacgtttgccaagcttattcaacaacaacgattagctgcaaagccaggaacttaccgagcacaaaattattggaacaaagcagggaggaggcaggaggcaccaaaggcagcttctccgtctccttggtgccaggttctcctgtctgctgtccggttcacacttgcctttataactaagactctgacagaactcactagcggaacctgatgaattataaaacagcccctcctagattctcatattttacatcacagggggtgaccatgcagcattctcgctcactgggtacatatatttccttgtaactcatcctgataaatatatcagccttagaagcagtgacagtaattggtgtttgggatgtaccactattaaccaataagatgctttcccaccatcagtagtgtacccccatcctctgctcgtgttcccctacaccttgttaaggtggatccacccagctcagtgaggagtaggcaaagacaacaaaatgtggaaaaagcccctgcaccaatgcacatacagcaaggcgtattactcagggttaaagctcttaatagtaaggatcaactcctatatttgcatagcctgtcacagtctaccaaacactttcactctcactgagtctctcagtgactaaagaaggtatcaggagtgctacagtacagatgagcaccagagatcagagagactaaatggctttatttggtattcactgaatttatggaatgcaaggagtcctagagattagggagtcctacccccttactgagcagataaggaacccctggcaagaaagataaagtgacttgcccaggtcacacaaagtgtgatttgaacttgaacccaaacccaggtcttctgatggcaaagtacagtgcctttctattctaccatgctgcctctggagcatgaaagcccagcaaacgagaagactggaaatcataaacagtactgttgaccaaaaatcattaataggcaggcttcatggggagcagtgcctgagctttttgttccctccctgacaaggtcagtttaacctttttaggttcatcgaataacagcactggaaaatatgttttggataataatagctaatatctattgaacacattttaggtgccatgcagtattctaaatgcttagcatgtattgactcaatcttcaaaatgtccctgtaaggtaagtactatcatgagcaacatattgcagagaagaagctgagattcagggaggtcaactaatccacgcaggatcatatatctgttaagtggcagagctctaatggactccacgcaatttagtttcaaagcccagactcatatatattatctggccccaagtagtgttttacactaaactgctagaggcagatgaacaatgagagcagactgatttactatggcctttagtagaaaggataaaaagataagttttgaaattcaacagaattgtgtttaaccctgtctttgccactaatttactaaaacgcagattgttttatctgtaaaatgggtatattgaaacgtacatcacaagactaaatggagaatatcaagaaaatatagtgcctagtttatagtatgtacccccaaatggttctcattcctgccgtatttcctttgacaaaatgaatttctgccacaccttctccctcaactaccttttaagatgttaattttactgtgctaaggagtcttctaacctgccagtcagtgaaggggaaaaagccctaaagagacctaacatctctctaccagagatgggctttctataagagaatgaagggcccagggctctgtgctgggctgctggcccagctcactagcttctctctgctttacttccaccattactcaaataaattcatcagcccaagaaagcaaatttgcaacatgtctgctatccactgtgagaccatcttggcttctctcacccttttcaaacaagctcctaccacaaaacccataaaaacaatgaacttttatatgtaactatacacttacagccactaagtcatggtgtgccaagcaggaagacaggtatctctgtcttgaacgttccactgctaactcctaccgtaagtcagtataacctagtatttggccactggtgaggtctctatctgatgagctcctcccgatcagaaactgctatcttcaaggtatgcagtcagcattccttgagagccatcagaagtaaccctctgtgggacaaggtgatgctgtaatgttgcaggatatgcaggtttagacatgagagattttcttagctccatgtttccagagaataactctgtggccaacttaatttgctcacatacagtctgttctctctttgtttagcttttcctctgagcgtcttactagaaggtctggaatacgcatggatgagatgccgtctttcctgaccatacttaatagtaggtactataggagcagaggtaagaaatataattggaggtaaggggtggagtaagacatgtgcttctaaactggtaagaaaagtcagatgtaaacaaagaacaggtgataactacagctacaagatcaatggttacttcctatatgtctgaagtaggtatccacttattatctgaaatggcttggtctcgaagtcttctcagtgccttccacctacatttagcccccaaatcccctcaggagccatttcttccctgtccattttcccctgctacctggctataccaccatcattccatgaaaaattaatatatatgagtcatgataactcttatattgtagcatttctctgttcccctgtcacgaataatcataattttatacatattctttcataattaccacttcaaccaacaattactctcagacataatgaattatgtagaaccttgaagctgtatcaatattttgcttaaattagtgatggtgctagtatttattgagcacttattatgggctgacaatatacaaaactttatgcatatctctcatttaagcttgacaacaactttttgaaatggtctgtactattatctttaccgtataggtgaggactctggctagaaaggttaggtaacttactaacagatggcacagtcacaataatagctgaggtctaagaccacagcacctgttctcttaaatctcatatccactgcttctaagcacttgcggcaacaggtaacataaaacattagtgtctgttttcacttcctcacatcccattctctcctttaatgacttcaatcaggcttcccactacaattgttcttatcaaggtaaatgaaaacattgtcactcacaaaatcaatatccggtgcacagttttcagtttattcaaccattcccagcatttggcagaatcaattacaacttccctgaatcgatcattgtctctgtttggttatcaagacccccttggtttttctcctacttcactaatctatccttctacgtctcctttgctgggcgcttctctgctttctgatattttaaatttgagtgtccccaagtttgtcattagacttcttttttatactcgctcccaaggctagccatccggtatcaagactaaaatgccatctgtagatcaaaggctaccacatgtagatctccagtctcaatctgtgctctaagctccagactcttatatccagctgcataccacatctaagcatctctacttgattgtttaataataggcttctgatatttaaaatgctcaaaactaaactcttggtttcctctcctgaatctgctctactcccagtatgcaccatttaaataaatggcgcaatcattgacctagttgctctggccaaaaacctgggagtcattcttgactctcctttttatcttacaccccatgccttattcatcatcaaatcctgtcaactctgtcttcaaaatgtaccctctgtcttttttccatctccaccctcatctccctaatctataccactatcatttctcacatggatttctgcaaccacctcctcactggtttctttgtttccattcttgccttgccgccacccttcctccacacagcagccagccatgtttttaaaacaaaattcagacaccaacactccttgctcagctcccttcagcagctcccctttcacttggaatttgctcctttcactgcagccagaattccatctgctcaagtgtctccttggaagaagagatttctctgacatcctgtatagaacagcatcctctattcctccatttatctctccctcttattagacttctaaaaaatttatagtacttatctctgcttaaacattatatactaaatattgtatattaaatgtatatatgaaatattttatagttctttgttcatttctttacttttgctcctctacccaactagaatgtaagctccatgaggccagggtcgttgtcttttttgtccttggttgaatctccagcaccagaacaggacttgccacataatatgtacacattaaatgaatgttatatgtaatatgtatttattaaatgaatgtatttgaagtcttatcttcactacttcttagtcctatatccttacacaaatttcttactgtccctacattataaatttctcaattataacttgttttttaaaaacaaacaaccctcccttatttttctttctgatgctttataggtactttctaatatattcagcctatcctgtgtatgactttgatacaacaattccagagattggtcaatgttgtgggttgaaatgtgtcaccccaaaattcacatgttgaagtccttgcccccagtacctcagaatgtgaccttattgggaaatagaattgttgcagatgttattagttaagatgaggtcacactggaatacggtgggccactacttccatctagttcaatatggctgatgttctcataaaaacaggaaatttgagcacagaggtgcacacagggagaatgttttgtggagatgggagttatggtgccacaaacccaaaaactaccacaaggcagagaagaggcctagaccaggtatttccctagtgccttcgcaggaagaatggccaaaataacaccttcatttcagacttctggtctccaaaatgttgaaacaatacatttctcttgttctaagccacccagtttacggtactttgttacagcagccttaggaaatgagtatagtcagtgagatattatcctcatttagtacatgaggaaatcgcagctgagaaaagttgagtaacctgccccaggtttcacagctagaaattggcagggccgggctttaaatcaaaatctgtaccgcttcaaagtctatgcacagtggcggtggttcttagacactggtccctggcccttgttggtccagagcagactgagaaaaggaagtaggatgcagtgatttttcattgagctaaaatgaccttcttttattatagaattattgccttcctgctatttattttttcttcctattgttttggtattgttctttttacttctgaaatgatggtgagaataaacagtagttggatttttttcgtaaatttttattttgttttttaatgtctttcattttattgacaagataaaaagttggcaattctgtggcctatagaagtttgttctgaaatgtttctggtttatgaaacataaatgtctgaagacaaatgttccaatgctgtcccctttatgaaacaagtcctcagcctgggcaacactgtgaggccccatctccactaaaacaaacaaacaaacaaaaaataccagctggtcatgatggcatacatctgaagtcccagctactcagcaggctgagggaggaggatcacttgaccccaggagagccacactgacactacagtgaggtatggtcacgtcactgcacttgtgttgcctgggtgacagagcaaggccctgtctcaaaagaaaaaaaaaaaaaaggaagctcttcacaaacagtaacacacttggtagagagaagaagctgtgctctcaatcaactgtagaggtccctgctcataaacaaagtgtccacgttaatggtcacaatctcaattaattaccacgaaattattctgatataatcccacgcaacgaatttgtttgaatttaacaatattcatttattcagaaatttccttagtcttgtccccttcctttttagtatagatttcctagttttcagtaaaattcttgagttgcttttgacttgatccattttctttcgggttcaggatttgtgggcttgtgcgaatgtctgaggattaaatgagatcacctttgttaagtatctagaacaccataaaaaagctttcagtaaatgctagttcccttcaaagaaagaagtgaagatttatgcatccagaagggaaacgactttaggactaagggagatttacagcaactggatgactttgcaagatggaccagcctggagagtgttaataaacttcaccctcttattgaacattcagtgatccccatgacagtttatagaaattgtggcagtctatttttatgaattcgtgttcatgagtatgtgtgcatacatataaacataagtatatatagaaattaatatatattgatgtcatatacatcattaatataaatttgagtggtatgattgtgtgtaccttcttcaatttctgagaaaactcagaaggagaaagccttcctacatataagagtttgccttctttgtttatctattatctggtcccctataatctaatttggggaccaccaatttgtcctatcctgagaaaccttagttaagaccacttcaatctatccctttgccaaagttatctcagacttcaaatcagtaaagaagagattccttcattctgtgagtatatatggagggcttacgatgtcccaggcactacattattacgttgaatgccagaagaacgatgtaatcaaggtcatattctccctctccttaggctctcagtccagggagtaataaatttaatagataatagctaactacacagctgcatagcatatttttataaggactttcattaaggtgctatagaggttgagagcaatggcatctaataactcagtctggagactgaggtcatgaaggcttctggaaggagaggatgagtcttaagctgggtcttaatagatgagtaggagatattgagatatccaaacaacaagtgttgcaatcagagtaagaagcatatgcaaagagatggtggggggttaaccacggaactctggaggagtgaaattttatccatttagcacttaataacataagtacatgtgatggaaaaaaagactaacttgatagtaggaataccagagactaatcatctttttttatgaacttcttcaatgcaatgaaggctaaagtggaaaatgtcatgctttatagttagacagtcctgattcattcaagctgacctttgcaagttgcttaacttctctgaattaaaccttggttcctcatctatcaaatgaggataatattatctagttcatatagctgttgtgttcttatgaaataaaaaaaatgtaaactatcttgtttctcacacaatgtacttacattaaatgtcaaaacaagacaccagactaaatgtcagtttatgtcctgaaaacacttgtgtcattgtgaataagaacattcatcactcataccaaatctggtttcccattgggatatattcatctgtttgcttcctaaaccagtggtttcaaaactttgcttgctgacaccatcatttaaaatcactttgcatactcacccattatcttaatatttacataattgatatttacataaatatatttatgtaaatattatatatttacataaatatataatatatattatatatatttatataatatatatttatattataatatatttattataatattatatttattataatatttaataaatatttatgtaaatataaattatgtatttttatatacataaaatattataaattattgtgtaactgtattactgtgtcacagtgtggcacactataaaacatataacaaaacagaaatttaaaggctgtgatgaaaaattaataaaaagagaaggtcttggctaccactggggtgcgtataatcactttgaagaataccaagatctcctagacagaaaagacctaatctcattcatttatggagcacccagaagcacagaccaagcactaaagaaatatctaggaattgaagaagcaacactgggacaatagaaaaaacccaaaaactctgtggcctactagtgccactatctgtacaaaccagttttttagtttttatttttaatatatattttaattataatacaagtttaatatagtagaaatgttaaacaacctaaatgtaatggctctcccccctcaaaggtcagtggcaaatagagagtcaatattcattatttctaaaagagctaattgtaataataaccacttgctgaacacttataaggggcagacactacattaatgcctttacaagtacttatttgctctttacaataatctggacaccatattatacctctgtagagggtatcaaacatttcggtccatgctgtgggtgggggtggggggggtgtctgcaaaccatggcctgcaggcaaatctgtcccactgtccatttttatatagtctataagccaagaatgtttttcacattttcagtttgtggaaagaaaaatcagaaaagaatactgttttgtatgaaacttttatataaaagttacatgaaattcaaatttcatgaccacaaatagttttactgaatcacagctacatccatttatgtatttatgtattgtctatggctgcttttgcactacaatggcaaagttgactatttcaataaagattgtatgccctataaaatataaaatgcttagtatctggcccttgacaaaacaagtttgctggccccttgtgtatatgactggagtctactggacatgtgcacgttgcagcttgcatggctctaagtcatggttccaataacaatcctatctggaaatgtaggttcagagaggttgtcacttctccatgcacttaggaaatggcagaatcagaggtttttaggataaatttttaaggctgaaatatgcacttgatctcacctagagttcaggacacttttctcttctggcctcttctggctatgtaacttaactagccacacgtaatataacttccccactgcctccactgtcttctctgtactctcctatctagcttttaatatatttatggctaaggacagggtagggtggggaacaggtcaatggaacaaaagtacaattcactcattcacaatacttttcattctccctcttcgagtctctcaaatacacacttggcccctgcgtatgaggctctgctgtctctggctgagctgaaagtgatgaaaaggacgtgtgatggaatgctggaaacctcattactggctctttgcctacagaaactcagccagcttatcttctttcccaacgaacttcaaacttacactggctcagctggttctaggtgcctgtaacaagctgctctgcccagtggagatcagaagccgatagaagatactctgcatatgctttgctgtcctggagaatatgttcccttttttctcattctcattgtagcagattctccaagggtctcggccactcctgggttgtaacgtggataccgaaaagtgcaagttacaataattttttcctggacggtatccagaagaccagacatgtgaacataatttctgtggctgcccaattatagttagaacttcacttctaagcaaggacaactacactggcaggacatggactacgtaaagttgtgagaagagctttcacatatgttaatctcattgactcctccccgcaaacaggaatttgttattcccattttatagataaagatgctgggactcaagaggaactaagcagtgtatatttttcatgtatccggtaagtggtagatctgagtttcaaacctgaagctttctgacacctaagtgcctgtcatttcagtaaaggagcctgttataaagaagtcagtttgttgccataatagtcattagaaaacaagcaaacaaacaccccttccctgcaacaaatcatggcatgatatgactgggatgcagtacagcataatggagttcaatgatgagcagggcttaaaattattggcaaatcatttaaacagcctgattctctgtaaatttatctgtaaaatggaagtaataacatgcctaacttttaggatcatggtgagggttatataaaagaatgtaggtattctgtttatatgaaatgcctagaataggcaaatccatatagatggaaaatagattgatggtgcctagggctggaggtagggggtgggaggaaatgaggagttgctaatagttatggggtttcttttggagatgatgaaaatgctctaaaattgtggtgatggttgcacaactctgtgaatataataaaatccactgaattgtatattttaaacaagtgaataatatggtatatgaatttaaaaataatgtaggtaaagggcttagccaatgcctggcacaaaacaaatgctttataaatgttaatttttgtcattactactttgaggcagagactatctggttcaccaaactcatttcctcttctcctagagcacaaaactagactctaccctaaaaattaggtgtggccatgtgtctgagtctgggccaagggaatgtgagttctggccaatgtaagggaacaagcttggcccataaaaataatcccctcacaagccttcatgttatttcccttctactagcttgatgcaatgaatcttttggcttcagagctacatgttgaagatgaaggagccatagtgtggaaaagccaaagttcctgaatcactgaccaggggagagttgcccattagccaagaagaccggctttagactttctgagaaagtaaataagcttctaattgtttaaacctttttttgagttttgattgtaacagctactggtattattataactaacatattattgttagtttttacagtaccaaattgaggagaagtgtcagcccttgtcacatgcctgaaataaattcactgtagattggctgaccatgctgggtctgggggcatgagtgcacacaggaaaagttgtctggtgaatttgagcattattttagtactgttgaatagtcactggacagtttgagtgtagtatgcagcttctaattaccttccccaactttggggaagcagagtccttgttttgccctccagtcccttcaggaagggccaaatgaacagcaggcaacacgcaatcaaaccgtgcatagcagtagggtgtgggaacggcgaaggcagctctgtgcctgctgctccacccttctctcctacccttctttgtggaggacaccgtaccctgtccacttcccttttgataaaagggaaagtaatacaaattaaagatgtgacccaatcacattgttttgtccttgcttagtgctttttaaagcagtatcctacactctaaatgtggaaggcagagacagcttttagctctccgggtgaataatgccaaagtatttgattgctattgtctctctttcagagggtttgctgtcaaaaggaaaagctctgagtcattctttagaaaaggtgaagagaggatatgcaaccacaagccaaaggtgacagatcggaaagggaccaatcactgggagcagggtttctcgggtttgtgagccccttccctcatgcaattgtgtcaaattgggccaaaaatgccttctgtatctttctcacagaggagtgctgtaaaacccaaagggcatgtaaaatgaagtacagtcagatcttataaaaatagctattgattcctgagtgtttactgtgaagccctcttacatagcttgtttaatcttcttgacaagcttaatacataagtattattggtccacttgagagctattgaaactgaggctcagaggttaagcaaagccgtgtccccaggatcacacaggtagtaagcaacagagctgggactctaactaaatctctcaccaccatgcccttcaaggacttcaaacaaatgaaaagcattagcaaggtaaatggctcttctgctggagaatctagaaagtccaaagccaaaatgtctacccttgcgtggaaagaacatcctacagggctgcctgtgttcagcatattaagtgcctaagagaataatgaaacagataagaaaagggaagaacaaaggccattgtccccggccctggagactagcctgcctgaacatgattcacagtcattcatggactcagacctcatagattttgaatatcagatcattgcagatagaaatgtgaacttccagatagcaaccatatcttcttgctgaaaatagcttccctccccccagcacaaagtcataaagaaagaaaaaagaatcttaatttccttctgcttcctgtttgccagactgttcctttcttccttcaacctcacggtcccattgtttctcttatttcttcctagtatgctctatttaaaccagatggagcagtagcattttgaagcgatttttgaacccaagggactcgcgtcataaataaataaaacaaatgaacactttagcaattggcaaatcaggcaggaatgggtttaacaacggagctggaaatgtagctgaaaatctactccacgatgaaagatcggaatgtggcacaagttcttttcaccgaataggtaaccacactgacttctttcagtaaactgggggctaaagagagacgcagtgggaaggcagtggcaaagagcttcagagacacattcagtggccccgtctactttgcattaccaatatgctgatacattatcccatggttgctacgaaatatttgttcaccacctataaaagtaaggcattttcaagagctggttttctttaaatacattctctttcctttaagtcttacataattcaactatcattccatgtgaggcttaatttaaagaaaaccataagttgagttaattcactgtgaagggttatggaagctatatttattccagagagtcagcagcagtgtaatggagcatctattatatgcctgacctagtgccaggttctgggaatacaaacatgaatagcccagcccctgcccttaagacgttcacagaactgggaggattcacaaactaagtgaaagtgaaaggcctgttaccgctattaagatagaagaaaatatatgaggtgcttagcgatcacctctaatgagggagaaattatgtgtggggaggggaagaggatagagtttgtgattcagtaaaagagtcctagctgggtgcagtggctcacgcctctaatcccagcactttgggaggccgaggtgggtggatcacctgacgtcaggagctcgagacctgtctaagatgttgaaaccctgtctctactaaaaataccaaaattagctaggcatggtggtgggtgcctgtaatcccagctacttgggaggctgaggcaggagaatcacttaaacctgggaggtggaggttgcagtgagccgagatggtgccactgcactccagcctgggtgacagagtgagactccatctcaaaaaaagaaaatcctcaaaaaaagaaaatcccctgtctgtctacctagaaggcctaagaagctgttaaccaagggagaagaggttgagatgatggtctgggcagagagcacaggaggaattgggacaggctccaccgtgatgtgaaacaacctgaaggttatggtcactgtagacatttgaacccagctggaaaacagactgaggagagaaatgagaggcaggcttgggagtcacggggtggatcattctctgtcatgtgggtcaggggactccatcccataggccatgggagcctctgtaagactttaaacagcagagtgaacatgatctgatttgcactttagaaaatcaccttggcaaccaggtggaggatggactggaggtgttgaggctgggagcatagagaacagttaggaggcaatggcagcagtccaggtaggagggatagggcctgatcttagatggcagcagtgggaatgtaaagaaaagaagggagaactaatattaggaaggagaaaatctgggctggaggtaatgaaatctagattctaatcctagctttggcacaatctcttaacgtgaccttagataagctcttccttttctggaccctgtttcccaacgtggcaggtgagagggcgacattttgtggctatatgagaatgcactttatatatgtacttggttattattatttactcattaggtaagccagccagtcagtcagtcagtaaaggcactcattccttgagtcacagttttgggcatcttgatatgaaaaagcaaaatggtagtacaaaaaaatccaaccaagggaatgaggagacttgaagtccataagcatttactgatgatacattaagtacaaaatgtacatcataatctactatagatataatggaaacagaaatgaccaagatgtgttctctaccttccgagagggaaatgaggcagcctatgattaattcaattaaacaaatattgagtaaatgactatgtgcagagtattgggtctgtcatagtaaggaaacagagaaataggacatggtccctaacatgaaggacttcgtagtcacaaatggaagaaaagtgatactgctattggagagttgcaaagcactatgggagcccaagacaaaagagaatatgtaccaagtcaaaaatccatttttaattttcgccatagtaaacagaaatataatttccctttctgtggttcaatgctgctaaaagcaccttcagaaaagcagatgaaagaagagatcattcattttactctaaacaaaaatttttctgtgggtgaggtcctatactaggtgttcaacgtaagaataacaagacatgctctttgccctcaaagaaatgagtcagtgtttgtaacattttgaattctggggaggagaaagtagaagtttggttctactttttctacctaacaattcaaagtgccttgaacagtgcttagcacaaagtaggtgctcaataaatgatcaactgaagtgaacaatattaaatttgctacttaaagaaagaaaatgaagttgactctaaaataacaaatacttgacctctaattatccaaagaatacatttaggaaagattacttttatgtaagaagtcatgagtaattaatcaaaccacaggccactggcttgttgtaatactaattcaaacaaggtttctaagcagcaggtctctactcccaaagtcttgggaagcagatggtacctaattgctttaaggggcatttggttgaccacacttagttctttaagccagagtaagttcagttttttgaactctccttaagacaaatcaacctccaaccccttacgtataacaagctgatctgtttctaaacatgtaagctagaaagaccaaacttgggaatggtgttgcttagaaagaaaaagttatgtcttcggggcatggcagggggattctactagcagcctggccaagaaaagttgctgacttggcatataaggtatgtaaaaagctttaataaaattaaaggtgctaacaatgcaggtgggatttaaaaagaacatgcaccacattgtgatattttttcaagaacagagaggcccagaatattgagataccagctggtaagaattatgacatttactttaaaatctttggccagtaagaagtgattctaaaagacttgcaatgggtttggctcatggtctctgaaccttgttataggccaacttgataaaacacagtgatttcacataggagcttttgattacagactggcttgattgtcatcaagtctctgccattcactagctgctacaaacttggataagtcattgagtctcacttaagcatcaatgccatctgtaaatgaagactatgatgaataatgtcacagggttgtgatggggagtacatgagataatagaggtaaacagcttagtacagtgcctggcatataacaagtatggtgactattactattataattatgtttgctgagagggaaatgttctttccaaaattggctaaaaaccctgtttcaaacatttctgagactgaaatgaaatatatagatgataggtttgcagaaatggcagtgggtgtttcattttcatataattataatgtgcagaagaacatagcagcatcttatgccaatcatgaatcttttctcatagtaaaattattttgtgagtgaacctgaactgtatgtacaatgtcttactaaatatgtacttccatgtgacatttggtatcatgggtttcttctgaattctatttgatgataaaatatagagaaacctagcctggaaggacctcaatgtagatatcatctctgtcacttaaggactgtaagctctggcaaaacaaaaactttctgatcctcagtatacacatctgtaaaacaggtataataattgtactatagttaaatggttttgaaagaatttcatgagatgataataatatctttactgagtttttgccatgtgccaagctctgaaagcctatcctaaattatctcttctcatcctacgttatctcttccacatcctatgttatctcttccacatcctatgttaccttccagagtgtggttgtaaagtcagggtctgcggccaagagttcagaacccgccaggtgggatcaggtgattagagaggcagagggctgctaaatgacagccaaaaatatcagtagcttttgctgcattcaagagagagctgcatctttgacatgtgagaagtgggctgcaggtagacgtccagcaggggcagaaaaaaaatagttctgaatatatgcaaacatcagaaactttgggacctgtgatcatgccctaggtttccaaagcttattacaaataactgcttccaaatatctgtctagagaagacgtctaaagggccccaataaaggcagataggagcataaggatagatgtccccaatatatcacatgagttaaaaaggatgtaaagaagaaaacaaagcacatcaacctgctctgctccaagttaaagttatttagctcctggaactggtttcatctttaaaattgagataataaaactatggcacaattcacattgggctactccacacttgtaagaaagaatggagaagctttctatgtactgatacataaagatctccaagacacatcattaagtaaaaaataataataatggctgggcacagtggctcacgcctgtaatcgcagcactttgggaggctgaggcaggcggatcacgaggtcaggagatcgagaccatcctggctagcacagtgaagccccgtctctactaaaaatacaaaagaaaaaaaaaaaaaaactagccgggcgtggtggtgggtgcctgcagtcccagttacttgggaggctgaggcaggagaatggagtgaacccaggaggtggagcctgcagtgagcagagatcacgccactgcactccagcttgggtgacagagcaagactccgtctaaaaaaaaacataataataatttaaaaataataataataataataataatacagaatagtgtttatagaatgctcctttggtatataagaatggggctaaaaatttatctatctatctatctatctatctttccatgtatgtatgtatgtatgcatgtatctgtctgtctttctatgtatgtatgtatgtatgtatgtatctatcttatctatccccccaccacacatgcacacacacacacacacacacacacacaaatacagtttgctgcatttgcaaaggaaactacagaaagatacacaaaaacctaaaaatagtgattagctttgtgagacgaatgagggcaggagaggaacaaaagttttcaataaataccttataaaaattaaatatttaaattaatttaaataataaaattaggatagcaattggtacataccttataaggttgttttgaggagtaaatataataatgtattgaaagagcttaccatggggcttgacacacagtaagcattgacacacatcagtgaagattatcctctctttttgagaaagagtgggaaggagcccttccttggccttaactttctgctcaagggccaaagagaggtggagacaagttgtaggaggctgactgctggggctttcattgagacttaaggagcaaagaggctatgatgaccttctggtatcttcctaggtcatgcagctctattcccagaaatttgagagaaaaagcccacttagaaataaagatggagcttttacttaggaacctgaatacagtggatgaaagactacaaaatgtagagaatcaaaatccaacacataccagatcgatccatgactctgagaattagaaatgatttaaaaacaagaatgtcttagaacaaaatgagaaaagatgaacagttgccaatgaaatgttattttctttcactgtgttcctaaaaaatttattcaatgtccttaaataatacatcttgcgggattaattgaaaatgccacaatggaatgaaaataaaaaaaaactggctctgaataaaatcctttatatagtcacaaaattgataatctacattttttttgctccatctgcactgaaaaggaaaatttaataatcagatacaaaggtaggaaattataatgaatcacaagtgttcagatattgtaacccaaacaattgctctagtagtgcctgctttacttagggttatgctaagtggctgacaaaataaagactaattctttcagtttcttttgaattaaaacacagcatttgtaacatagaaaagcaccattttgggtacttgtttgggaaatcgcacacaacaggatgtctaggctttgttagatgcttctttaagtagattctataaaaggagcaagcaggcaggagtccgggagatggtgatgagaaaccccctttgggtagctgccatattgttagttatggtggttgaaaattccagctctgaaagtagaaagatctgaacacaaactctgtcactcattagttgagtaactttggcaagttactcaactttgctgaacttcaatttcccatcaataaaattaggataaatataatccctaccttatagggatgttatgaggatccaaagagataatgtatttaagaatttaaatatacctttcttagaacagtgtctggagtagatatcagtaaatattagccctgatcataaacatctatctttgtattcattcatccatccattaaaccatcatttaggggccacttcaggtcaatctttgggttaaacaaaggaaattgaggaagaataagacatagtccttgtacacagaaagctctcagcccattaagggaagatgaacaaagaaggctgtatggaattagggacgctatgaaagaagtcaacatcagttataccgggacatacaaaggaagtggttgatgtggaaggagtatcatagagaagatgatacttaatgaaaggcttgaaaaggcttgaaatgtgtgtatatacaaggcattcaggacaaaacaacaggaagagcacagacactgggataacctgtcgtggtagggaagggaaagaagtctagtatgactgggtcccagagaacaagtgagccagcttgataggtaagcctggagaggcctaggggccacatcacataatgctgagtatacaaggaagtttctgtaatttggtgttcaacaaatcaacttacttaatttgaagttgagagatagtcagcattgccctgctagggaaacatcctgaggctattccacattattatagtagaaagataattttgtgctttctttgtcagctgtataagatacctgctgaaagagtatcttgcctgatcttgccagggacttaccccctttgcaaactcagtgttggcttgggatcaggatatctcagcaaattccccttaactttcactttttttttcccctaacatatcttctcttaaacaggtagttcacttctgtacaaaaggattaacagtgtcagtactggttaaaaaagtgttttttaatggggtgtggtgaaatgaccaggatatagacacctacagtttcaaacatcttcttctacttaacaatggtatgaacttggacaattttttacctttataaatcacaatttccttatctacaaaaaggtagaatgtgacttatctcatggggtgttgacaggagcaaatgtagtaattaacgctaagtatctactatcaagactgacacagttctacaaatggtagctgtcattattgcccatgaaggtgaagtaggtgatttacatggcaggcttgggagaaagaaatgagtctgttggggaagaagaaggccaggtttgtttgaaggcagaggaagctaggccaccttgcactgctaaattgtgccatgttctgactggggctgggcccagagaaagctctaattcctgtgtgttgattgaaactgaggttgaagacactgatctgtctcttcctggtgctcatgaaaattcttcctacctagcctgagcttcatggacaaataaaggctaaccaaagcactttcttttaaaagtttcaagttacttaaggtctctagatttggagcagaaagagatgctaataatgaaacttgctaaatacagcaatttttctgcagtccatacaaattttattagttaaggaggtgatgggaagaaagcaaatatactctgatggtaaggaattgcagttcttccgaaaagcactgtaaatgacaatataatgacgcatcaatccagtccccaggggggaaaatatattatcctctatggtacatctgtgctgttccagcatttcacagacaagattgaactctcacatagccccaggaaagccacatgctcttgccttttaacccagcatctttaactggttaaagcctatttcctctgtagctcacaaatatgtttataataaaggtcacctacaatggaatataaagggaatctctctgaccatatcacacaaattctataatctggatcctgtaaacccactgatgaaaaaaacagtgacaaagaaacaaaatgggactttattaacctaggttcttgaattgtaatgtttaatgccaagcattaatggaagagtacacataaaaatttcaacaaacggccgggcctggtggctaatgcctgtaatcccagcactttgggaggtcgaggcaggtggatcacctgaggtcgggagttagagaccagcctgaccaacatggagaaaccctgtctctactaaaaatacaacattagccaggtgtggtggtgcatgcctgtaatcccagctaatcgggaggctgagacaggaaaattgcttgaacctgggaggcagaggttgcagtgagccgagatagcaccactgcactccagcctgggcaacaagagtgaaactctgtctcaaaaaaaatcaacaaaaaccaaagttttctttacatttgaaataattattttccatgccaattatcttgaaaagctttggtttttagatgagagctctgaaagatcatataaataacccataacaagctaacctaatactcatcatgactgttatttacagtagtgaaaaatcagaaacaacctaaaagtttaataatggtaaataggctaagtcaacagtgtcacttccctattatggaatcttagatctcttttaaaatttacttttacaaaagaaaaaaaatgtatggacatgaagaagtgcccacaaaacattgttaaatgaaaaaggaagtatcaactaccatgactaccatgtacaataaaattacagttttataggatgcagaaaataaatggcaaggacctacaacaaaatcaatagttattttttattgccttatttattttttataatttaaaaaaatcccaataaaatatccttttaagatatttaactttctaagtaaaagctggcaggctgtggaagtataaaaaagagtgcatctgaaaacatgaaaaactttgcatgaaaaatgtttgtaacatattttagatgacattgttaaatgcttatgctataatgtaactaaaatgaaccagggtagttagttgtacatataatataacctcccttatgtatttcataaacagaaatgatactaaaatgagacaaaaacagaaaccagtggttgcctctggatagtagaaattattgcttagttcttcaattgtttttttaaacatgcttctgtattttgcagtttcaacaataaacatgtaataccattataattgaaaaatagtttctggttttttctttttttaaaaaaaatgtataatttgaccgactgaggtggctcatacctgtaatcttagcattttgggaggctgaggcaggtggatcacctgaggtcaggagttcgagaccagcctggccaacgtggtgaaaccccgtctctactaaaaaaaaaaaaaaaaaaaaatattagctgggcgtggtggcacaggcctgtaattctagctacttgggaggctgaggcaggagaatcacttgaacctggaaggcggaggtggcagtgagccgagatcacgccactgcactccagcctgggcgacagagcgagactccatctcaaaaataaaataaagatataattcagcaggaaaaaaactgagtataaccttaaagtcactgaaatattaagttattcagactaaacttccggatattacacttactacctgggtgacagaatcatttgtatcccaaatctcagcataatgcaatacacccatgtaacaaacttgcacaaatatacctcctgaatctaaaataaatgttgaaattataaaaataaataaatgcgttaattaatttaattaaaaaataaagcatagacatgaacaggaatgtgatatacctaacttgtacttgccctttgtactttctgaatgcaggtgggaattagctgcagctctgtttcctctgcatattttcacttattaaaagagttctaaacttcttttctccaggctaaatcttcaatgtaaaaaaattattttggaattaatacatgtgattgcctaaaaatcaacttatttgttattatcaagtaaacttttattctctggaatcctcagagaaaagaagtatctttctgaatatctgaattttccatatagctgaagattaagacttcaaatggagagagttaaattgattacttttgcgattactttacttttcaaaacatcattattaaatacttgcctcacctccagaataatatactagatataataggtttttaaactgatgactcaaaactatcattatgaagatctgttattgtgataataaaacatcaagtagttcttaataaataaacttctaaccctttaaattcaaatctactttactttccatgttgctaacatttaaaaagaacaacaaaataaatctaagaatataatcctatatcaattaaataaagtagaaacgtttacagtttctacttaattccattattttattttttaaaatatgccataaaagatttacagattctctagcaatgaattctcttcgtgaaaaaaccacatagactcaaaagcatatgaaggcttattttgcatggctcttggaaaagtagaactatgcttggaaggcaaaagacaatagatttgcagtcatcgcgcacaccaacaaaagtttcaacttcacaattaaacattttaaaactaggccgggcgtggtggctcacgcctgtaatcccagcactttgggaggccaaggctggtggatcatgaagtcaggagattgagaccatcctggccaacatggtgaaaccccgtctctactaaaaatacaaaaaattagctgggcatggtggcgggtgcctgtagtcccagctactcgggaggttgaggcaggagaatcgcttgaacccgggaggcagaggttgcagtgagctgagatcgcgccactgcactccagcctgggtgacagagcaagactccatctaaaaaaaaaaaaaaacattttaaaaccaacaaaatttttacttaaaaatttatttgacaatgtttattaagctcctattctatatcaggtgttgtgctaggtgccggggacatgtgtctagtgcctagacatggtactggagacagcatattcctttcataggacatgttaaggcagcggctgaatgaccacttggcaaagatattatagggggaatccaaatacataatatcccccaactcctatgattctcaccctctccaactgcacttccataatccccaggaaagcagagcttgaatcaaaggtttgcagtaatatatgcagaggctcacatgtgatagttcattttgagcagtgatcctgagaagaggaaagaggaagcagggaaaccttctgaggagcatacacaatgcaattcagaactatctatccaagggatggaggagagctctacccaccagttcccttcctctccaattgtcgagagttgccacatgcgatgccaactcccttgcacgtccagttttgtgcatgccagagtggcgagtgggctctcgggtagaaagcagagagaggcgtggcagctaaggcaaggtggtgtcagttacacctggatgaagctggttgctacagcaatgccttgagttagtttggcagaaaaaatgcaagactgagtgcaagaggtgacaacacctttaagattcttctaacccatatggggtcatgataacaacaaaagtaattaacacttatcatcaagcaaacatagatactttccatacattttatcacttaattatcaaaatcaactccatgaagtaggtcatacttttatctctatttatatatacttttatctctatttcaaatacgagaaaatagctttctagaactaagtggtctgcctgaggtcatcaataaatggagaacaaaagatgaggctgaaggactggctgcagagccctagaacaacactgactcccccagggcctataagcatccaaacttctcctatataggagaacagaagtagaaatcagttgcccttaggagttcctgtttctatatctgtctctgacaagagttccttgaaggtagagattgtgccttattcctgaattatatccagtaccgtgcagtgcatgacatataacaagtgcacactgttggccgggctcagtggcttacgcctataatcccagcactttgggaggccgaggggggcagatcacctgaggtcaggagttcaagaccagcctggctaacatggtgaaaacccatctttattaaaaatacaaaaaattagtggggcgttgtggtgcatgcctgtactcccagctactcatgaggctgaggcaagagaatcgtttgaacctgggaggcagaggttgcagtgagctgaggtggtgccactgcacttcagcctggacaacagagtgagactcggtctcaacaacaacaataacaacagcaataacaaaaacacaaacaaacaagtgcacaatgcttttgagattggttgagtgtctgttccctctcagtgcactcacggttcttgaaagcaggaaccctgtcttaatcatctttatatcccagcacccagcacacatagttcaatgtttgcttgccctaacagaataaaattttccagaaggcagaatgcatagggttaaaaacgtgcagcttctgtcatatgggcctgagttagagtcccacctttgatactttaactagttatatgatcttgagtgaactatgtaatagtcttttaaatccagagcttcctcatttgcaaaaaagcatgatactaattgtattccatcatgaggttgtggtgattattacatgaaatttacgtaaaagctcttatcattaatacttggcacatggcaatcttgcaataaatattagatattatgataattgttggaaatttattctgtgtttaagttatatttgaagttcctaaactagatctgaaacatttagaatgttcacagtggcacatatgggaaaatctctagaacacaaagtacctaggaaacagatagtacctgtacacagtgatgctcaataaatatttgttgaatgtcagataaaaaacaatgagccatgtttgcttttggcatgaattaccagcacaaatgttgaaaatagaaaaatataatatacgttgctatttaatacctgacagggagaaagtatcagtagcccaagatctgactgtaaacaaagaggagaaacagctatataacctatgaaaggtgtgaagccataaaacaaggccagaaatttggtaatcattctcaagacaatatgataacaaatgtctttcaatacttggctttatgtacctccccaatttcgtatcacttgtgttttatggtcaaaaattgcaatatgttgccatttttttaaattacagagctatgtatttccttaaagtactgtattttccttaaagtacctaattagctaatactacttaattacaatttacatttagattctgcagactgaaggatctattttggaatccttttttttaatgggatatggaacccagatactaaggaagaaactgggggatagaagatcaatgcccaaggctgtgtaggcttagtgggtattctctttggatcatgagagaaagacttggattgcattccagctctgccacttatttactagttgagtgatcttggacaaattatttcctgtgtaaatctgtttttcatagtctctagtatgaggctgctggtgcccatttccctgactttacttgatgatttattaggggaacaagcagagtccactgtatgtggtatgtactcaaccgctgcttgttctcttcccctcttaaaggtaagagacaagtctgagtcctggggtagctgccaataatattcattcaggtccccttcttaattatgcaattcatcaagaaagaatctttttgagaggaaaaaaataaaagtctgaaatcagcatgcctaggacaaaattttacactgtgtgtgtgtgtgtgtgtatatgtgtgtatatatgtatgtatatatacatatatgtacatatatacatatacgtatatatgtataaagttatatatattatatatacatatatataatatatatacacacacacacacatatatatataactttagttttttcaacaagattgctcattaagcaagaaccacattgtaaagttcagctccaccttagtttgctttctggccaactaatctgggcagacttttaaaatcacactggctggtaggtgaatatggtgtttcattacaatcattacatttaccaccccagtgctggtaatattctctaggctgcctgtgatgcttagtggctgagtggcaagtaagaagtttaatttagctttctcagcatctgcaggttttgttttcaacaaagaacttcaggttacataacagccttggcttgtttcagaaggtgaaacttgactctccaaattaactgttgatacaggtcttcagaagcagaacttgatgtatctggaagtgatcccccccaagtcatttggaaagtaacaatggcacttgaccttcctggttacttagcaaaagaaggcaggagaaagaaggttctaagcgtaagtaggtgatcattgaaagggcagatacagcctctaaaaatcaggttaggccttcctttcccaaccctttctagctttaccctcttgctgtccacactccactggataggtgtgtctcactgttgtgggtgagcattttgtgaaagattttagaaaaagcaaaggggaaagtgtaacatgaaaatagggtgcctgggatcatatgaaaacaaaggagagaggaatatgaggtgggtacactgtcctgaactatttcatttaacacatgtgaaatgtggatggaatgaagcccagcacagcaaataaggtacttttttttttttttgagactgagtgttattctgttgcccagtctggagtgcagtggcaccatctcggctcactgcaatctccgcctcctggattcaagcaattctcctgcctcagcctcccaagtagcttggactacaggtacccgccaccatgcctgattaattttttatttttgatacagacagggtttcactacattggccaggttggtctcgaacttctgatctcaagtgatccacccccgctcagcctcccaaatgctgggattataggcatgagccaccttgcctggccagatacttttcatccactcaagaggaagacacaagaagcggataattttagtataagatagtgagtgccaagatggacaattcataggaacaaagagcagtggtattggaatgacagaagaggataatcagagactaattaacaacaatatatagttcatataacatgtttctatttgcagatgtggacggcataaccaaagcttgaaactggtacaaggacattcatgtagttagtaggacatgagagacatttagggtttagtcttgtaaatacaacagaaataaattttctgactccaaatcctatgtatttttctagtagcgagaagaagctgagggcaggtggaatgggttcatataaatatactccagaataaaaaaggtaaatgtaatattataaagtattatagtaacataaatatgctagtaacaatcatttgtaatactaataaatgtaaccaattttcatggagcactaactgtacccaaggactgtgttaaactcttaacatggactgtctcatttattctcacagcccctttgacaaatgtaaagcctgatacttggttaggtgacacacctaaggttccacataactagatcctgactataaaaccatagcctcagcagtcaccaacccccttattgaactgtgcattcaaagaatgcaattcaaaatcagatacacattccttcttgccttgtgcacacaaagagaactagataaagaagatgacaactcagcaaaggccaaaatgtcactgataagctgtgtaaagggacaatcacatgggatagggtgtatagatgctatgaccactctgctcagtagaggcactacactgctgaaggttagttagacagataactagcttcccagcatttcccctcacttggacgcctctgtggtatcatttgctacaaaaggaggtcttctcgggtaatgggatgacgtccatctgtgacttgacgtcaagtgagtcattggactgtcgtcatagggcaggcacctcagtgtagatcaagttcaccctgtgggaaccctgcaagtttgctggtgagttttatatttattctgaagtaacacacttggcacctcaggctgactaatatctatgtgtgaccaaggtaactacccagctagccagctttcacagttgtaagaaaagttacaggcagaaaaacataattgaacactaagatgagggtcactgtgcaagtatcatgtctagactccagtctaagtgtgtgggtgtttccattgcctgtctttttattagggtttacaggaagccttgctaatcaaagcatgctccatgggccaaagcaggagtactaggtcacctgagagcttgctataatcattttagactctacttggtgaagcatgtacatattcttttaaagaatttattttttactaagctcaacatcaaattattagagaaatgcaaatcaaaaccacaacgagatactatctcatgccagtcagaatagctgttattaaaaagtcaaaaagcaaaaaacaaacaaacaaacaaaaaaaccggatcttggtgaggttgcaggaaaaaagttgcatttacactgttggtgggagtgtaaataagtccaaccattgtggaagacagtgtagtgattcctcaaagacctagtggcagaaataccatttggcccagcaatcctattattgggtatacacctaaaggaatataagtcattctattataaagatacatgcacgtgtatgttcactgcagcactattcacaatagtaaagacgtggaatcaacctaaatgcccatcaatgatagactagataaagaaaatgtcgtacatatacaccacggaataccatgcagtcataaaaaggatcaagatttgccgggcgtggtggcttacacctgtaatcctagtactttgggaggctgaggcgggtggatcacctgaggtcaggagtttgagaccagcctaaccaacatggtgaaatcccctctctattaaaaatacaaaaaattagcccggtgtggtgttgcatgcctgtaatcccagctactcgggaggctgaggtgggagaattacttgaacctgtggggcagaggttgcagtgagctgagatcatgccacttcactccagcctgggcaagagaacataaatccatctcaaaaaaaaggatcaagattctgtcctttgcagggacatggatggagttggatgccattatccttagcaaactaacacaggaacagaaaactgaacactgaatgttctcacttataagtgggagctgaatgatgagaatacatggacacacagtgggaaacaacacacactgggggctgtcagtggggacaggggcacggagagcatcaggaagaatagctaatggatgctaggcttaatacctaggtgatgggatgatctgtgcagcaaatcaccgtggcacaagtttacctatgtaataaacctgcgcatcctgcccatgtaccccggaacttaaaataaaagttgaaaaaaaaagaaagaaaataaaaaaaaatttatttttttactaaatatttgtttaattgcaaactgagaatatacaaaaaggaaaagataaatgaatacactaggcagattatcatattagttacacagtgctttcacatgttttcctcctttaatctttttaaaacccttaaaatcttatctgttttcttactgataaataaattgtctgaagaaggtaaaaagatctcatcattggggaagaatttgaacctaggcattccagctccagattccacaattttccccataagttacactacctcattaaaggaatttagaaggttgctttaacttggagtagtcaaaaaaggaaaaacttgaactgagatttgaagaatgggtgaggtttgcataaaagacggatttccagagtcgaagaacatcaaaaacacaaatacttggagaatggcaagacaaagtatttttcaggagaagcctaaagaaagtatttaaatgtagggttcatgttcctacgtgagcagcaggagggaagaatgagatgacgatgaaaaccagatcatggaaggccttgaaagctatagggcagagagttgggctacttggaaactcagggaaagagtgacataaggaatatatttccagaagataaattattccagtttggttcattaagcttttattgtagattttaatatgcaatggaaaatatgcttttaaaatgagggatgaataaattccaaaaagtactttagaaaactctcttcacactactgcactgtggcaattgcaccatctgtaattctgcacctgcttcgtcaactgctggctgcatttcaggagacctgacttcactgttttctgactgaggcatacagtatttgccagagtacttgcgaatgtgcaaggatgaaaagagcattggctaggaacacagatgtcttttcagcagagaattaggtggatgattcatctctagagtatcaaaagtgtgaagtaagtgaagttgccagagtgggtctgaaaacatactattgggtcaatgttgtgcaagtgggacatatttttctactaagggtcacatacataaaacaacttgattccaaagcaactgttttgttcttaacaaaacagaaacagttggttgctgtttatgttaagaatagaaactacaaatgtaactaaagtaaaactttaaaatgtcagtttaatattatgtgaagattaagaaagagagaaaaggagtagttctaaaggggaaacaattgaggaagaggagaagagagtaaaatgtaggcaaatgcagaggaaatggggagaaaagataaagaaaaagaggaaaagaaggaatggtggggagacacttaattgagggctatcaagccttttaatgtgcattatctactttaataatgatctgactccatatggtagatagtatacccatttcatagataagaaaactgatactattagagattaagtaatctgtctaagatcacatagataaatagtagagctggaattcaaacattcaattcatttgaatctcaggatatattgaagtgaatgtcagtcagagaagccatactaggctacttaacctctctaacattaacatgtgcttcctcatttgaaagatgagtagcatttctaaagctgctggatacagtaagctccacagtaacagctatcattacaggagccctttgagaggatcagttaactcactactgataactataatttgttttattattattatactttaagttctagggtacatgtgcacagcatgcaggtttgttacataggtacacgtgtgccacgttggtgggagtgtaaattagttcaaccattgtggaagacagtgtggcgattcctcaaggatctagaacaagaaatgtcatttgacccagcaatcccattactaggtatatacccaaaggattataaatcattctactataaagacacatgcacacatatgtttattgcagcactgttcacattagcaaagtcttgggaccaacccaaatccagtcaatgatagactggataaagaaaatgtggcacatatacaccatggaatactatgcagccataaaaaaaggatgagttcatgtccttgcaaggacatggatgaaactggtaactacaattttaactccttccctctggtcccaagtctgaggatcaaaaactcacaggaatcattggtgttctgggaaagaatcctcaaatccaccaggcaccaaacattccacatgctgaatcaagaatatcttctccatatatttcctactagatattaaatatacatagattgcactgtgaataatttaatttgatgtatcattctatcattcaccattatctttatcaacagaatctaaaagtaccagcattctcaaacagttaaaaagggattccttgcattcaaaacctgggaacgactataagtataatcttagagttttccacactaaagaggcaagagagcagccagctgaggcctatacctgacatttccacctttgaggcaaatgatccccacccttgtcttcttaatgactgtcctttgttcactgcagagagatgtgatttttttctaatggcaaaattgatcttgtccctttcctgcttaaaaccacttaactggttttactaccttcagactaaaaatcaaactcaactgggcataacgattgttccgtgatccttctctgattcaggtccttcctagcaatccaggcccgaccagatactcatctaagctcctgcctattgaactactttcacttcctaggacaagctgagagctccctctccctgtcctacttttctacttactgttccttctcctttccactcttcagggttgacttctcaatgtttcacacctcagctttgacatttcttcttccaggaggccttttctgatcatctcattaggctgaattaagcattcctcacctaggagcctataagactcccatagtattgattacattgattatattgcattttgattgcccccaaactggattctaagctctgtgaggatggaggtcatgtttgatttgtcctccaatgcccaccatgcctggcacataacatagcaagtgctcaataaagatctgcttagtacatttaaaactccatgagagtcctaactccaaaggtcagggaagcacgtgtttttttgtttgttttttctttctttttggtttattttgattttccgcagaagaaaaccacatatcaataaatctatttcctacttaaaaccattaagttacagcttcaagcacagagactagagaatgggagggagccagcagccctggcagccagtcctggggttcttggccagttgtcttactctcaggccctggcttttcctacttaaccagtggaattaacatcagttgctcatttttcatttctacaagaacttcagtgtctctcagtaagttttatagaactagtgataaaaattgacagctcagtggtgttgctttagatgcactgtgttttaacatggggatttatctatgctcggggatatacaaactgttttaagtcctctccaaatgctcttcaaaatggatcccaaaaaaagtattaggtcactgtcacagattatacccattttgcagatagaaaccaaagatcgagaggtcaagggatgatttccttttgatcacataatagaatgttttggaaaagagatttttttttctcgattctacttctttccttttggcccatcatacagacttttctcacataatcttcaatgctttaatgtatttggttttttataagtctttcttttactagactttaagctccttgtaggcagggactagatcttgtttttctttctgtttttagcttaggacctggaattgcgtaggcatgaaaaaaatgttactgaaatgtttgcccagctcttacaaatgctctaacaaccatactcttaggcttactgtcatgaaagtattcctgtcttgtgatttactgaaatctcagttttaaaaggaacttaaatattttgtagtaccctccacctccccactcctgattgtactaatgttatactctacttaaacttcttcagtaaattggagctcctgtcttttcgagaaagtacagtatacctctcactaactaggaaaaagtcctagatttttcctttgaagctacagagaacatgatttgcacacactgagctccctaaaaaacgaccaccaatacaaattaaaaagcaacactctgcaagtttaaatttaaatcttaattcatctaatctagatgacttaaatgtttgcttttcactttaacagcagggaacccatttaaaaatatttttcaaataaataaagactcctagatattaatgcagatgcaaatctgtctggagattaatgaattactgccacatcctaaaagtggccactagagaaaagaggagtagctgaaggttttgtaggggcttagtcacatagtccagtagtaatagttgggaaatgagtagagaggggataacaaaaataaaaacaaacagttcaattagtctagatggagaaaaacagcccacaggctaattgactatagctgtcacgacagttgattacagtgtctgtctgtaaaaacacagggggaaaaaagtacagaaaaactcatggcctgtttggctgccttttgttggtgaaatatcctacaaatagatgatgcaatgcaagccagcccctctctggtaagaaacagagtgaacccagtgacgtggcagtgtggtaggaggcactgtctgctgacacagaaaaaaaggtggccttgcagactgtggtttgaaatgccttaggagccaggtgctaggttacattattgtgttcaaagacagatcctttgggttatatcttttctgtgtccaaatgacttacaaacgatgatactcttagggctactgactcaatagtaaaggaacaatccctgttctggtctatctttgggagtaaagacggctttaccttcaaacctgctccgtactccctctgggggtccattatgctcagggggacaaagacaagtgcagcacatgcttttgggagaaaagattggtcataaacagtaaattaaaatgcaatagtttaaattctataggtgcacagaggaaagggagcacctctctgctgtgggcaattgggagtagagacggcttctcagagcaggacttaaaactgggcttctaaggtcattaagagtttgttaaggccaggtgcaatggctcatgcctgtaatcccaactcttttggaggccaaggcagccggatcacctgaggtcaggagttcaagaccagcctggccaagatggtgaaactctgtctctactaaaaataccaaaaattagccgggcatgatggtccagctactcaggaggttgaggcaggagaattgcttgaacctgggaggcggagcttgcagtgggccgagattgtgccactgcactctagcctaggtgataagagtgaaactccatctcaaaaaaagaaaaaaaaaaaaaaaaaaagaaagaaaaaaagaaatatcccatgttatggaaacaatcagcagcagttcttgatggctggaagattgaggaaatgacaatgggtttcttattttagcgaggtaagtatattggcagggtggaaaatagactgagaggctgagagggaggtgaagttggggagcccagttaggcagctgttataaaaacttaagtcaagatgagtaggattactctctaagaagacaatattgaagaaaatgttgccctggggtaaaaagaataaggagcaactgggttctaatacaccgtagggccagcttgcatctcctagcccaatccagtcaccaggcaagtgaaggtcacattcttgtccagacaactgcagctgggactagttttgatctcagattccagcacctataggcaccagagcagcaattctcaatcctgcccattcttcacctgggaaacgttttttaaatgcaggtgcctcaactctacttcagacctactgagtgagaatccctgaaaggagctacagtttaaaaataccctgcacagccagaactgagagccatggcccacacagcagtcaggcctaacagtgactcttatttggtgtctttctggaaaagtctgtaggtgtatgcatatggcacttgggacacattgtaatggatgcagtgttagaggactgagaagcccatgaagcaagctgctttttccaggggagacatcactattagcagaaatggaagagacgccctgccactatgtgacttgagtgttttgatcttgagagatttgaacatacctctgagcacactcaaaggagatgtcttagtccatctgtgctgttataaaaataaaaacaattctgaggctgggtactttataaagagattattttggctcacaatcctgcaggctgtacaagaaacatggcaccagcatctgcttctggtgaaggcctcagtgtgcttccactcctggcaaaaggggaaggttagcgggcatgtgcagaagtcaaacagtgagaaaagaggcaaggtggaagtaggttccaggccctttttggcaaccagctctgaaggaatttactcagtgaccccagggagggcattaatctattcatgagggatctgcctctgggacccaaacagcccccattaggccctacctctaacagtgggagaaaattacaacgagaagtttggcgggcaaaaatatcaaaactatagcaggaggtgttccaaaagaatttgggggactgactctataaagaatataatacaggttcttaatcatcaatgacagtcaataaggagacaggagaaaacaccagtcttagcctttgttcccgacaaacagactggataacttccatcaaggtgaatctgtatattacatgctatctccacatccagaactcttgtatactgtgaataagaaaatcttagtaaaaagaatgactttcagccgggcgcagtggctcacgcctgtaatcccagcactttgggaggccgaggtggacggatcacctgaggtcaggagctcgagaccagcctggtcaacatggcaaaaccccatctctactaaaaatacaaaaaattagctgagcatggtggctcgtgcctgtagtcccagctacttgggaggctgagacataagaatcacttgaacccaggaggcggagttgcaatgagccaacatcacaccactgcactccagcctgggtgacagagtgagactccatctcagaaaaaaaaaaaaaaaaaaaaaaaaaaaaaaaagaatgacattcacttaagttatgtaagttatgcctgagaagctaaaaccatttctgtttctcaagcttttccactacaaaaggtactccaagtgtattgtgttctttacctttttcaagattctcaaaagcccagggaaataataattacaacctacagatggaagaatgaggttctaaaagcttcataggcttagtaaagactatataaagtaacttgggaaagctcacagagctaagaagtgatggatctctccctgaacccatatctgacaaagccaatgctggtaaccaccacactgtaaatacttacatatctccagaattcacagtccgtcttgaatattaacacattgaaatgaaagagtaagtaaagtttaggattatctttgactcccttcttcagccctccctttttttttttttttttttttaattaccagagagtagggccagggaagaagcttctctaactcaagaaccctctcttctgctgctcaccaggtctgaatagcccttgtgaaggcagcatttgagagaacttctctgccacatgctgattcctctcaccgcgggaagaaaccaacctaccctggggagcctgagagctctttgagtatctgggggtgaatcaactaatctgattaattgttttcagaggtgaggagctgggtactgaggaagggaaaattttgatgagaaagaatctgggcctttagcatgtgaaacatgaggctcagaatttaatgacttgttcaaagggagatttttaatagacatgctttaaccagctattttggacatcttatacaggtgagaagagaagggggatagcagttggccaagctataaggacacttaaaaggacactataagactgcaaaccagatcagtgtgaacgtacaagttaattaactcatttaacagacccttactattgagtaactacagacattttttatttgcatggttccaatatgcatgaattttcattaccatgatttgagtagttccagtcccccaacaacacaattcaaactttagctaccacaatatattaagtatgagtgattgcataaggcacaaacctgctactagctcttcaattcacaaatttctacacaataacacatgcgcatcatcatcagtgactcacgtcagttctttcaaggtctgtcagtgactggtcactgagcacctgctattcacttcacaacacagacagtaaagcatacttgttttgcctccttgtctccagtgataaatccacagacattttacaaaaatggataattcaaagagggactttgtcagcaatgaggaaagcacagcaagaaaacaaaaagttataatgctgtaagtgaaatttagatgcgacaacgaattatagaagatacagctgactatgggaatgtcgacctcaacgctcattgagaaattccacatatgcagccagaggaacttactgaaggcaaacttatgaatataaataaagaaggtggctgggatataaaggatgaaaatgtcccagagaatatgatactggcaaaaaaatttacattgaagaactcttgtaggtatttcaaaacacaaagtgcaaaggataaaaggttgccagatgattagaaaaaagtgtgacagtttgccaaggcatataaaaaatacttgctctgtatcacaagttatatgactgacaagaagaaaaaggcaagtactattccaactactcttttttccaaagaaatataataattttcactgtttctaatattttaaagaatagcatactaataaaatattattttactattttttatttccctatatatctaacaaaaagataatttttaacgttttgacaaaaaactggaaagtttatgggtcaatcatagtttttctcattgatcattatggtttcattcttatggtctcccactgccatgcaaagtaagaattttcctgttttaagtgccaagcataagaagacatggtccctaccctcatggtggtcttacggcaacaattaattctaaaaatctgtgattgttctatttaataagggtgctagcctagctcaaggcactcataaagcctgtagaggagttgtgggaagtaaatttggtaggggatatggagaaagtagcaaaggaagtactgatgggggtgagctccaactctgaggaaaatgcaaatctctccagtccagcaagtttacctcctcacctccagaggcggggtggggagtgactccaggctggtttttaaactggctgccaactgctcagctgtaatgccagatacatattaattgccaacagaaagcagagacacaggttcaagttccttctcaaaagtaatacagaaacttgaaatgctaacaagtgccaccttcagccaacttaggtgaataaactttcttaaaatcagtacaaaatgtttggatgcaagtctcttagtccccagagccacagaaatgcaaagaagcatcaggggctgtgacaatatatgttcttaaggaaatacagttataggagcatatgaaatgacgcatctggctttatgagctggcaatgatttttaagtccagaacgtatgttacattgcactgtttttccatcataaaacatttaaaaaattttatttatggcccctaccagaaagatgtgtggctatgttacatgcatgtggatgcaattaggaacaaagccactaagaggtagaaggttcattaggattcatcttgtccaacttctcatttaaaaaacaacaaaacggccaggggtggtgtctcaaacctgtaatcccagcactttgggaggccgaggagggcagatcatttgaggttagaagttcgagaccagcccggccaacatgatgaaaccccatctctactgaaatacaaatattagctgggcatgggggcgggcacctgtaatcccagctacttgggaggctgaggcagaagaatcgcttaaacccaggaggcggaggttgcagtgagctgacatcgcaccactgcactccagcctgggcaacagagtgaaactctctcaaaaaataaaaataaataaataattaaattgaaaacaacaaaacaacaaatgaggtgaatttagtcgaaggaggccaactgcctagctccatagtcagattcctgcatcataataacaacagctgacattgagtgagtattagtttgtgctgggtgcaatgctgtgggttttaccaaagaagcattatcttggggggccagaaatagtggctcacgcctgtaatctcagcactttgggaggccaaggcaggtggatcacccgaggtcaggagtttgagaccagcctggccagcatggtgaaactctgtctctaccaaaaaatacaaaaattagccaggcatggtggcacatggctgtagtctcagctactcaggaggctgaggtgagagaatcacttgaacctgggaggcggaggttgcagtgagccaagatcgcaccactgcactccagcctgggtgaaagagtgagatcacatctcaaaaaaaataaatacataagtaaaaataaaaagcatgaacctcagaaattgtaaaatagttactactaccattatcattttacaggtttatgttattcagctaaccatgagagagctgggatttgaattcaggcagaataatctgagctgacattcttaactatgaagctatgattgttaaaaattatcctttccagttacttaactatgtggcccaaaataaggtaaccgtgccccctggaggatgttagagtctagctttccatatactactactaatctttaaacaaccaccagaacgtactacccattttactgataagaaaactgaacgcgtaaaataaaatggtttcccaaggttgcacagtttatgattggtgaaagcagaattcaacattcaagtctgtctggttctttcacacacataagcctggctccctggattagaactaggctctcccgaagcacgctctctggtttctgtttgaacaggacttgcatacattaaatgtctgatctgaaatcaatgtggatccaggtattgctggaaccaatttaagtctaaagcaaatatttcacattccttaatcaatctctctctccgtgtgtgtgtgtgtgtgtgagagagagagagagagagagagagagagagagagagagagagagaatatcaagagtctagcagttcacatgagataatcctgctgaagaggccagtggtaaatcaaactcagagtgtgattctgaggttgcatttagttgaaggaggataaaaattcactgattgttgttctcacagaacacagatagcaacagacatgaaaacagagccactgtagaaaatgcctgcaagcagtggctactaacaaacggcagggaaaggctgttttaggaaggaaagggaggagaatctgctgccctcttttcattttactggccacacctcccccacatggtctgtcaagagaaatgggtctgagaaaagcagcatgattctcaccacagctctttagcaagtttccaggggttttcagcatagcaggcagctgcttcccaaattcagctctgttccctcctcctggttgagctgcttggtgtataaactccgcctggccagcacacacctcctgacgctcttgagtggtggccaaagcctgttaggagtgaagcaggtagggctaccttcccaggctagtggcagagctagtttgagatgctttgcaacacaaacaagccaatttgaaagatgggattattttctccgttttaaacgctgtaacaaatcactttccagatgttggctatctcactcacctctttttctttctcttctcagttaaaaaggcttagtcctggaaaagtcgaagaggtgaaaacctgcctggggaggctgctgaaggacgccaggaagaattcttatctccaaattcaatcctgcctcccagctagctgctggtgtttgaaattccaactctgaagtggtagtctggtatcttcttttaaaatgtggaagagagtaaacaaagttattcacagcgtagtgttaattcttcagctgcaggctggaatctgctggctccccttaggcaggaaatgcctgcttaaatcgtcccttaggtgggaagaaaattcaaaaagggaaggtttatggaggcggactttcactaatttcacctttttgcgtggcaaaaccaagtcaagaaataaggtcctctcaatctcagaaattaatctttgtcttcatttaatttgaaccaggaaaacttgtaatgccaacatcaagactttgttagttaaagcttttcttaatattttaggatgaatagctaaaacttggaaaccaggacgatttagattccttcctaaaaccattttccaggtacgcttaaggacttttgttttgatgtgtgctatatatgcatttgaagccaaagcacagatgttgatattcatgttttaatggttggtcatttgattaagcggagctcagacattttcactttccctctcaatattatcactgcagttcggtttaacaaggcactatttcccagcacggtctactgctacccaaatcagctgtggtggtcaccatggtaaccacccactcatttttccctgttatttcactttataacacttaaagagcagtgcacaggctaaaaaaccctatgagggaaaaaaaagtccctcaaataggagtcaatcaagctcacctgagatgcaaagtcatctaagtgtaaatgttttattttttaaaaaaaatcagctgtgaatgtattcatcagaaacaaatgatcactaggaaaacagcactgaaaagttgaatctgctcattgcttggagactaaaaacattttaaaagtgttttttagggataaaatggggttaacactaacatttctaactaatcttgacaaagggcttccctcgatgggattgaaagctgtggaagtctccagggttttaggttaaatcataaaactaaacaaggtctgtttaaaccacacctacgagcttgggattgtatttttctatatgaatttccttccctccccacacaaaaatattaggagaaaagttttttaaaaagaactttctttcaaagcagtattttgctcatttattttatgattggttattgagtctgccaatcatacgtctaaatgacaaggaggtatgggaaatcagatgagtcactgagccaggcaggaaggcaggtattcaatcaaatccccccaaaagataagggctgcacaagtgtagacctgtagaccatctctctgttagacacaggtatttgaccattgccaaacaggtcagccacaagtggaagctaatcttgacagcaagtcagttattgcagaccctgagagacatcagatctgcctgaaaacaaacaaacaaacaaacaaacaaacaaacaaacaaacagtgctttgaggagtatcatgaagactttccgtttctctgcaggcatcctgatagcatgccccttttggctcctagaaagacaataatgaccccttcagatgaacactctcttcctgcccacaaatgcctgttgcatctaagacaggtgtcttacctcttcccaatcaccaccacggataaaaaataattgaaaatgattctcccaccattgcaaaatgattctactacttctagtagagaacttctggttttcagggatcaggactctccaattcctctgctcactgaggttgagattcagtgttgttttaacaatataagagcagctcctatcacttttcaaactgaacaagcttattttcatagcctctacatagtctacatagataattttattcaacacaatcaacagtccactcattccctggttgagattgcctagggacagattttgagggtgatgccgataagtaagttgtaagggacctcttaaacagacaggagacttgagggacccagggttccagagtctgtcctatgtagaggccacagtgattgttgttcacagccattatcagctggtccctctccaccttccactccccaccacccaaggctaatgtggtgcacaggggagaggtttatagggaaaactcagtggattcaggtgcaacaggtgcccttggactgtgagtaatgcaaatattgacatctggaaagcctggaagagtcattattacttggctcccctttgccttctactggacacctcttccttcccaaaagttcccaggatttctttgtgacttttccaaagctccctgcttcctattctgttcaaaagtctctccaattttaatatagtccatgtaaaatataaaatgggtggagtggatggagtgcaaagctatcagatttgttatttgatttaaagtttaagactagggaacatggagacttggttctagtccaacctccgaaaaatccacttcggtgattttagtcagattattttcacttggctttttcatctatcaaactataaatttagtgagatcaaacaaaaggaagttctctgtaaagttaaaagtttagttcaaattttaaaggccacagaactattatacagctgaagtcatactatagattggagagttcagccaaattcatggattttacagggcataaagtctttggttagtggtatcacaattgtagtgatatgaactagaatcttcagcctcaaacctccacatctaatcaggcaccaaatcccattaatcttacctccaaaatgtctctctactctgtatgtccctctgttgccactgccactgtcatgaatgctactctctccaaacttgctccttccctcttatgtcacgttcccttagtgcattagccacaccagcagtcagaggactccttctaaaatgctcacctgatcttgtctcttctctgttcaaatccattgctgactccccatcaactaaagcgcaaagcccatgtttttagtaaagcacatgacaccttcacaattttgcttccctaatagcctctcttctcaccatcttcttcctagaaaacttggtgactttatacagacagctctttcttcttttttgtacactcactttattcattcttctaaaacacactcaaacactgctgcctctgggaatccttccaaacctcacagactgagataatgaccaacccactattcccatagcatttcctatatgcctgttattccagcatttctcacactatcctgcaatgttttggatccttgcttggctgaaggttccactggtatgacccaacatagcatttctgatggcctggtttgaataactcacaaaggactttgcacaaatcccggacacatctaagcagttctggggcaaggagtcattcttcccctgctttcagcaatgtcatgccagcaacactcttgtcttaggcctaaatcacagggccttcctccttgaaataggttcagttcctgggaatccatttggtccctgcactttaacttacaactgaacagggatttaacagcacttatgccagtgtttgcaaaaccgtgatacacagttgtcttgcccaggaataaattaaggttggtagaatattgttgtcctgttttatttttctttcttttttctttttaaaattctttccttctacaatgcaggcatgattataagcattgttacttccactaggtaagttccaagatatgctactgtgaagatatcttaataaattattttagacaatgctaggtaagaaaaagtcccacccaggaaagacatgtgtaagtctgtaaagtatatatttcttatttatcaactgcttaacaggcaaagttaaaggtttaaattctgatgtttggacgttcattgccactaaggataatattgtaagttattctgcaaatgactctaaatacaacatttaatggtggggtggacatctttcattcaaatctaaagctaaggaagggaagtggaccttattaggcagaagtttcctgtggtacttgtgacagttactgaatgaaaaacaaaggtagagtttttcaaaagcatatttcaagcatacaatctccgtgtgggacagcccgagccttcctgaaaatgaagcactccaagcttcctcaggttaatcaagtctaataatacaggaattactcttcctcagctgggtacttaaatcatgagcctggagatagtacacatgtggaggaccttccaaaatggactataaatcacatcaccttgcattaagttcttcaaaccagctggaccagccttcaccattctctgtgagctgaaaaatacaggatcatagttcgcagggctgcagataaaattctgcagcagtcaattcggtggaattgatgaaggtggcagtaaattcagtggagattctatacattagactccagtctgggcaaagttgaattggcagtctttgtgcatcttaataattgaatgttttatagtgaatctgagttgcccatttctatacagattcatttattgctaaatgaacatatgaccattaaaatatatcttcatttaagaagagtgagcatgaaagcatgatactttatacacaataacgtcagatcagaaaccaagtcacttgtatcagaaaagtaaaccgctttatagaaccaaaaataaaacaaaacaaactttttttaattgtagaaacaattggagtttactaagtaaaaatacaagagatttttaaagaaaagatattagaacaaaatagatattgctactcagggtcaatcattgtgagtatatttgtcatttccttctaggtgtttttttatggtttttttttttttttttttttacaatgttaaggtcacactatatcaaaaaaatgttcactttactgtttcatctgctataattgcacacattttcctgttaatacctctttgtcagaaacattttaataactccttaaaatttcactgagtagataccttgtaaattacttaaccatttccacttgttgaaaatttataatacaatatttcaaattttaagaacatatacttaagctataatgtatatgattgtgggagaccggaatatgcctccccaaaatataaagaattactgagctaaagacaatcaagaagaagcagatgtgggaaaactctctgccctccattttcctaaaagcagcacatagatttacaaagacaaaggtattctccccccatccctgcttttctaccagggagagcaaaggttaaccactgaacacaactttggaccctcatcagcctggtcatggtaccaggagaatctacattaacaagctttactaagtagcctttatctgccatttatttggcttcctacaaactgctcgctgtgcctgaagagactcaaagtccttttccttcatcttgtcacttctctaaaaatttgctgtttctcgttgaagatgttacataagctgaatttcaaagtcacttctttgagaattactcatgccctggttgtcgcccatgtgtatatgaaaccaggggtctgttccaactaagaacctataggggtcattcttcctttctcagcatgattatttccaataagggggccttactaggtccctaaattttagatgatgaaacagaaattagcaagggtcaaaaacatctaaataaagctcattttatagataggctagtggttatgagtttattctgttgagttagtatactcatcggcattaagtcctggttctgctatttccaagtggccctctgcgttatgtaatttccctacctcagttctctttctttttttcttttgtaagttcagagaaacaagtgcagaatgtgaaggtttgctacataggtatacatgtgccatggtgttttgctgtacctagcaacccatcatctaggttttaagcccctcatgcattagctatttgtcctaatgctctccctcccctctccccccagcccctgactggccctggtgtgtgttgttcccctccctgtgtccatgtgttcttgttgtataggtcccacttatgagtgagaacacgtagtgtttaattttctgttcctgtgttagtttgctgaggatggtggcttccagcttcatccatgtccctgcaaagaacatgatttcattccttttttatgggtgcatagtattccatggtgtatacgtaccacatttctttatccagtctatcatagataggcatctgggttggtcccatgtctttgctattggaaatagtgatgcaataaacacacatgtgcatatgtctttgcagtagaatgatttatattcctttgggtatatactcagtaatgggattgctgggtcaaatgatatttctggttctagatccttgagaaatcaccacactgtcttccacaatggttgaaataattgacattcccaccaacagtgtaaaagcattcctatttctccacagcctcgccagcatctattgtttcttgactttttgataatctccattctggctgcctgcctcagttttcttatctgttaaatgaaaataagagctataccaccagaaagggttatcattaaattagtacctttaaagcacttagtacagcatttgccacacaatagtcatttaaataaatgttagcaacttaagaacaattgtcaatgttactagtgctttgttactatttggtattattcataattattattactaataatttgattttgctgagccatggctatattgtcagaagagactgactgaaatgtacttactgattaatttcgatctagttagtatgttaaagacgtgttcatttaaagagaaagccattttgtgtttttggatgtgattccagaaagcacgtataggaagctgttttagggaaaaaactcggttgtgggctggagaaataattaaattaattatttaattaaaacatacaatctcaagggtggtaggaagctaaagggtaattttgggtaacattctccccttactccaaccagatgccaggtgaccttcaactattcttaaatgtctctcatgttggggagcttaatacctaccaaggtagctattatgcttagaaatttagttttatatggaaccaaaatatgtctttctgtaacttcaacatgttgataataaactcacagataaccctaaacaagctttaacagtgaattttccgtgtagtgaaatgatggggatcacaacttctaatggatttattttggaatttaaaagaaattggtaagagcccaaagcgtataaaaccaagaattcattatgcaggctttgtgggtatttgagaagatttatgtattcattatcatgtgtgctttcctgcaaattaaacaatctaaaataaaaggaaagcttaatgatttttctcaagaaaaaatgtctaaagctagaattctaaaatggctcctttaaagttcagatggaagctctttcatagtttcatgctccaactggggaggggaatgggggaaggaagcactgggaaacactttcgctgaggtagaaagctcatagctcaccttctgaggacatctgcttctccataactgaaccactttctgcacagtagtgaacactcagaagtatttagaaattgactcaatggctgggcgcgacggctcacgcctgtaatcccagcactttcggaggctgaggcaggcagatcacttgaggtcaggagttcgagaccagcctggccaacatggtgaaaccccatctctgctaaaaatacaaaaattactgggcatggtggtgggtgctcgtaatcccagctactcgggaggctgaggcaggagaatcacttgaacttgggaggcagaggttgcagggagctgagatcatgccactgcactccagcctgggcaatggagggagaccccatctcaaaaaaaaaaaaaaaaaaaaaaaaggaaagagaaaaggaaaaagaaattgagtcaaatggcaaccctggtaaatgaggagctctgtgagtcactaataaaaccactcactaggacttaacaaaatctctccatactgcatatcgtatcaggcatgttgacctatcacatcactgaaaaagcagggtttctttgcataaagattaactaatgtatttggtatttgattttcagtctctagcacagaagctggcaagtagctggtgttaaatagtgctcaggtggctgaatgagtgaaaatccatccctgggagccacaggaagaaatgcttagtccctctaatgtcttgttacttcggtagctgctcaaatattggaggactgagacttactcttctggcttcttcctcctctctacaatcatcacttgtctctagcccaggctaactatgcccagttctagcaatcaacttcaaatcccttcatctaagaaatttccaaatgtgcctttgctcatttgtttctttgttgttgttgctttaaatggatttaggaggatacacgtgcagttttgttacatggatatattgtgaagtggagaagtctgggcttttagtgtaaccatcacccaaatagtgaatattgtacctattaagtaatttctcattcctcatccctctcctaccctcccaccctcccaagtctccagtgtctactattccactctgtatgtccacatgcacacattatttagctcctacttatcagtgagaacatgtggtagttgactttctaagttatttcacttaacacaatggcttccagttgcaaccatattgttgtaaaagacatgatttcattcttttttggctaatattccatatctatatttatctatagacagaaatatctctacatctctctatatgtatcacattttctttacccaatcatttgttgcccacactattcatagaggtcacggtgaactcatatctggcatatctgagtaaccttctttaaaagtatgctttccaaattgcaaatcacaacccaaaagtggattgtgaaatcaaatcaatttatgatcactaattttcccttccttccttccttccttccttccttccttccttccttccttccttccttccttccttccttccttccctccctccttccctccctccttcctttctctctctgtctctctctctctttcctttctttcagatgtagccttgctgtgtcacccaggctggagtgcagtggcactatcttggctcactgcaacctctgcctcacaggttcaagcgattcttcttcctcagcctcccgagtagctgggactacaggcacaggctacaatgccaggctatttttttgtattttagtagagatggggtttcaccacgttggctaggctcatcttgaactcatgacctcatgtgatcttcttgccttggactcccaaagtgctgggattataggcataagccactgtacccagcccatagttttctttaaaaaataaaatagaaacttcagaggataatgcacacagtaagagtattatttcatgaaacatttatgtcaattgtttaattatgtgtgcctatgtatcgttatatatacattaatattatatatatacacatatgtataaaatacacattttatacatatttgtcgtacaccacacacaaacaaggcgccccacacagattgtgcagaacttgttataggtattagcctctactcacctgtttgtcttgtcacctttgtgtaggggttaaactgtattgacataagtggtggctttgtgtatgtgtgtcctctgttttaaaataaatataattatttttttaacatttgatattaatattggccgattagagagggttaggatggaaggtgagggcatcacaatcatgccacataagtttttctttggccttttaaggtaaatcacttgtaatttcataggtacgtattttaaaatgtaaccagcactgagtgaattgttaaggattattgatttgatatttaaattagtgttttagtaaaattgattaaggatttaatttggtattataccaggaagactaggtcacacagcttctactgcacaggcagagaggtggaatcctcccagtttgggggcaagatgctttttaaaaagccactgaatcctcagtgttttctttaattggtcatagttgttaaatcctactattcctacttttaatgataaatttaatttaggtttaccattatcccttctatttgttgcagataattttgttaactcttggtgacacataatttgcactctgactatattttggcctaatattttgtaataattaggctttaagacatatggacacttaaatcatctgtattcctattgctaaagcatatgcaaacataattcttcccacacgtacattttgcttttatagtcacattctttctaaccagcggttctgtttaccactggaaattgagagtgattggaatgaatgagacataagatggttcaccctttctaagtgaactacagtctgaaaagtttgagatctgcttatttaacagatgaaaagacaggtccagggaaatgaactgactaatcaaaattagcaatgggacttggaaaattccagtctccagattcactctctgccaccaaatcatactaactccagcaacatccagaaaacagggcctgacccagagcagaggcctcataaatgtgtgcttagttgctttagttgcgattagattggacagtataaaactacagatctgttaggtcacaaactgtcaaatattgacatttttcatacagttcaacctaaatcattttattttaataactctgcctatgccactctgaggttttgcttttcacatgaggagcatgatagtatatttgttaagagggcatattttttaagacttgagccaaaccgctcaggttcaagacccaagtcttaaactgattggtcatgtgtccctgagcagattagattacttagcttctctgtctctcagtgtcctcataggggaaaagggtattacacaagtgtttgcttttaatattattattactagaactcaacatacatactaattagccagatggcctgaccaagttagggcaactttatgcacctgttctgaaatgcattttttagatacaaaaaaaaaagagaaagatacagagattctgcaatgtcttttcttggcaagattggctatttatttgtttgactgacatttggctttattgtttacaatggttgtctcaaaagtcctatttttctctgctgacagcgctggttaataaataaaacagaggccaaaacatcctagcaacagaaatcaactgtgtgtatgatttgttgctctgttttaatttcatctatttttgaaaatgtagttgctctctaaagtgcctgtttcttctctagagcattgccctaaagaataagaagaagaagaaaaaaaaagcatccaaacttgaagaacagctttgatcagctcataatgcacagtgaagacaataatttaagggtgaatcagagtgcagcaaagtgattccaatgaaacctgatgctggctaattacttctctatagatggcagtgttcagtttactgagcatctgtgcatgacagaatttgggacactgtgggtggtacaattccaagatatctacacaatctgaaaagcaaaatattccaactacaagtatcattttattaggtgaaataaactatgtatacaaaaatctcattttgtaattaagccataggccacactgtagagccccaaaaaccacacctgtttggataaaagcaaacaaatcataccatggaagctgtacctgtttggaatgggacttagaacaaaagggtttagaagacagatgctactgtgatgctgcaaaagattatttacctcccagattttaggtgtgaagctgtaataaagttaatacaactcttttatcagatgaattatttttagaattactttttcactacattctcataatgtcctactgaaaacaaacattctcataaagaaaaagtgagtggaggagaaaagcaattaatcagacaaaaaaagataaagtatgttgagaaatgaactttcatattgattggttctattttttaaaattatgctttaattaatggcatacattttcatgctctcttggagctatactttttctccatttctgctgaatctgaaagatatgtttctacttaaaacacatctcaaatatattcggtggcaaggcacatcaaagtccatacgattataaacacagattggaaaaggatagcaaatagaactatatgcttggtccatagttaactctagataattgttaaatgaataattaagaaacaataaataggccgggtgtggtggctcacgcctgtaatcccagcactttgggaggccaaggcaggtggataacgaggtcaggagatcgagaccatcttggttaacactgtgaaaccccaattctactaaaaatagaaaaaattagctgagtgtggtggtgggtgcctgtaaaagggttagttgaactggttcctgaggttttcttctgtacttgcaattttcctgtcttctccacttattcttttggtgatgctgccttacataatcttcttttcttcttcttctctttaatacctgtgcccccttgctctcctccctctcctctcagatccatattcagagaggaaccccagagggaaacaattaagagatgagaggatggcattggatagcttatgaaacagggttagtgatgatgccaattctcttcctcctgatccttctgtgagaaaaggaggtttagaacaagttcagattccaagggtctgtgttttccagggggagttaaacatgcaccatcacaaattataaactgctgctctttatctacaaccagccaccattacaatgtttacccaaacccacatcagcaaccactcactgtccacagtaatgctgacatttaccaatttaggcttctggagataatatgatgtgcagtacacagccaagattttttttttctagttcttatgttgaaaaagaggggcaggcttctctttgggggctgctccccaaagacacacactagtcactagcaaaccactggcattattgtccaaatgaaatgtacctgtctagcacactcagctgagcgggctgtgatttgataaatacattagggagaaaagcttcgaaataatttgaatttagttccaatttcctctgcctcaaaacagcaggagatacagtcagacggagaagctgtgctctgtacaataagggacagaattctaagtcaccaactatcaccaaagttgtcataatcttcctcatttctctaaaatttgctctactcagagattctccatccacccaaatcctaggcatcatatcctaattaccaagtgttgtcaagccgacttcctacacacctctcatattcaccagctcctctcccatcatagctgcatgatgatgggtccttgttgtctgccatctggaccatgaaagtaactgtcttgctttattcctatccatcttctgccatcaaggtgaacttttaacacacaaatcctgctcaacatcttttaaatgttgcctactgttggtgacagtgaagtccaaagtgctgggggataagcagagctcagttaagtgtgcatgatggttcaaatggttctatttatattattttattatttatatgattgttttctccttgtattagttcttctctctttttttaaggattgtaggcatcttgaggaaagagagacattcacaaagctgaagggcttcactgtgcccccatttgaattctatgattcaaattatcttaactggacccaccactgatgggttaagataatttgaatcacagaatctttacagtattttgtaataatctgaaaagtggccataagaatcttttgtgctatgcagaacttcactggtgtcaaagtacttaaaaagaggtgttaataataaattatgcatttttatttttcataagcctctaaattctactaatcgtttctatggataaattgttaacagaaacatgttacttagcagataattaaaaagaacattaagcatactcaagacataaagaaaaatatgcattggagccttaaatcatataatacttctgtgatattaatcagtaaggaaaaagaaagataactcaatagaaaaaatgaccgagagatttgatcaggcaattcacagtagaagatattcaaatagctgaaaaatatataaaaaaagagttcagcctcaacctcattattcatcagagaaatgcaaattaaaccaaaatgagatttcccagaagataaagtaagcttattttcccccattcctccctctaattacagctaaaaatcttacatgttatttagaaaacaaacacaggaagactgaaaggtagacagaaggtagcagactggctagggacctcagggtacaccacagtatggagttccttggattctcatggactcatcacagtgcagctggagaggagctggtgaacatgagaggtatgtaggaagtaggcttgacgacacttggtaattaggatatgatgcccaagcatctgggtggatggagaacctctgaggagagcaaattttagaggaatgaggaaggtgatgacaagtttagtgatagctgatgacagaattctatcccttttagtacagagcacaaagacagcacagagcacaatgcaaaagaaaaactaatgtggaagtaaattcatcttcactttgcaaaactattaagcagttgctcctaaagctaaactaatacatactctacattccagcaattttgctcctatatatacacctttgttccaaaggacatgcacaaaaatactcagtgcagcattgttaataatagttaagtacagaaacagcctaaatgtccattaacaatagaacggatatgtgaattgtggtattttatacactggaatactatacaacactaaaaatgaatgaactacacctatatccaatgacatggatgatcttcacaagcatcaagctgagtttaagaaaccagacacaaaagattatatactatatgattatatttatttaaagtgccaactggataaaaactaatcaaagacattaggagttaggatagcagttactcttcagaaggaggcagtacttctgggagaagtacaaagaagcattgttttctctcctcatctgagtggtgatcacgtaggtatcttcactatgtattagcataagctgtatacttctgatttgtgcattttcctgtctatatgctatcaatacaaattttatgaaaacagtaaaaataaatatactttctctgtctctcctgatacaaagtaaagatgatatattagcaatgagtgaaaaagttactgctttttgaaaacacttgtgccatggagggagcactgtgaagaaaagagtttggaaaagttttcattgctgtatgcttttgccatgcccccagtgacttgtgttttacctctctgcatactaaaacacatggggacagaatttttgtcctgcacaaaaatcctcaacaaaatactagcaaatcaaatctagcagaacatcaaaaagttaatttaccgtgatcaagtaggcattttcctgcgaggcaagtttggttcaacatacccaaatcaatgtgattcaccacataaacagaatcaaaagcaaaaaaacatatgatcatcttaatagatgcagaaaaagcttttgataaaatccaaattcccttcactgataaaaacccttaacagactaggcactgaaggaacataacctcaatataataagagacatttatgacaaacccacagccattatcatattgaatgaccaaaatcttggaccattccactttagaactggaacaagacaaggatgcccactctcaccactcctattcaacatagtactggaagttctagccaggacaatcagggaagagaaagaaataaaaggtacccaaataggaaaagaagaaataaaactatcactctttgctgatgatatgattctataccaagaaaatcctaaagactctaccaaaaggctcctagaattgagaaatgactttagtaaagtttcaggatacaaaattaatattaaaaaatctgtagcatttctatataccaacaacatcatggctaacagtaatatcatgaacacaatcccacatataatagccacaaagaaaacggaatacctaataatacagctaatcaaggaggtgaaatatctctagaaggagaacaataaaacatctctgaaagaaatcaaaggcaacacaaataaatgaaaaaatatttcatgctcatggattagaacaatcaatattataaaaatggccatactggctgggtgcagtgggtcatgcctgtaatcccaccactttgggaggccgaggcaggtggatcatgagatcaggagaaagagaccatcctggttaacttggtgaaaccctgtctctactaaaaaaaaaaaatgcaaaaaattagcaaggcgtggtggtgggtgcctgtagttccagctacttgggaggctgagaacctttccctgacattctagacagacacactggaactcttccctgaaaactcacactgtattttggaagctcaaccaaaagactgagaatgctgtctcccagaagactggtgatttcttgggcacaaggagtatgtgcctttttatctctttatcccagtgcttcagaccagctagaatactagaaacttcacaaacgttttctgaataaacaaatgggtttcaaattttagggaaatattgtattgtataatggaaatttgctaagagagtaaattttaccacacttttaacacacacacacacacacacacacacacacacagacgtaactgttagatgatggctatgttaatttgactgactgtagtaataatatcataactatgtatatgaaatatcaaaacataatgttgtgtaccttaaatatatatagtttttttaaaactttaaaagagaaaaataaatagtactctaaggaaaaaaaatctatggaaaaattagttattagcaggagaaggttaattttccatagtcacagacttctatcatttgtgttagcagaaataatgctaccaagattcaggagtccttgactttgcacccacctctgcactttctggctgtgtgatctttcatggtcactctccttctctggctctttatttcctcttttgaagggattgaattagctcaactctggattccttctagttttaacagtatgtacttactttctgtatgatactcctgatgttaatgaagcagtagtatttactgggcacacactacatttcaaaccttcccaaaatacctttcatcctggtccatattgtcatttttacagtagaattagaattagaatttttctgtcttgagattaaagtttcctcattatctggccctaatctaccattggaccataaaattcattcaattaaatttaacatatagttatggcattagacacccagaagttagaagtaaatgaagacatctctattgctgctttaaagtaccatatagcctagtgagaaagacaacacaggaacacaaacaaagtaaaatatgactttgtgggtttctgtaaccatcaacttaatgttagtcaataattctatctttggctgcattaataatgactaaaaagaaatggatctatccaaccaagactagggtaatcttcttaggccaggtcataggtaggccctacatttagctctacaattcatgttttaaaaggaagcttgactgagcagaagaggtggttttattcatctctgctaatgggactaccctccatagtcttctaaaccagtaacttctagcacccttgtctcttcctttttcctaacccctgcatctaagaggtcatgaaatcctgtcagttttactgcagaaatatctcttcaatccattgtcttctttttctatgccctaagcaccctactttatatctctgtctctttctctctctttcacttacaatgtacataacagtgggcaggccattttttttttttttttttttatgacagggtctcactttgtcacccaggttggagtacagtgatgtaaacacagttcacactacaatttcgacttcctgggtttaagggatcctcccacctcagtcccccaagtagctgagactacaggtgcatgccaacacacccagctaatttttgcattttctgtagagatggcatttcactatgttgcccaggctggtcttaaactcctgagctcaagaaatctgcctgcctcatcctcccaatgtggggagattacaggcatgagtgactgctcctagccatggacaggctacttcatcttctcagtgcttcagttttctcatctataaattgtagacaaaaaatagcatgcacctcagagggttgctatggggattacacgaatgaaaacaggtaaagggcagtgaatgttcaataaaggttggctatatttattacgtactgggtatgtcaatgggtcttcagcatctattcctacttctttctatgggatttcctgactacagaggctggaaaatgaaaaactacatttctcagactcccttgcagctagggttcacaatgcaaattgggtttccacggttagatgccctaactggatgtgaaagctgaagtaagagagagaccatcttcctgttatctttctactgtcaaccaagcttatccagaattgaatgttgagaggcagttctgtggtagtggataatataactgctttctaatccttttccccttctctctagatttcaagtattgcagtgtgttcttgactttgatccagcagctgcctcctaattcccactccttcaattattcagcaatactacaaacacttaattccctgaattaaatttctttcttcttaaactacataggatagtttctatttcccatatgcactctgattaaatcatatggtgacctgtggtcctacacataagtacagggcagagatacaaaccaagtactgcactataggaatataaattataaggtattgctttttggcaaatctgtgaactcatttcccatattaaatatgaaagtcaacatcaccaccctttgttattaaggacctacacttacatatattcactttacgtagccacataccagagagtgatttacagtatgttctagaaaacagacaatttagtcctcacccagagatcatctgctttcagaattctggaaatcctcagcagtcttttagtgtttggatccgttaccacttcaatttcatagctgaaaatactgacacagaaaatgcctcatgaatgtttatgattcaccacttctgggagtctaggacacctgcttggcacaaggctttggtataaacaagggtttcaggaagttttttattctacctacacagaagctaaaactgtgttaagttagctgcccagacctgccctgtagtcatcagattttgttatgaagtaaaatgattaatttccagaacctttcatgttgagggaaaaataattcactttccatacttagcagtttaatccagcgtggctccaagccagctgtcttcttaggatgctgcaatactcatacctgtcatcagcaattagcgaaagcaaccaaaaatacgaatctcagttctcaaactctggatactgacactcatgattggttcccatgcatcgcgatcaactcatctgctcatcctgaggttctttttacaggatttaaacccctcatatattctcagtgtttgtgatgcattctgtagaataaaaacctggccaaatgctgtgaaaacaaattttgttggttgtgttctttatacagcaagaagtggccaaagtttgaaaaaaattagaaaactatgcaacactatccttgaactaaatttataaaattgcattgatttagctttcttctgttctactctaatccttccacctctgtttttgatttcaaaacctccctgtctctttcaagattttactctctcaattattcctttactctttcattttatctccaacttcttcctctgtcctagctccttcccctcaacaattaaatatactcaagtctttcctttcttaaaagcctgtagctgagcacagtggctgtaatcccagcgctttgagaggctgaggcagatggatcacaaggtcaggagttcgagaccagcctggccaatatggtgaaaccccgtctctactaaaaatataaaaattagcctggcgtggtggcatgcacctgtagtcccagctactcaggatgctgagataggagaactgcttgaacccaggaggcagaggttgcagtgagccaagatcatgccactgcactccagcctgggtgtcagagtgagacgctgccttaaaaaaaaaaaaatttttgcaatctactcatctgacaaagggctaatatccagaatctacaaagaactcaaacaaatttagaagaaaaaaacaactccatcaaaaagtggacaaaggatatgaacagacacttctcaaaagaagacatttatgcagccaacagacacatgaaaaaatgctcaccatcacgttcatcagagaaatgcaaatcaaaatcacaatgagttaccatctcacaccagttaggatggccatcattaaaaagtcaggaaacaacaggtgctggagaggatgtggagaaataggaacacttttacactgttggtgggactataaactagttcaaccattgtggaagacagtgtggcgattccccagggatctagaactagaaataccatttgacccagccatcccattactaggtatatacccaaaggattataaatcatgctgctataaagacatatgcacacgtatgtttattgcggcactattcacaatagcaaagacttggaaccaactcaaatgtccaacaatgatagactggattaggaaaatgtggcacatatacaccatggaatactatgcagccatcaaaaatgatgagttcatgtcctttgtagggacatggatgaagctggaaaccatcattctcagcaaaccattgcaaggacaaaaaaccaaacaccgcacgttctcacttataggtgggaattgaacaatgagaacacatggacacaggaaggggaacatcacacatcagggcctgttgtggggtggggggagcggggagggatagcattaggagatatacctaatgtaaatgacgagttactgggtgcagcacaccaaaatggcacatgtatacatatgtaacaaacctgcacgttgtgcacatgtaccctagaacttaaagtataataaaaaaaaagtttgtaatactacactcccttcagtttttctttcaaagcagctccttataactttatttcttagattggaattaggtgacatattactaaggtccataagttcttcacaagaagattaagcttctgtttgcattttcatgattatcttgaacaataatataaacacattttagatcatctgggtgcctgccctaaaaccaagcagtaccataagatttcttatctcttacctttgtatgtatgaatgcgtcaataccaaatggtactgatttaattttcttgagccaagaagaaaagaaaattgatggacatataataaccttaaacagtaccttggaatattatacaaatgaggagaagtggtgggaggttggagtgagtcataacatagcacatgaaagtagaagtatatcaaactcaaaattacctgcagccagtatcatacttcatgtggagaactgttatgtagttttggtagaataacataagcaattacattaaattaatattgtaagtttgattttaatttgctttaaaatcttccttccttccttccttccttccttccttccttccttccttccttccttcctgccttccttcctgccttccttcctgccttccttcctgtctctctctctctctctcttttttgacagggtctggctctgtcacttaggctggagtgcagtggtacaattctggctcactgcaaccgcctcccaggctcaagccatcctcccacctcagcctttccagtagctgggactacaggtggacgccaacacaccttgctaattacttgtgtatttttgtagagatggggtttcgccatgttgctgggctcaagctatccaccctcaagtgatccatcctgggctcaaactatccacacatcttggccttccaaagtgttgggattacaggcatgagccaccgcacccggttttgaattttctttatatttattttataagcatatttagtttttatggttgtattagtgctgcaagtatagatgtttcatatgaagtttctgtttatatatattatatatttaagtaatataaacaaaaattctaagccaacctgagtttactcaaggattcttttcctttcttatttgaattttattttacaaacactcatatagagctttctatataccagatattaagtactaactccttgtaataatcatatgacataggtattgttattagctccactgtgctgtggagaagattgaggcacttatagaaattaataacccatgatcacacaacaagtaagtggtacagttgggatttaacaggcaatctggcttgagaatccccatctttaatcatataaaatgctgctttcctttagatagattctgtatgtactctgtcaaggtttgaaaaataccactttaggaaatatggtctacccttgatacatattcacgagggctctgttcttagctttcttccctttacacttgacatgttctcccaggacgatatcactgattactacagttctaactatcaaccacaccttgactagttccagatctctaactgtggattagacctgtattctgttctcaggatgcatataatcaactggacattttcatctgcaactttcagagacacctcatgttcaacctagtttaaataaagccaagctttccctttccctgactccactcttactctaataagcctgctttttctactgtattagccctcctgtttaatggtcccacttcctactcaaaatgctcactgtttagtgaagaagagagataaacagtcattacagtgagtacatgacaatcacagggatatgtccaaaatgccattcagctcagaaagaaacatgactctgcctgaggtagaagggtcaaggaaggcttcactaagaagacaatgtttaaactgattcacagtaatgcctgcttacatttagaaaaggaactctcatctttgtccattagtatatagtttaagggtatcttttatgtgcactatttatattggcggtagaaaatagaaatgtatgataatttttcactttagctccaaaatgaaatctctactactttgttcccctccatttcccagaaaagcagaagtagcaattttacaagctttttttgccatttgaaatgaaataaatgaaagataatattttccgtactcttttaaaagatcaatttatctctaaaacatttttcatactctaacattttatgggaaaaattctacatagattttggtcaattatatcagttttgactgactctgaggcagctgcagtatgtagttcattagtggtcatggctccccatatggcttttgtgggttgaccatcataggcaataggtccttctagacttgtgcaggtaccacattggaattctagcagcacaacacagatgagagatggcagtgatgattagcatggagagccatagaatcaggtcacagttgccagagaggcaacctttttgcctttctttttgaagatgttcatcctgatagcgtctccttcagaaataattttattgcataaaagagatgtccattcaaactgctcaagctaaagtgataatttccttgtcaggatacaggggtcatttctaggaacccaagaaaaagatgcaaatcctggctttgaaacagtctagaaacagcaaccacaaggcctaggaataaagggagtttttcagttatgatctgtgccatttgtctctctcttggttatactgtctcctcttgtttcttcctgtgtcagtttccctcttccttctctctgccaacccactttctctgcacacagagcccccacccagcagctgtatttccagcctgcaccccagctgtatgccatctttgagtttaagcactaacagagagaaatgcatctctaagatgcaatttcaaatcctgagggggtctgatgagttccttttggttcacatctagctatgcacagcgaagtaagattatttcttagaaatgtgtatgtagggacctacactggggaaaattggcagataccttcaaattgtctcctatgggtatgtttgtaaacactgaagttttgtttcaaagagagaacagccacaaagcctgacctcataagataaaataagtgaagcgttttctctgcttcctaagaattatgctgttactaatcaaaaagactgccctaattacagccacctgtgccattgaataaacataattcttcaggatcaggttgttatgaactaatttgatacatgttacctttcacttttagggagggggaactctgattaatgctaaggtaaactcatggacaaagactaaaaggggtcacaagaaaaaacgctcaagcttgtctttactctagttcttaagttaaagcatcaagaggaacccccaagattcccatctgaagcagctcactggccctaggatttaaggctaaaagtcgtgtaggataaagaatatgggtttttctagtggtgttcatgggaagtccctctggcagtttagttgttattctgtgactgaggctaatgaccacgtataatactatcgacaagtatgaggaatgttttcttaacattctgaatacctgaattgcactgaaatccaatatagttaaagagcagagtcttctggttaatcaaatattgagataagaattaccaaatgtagaataataggacttttcgattagataattatgcagttcagttacctttagactctactctgaggtgccatagaagcaatagagagaggctctactccttgctgtaccctacattcatctctactttcatctgttctacatatagacatttcaaataatgtgccatttgaacaaatggttccatgacattatagatatatgaaataaatatgcttgcctatgaaaactgctgatgtacttcagtcttctcaagagaaaactgagagccccaaaaaagttaaatttccaacactgatcaaaacatatagaataaaaaataaagaacacactaaatatgattattttttcaataataatttaaaaggtacctttaggacttattgtcccagagttatagacctcctaacttacagtccagatatggagtagacagagttagtttatttctttatgcatttaacaaacatttattgaccactccccgtgtatcagatattttactaggcactagaggttcaacagtgagcaaaacaagataaactctctgtcctcactgaacttctcttctaatgagagagacagaaaaatatgttagataagtaaaatatatattgatagtgttcaatgtaaaaagtcagaatacaaagcagagaagtgggatataaagtatatgtatactgtggaggcagaaaagttctcatgtggaagctaactttttaataaagtttgaagaaaggtggttatgcagatactttcagaaataacattcttggctagagaacagcaaggacctgagctggaagtgtgcccagtgtgttagaggaacactaggaagccagtaggaatacagcagaaacagtagaggaagagtagctagaaacgaagtcagagagtaaatgggaaatgggagagaaatatataggagcttagaggtcaatattaaggactttggcttttgctctgggtgggataggagaagtttagagtagaagaataagataatctaacttacatttgtgttgacaacagattgaagggagaaagaacataaccaaggtgaccattaggagtcagttgcattaacccaggtaatgaatgatagttatatggactaggatagaaaaatgaggatgctaagaaatagtcaagccctggatataaatctaaggtgtagctgatcaaatttgcttatggatcaaatgtgaagatgagagaaagggagaagttaaggatgacatcaagttttttggcctcagcaactggaaaaatggaattgccactgaggtaggaaagattgtagaagtttctggttgtagaaagtagaagatcaaaaggtcaattttggacatgctatgtttaagatacttactagacatttaagtagagaagtcaaatgggaactagaacaccaatatggagttctttggagagttgttccagtgtccagatttcagatagcaatgggaattattagcattgagctgggatttaaaattatgacactgcatgagatcagcaagggagtaggtagagataaaaaagagaggacttgcctggctgcggtggctcacgcctgtaatcccagcacttcgggaggccgaggcaggtggatcacgaggtcaggagatcgagaccatcctggctaacacggtgaaaccccgtctctactaaaaatagaaaaaatcagctgggcatggtggtgggctcctgtagtcccagctactcatgaggctgaggtaggagaatggcatgaacccaggaggcggagcttgcagtgagctgagatggtgccactgcactccagcctggttgacagagcgagactctgtctcaaaagaaaaaaaaaaaaaagaggaataagccaagggacactccaaattacaggttttaacaatgaaggtgaacttccttccctccccattccaaaacacacagaattgaccaggagaaaccaggaggaaaatcatccaagtatgaatcatataagccaagcgaatcaagtacttctaggagaaaggagtgttcaactatgacaaatgctgctgatggagaaatatggtgaaaattgaaaattgagaagtgacaatggagatcatttgcaacactgagaataaaaattttggtgagtggtggggatgaacgccagatagagtgggttcaaaggagaatggaagaagagcaattggagatataaagcacacttttccaatgagctttgttataaagcaagattgtttaattgttttaagatgggagaaatagcagtgtgagttttctcctaagggattgattcaatagagagaaaatgttgataatgccaaatacaaagaggaattgctgaattaatgtcacctggaatatgagaacgaagaaggcattggccagaaatatgggaaattcatccacagttccaggaaagaaattacagatgcagatagatgggcagatgattctctcttgattaaataaagttgtttcagaaaagtagaaaggaagctcagcagctgacaatgagaatgaggagagtgttgctgaaagtttaaggtaagaggagaaataaaaagtagtccttgaggggacagtgaatttacaaaggaaatgtagtatgatttttaggtagtattaactgagactcagaaagggtaaatattttgaccaaggttatttatctagcaatagaataaggaataaaactcagatctcatggccgggcgtggtggctcacacctgtgatccaagcactttgggaggctgaggcgggtggatcacttgaggttaggagtttgagaccagcctggccaacatggagaaactccacctctactaaaaataccaaaattagctgggcgtggtggcaggcgcctgtaatcccagctactctggaggctgaggcaagagaatcccttgaacctgggaggcagaggttgcagtgagccaagattgtgccactgcactccagcctgggtgacacagcaaggctctctctctcaaaaacaaaataaaacaaaaaaccaaaaccaaaaactgagatctctccactcatggctctttgaccaaattgttttcctctatactgtatagcatagtagatgtttatttagggagtttccaggagaaatgcaaaattcatactcaagtaaaattaaagtttatttaactcctgtgccagtcatcaatttaaaatatatatataaaattgatataaaatatatcaataaatatatatatattttaaattgatatatatatcaatttaaaatatatatagtgtctatttcatatatagacactatatatatgatatatatatatttcatatatgtaatatatatgatatggcatatatatgtcatatatatgatatatcatatatatcatatatatatttcatatatatatgatatatatcatatatatcatatatatatttcatatatatgatatatatcatatatatcatatatatatttcatatatatttcatatatatagtgtctatttcatagctttaaattatcgaattacatgccaagtgaaatagagaaaaaaggcagtaatacaacaattcaaccaaatcctgcctctgccccatccccaattccccagtgcacataaacaatgcttttgccctaaacatggagcttatttagttaaaaaatactgggtttacaattgggggaaatttatcctgaattatccaaataatgatctttagttctctaccagcagaatatcttagaaaaatacttgacccccgcaaaaaacaaacaaacaaataaacaaaaactgttaaaatcaattgtgccctatatttcttgggggaggggtggagtttctaacactaactttttaatgagtatctactattgtataaatagtagtggcagtggagcacttattttgcattaaatgtcaagtatatccaataagaggattagaattgcaaataatgaatttggtttctgtcttgcctaattgtctttaatttattatgttgaaatctcctatatttaggactcccattatggagaagcagtgcatcatgctaattaaagtgagtaaattgcaaaagtaacatttatcatttgcatcaagaaggtagaggtctcctatccttactgacagtaaataaaataggggtctattccacatgatcactttacattcctcactttggtgcctgcctttctggcctgtgacttgatgattagagattcaggaggaccaaagggtaagagccttacttgtgattgctgaagcttgtcatgtaagagatacaaagatttcactgaaacacaagatacaggaggaaacaatttgccatgtgaaaaagaagtcattagaaagcaaagagagtgatgtgagttagttggagaaacaatattggcaaagatatggcccaggatgaaaaatatgtaattatcagtgataatttaatttataattatttattctaatttctataatcgctttcatttaagcaaggaagaaaactaacttgcctccaggaaaatataatattattttaggtaagtactagaatatgtttctagcttctaaataccagcatggtttaaatgtcagatttatttgttgtgagaaaatttaaatgaatgttgcctatcattaacattcaaaaggtaaactgatgtgttgcaagatcttacctacttttaccttatttcaaagaagattgtgtaaataaaataatattttttaaatgtaggttttaaaaatcaagaaataaaataaacgtaactataatgaaaaagaatacaagttaatatcttttaaattacatttccagcacagattatacacttgaatgactataaatggctttaagctattcaaaattagttctactctgatatcgagtttgcgatatgtttatcagaactcaagtaaatctgtgggtgatgtccacaagcaaacggcaaaaactagatatgactgtgttttcatttcaatgtaatagtctcatatgaatgtacatatacatatagtatttttaatataatacactgtaagaatctagacagtatatttaagttcattaacaaagggtaaatataggaatgttttattactttcccagactcaaaaaacactgttttgatttccacagccctaaaaattccatagtcattgattagatagagtaatggacacacattatgatctatagtgttaatttactggccaagaatctaagctattgtaataaatatgtaagaggacatgaaatggttaaccatacaaacctcaggggtcaatttttagaccatttgaaatacagcttctaggagaaaggggaaagagggagacagtgaggaataggaagtgactatggcggttactacgcaattaaggttaagagaatacagatatcttgaaatttggctttaggtggttggcagactctcttactagttaagggtttattcccacacgtgcctttaacaaaattacaaatcactacaagctatgggccttatgagttacactcaaatagttgcaaattaattttgaaaatgtcaaggtcctactgcatatactttttgcttcagcaaaagattaaattgggttgtctattcctcggtatatttaattcttcttaactaatcctttgctttactttataagctctagagccaaaagaatagtttccggcatcattatggagaggcaccacaccctcagtattagaatctttttgaattatataattatttaattgaattaatttatgaaataatttataattatttcacaggagtgaaatccagaatgcattacctgcttttagaaccacctgggccacaggtttaattctgaagtgtgaacttatgtaatgttttgtgtgctaaagatggcaaatagctatgaacttagtgtaattatataattggtaaagatataagattgccaaatgcatttatttttactgtgctttaaaagactgagatatattgctaattttcatagcttttatgctaaaagcaaacaaacaaaacaataagaacttgtgaagagaagcgtagtagtttcaagtcctggctctaaggccagacttcctagctggagtcctgggtcttcctcctacaagctgtgagcctgaacagatcaccttacatctttatttctcagattcctcatctgaaagaaggagataataacctcataggattcttgtgagaatcgaatgtggtaatacatgtaaaacagaacagtatcttataccagagaaagcatttgataaaagtaatccagcccagttttgaaaaaatatataaacaaatagaaaaatttccatctttataatctgttactggggattattacatagagttagcagtcttagggagtcttggagttcattattaacataaaatacaacatttgtatgagaaaaacccattatagttagcctttcagctttgttcagcaaatatttattgagcatatactatgtgtcacattgtgtcttaggtattacagatacataaagcactaatatagaaatacatgtcatatattgtatattaaacaaacatacacaatatgcatatgtggcaagtgtgcctatgaggataatagttatcacctgtcctattcaccgagtgcttagtttgtatatggttctctactaggatttcctgtctgcattattttgtttatgtgtcttacttttgaggaatttatatgatccccattttcactatgaagaaaaatgaggctcagaaaggctaaacaactttcccaaggtcagcagagtaagtgacagagttggaattcagaggtcagtctgactccagagctagggctcttctgctttttgatactgctttggttcttactgactgagtaacagtgaatttatatatttcaaacaatttaaattgggttctactgagtggagactgcattgtttacattctgaaacttttcaaagctagaaagtcatcacttaacaaagaactactttgtggcctaaagtggcactgaaagtgttaaagaggtgagctgggacccagaggtgggatccaagatcgccactcaatgcataatggtagggacaacccaccatgttgtaaagcaaactgtctttaaatagaggctgagatgaatagatgaagactttcagagactgggggcaaaggtaaggagaccttagataatttgtgttgatcagaaacagggatcctgatgccttctcttgatctcagggttgcttaaaggagatggcttgatgaaggggggtttagggcttcttagaaagcttctctgacttcacacacacatatacacactcatacatgcacattccctttcctcatcagactttgatgcctaaagttcctttaatataactaccacccccttctcttcatttcctacttttgtatttcccttattttctctcctactcacttcctataaccacctgtagaaaagctggtatcagaacaactgcactgagtactgatcaccatgtctgttgcccctattgacttggttaatacaaacaaagctaacatctgtgtccaccaactataagtcaaggacataattattacagaatttaggctagaaatggttatatggaagtaatcatacagagattcaaataaaatttttgctgactgtaaatgtcttttcttttcttgggagaaagactctgaaggttgtaataaaaaattctgtaacctaacaagtcactctattacccaacaactctgtgtgcctctgctagactaatcttccaaacctgccacttctattggttagtctcccattcatttccaccaggatctagttcagccttcttggtcccttttcaggccccacacgtctttccacatcacatccaattaccccacagaactatgcacccctctccacccactccccataacccagtccatcaggggactggatcccttgatcctttagcttaccagccatgttccttttccatatctttgcagtctataggagaataggtggcttctattctctagtcacatttatcgaaatctatgagacttcgttgcatagtacagcataaatgaagttatatatatgagttgtatgtgaaacccagcactgctacttaatggctgggtaatctagagtagattacttagttttgccaagtctcagtgtcctaatgtgtaccataaagagaatacaagtaactatctcataggcatgctttgagattaaatgaaaaaatgcatgcaatctgcttagtccagtgcttgacatatagtaaggagttaaaaaaagtaacttaaaaataattaaataccacagtttcaatcttactttctaggctgatcattcttgttttgattatatcaccctcctctttactcataatatggcttgcaattgtatcatttatgtaatttcttaggatatttaccattttgtaatataatatttttatggatacgactgctgaacttttgatgaagcagaaactataaaagagatgctttccaaggccacagagaaagtacacttcaaaggacatgttatttattttcactgattgagtggttaattgatggcttcattcattcaatcaatgaagagatatacattgaatatctaatatatttcagacaccggaatgagtcagaaagattctgatttaaaggagagaataagaagtacataaattactatgacacaatgtaaaaagtcataagtgtctatataggtaaagtacattaatggttcagaagatagaaagatagcaactggaagctttatagaggagggagacttgagctgtcctggaagggcaggttgtatgagttgattgcaaaataagaggtgagacagggatagccgaatggcagagggcacattccaaatcaaggcacatgcatgagcatagaattgtggttggagagaacaagtacctgcggtgaatagcaagggaacagccgttcagatggggggcatccaaaagctcttttcaaaatctgcttgacccccttgggctttcttttaattagcacaactgtgacctcgaaggctttagcaaatgtctttgctttccagctgtttttattgatttttttttcattgtaggactttaatttagagtagttcctccctgcattcattgttcaacaaattacactcatgcggctgtcataccaccctacctgtttctttaagaagtgacttccctctgtgagagaggttcctgttgacacaaaatcacagaacgttagatgagacctaggagggctttgtactcatagtggttttaaatggagaaagatctctgcagaaaaatttatactagtagctaagatggactgccaaattcctgttcttcactaggagaagtcctataggttctataaaggacatccagaacccaaattaataattacaacattgataataattaccagctcagctcagctctgtcccagattccaaaactcacaagtaggacattcaaaacggaatcttgaagctcccgaagatgttttattaaatcatttcaaaatgaataatattcaatatggtttgtgatatttagaaggcagagaggacatactaactttccctccatgggtggccttctattcccttacattaaaatctaaggcactgacagttgaattgcttaataaacaaactcaacatccaaaagaccctcagctgagcaatatcctcagactcttcttgtgaattcctgaagttcccttgacatgctcagttcattaaaagcctttcacctggtgggcagaaattgtctccaggcttatgatgaatgaaaaagaacagaatactaaatttaagaatttaagaagtccagcttatattcccattattggcagataacaaaattgaggctcaaaagaggctggatcaactggatcacttagctgcatagtgcaaaagctgagaccaagtcctaaacacatattctttctcatttctagacttccagttcaatgcctgctcactttcttctctaatctcactatctccatctattcttttttttttttggagctgggattacaggtgcctgccaccacgcccggctaatttttgttatttttagtagagatagggtttcaccatgttgaccaggctggtctcaaactcctgacctcaggtgatccacctgcctcggcctcccaaagggctgggattacaggtgtgagccactgctcctggcccaccatctccatctattctaaaaacagaaacagaaaaacaacaacaaaaacaacaacaacaaaaaactgtctccaaatagatcagtcacaaatccagtcccttctttccatttccactggcatcttcccagttcaacaccacggtcccttgcctagacaactgtagcagcttactaactcctccttgtttctctagtcttgccctacctttctgcctacatcaagtacatcatgggttgtctctataaaaatattcccttatttaacaccctttgaatgtacctcattgtcttaaggtataagacaatgagcagaagatacaagacctttcaaggtttagccaaatttttcttttcagatttatgctgtatagattttgcttgttggcttctcagctctccacccttcttcactctgatctgtgcctgggaagctgataagcatggagcacatatggcttctggttgggtttggcaaagggacaacactagcaggagatgagaagcagaatgacagtgagaatgggcatttatttgctggattcctcactgcagtctccttaggagaatctctgcagttggataattgctacaaggacaccccgtctaggaggggtaacaatcccatacttaatagtcctggagtacctctcaagtgttaatacatctggcccactttttggtaaataactcctatgttaaattctccacaaataattcacttcgagttctattagtggttccttgccagtctgatatttggccaatcccaagttgatgccttaatttacaattacaatttgcaacttacaattatattgaataatgatagtctctgaaacaaatgcaccctgttcattcttctctgaagctttgttcctgttgtttatttctgtctgaattgcatttgtatgcatgtatttctgtctgaattggattcctacttcccattacccccaacatcatatctcaggtcctagactaactgctcctagactccttctgattgaatgcaaatggctacatagacatctctaatccccctgtgcttccccctattggatcacccttgacaacgtgctgttgtgtgttccctaatacatgggaaacatggaggccgggagctgtatcattcatcctcataaactcactacctagcacagatcccacaacagcatagcaactcaacaaatcttacttaaataaaatgtatctttatttggatgtggaggtctttcccttccagttcttacttggcttgaaattttcccttgaatctcccagggagttattgtaattaccagatgctgggcaagtaccaacaaaccgtgagaagaacactgttctaatccttgagaagctcaaagtccatgatctaactcccaggctatttaagagctcaaagcagatgatatgtaagtaaaaatgcattttaaataagatattgaagccaaatatgatttggtttcaaaagagaaattaatattttgaagaaggcatcacaaatccagatccatttatctgaagtacaagactgccctgccaaattaaatgtctgattctttattcccgccagtttctaaaatctgtcagcgattgctgactcaaaaacaaaagcataaacaacacagtttaaagatgttcttaacaagtatctggtcctttctgatgctatgtgacagagcagggaagaccatgctgcaggtggaccattctattcaagttacaatggctttccaattaagttagggcaaaattgtcaccacattctagcatcacctcacattttgttctaaagattttgtcgactatacctcacattttgtatatagattttgtcaacacatgtttgtgccatgagtttgggaattgtagtaattttcatgataaggacaatggcaaacctaagtgttgagattaagtattaattttttttttttttttgagacggagtcttgctctgtcacccaggctggactgcagtggcatgatctcggctcactgcaagctccgcctcctgggttcatgccattctcctgcctcagcctactcaacagctgggactacaggcgcatgccgccacgcctggctaatttttttgtatttttagtagagacggggtttcaccatgttaaccaggatggtctcgatcttctgacctcgtgatctgcctgcctcggccctccaaagtgctgggattacaggcgtgagccaatgtgcctggccaagtattaaattgttatatgacagcttcttagaagctttgaacatctgagtcagagtctgtgatatagtttcaagcaagtagttgtttgttttgttttgttattttctgttcccatctgccaggttggctttttgagcagcaacctccctgtccacccttgaaggcaaagttccctataaagggctgccatactacccttttgctagcttgggacatcagttctcccctatggtgcattacatactgttacatcacgttttagcaattatgtacaaagaactgaaattaagaatttttttaacttttattttaggtttaggcgtatatgtgcaggcttgttatataggtaaactgtgtgttgtgggggtttggtgtccagattatttagtcacccaggtaataaggataatactcaatagattttttttaaatcctctccctcctcccaccctccaccatcaagtagactccagtgtctcattcttttctttatgtccatgcattctcacaaaacagatttttaataaattagtgtgaatcaagattgtttctattatagcttccttcttacttttgcttgcattgcaaattgctctcttcattaggaatgaaaggagtgaacttatcataaatgcatagaaaaacccacagccaatctcacttatgccacatgtgactgttcaccatgtgagttgcaaggaaaatgtgaatgatcaccatatttcatcaattgtaaaaggcaactttttccacatttttatatacctgaaataaggctgcatcttacagttgatcataccttatagttaaaataggcaggtttttaaaatggaatataacatataatgctgtatcccacattagctgcattttagactcaaagttaattaccccaggacccatatcccactctttattttgaaatttctctctagtcaggcacaatggttcctacaatattgtctgtccttcttctctcactggtcctgtcatattattaactcattttaaaaatattgattgtctattttgccggatctcatattcttataaagtggttccatttatagaacagtcattgcacctaatttagaccagttcaagatatttcagaacttatctttcaggtaagcccatgttggccatttgtttgaacaagagcctctgaaaactgtttggtggattctaactacagatgggttatttaggaaagagaagccatttcttaatgaatgggagtatgcctcataccagcttatgtaaaatcacagcagtactatcgcatggctggaatcacataagcattggctaccagatcccctgagacaggtgcagagctgagaaaatcacggtgggagtgattgtggagggagtaatgattgtgagacagcaggagggagaagcttcctaccctaccactcccagcttttggaacttcaaagtgctgatgtatcatagacattcaatatatggttgtttaatgaatgaatatatttagccaaaaaatcagattaaagcaatttgaatgagtggtgctgaaaagaaatggaaatcacaaaggccagttgccccaaaggggtgtgcagggaagggagaaggcaaatgtcactgaccttgctgtggtggtgaggttggatgggagttactctatctttctgcctgtcaacacttgggatttattatcattgagtcactattgtaagagctttataaacattaacctacttaatcttcaaaattatcttataacatagctactattatctcaattttattaataaagagactgatacaccaagaggtgaagtgcctttcccagggtctcacagctagtaagtgacagatttagggtttgaacacaggactctggttccagagtctgtgctttgatcacttcatttcagtgcatctttcttcactcaggaggtgttctctattttagtcattacaatactatggcctttgaagccagatgtctgtggtctgtcccagacttgaggagagacaaactcggctctcaggctgcagaatgataggctgataggcctgccctgtaggtgtggtcaggcagagatggccggcacactctctagatttgacttggatatgatccatgtttttagaaatacaattaaaaactttacttaaaattacatgttctgttatagtattaaaatgacatctcccctgtaccctcaaatcccaggttagaaaaaagtaatgtttgactttctttgttcttttttgtcctggcattgtaaaatatagcctaaagaaagtcctggggaactgctcatagctatatgtcaaatgaattattttatcagtgtgttaaaacaatttttttaagcccacattttctctaaaactcttgatggaaaattaacatcttgatgggatacagaattaaaaacaaatactttaagaaattactgctagaggaattaatcaaaatactgagaggcagcagatttgttctgaaaataatcctgatatctgagtttctgtcttgaaaaggagaaatatttaccttttaaaattccatactataaatacattctaaatcaaaattctggctcttgattgttgtttaatatccagaaaggaaaatggcttttgatttggggttggcgtttaacagaaatcacaaaagtgtccatttgtacaccataggctggatttgggcctatgatactaacaacataccttcagttttaacagaggttagatatttaatgcagcattagaatccaagatgtagacagatgtctcagacagacaaacatggtagccaagtagaccttgctttttcagcctatgagagtgagagctgtgtctttgttcctagtgcctagcaaagggctggaacataggaggcacaatatatgtacaattgagtttctccaactgaacagagatagaaaactgttgcctttgtgcaccaatggaaagttaaggtattagaattgctacccaaatatactcaatagtgatagtgtatgtttgtctggaatgtagatgtagataataaataaaaagtagattcacatgaaattttgagagcacacttgacagcatacaatgtccattttatttatttccttgacactgtgttttgctcagttacttggatgttgacaaatgctattatcatattttcttcttagaagcaatatgaatattaaaactaatcttgggagattccactgaatgcttttttttttttttttgagatggagtctcactctgtcacccaggctggagtgcagtgacgtgatctcggctcactgcaacctctgcctcccgagttcaagcaattctcctgcctcagcttcccaagtagctgggactacaggcacgtgccaccacacctggctaattttttgtatttttagtacagatggggtttcaccatgttagccaggatggtctcgatctcctgacctcatgatccacccatctcagcctcccaaagtgctgggattacaggtgtgagccaccatgcctggcctgcctttttttttttttttttataatgagttatgagttaagcctatttatctttggtattcttctttgtgttccatggcaatgcagattccactgtgttcctccttcttataaatttgaaaaatgaggaaaaatgagattgtgtgcctttaattatattatcagcaattgagggaaaatacaggtaccatgtattttgccaaggttatcttttctaacaaactgcctgttaatttgtgggaatgcttctgagtcattattagcaatgcttttgtttgctattgtctcttagaatcttaatttcttacatatattttctttcatttttctaacttgattctctcatcatcttttatggtttcttaacattcttatttaccagtagtaaatacaattattatcattttttcttagtagctcacagcaacatacatttatctgagagtctagagtttagaagacaaaaataggtttcactggaataaattatctgtccacagcactgcattcctcctagaggtccagggaagaaactgtcttcaaagccagcgatgccctgtatagtctttctcgggctgtcaatctggtctctgcttctgtcataacatcttcttctctgactctcctgcctctctttttctatcaaaaggcccttgtgattagattaggcacatccagataatctaggattgacttctcatctcaagatccttaatttcgtcacatctgaaaagtcctatttgccttataaggtgacgtaatcataggttttaggtattgggatatggacattttgggattaattattctgtagtgttctttttttaggataaaattttattttatattttcccctctacttttaagttctggggtacatgtgcaaaatgtgaggatttgttacataggtaaatgtgtgtcatggtagtaataattatttgattagagaattatcccatcacctgggattacagttataattcaattaggtccttgttctcatggagcttattttcaactgggagaaggaagaccatggcaaataaatatggtaattatatgtggtgacaaatgctgtgaagaaactaaaacaggctatcattttacaataaaaaggtagcaggctctgatggtcaagagcagggaggctacagccagaccagaattttaatctcagcactaatactttgctgtgtgatcttgggcaagttattgagcctttctgtgcctttgtttcttcatctctgaaaaggaaacaatcatagcccctatctcacaggcttgttttagggattacattaattaatacatggaatacatagaaccctatctgatatacagtaggcactttgcaagattaactttttttttcattattttagtaattaatacctcccggatactttctatcagccggaaattattattataacttgtccatcaaaattaccctatgaagtaggtgttagtcccttttcacagatgagaaatctgaaggttggagaggctaaataactatcacaaggtcatgcagctagccaagtagcagaagcactgcatttgacttctgctctgtcctcaaacatctttgcctctcttcataagacgtaagtttgattttttctgaatatttactttctagtggctcattaattaagcccattatatccataatctcacatttaggactagcgagataatgcacatttactgacaataaaactcatccttcttagcctttttcttttctgatttttttcttatacaaaagaaaaaattttgctgctgcctaaagtcagactgattataacctcagcaacatcttttatatacatttgacttaactttattcatatagaatttattaattacgagccaaatatcttgctccttaaaggttgcatgcagtttcctgttgcatctgtaccttctacattagatgctttagagtagggtgctttagaaagtatttccatttgtgatcccccagatttcacccatttagttgaaattcaaaattgctattatttttcttttcatgactttttcagatgtctcttttcttttcctaatcacagttccatttagaccaaatgacattcagaaattctcacttcggtggtaatctgctttctttaacatccagttttaaaccataatcactaccctcttccctcaattgctcagatagttggtgtatattttattaagcaacaacttgccagatttaagaaaagtgctctcttagagcaaagcatcattctaaagccccagggcttggcagcacaacgtggctcagcagatcctgaggccatgcatataagtttaatgaggctgtgaagggaaagtgctgtaaaatccatgaacttcgcccatactagttaaaggagcatggcctttttctccttctaaagaagtgaggaataggtgaggacccagagattggcagttaagatctggctgttggccccctcttggagatatggtgtttcaaatggacaccagagtcaggcaggccattatcagaattttgcctcttctacttaattgttgtgtaacttccctgggattttattctatcattcacaaaatgggaataacagtgtttacagtgctttgtgagaattaaatggcataatgtacataaatatttagacatactgggcactccataatgataacaagtattataactagttactacctgttctttctacattcacttgtgatttttttctgaatccttgaacccagttcattccttcataagtggactttcatgatggtgtagagcaaaacctctcctttggctttgttagttcaccatttatttttattattttaaggactagccatcagcttctccacatgaacctacccattttcatgatgcttaggcttaaaaatattactggcactcaaatttttattgatcaattgactgaatcattcatcaaacatttattgacttcctactagagtcactcctttcccccatgaagctcatagtctctggccaggtcaggtgcttgtttacatgaagtacaagtctgagggagaaaggcaacaacacaagatgctgagatagcacagaggaagcagtgttcctctcctggggatggagtgtatggttagggaaggcttcctagaggagaatgactctagcttcttttttttttttttttttttgagatggagtttcactcttgtcgcccaggctggagtgcaatggcgcaatctcagctcactgcaaccttctctttccggggtcaaactattctcctgccttagcttcccaagtagctgggattacaggcgcccaccactacgcctggctaagttttgtattttttagtagagacggggtttcaccatgttggccaggctggtcttgaactcctgacctcaggtgattctcccatctcggcctcccaaagtgctgggattacaggcgtgagccactgtgccccgcctaccttgttctttgaaagtaaaggtgggttccagtggcagctgccccagggcctgcttcctcttcctaagtctgttgtcctctggaatggaggggtggtgctccaatctgtggtgcccaaaaacccaagtttatttctctcttaacactggcaataacccgtccacatgactgttgccttttaaaacctcttaataatgtcatactgtgtttgttgttgattccaactaaattatcaccagggctgtgtgggtaaatgcttttaaatactctctcatcttgctctttcccctgtatgatgctaatcttgtccctaagtaagtttcttcctgctccttttgtaccttcctttcttgtctttcctcctaccttttgtctcgtggtgtctggtgtttttttttgtttttttgctttttgtacaaagattagtttcaatgtagtctatagcctcctttgtaaaccagttaaaaagttctttaattaaaaaaaaaaagaaagtaaaggtgtgttaagtaggcaaaggaaaaagggaattctgggcagaatataattactaagccccagaggatgaaacatcaaggcctgtcgggtgaaggatgagcaatttggtgtcatttgagtaaacattcaaggagaggtatagctgagaagaggatgataagagaagacatacatttggatgtataaatttagaggaaaagtgcccaagaaaactgcctgacatatagtaaatgcttgataagtgcgcttatttttttttcttctaaagaccagctcttgttttataaaataatatacattatgcttaaaagccagatattatacttgattttctttatagcttgttctgtactctcaggctttctgtaaaattttactttttatttttggtttatagttaagaaagtcaaagatggaaaatacaaattgtgagaaaaaattacaataatgtatccttaatatttcaacatcaacaatcacaaaacgaacaaataagagattaataagaaaatccactttttttgctttcaataagaaaattaaacatccatatgtcagcagactattaaaaacgttttctcttgaatctattagaaggagggaaaaatgcattcctaatgataaatagaactatccaagttgaaaacatttgattttcctcagcaattttctcagcacgtccttctgtctcccacacccctcccaataatcttcacatcttcatttctttggagtttgtttcagctttgttttgataatgatagtgtagacacactactttcattatttctcactaatagttacctaaagcaactatttgtctgcaattttatagataattgtgtttcttttagaatgctctttgtgtttctgctgctcattactaagtatacaacagtggggaattgtctctaaaaccctactactccttcttttgcatactgggaaaatctcccacagtgaagaatgcctatttttaagaaattcaaatatttctttttcttttttgtaggaaattcaagtgtttaaaagaaaataaaaatacagcaatgtgttgcttaacaatggtgattatgtcttttggtgtcacgggaacatctcagagtgcacttacatgaacctagatggtatagcctaatagacaactaggctgtgtggtatggcctcttgttcctgcgctacaaatatgtacagcatgttactgttactgtactgaatactctaggcaactgtaacacaacgtaagtatttgtatatctaaacatataaaaagtactataaacatatggtattataatcttataagaccaccgttgtatatgtgatccattgttaaacattattttgtggtgcatgattattttaaaaatttggataaatggggtatgattatttctattaccaagaaatcaatcatttataaaatcagttcttctgagtgaccttcaacagaggtatttacgcgttgactattgcataatgaaaacggattataaatatctttatatgaagatgtctatgatatgaaactggttaatttttgcacatatttccaagggaatggggtggttttaaccttgatttcatatccctttagatgccagtaacctctttaaagattattgtgttccatttttttttctagaaaatcacaccagttaatgaagtacaattgcatggagatttcttttgtaacttgtgatcccttggcaatctacagaagattggttattatgatagtcacattgaaagaaaaatctaggccgggtgcggtggctcatgcctgtaatcctagcactttgggaggctgaggcaggcagatcgcttgagctcaggagtttgaggccagcctgggcaacatagtgaaaccccgttgctaccaaaaatagaaaaaaattggctgggcatggtgatgtgcacctgtggtcccagctacctggaaggctgaggtgggaggatcccttgagcctgggaggtggaagttgcactgagctgagtttgcatcactgcactccagcctgggtgagagagcaagaccctgtctcaataaaaaagaaaagaaaagaaaagaaaaaaaaagagaaggagggagggagggagggaggaaggaaggaaggaaggaaggagaagggggaggggaaggggaagggaagaaggaaggaaggagggaaggaaggaaaaaagaaagaaagagaaagaaagaaacagagaaagaaagaaaagagagagaggaagaaaggaaggaaggaagaaaggaaagaaggaagatctaatgctataaaattatttctgatttgggaaaatatctttaggcatgaagagcaggtgtcagtggtaagccaactaagaaatcacaatgtttcattccttaactccccaggccattacacattctcctgttaagtgtttttttcttctttaaaataataccaataagatttacctgtattcctctatggtcttagtttcagattttatttagataagtttctcattaatttaactggctactaataggggcaagaagaaattgggatcaatggagacgaagaggatatgtgacttctcagtgtacacattttaatattattttgatttttgaacccacatattatgttagcattaaaaataaagttaatataccaccaagcattcactcatcaaacaggtaaataagttttctcaaaatatgattagcaaacttatggaaagcctgataattctatgctccagctagttattatttggataataaaattaattagagtatgatgctgaagaaagagcacaagaaatggaaccagagcatctgggtgcaagtttggctcatagtatttactagttgtgtgaccttgagcgagtcacttaacttcactgagcttaacttctcttatctatgaaattacaatgatgataataccaccagtatatttacctcttggagttgttctgtagattcaataagaaacacacatgagagcgctttgtaaactgcaaagtcttatacttgtgctagctaatattttatatttcaattaatgtttccaagactctattttcaaattctcaaagccactattaagatcattacgaaatatgtttatttgtttgcttaatcttttgctttcatgcaccaaacaaccaaagtaaaactgagtgtgtgtttgtctttagttaacctggtcagcaggagtgtcagaatcattcttggaagcaaagaaaatctgctcccatagaatggctatttttcggcattgaagatcaatatttgggagctctagttaactaacagaactcccaacaagcatttcagcggggatgaatttactttgttacccatagttcgaagagaaactgcaaggtatggtcatttttttggcccatttgttcattccacaaatatgtattgagtgccaactctgtgctgggtgctcctctaggcacttcggacacggctgtgagcaagacagacaaaacatgatgctctcatggaggttactttctactggaaaaataactgagcttacagcttttttcatcctaagcacacaaataccttaatctgaagagcatttcttgccttctgataaacagctttaaaactgttttttggtggtaagatccttgcttcatgtatccaagaccaaacatgaaaaacaaataaagattgctctggctggagtgggactggggccaggggccaggttgtctcctcctacactccccatccctgctcctgccatccctctgccagaccccaggactcttcagaggacagtttatttgaaacttccacacagggcgttatctccacatcagttttgatactgaagacatcctgtaagtgcctgcatccacagtctcccaagggttttctcaagttccattcctcctctgggtctaattatctctctctccacataatagccacattatagggtttctgttgtttctgataattatgataataacgataattatcgcttatggaggacatactatctgtcaggacagtgccaggcattttatatgtacgccttcgtttaatccccagagtcatcctgtgagataggtatgaatcatcattttacagataaagaatgagactccaagaagtgaagtaattttccaaggctacagagctgttaatggtggagctggaatttgaacatatctatccgatttcacagtaggaattcttttttttttcttcctatatttcaggcccatcagcaggaagtaaggaaattcttaactactgctgcttcccaaactctgtgaagctctttgaccctctcagggatagttctaagtatggtgcaaagggctgattagagcaaagggcagcacaatgctcactcaaatatgtgttgaaggttattacactagctgtcatttacgcatggcctactccattctgaacattctacatccattttcactaatcttccagcaactctggaaggtaaatatgattacccctacattcctggtgaagactctctggcacagagaggttgtcactcacttgaggtctcacagctagcaagtggtgagccctctgcttgcctttatgacagcttggggccaaactattcctagagccaaactattcctagagccaagcccaagactcccatatcccccaaaagaacaacaacaattttaaaaagagaaagaagacatactctcctagcccgcatctgctcctaatccaggccctactccaagccgctactgtcggactccgttctcatttacaactgggtgctaaactctccaactccaccagcatgaaccctcctaactctatttccttgtctgacaaattttgtccctccatatccctctcctggcatctttttcttttggtttctccacacccattccaaactattttatttgtttcctcttcaagccttttattacagcatgaatctgtttatattttcttccttttatgagaaacaggatggtgcacgggttgttctggagcctttctgcctgagactgaaactttgttttactctactgtatagtttttaacctcgggaaaaccacttatgctttctgtgtctcagtttcctcatctgtaaaatgagtaagggaatataacctatatcacaagtttttgcaaagtttaaatgagttaacacatgcagagatttttagaaaggtgtcaggcctgtagtgagtgcttcatacatgcgagttttaattattctcttcttgtaaccatgtcccattctctctacatctttctttttctctcatctatattttactctgctttagctacacattgttttaaaaagtaaaaacagagtttatataaaataagttcattgtcattattctttttttttttttcaatttggtctacatttaaatgcctactattagccagacactgtactaaggaaaaagaaggaatataaagatgaatagccgggcgcagtggctcacgcctgtaatcccagcaccttgggaggccaaggcgggcggatcacaagatcaggagatcgagaccatcctggctaatacggtgaaacctcgtctctactaaaaatacaaaaaattagccaggtgtggtggcaggagcctgtagtcccagctactcgggaggctgaggcaggagaatggtgtgaacccaggaggtggagcttgcagtgagcagagattgtgccactgcactccagcctgggtgacagagcgagactctgtctcaaaaataaataaataaataaaataaataaataaataaagatgaataaaacatgcttttctgtgaagggtttgttaattttttaattagccaatcatgctttccatgttttcaggaaaggatgaatttatgtattcataggtccatatttatgtctattggttttatcacctacatccttccctgaatctatctacttctctctacctattctgccacccctctttattttttattttaccttttttacagatagggtcttgctctgtcctgcaagctggattgctgtgatgtgaacatagctcactgcatccttgaactgctggtctgccaccatgcttatccaactagcaccatctctcacacagactcatgcctttcaactggtcctaccccagcctcttcggtgctttctggcctactttctattcagcagccagagccatctttgtgaacagcaaatctgatcttgccagcctcaggcctaaaacctttcaaaggtcctttcattgtttttagtagaaataacacagtcctgtgtgatctgtctctgcttctctcttctgcctcctccagtgtttctcccacattccctggtttgctttcagtccctccactgcaccatcctctctccttcagatacacttcagatatctttccctcctgaaatactcttcctcctttttctgctatgctttgacaatacctactcacccttcagattaaagaaagtattattcccgtggaatgccttcttgacgctctcctctaggtcagagcttttgtttgtcttcgtttggtctggtttagtattctctgagtacatttgagtacctagactttaagattttggatccaagttctcttctttttcttgagcattcactttgtataattcgttagtgtgattttacttggctgactgtaggtccattagggaaggaaggggccatgtctattttgctcaccattgtatctccagagtgcaaggcagcatgtcactcactggaataatttaataaatattagctgaataaagattgaatgaatgaatgttgtcctgccattgcttaattttaccaatgtgccagcaattctttagtaataaagtaaattacttttagcaatgggaacatgataaatgtgaggaagctaagaggagaataagagattatcttgaaacaaagtgcaatttggaatttttgtcttttaaagacttaggtaatgagtctatcaggaattctatgtgaattaggaatctaaaaagcacattaaagatgtatactttctatttcttgggcttgggtttccaccctaaagctgccactacttgtgattctgacagttcaagacatctccactatttcagctttctgcatctttaatgtcctgaaattgattttttacattactttccttcagcctcaaaaaatctatctgcaagtttagcaattacaatttaatttattaaactgataagatttaggccacaatggttctataaacaaaaagatcatgaacagtaagttgttaatcctgaaacccccaagaaacaataaatgcttctacttgaattaaacttaaaatcattattgaatgtttcaaatcccatggtacacagagacagcaaattacacagatacagatctttccccttcttccgagtgggtgaaagataatttctgtgtgtttaaaatgtatggggaaaaaaggaaacatttagaaattaccttcttgtaataattgttatttgatggcatgttttaatcagaagacacaataaactaaacttcatagaacatcagctggaaagggccttaaaactaatctcttgaaccaccttaattaacaaacaatggaatccatgttcagaaaagtgatatgacttaggcgtgctcaataaagttgcagagtgagggacaggacgagaaaagtgcctcattactcattattaaagttgaggactgacaaatagctattcaaagagatgtgagggtaaactatactgggcacccagaatatagagtgaagtcagaaagttttaaagctgtcttgctttatagtcctctttgcatatctctgtgcaacattcttttacagttctctaacaccctgaaattccttatcaaattgaaggattatctagtgaagatctgtgttcattttgtaatacttgtagagtcaagagtagtattagaaccctttatttccatgcatttgatctgggtgttgctaatgatagatgtgaatctaagaggtctccttgttgtcaaaatgtctctagcacaaggatttatttggctttttccagtattaatgagtgactgatttatgtcactaaatgtcaacatacccctcaaataatataaaatcacaagatgaaactgtcaaagataaatatactttattacggaatgaaagtttttatggggatgttcggaactgtaatcatacaatgagaggaggttatatctattattaacctataatcagctttgtaaatatttttaacccctttgatatgagttaaagatgcaccattcccaggatagataatgagatgaagagagttttctaatttaggagttaggaagtgatacctgcttttgtccttattatattactcgaggtcaaaaactggctgttaggcatggggagaggtatgcagcatgattaattattaaggaatctggaaaggacctttcatgaatgaatctgcagactgttcaggaatcatctttttagtcatattctacgctgctatgggttagatggaggttggggaggaaacaaaggcaactaggagaaggttattaaaaggatacaataagtgaagagacttcctgggaagtgtctagttgctggcagaggcctttttctgttagtagaatgtgtacatgtgtgggagagagttgtggagaaagaaatgtctaagcaataaaaatctagagtcatgtaaagttttatttaagtttctttcctaatatttcagtacaaattagaatatgataactagattaattagaacataattaatgtaacatattaggtgaaatttaatacttggcaacaaagagtatcactaaagacaagcttattgataacagataaatgaatggataagcagctggctggctggctggataaagggtgtgcacgaagaaggtaggatggaaagagaaaaactgtaatatatttgaactacttgttgaaaaaaataactatttccagatttgtggctattttaaaaattaacaatagttgcctacacttacaataatgctgtcatgtatacatcattcagttgtgatacagaaacaatagcaattaacaacagtaacatgctagaaatgaaagtgatgcagtatgcccgagaaagtggtgaggctccctcagaaattttttgacccctttatgtccatttgattataataatctcattgcattccattccttgggctattaaagccactccccatcatgagctactacagtaaattttaaaaatcaaggaaattactaactgctcagctagcctcagctttaacagctataccaattttaaaatattaaacggctttcctatctagatgctgaactttagttcctccatatgtgaaatgagtaaacttgacaagattatctttaaggattcttaaaacttttaatttctatttcttagtgattctagttaaactacacagaatctatcaagttaactaggtcgtgcattcatttctccttatgtattaaaaatgcaaagaaaagatgtaatgttagcgacaaaactttcaagtaatgaaacttatgcttctatctcacctaagttggaatttgcactagaaaactggtcttgtccagtccaagtcgtgtacggtactttctgttctgaaagcttacttaaatgttctctgatgattctgatgcaatttctgatcaagatccacagctggactttaaaaatctttcctgggtatttgtgatgcagttacgtgagttgggaaaatgtttcaacatgccacagctgctcattcatatgcataagcctacatagatgttgatttaaagaaagaaatatgtcttgcattgtaagtatgcttcttggatggcgtatgtactttcatttctgagaaccttcaggtacagaaggtgtccatatttttcaagggataaattgcatattcatgtcaagctttcattatatctttgaccccatagagaaatgcaccgtggtgtccaactgtggtttaagctctgtgacagtggttaccccaaataacatcagagtttcacttattgctgaaaagaatagttttccttctgaattagcctcacaatttaaaaggagtgaaacagattatttacatgagtttctgcattaaagtgtggtaagctattcaaattttcaaattttatagtgaagccttaatgactttcccttggttcatagaggcatctgtgaggataggaatcaatgttacttcatcccaactcactgcttctaaactcacttgctgtagaggtcataactaaaggcaatgaagcccgaataggttcattgtctcactagctgaggagttctagcaagacttatgaatttgcttgatattggtatttagatgggcggggtagacaaagtagagctgaatggcacatgaacttcttagatctcctgcagtttgacctatccctgctaaaaccactgagccatgaccaatcattgggtgacacatgccagaaatcaaatctagtgatgcagcctcatgtgactttgcccagttctccaggtagagggagtccaacccaacagtgacaagtgacaatttttgcagggtctccaagtatgttagggcaacgcctcacaaactctaatgtgcatacaagttatctggggaatcttgataaaatgcagattctgattcagtagggttgggttgagacctgagatcttacaattctaagaaggctctcatttaatatctatgcttttggtctgtagacaacatttagtagaacaaaactctagaataattcatttcttccttcagatgcctgcatagcttactccctcatttcttttagatctttgttcaaatatcaccttattagcatggctttcttgcccactatatatttctctgtcactattgtctttctcctgctgcttctttctttatactacttatcaccatgtgacacattttacatttatttgagaggggcttttttggttcactgctttgttatttccttataacatggactgaggcataataagtatccagaaaaaaaatacctattgattgaatgaatgtataaatgaataaatgaaccatgtggtcactctgccacaattccataaaccagactacacttatgagtctccaggcaattatcaactctgctttttgggcttttcttttaactccagtaccttattaaagaataaagggtggatgaaatcaggtcccttcactatctaccgaagttcctcatcactggtaaggactgtaccatccacgacttcttttctacctgcaggccattctgaaatcctggcagtctctccaacaatgtcctgagaagtcatattcaaggcaaaagaatttgtggttctcacagggaccacttggctcttaactccattttgagctttatctaatactagctactgcctacctagttctccaagtcaatatctgtggcttattatttcaaacctaatcagttatctcacaataaatgtagatattattagaaagaaggcagcaaatacagatcagatttaccctgatctgacttggggaaatgctgtgttatcttttttgaaaaatgtataattaggttgtaatcaattccctttttattcatcaatggtgtcaaagttgagtttcagaacttgaaaaaaatgttagtgctttaatcatcttatctttgtgctatatttcaaaacaacagctgtagattttctgcaatgcaggggaaatggagtttatctactagggttgctaaaggttttatgactgaaaaccaaaaggcaccatctaaaaactgtgtcaacaccaaatgtccaaaccagggattcaattaccatctctgaatctaatataaaaacccatgccattcctttaataattactcagcaaacatttcttaagcacctactattaatatatgtcaacacactgaaaacattatattgcatttaaattaagagcagacccattcaataactcattaataaaccatagtcaaattcatattgcatggattaacacaagatataaaatgagtgacagaagggtctatcacagctcctagtgctgtctaggagctcactcgagtggagaggtgtgcaaactgtcataatgggcacaccaggtgtttacatacagttttggggaactcagataaagaatcaattaatgctgactaagcagattaaaaatggctttgtagtggaattgacatctgtgggctctcaagatgagtaggaatcctgcaggtggaaagggagaaaggcaattctgggtagaggattccacagagcaaaggcatagttcaggaacaagtgtaagagcagacagcagtcctgtgtagcaggggtacaatgagaaaggctgatactgtgggtggtggaggggtgagtggggtgagttggctgggaatatattgtgaaagacaaggagttagtgcacagggatcttggtgtcatatctcttagaaagataattctgaaatcaaaggggaaggtttctgggaagggtaaggaaagggaaggggtacctgtgggtgcacatgtgtgtaagacattatatttccttctgtgaagtggcattacagcaacttcactaactgggtataggtaattaaaggtttgacaataattaactttgcatagtgcttaaatggaattattattgaagtacaatgtatgtaatcctcttgaaagaaagaaaaacaacttcattattttcctcttcttatgaaagtaatacatgttaatttcaaagtaagtgcatgataaaattgaattttaaaagttggcaaaaatgaatcacaatcacaccaccagagaaaaacatcatatatgactcttcaaattggtgtcaattctactaccatgaaccagacactgaataagattgaggatggatatagcaatgtggacaactggagacaagctcattttaagcagaagtgagtaaaattgtgatctcgctttgtaaagtgaaacttgccaaagaagacatttattgctacattatgttaattagacattttataaattatttataattatcacaaaaatatgctaaagactatgaggaacacagttggaaattgtttgatattttgcaatacacatttctttagcaattcctttatgtctttgaagcaaaaatgaaaagcgcaagtagtgaaaatgaagaatcccttcaacctttaattaccttcaagtgaaaactcaagtgctgaggaatggtaggcttttatccactagttcatcaactctttaagaaataccaagtaggacaccagagatagagctatcagctacctatattttgttaaatataggtatggtgtctgcatgcatggaactcacaattttgtagtttagcaagatattctttctccctccactcctgaatagaaatttcacccatttttcaaggtctggctccatttccacatttccatggtgcactcttgcactgtcctgaccccttcaggcttatcctttctctgacattccataattcctagaaatactgctgctaagatcattcaatctgatcatatgttaccaggaactatactctattaaatgtataaaaatctcttttcctcaactagattaaaaaaatccttgaagacaaagactatgcttattacttaaggttaggggcagatttttgtgagcatctgataatactgacagatacatttaggaaatttttgataaagcatttgattatgactgaaaaatgtattcactgaaagtctaattcttgaccatactaaaagtatgccaataaaatcatctgccagcattgtcttaagggttgaacgacttacaatatgggtgcagataaagggcacttggtgagaatttcctaatggaatctcatgaggcactcttcatttcatttgttattttaaaggtaaattattctttatttcctaaaactgttgtacaatttaaatgtctctaaacaataattcaatcactttttcattgaaaactgcagttaaattaaggctcagttacacgtaaagtttggataggagaggaaagaaatctgattgcttgatgttgccattaccacatttccaactaatttaaagctgcaacagattagtatacagttaggctattaaaacagagaagtcattctgtgaatccaatctgtactttggcattttgtaaaaagcttgttgttatctgcaggtttctttacaagcactttaaaaatcaatttgtatgatttataggacatgctttgaacaagcatcttgataaactacagcatagtaaccaaattaaacatattgcttaaaggaaaccaagatgtaaggaagctccagtagaaagatgaagatctacattgatagaacagggacatgtttgtccttttatgtaaactttaaagcttgaagtcattctgttcaaggttatttgaacacttgatcactatcgagagcttctaattgcttatctatgattctaaccatcttatcgtctgcagaattgtttgagatgagatttttcagaaacaggaaaatggggacatttatgttgcaatgtcaggcgatggtgaaggacatacagtttgagactgaaaaaaacagctattaagaaaatggaagattccgatgaaaaagttcttactctatatgaagtagaacttgttattcaaatggtaccagcatatatcttttaattttcagctttataatggatacttattttttttttgagatggagtcttgctctgtcacccaggccagagtgcagtgccacggtctcggctcactgcaagctccacctcccgggttcatgccgttctcctgcctcagcctcctgagtagctgggactacaggtgccagctaccacatctggctatttttttgtatttttagtagagacagggtttcaccgtgttagccaggatggtctcgatctcctgacctcctgatccgcccgtctcagcctcccaaagtgctgggattacaggcttaagccaccgcacacggcctatgatggataatttttaaagcatttgtccctactgaaatacaagtctactaatatttagcaaatagaaagacttttcaaaactatctgagaagagaatatttccttggtgttgtcatcatccatctgtgaccatcacaaatctcctctttcccactctctggccatatctggcctaggccacataggaaaaaacatttattaaaaattttgaataaattaatttcaaattctaattctaaagccaggcacaactgaaagtaacatgtcaaaacatgcatggaagaaaatattttctttattcatgggcagaccatgtgattggccaccattaatggtaagatctaagctgtcacaggcaagacacaaacctcagtcttccaaacaacaatagacccatcgatgctaacaaatcatcacttgaaaaggagctcctaatactcatatgcacagagactcttccttgatgacatcttatactctcatgttcagctgtttaatactcctctttgctagccatatggaccaaaagcaatgcgcttcatttcttgaagacagtagccattttcctcttctttttttaataacaagatctgacccataattgtgtgcttacattaagtacgtttcatttccaaaggagcaacctatatatgaattttctaagaaatcaaccatacaataagtaacatcccagttgtctcattgagcctcattttaaacacggaaacagatgtttaaataaaccaaaaagcagggcatggctaatccaatttaggatatctcatcaagtttaagttggctaatctaatttacatgatctcactgagtctcatggtttacagtgatttatttcaaacaagggatattgtaggagtaaaggcaaaaaaaatgtcaatcaagcacccccaaaagccatgttagtgttaatgagaattaagttaatgccatgaggagagaatatggtctactggtctatttctgcagatgaaatctctcccttttgcttcttaagtcttaactgtttttacagtatccattggtgaccgaaagtgtgtaccacataagaatataaatgaaataaagctgatgctggttgctatttatttgaattcatattttcataggcctttctaactgcttgatattttcctggaagattagaggtaacaaagccacggttcacgttctttggacatgaaccatcaatttttcactataggtaggtttacaaaacaccaatgatggtgactctagttaataaaaattattagtaatgagggtacagatccacacagagacatatcagaacattattagtttgagttctgactgaccttcaggttgatattgtgctataatcgtcactgtctgtccagccccctttagtgcagcagctgcctgctcgtgggatgcaccacggaggtcaatgccattcacctgaaagagaggaagccagagaatcttggtatttcataaggcatattatcctgatagaagaaaaaagtttcccaaaaccaggctgtctaacattatatcacatgcctcagaaacccctcatatcctactcaggtgtttgtggactttcatgatcttaatcacttttagttaggagagacattaaatttcaccttgtggtgtttgtgccatggtctgaccgggttggaaacatttttatctattcatgttctagtgtatgcatttaatatgcctctgtgagcttcctagatttctagggtaaatagggataaatatgagccttcaaaattagagggaaaacaggatgataaagagagacacatgtaatgtaaatagacaaatatatgctaaaagattaaaacattcagatgagattctggggacatggtataaaatggggccagatggttgccaaatccctctctgtggtcaattgtctagccttgtcatcctgagcctggttagacagccttaagccttgttttttttttgtttttttttttttttttagacagagtctcgctctttcgcccaggctggagtgcagtgacgcgatctctgctcactgcaagctccgcctcccgggttcacaccattctcctgcctcagcctcccaagtagctgggattacaggtgcccgccaccacgcccggctaattttttatattttcagtagagacggggtttcaccgtgttagccaggatggtctcgatctcctgacctcgtgatccgcctgcctcggcctcccaaagtgctgggattacaggcgtgagccaccgcgcccggccgccttgttttaaaatatatacttgactgtcctatttctcatatacaattctagaataaattctgacaaaatgaaataaagagtgcctggagtttatttagctattgctaactcccattttgggtcccatactgaaagagaaacagaaatgtcttaaaagctccaaactctgccagggtgaaaggcattcttaactcaaatttaataagaagaaaatgctaaaatttttcttgaatcagttcagcctaagtcaatataatgtaattaataagtgctctccaatgacagagttctctgtctgccccagaagagggacaatgagtggagcacaaagggagacaagataagccctcaagaagtttttctgatgaacacacagtaagtatgggtttctaacctacaaaaaactaactttttgcagatgatagcagaattctgcttccttttattcatggggcaggttgatatgggctatgaaagaagaataaagaactgattagcttatacacgttcaaaatgtataatcgtattttgcttttcatcaatcctatttgagaatgacattgggtggcagatggggggttactactttgtttccccatcaggcctgggacatccatacgcttaaattccacatcatgatcctctcataataacttcgttaacatctccttattctcttttgtaattttccttgcctcatccctggctttctagtgtggtgaactccttacagaaagcattgattacatggtaacattggggagtccactgagctaggcctgatctggctgtgccactctcttgctgactgtcatactacctgagactcaattttctcctccctcggagggaagagactgttaggctatatgaatctaaagcccccttaaagtataaaattccagatctattcttgagttattcttgctagatatagtcatttcagagactgtctaggctattgatgagttagaagtatgaatctgctggccagaagagacaggaaaggtaattagatccaggctactgcctacaggaggctgaattgcacaaacttcacatgccaaataatttattctcttgtcaaacagttaaggtttactttttataaaagaataaaatgtgatcatggcaaataaattctgtttcagaaaggtctaaaaggaagaggtaaaagtcccctcaccatctccatttccagtggaaccacttttatggatacttttttcttttaggatcatctaatatttctttaatcataattctagttccataggttttcatgttatggcaatttgtacctgagtttaatgacagaaaaggcaacaatttctaaattggtggtaaacatttctttacaattttttaatgtaaggccatttattataataggcaaactataagatgaaaatgaaggcaacagatgaaacgaaggcaacagaaaagctcaacttctcacaaccaataaaattagcacaacctaagaaataatttagaaaaaagtgttgttagaagatatgttgtagatctccattccattacccaagagtatgccaattcatgattctaaataaatctttttaaagtaatagattaaaaattcatcttcagtgtatacgtaaattctgtgttttatcacacgggtatgtttattcaacactatcttttgaaaatgggccatttaaaaagacatagcaatttccattctgtttaatgcataaaaatcacagtggatagcagcaaaggacagggcggggcgggagggggggcagcattgaggagaatttgataattcacattgtgattattctgcacattgaggaaaggtaattcacacttctaaaacctcaagacttccctttttaaataaccaaaataaacccaagacaccttgctgacacttccccacccctaaacaaactgatgactttttttttttttttgagacgaagtctcgctctgttgcccagcctggagtgcagtggcatgatctcagctcactgcagcctccgcctcctgggttcaagcaattctcctgcctcagcctcctgagtagctgggactacaggcacgtgccaccacgcccagctattttttgtatttttagcagagatggggtttcaccatgttggccaggatggtctcaatcttttgacctcgtgatctgcctgcctcggccttccaacgtgctgggattacaggcgtgagccaccactgatgactcttttatacataaaagtgaaatagttatggcagcaaaagattttgatggcaatgaaagtttgtaaactgtgtttcaatctctttttcttattcccaaagtgcaagatgcagggttctcagtctttcagtagtgcttctcctgtaaataatccttcattttgtttggcaaaggcagtttctgaattaagtctattctggtatactgacataaaacaaaatgacacaggtactgcaacgagtgtacctgcatgaaccgagacactggcttggccagtctgacaaggtaagttgcagatccaggcagctgagaccttgaataacaaaaagttccattttcagagtccctgactgaatgctcaattagatcaactatggatgtatgcccttccacatttggctgttcataaaagctaaacctaccatttgagtgcccaagtctagtgtgaactgttttaccatgggagcgaaagctcaagcttaaaaggtaacagtcttcagaactgtcccaatcaaggaaagaaccatctggcaggactgctagcttcccttctgcctcccaacatgtgattggtccccagtaccatccttgttttgcaagatctttttagctcctctgtaaggcttgtcactaccatgggaccactactttgcactgagacataaactcttgcaacaccaggagcagagttaaaatcaaaattcaaatgacagagcatactttcagccatgtgggcttctgtgccagtaagtccactgaagttcctttggatttgattattttgcattggaggtagcaatggtgagagtggagggacatgatgcggacccactctggggctctgcaacatgactcccgtggtgccagtcaacaacccattcatggactgatccacaaagatctctggggcaacaactaggttctggtctgcctgactctcatcttcggggaaagagcgccctcccacttgagaaggaaccacagagacttccatggtagaagaactgtccagacaatagctacttgatccttccaaaggacacatcccctcatctaaaggcacagtatactgaatgtagtcctgaggcagaagtccaataacgacaggcacatgttcatccaggcgaagatacaggtctccgttctgagaagccgagcttttcagtgaattggcttgttcctggcacgcggtctcagactgaaggtcgtggaaatcctttcggacgccattcaggggtggactcggactggaagagtggccttgactctcacctccatcttgatgcacgtctcctcagagtttgtgggtcgaagaggccatggcatgggactgcagtgatggctgcggagggaggtggccttatcggcctctgagctctcacggctttaaagactatcggtgctgaggaggaggagaaggtgtcctcatcggcagagctcccagagggtttgcccgccttgccttttggcttctgtttggcagaaagctgcctttttaacgtatccatcaagcttttgctttttgatctgtcttttttttcttttccacctttttcgtctttcctgttgatatcgcagttggccatatctttaccatagcagctaccaaattaggaattatctttccaaagtcactggctagcgatggttgttgtactaccatgaaatcagtttattttttacttttattcaagttaaaggatttccagaaggttttaaaactgattttcttcattatgactagttacctaatccaacggatgaaaatactaggggattcacttctggcatgatggaatgagatggtcagccgggcgcggtggctcacgcctgtaatccgaacactttgggagttcgaggtgggcagatcgcttgagcccaggagctcaagaccagcttgggcaacatagggaagagcccgtctccgaaggtggccgggctacgcttcctctcccaggaccggcgtgactgctgcgctcgcctttcctccagcaagtccttctcccgcctccttcctcctcctccagcttgtgtgtactttttaaagattcactatatgcacatgcaagcacatgactttatttctcttgctctccttacatacatattttaatatattattgcctttttatttaactgaatagatcataacatatataatttgacagcttttgttttgcttttcattgagcaatgtatcttggacatctttcattatcatatcagctcatatcattctacctttttaatgaaagcccagtattccatgttatggatgtcccagcacttttcagtgagatccctcttgatgttgttaaggttgtttccagtttttctgctactatgaacacttataaaagtgtttctgaaggataagttccctggaaagacttcttggtgaaagggtatatgcattacttgtttttttttaatttgctattgcacattttcaaaatgattatttattcattaaacatataggaactaataaataagaaaacaaaaacaggccataattgaattgcccagatagtgtactgatatgaaaaataaaattaatatacccacatcatatccatatatcataagtaaggcacaatgaaaagacatacaattaaaaggctcccttacctcctattattctctacaaaggtaatcatgtgaatggtttcttgtatatactactaattatttttgttgtgaatataagccactttataaaatatataatttaaaattttatacaaataagatcatgttctacaccttgattttttccacttactaatataccttagtcagctttctaatttacatatttcttccgattaatctcattctttttaatagctatgagtgttctattattcaatgaaaaacaatttgttttaccagtgcatggctgatagacagctaggtagcttcattattttgttattataaacaatgaggtaataaatatcatctaacagtaagttgttgagtaaaggatatgaatgtcaaattttgataggtatcgccagactgcctctaaaagtgtagtattaatttatatgccaacaaataatatacgattttcaacttcctcacactcttgtaatagttacatatacctcgacatttgactttttccattctgataggtaaacaattttatttttaaattttgtgtttcttcaattataaggttaagcatcttcttatatgtttattggatatttgaatttatttttacataaaatccctttttatttattttgctttttttgttgttgttgtttaggcagtttgctctttcaaaaaattatctgcaaatgaagaatgttattgttccttcttaggtaactattacaaatattcttagtttgttatttgtactgttgtattttaacttttctttcgtacattatttcatatcatagatagagtgaatttttaaacatttagtgaagtcttatttaatttccttttcttttttggctcttaagttttagattatattttctcttcaccaatctatttaacaaattacccatgttttcctgtagcaaactatagtttaatctttagccatttaatccttaatcaattggaatatactttaatgtttgatgtgagaaccaagtgaacagccacaatttcttggacgtttcctttacagcataagatttctacatgtttcatcattctagtcatcctctgaattttttttcagtgcattaagaaaactgcatggaaaaatgggaaggaacaaaggatttgcagttagacaaaacgggttaaatctcaagtctacctaggtttcctaggtaacctggggaagtcacttaacttctttgaaccttagcttccttttctataaaatgagtatacctacctacctacctacctatcagggctgttgcaggtataaacaggcattcagcaaatagtatctattattattgttttagcatttcttcaaagagctgtgattataagtgatgaaataaaatctaatagaaattaaccaacacagagtgcaatatattagttacttcatgctttttttaaaaagaggaacacaacattttaggagtagaagagccttagaaacttgtttgtctagcacttatacattagagatgaaccccgtaaaggaagggactggcccaaagtcatactgaagttagcatagggataggaccagccaagcgctcctcttgccaagcccagagttctttctagtttagcagatgtgctctaatatgtgagtttgtttctttttcactggaccaataataaaatcttgttcattttaggcccaaatctacatgggcctctgcatttttggagaggtttgttgctgctgttatcctgaaaaatatcatattgcccttgttcctgttgatttcttccctggttttagcaaacatgttcttctccagtctttcaaacttttcaagatcactttgattcttatttctatccctgaggtttgagtttttatcagtaaaccttgaacaaataacattttcaagtattcacagtttacatcattgatatgacattttaaaataccaagtgtgacacagcctcatatatttactattggttttttttttttttttttttttttttgcttcagtttgaactttttcacctggatgcatggattctgagagttctatttagagtcctctcctctccaagaaaaattcttttcttgaagcatacattctcaaagattggatgccattaattattgttgagattaataataataattgttaacattaattgagcatcaggtatgtacatcagagatagttatatattatttcatttaatcctcaggagggtgggattatttttcccattttactgataagaaaactaggctcagagactcactgacttactcaaatttatatggtggaaagaggctaaggatctaaaataatgtaactaatactcctgagttcctaactaccaatttacactgtaatttaatatcctgtctaattccgagggtctacgcctacaagattctagttctgaaacctgtctttcaagggcataagtcaagctccctgagactggcagcagatgattgggtgtgttttgccactctgctctgtggtggtccaaaagcaacctgatctagaaattatggcccaacttataatgattagatcatgtagggctaaagcaaaaggcattgtcaagctagaacaatttcatttattgctacctctttatgtatatgacttttattggatcattaaaatatttatattccggccaggcgcggtgctcacgcctgtaatcccagcactttgggaggccgaggtgggcagatcataaggtcaggagattgagaccatcctggctaacatggcgaaaccccgtctctactaaaaatacaaaaaaaaattagccaggtgtggtggcagtcacctgtagtcccagctacttgggaggctgaggcaggagaatggcgtgaacatgggaggcagagcttgcagtgagctgagatcgtgccactgcactccagcctgggggacagagtgagactctttataagaaaaaaaatatctatatctatatctatatctatatatctatatctatatctatctatttgggtaagttccttaatcatacacatatatattccatatgttttggcatccttttcacaataatattggtaatgaatagaaatttgagcacttttagttgacttctagttgtgttgctgctgctgtttttcacatcttaatgtgaagatgagtggtttaccattcccaaggtcaaattttttttctttttgtttttaagagatgatcattatatttgctacttctcccactaggggcatttattccttgaataaatgatgattctctggaaatatttgtctatttcttagtgctatagaatgaatgatatcagaatcagaggatttcaaaaatggaggaagtcttgtgatcttcttcaaccccaatttatatcattaggctgattcaaacacattcttatacccttgtccctcaccatgttgaccttttaaaatttctctgattcagccatttctgcatttatgcacatgctattttccatatctagaacatagcttctcactctttcctcatctggaaaacttcttctagttcttaaagactcaattcaaactgagttgtgtaatgtatctatttataagctccttaaaagtcagatctctgcttattggaacttgtgttcctggcatagggtcaggcaaataataggtgcaaaagaataaaagaggattgtgagtgaataagtgagtggatgagtgaataatattttctcactgcattatcctaggcaaatgatcatctaacctccatgtgacactggatcaacactaatgaagaactcactgcctttcaggaaaatccattctgtttgggtcagctccagtgattaaaacaaacaaatgaaaaaaaccaaaacagttctttgtgttgaatctttctttccacctcttggcttcagttctgccctctgatggctcacaaaacaatatcatttcttcttctatatgatcctaatatttgaacacatttttcacttttccagggagtgatcccactcccttccgcatcccttcatatcattctcaccaagtgaccatttgcttgtgcttgcatacctcctgtgtcagggaattctccttccctagtttctaaattctattttttgttatctcttatgggtgttatttccagcatcttgatataatgtaatatctcattagagactcagataagtgattgtgagatcaaatatggcaatatggatgcttaccctatggttcactgtactatcttttaatgtgtgcctaccgtagtgcctagagataaacacagtattgaaatatatttgttttttaaaaagtatccacttagttatttcactttccagtttaagggaagaatgaactagagtgacacatagccattgtcaagcaatgtgctgttcattgcaggacagtgacagctaaacacatgattaaatgctgggcggtaagtgctagcacaaaaaaagtcagaattctgtggcgtacagaggaggcattcctaccaagggatgaggaggaatgagctttcctggagaaagtgacattgagatgaggtcatgaatgttagcaaggtgaggatgggtggaggttctcacagagggggagattggggtgaggagaccagtggcaagagtattcaaggcagaaagggaggcacatatggagggctggaggtgagagagggcctgcacatctgaagaacaggaagcagttgttactgaagggtagatacgggaggaacaaatgtgagaaagaagtgatgaaggaaaagaagaagaagaagaagaagaagaagatgatgatgatggtgatgatggtagctgacatgtacataacacttaatatgtgccaggcactgttataagcatttgatatacagaaattcccttagccctcataacaactgtgtgaagtaagaacacacaacaatccccattttacagaggtggtaactgaggcacagattaagtaacttgtccgagggtacattgctaacatatgacaaagtcaggaatgaaacccaggcagtgtggtttaagtgtctgcattctttttttttttgttttgtttttgtttttgttttttgagacaaaatctctctcttttctcccagactggagtgcagtggtgctatctcgctcactgcaagcttcgccttctgggttcatgccattctcctgcctcagcctcccgagtagctgggactacaggcactcgccaccatgcccagctaattttatgtatttttagtagagatggggtttcactgtattagccaggatggtctcgatctcctgaccttgtgatccgcccgcctcggcctcccaaagtgctgggaatacaggcgtgagccactgcacccggccgcgtttgcattcttaaccatgacatagcctctcaaggatctggtgatccagggcatgataagccattttagtatatttgaccataatgaggagtcattcctcagcttaaaattgagaaatattattttaacgtcattcttgtgccccaggagtgcttacaggtagagagaatgcacaggaagggaatatgcaggaagcatgtgcttatggccagcctggctacaggactctgaggttggatggacccccttggagatgctgcttagaaggcagagcaaatgctcatggctgccaaggttttccaccacagctcatgtcatctgcctgctctgaaagcagtgtcctgggaagaatactgggtttagacccgggaaggccaggattcaaatcttggtcccttcccttaccagctctatgactttgggtaagttccttaatctctttgaacttgtttcctcatatgcatcaaaagatgtgaacccttcttttgttaggctgttatcaggattattagagtttaagcaaataaaatgcttaaaataatatttggtacatggtaggtacttactaaatagttgctatgtgtattatagcatatccattatctatgtgaccaggacttttaactggcttttattagcaataataaaaccaaagaatatgtttggtagaagactatcttaggataaaagtaggtaagaactacaaatttaacagaattattaactgtgaaaaaaatacaaaggagtaaccaaatgggaaaaggctagataattggcaccacatttcaattaaaatgagacaggtacagaacacaggggactgtttcaagccaataatttcacagttgggggtctgggtgcaaggtggcagggggcagcagggaagaaattggtgtaggatccaaactatctctactttattcagagagaccatggataggaagatgaacagatgtattacagtgtattaaatacatgtagaaggctcccgttctttttcaagagggaaaaaaatctattttcatttttcctgaagtgatgagatgcaacgaagtgaaaatgtaagttctgttgccaactctgccatcaacttattcaagccagctaaggagctgctctgaaaaatgaaggtgctgggccacaccatctctagggtcccctgtgttgtaaatttaattatttctatggcttaaaaataacatctcaaaagtatttcacagttagtaaactgcttccccacctcacatttgttactgaacaaggtgatacataaactaacaaatagaataaacaaattcacatgtattaaatgatcttaccacatacttatgtgggtaacagggaaactacagatatcacattcaatgttgaattgtgagcagtctgatggctggcatagaacatagatagggagaaagaaaaaatgctgccagcagaagtagaccttgaatgccagggcaagaagttttgtcaataagtggctatggaagggttttacagaagcatttaacacaattggacctgtgtttatgggagaacaactctggcaacagtgagaaactggggttaatgaattaagtgaggacagggtaggaagtatcccagtagataatcggatgtgatactattgaagtgttaccaatgatacaaataattaaggcccaaattaggcaaatgagggtggatttgagggtgggagatgtggcacaaatttgagagaggaaaacagaggaagattctatgcagctattctcctcaaatacttctggaagccaaacagagtttaaataatatttactgtgttgagcagattgaaaatgggaaatggggaaggtgtcaaaaagctttaggatgattggaggtgtgatgataccattaatcaagacaggaacacaggatggagagtgggtttgggtgggaggataatgtattttgttttagacatgttgactttgctatgtctgttggatatctacagttttgcagacagttagaaaatatctacctgaagcttagagaagtggccaatgttcaaaatcattttagatttcatattcctgtggtcagtaccctggtcaaattagacacagatgtagaagaagcttgatatacaagatggggataataagagtaccacatcacagagttgctgtaaggttagattagttaatacatgtaaagcatttagaacagtgcctggcatctagtaagggcatataattattagctattgttgaaccctctcctgacgtacacaaagaggatgacttgggagagtataaaattatctcaatgcaggctcatttgaccagggaaaagtgctagggttgaaggcactgaaacagaaaagcacaatcctaggagtcaggagtgctgagttccagtcatgctgttagcttatttgactttgagaagccccttcatctctctgggcctcagtttctttatctagaaagagagcctcatactaaatcacagaggtaccgtctaatgcttaataaacaaatatattctatgctcaaaatgtattttgttgacaacttgagacaaacagatcattatgcattaaatttttcaaataccctccagcatgtttcagagtgagtgaactataaattgtatttgaagtggaaatttctaattaagttcccttcccctcctggaggctgttatactttgtggagagtggtaatatttctgacagtatatgcattacagctcaagactagaatccttctggagcagaggcaaagtgaaaaattgatattgaatatttatgtatcttagcagttaaacattaacttccctttaaatttggattcctgatgcaaaaacaggcttatagttaaaaaaaattagacctttaaaaatgttttggattaccaggtcatttctagagggatgattattttggaatctttaaatgaaaataataaagtataacttggctgtccaaacccagcttattaaaggctgaaagacagtaagatctagaattcatgcatttcaagtaaaaagttaactatctttataagaatatataagcaaaaaatagttgaaaccttatacaaatattatacaaacacaagctgatactagtatctccaagctctgatttttacattaactccagacttgaaatctatctgcttacttgacatctgcagatagatgtgtaagacttttcaaactcatcgtgctcaaaatcaaactcaaaatttctcccaaacatgtttctcgagagttttctcattttcagcaaacagtactaccaccattctcctctcaaaccactgaatcaagaacctccattcatttcttaccctcccacctccccatgcaatcccttagttcatagccatattctaattccatgcattttctctaactccaccccatccctctaggccaagctatcattttccctgggaatactacagtagcctcgatgggtccctccattgtctctgtggcccactcctcccaccctcctctatccccttttgactcggcagccagaatgatctcaaactctgtatcagatcatgcctctcctctgctaaaatctttcttttggctccttgttagactttgaatgaaattcaaactcctttcctcgggctctgcctatccctcttattccatcttattccactctgtcttctttactgtttgctggccacaagggccttcattctgttttgcatcagtccaagtttcctccagtcttacagcatttatgccagtggtccctttgactggagtgctcttacctagcttttctcatctttgacaacttattttcataagctcaaatgccaattcctcaaagagctctttgctgacaatcacattgaaagtagcctcccagcctatctctaattcatctggttttactttcttacagaatttaggcccacatgttattctgtttattatctcacccaccccgagaaaagcttcccataagtagagaccttgagtgtctcttttaactccatacttttagtgctgactacactatgtagatattcaacaatattccttaaactaatgaatggttataactattaaatcacataactttatttaaatcattaaaatttatttgacaaccagttactgtgcacttgttataagccaggtactaattagagtccttttcagaaggcatttgtcctctagggggagaatggttgatgaaactgaactcactgaatcagcatctttgagggtgaggcccaagactttttttttttctttttttgagacagggtcttactctgttgctcaggctagatagcagtgacatgacatgcaccattatgcctcgctaattaaaaaaaaaattgtagagcaaccaatatgttccttgaagcaccaatatgtcttaaatgtccttgcaaacattgttaaacaaccacctccacttcatccaagcctctaaattgttcaggcagtgtcagactctgggctgaaggctaaattcctacccttcaagatctgctttgtggcttctcaactcacccaccaaatgttctatcctgagatgagatgtgtgtgtgctgctaggctgacagattccctttggttagggttaaatttgaagctgagatcctttctctggtggatggtggtaagaaaaaagccttctgaatttgctcaacatgttctcccttttgaaatcagtggactaactgaaagtgctctattattctttatttaaacttagtttttttgtgatttctgggtttcaggtattaaaatatcactatttaatctactgttaaaacactatcaataataaattgattaaatagataatgaactattcatataatggaatactatgcagtcattaaaagcaacagcatacatgtctaatattttgaaactaaaaaaaagtcattatctattgctaaattaaagaaaagcaagctgtagaactatatgtgtatctagtttgtttgtttcaaaaaaagaaaaggatgaatgatcttatagagaatgcctgcaaggttacacagtgaattgataacagaggctttaaggggctatggtattgtggtggggaggggagaaatgctgaagaggagagaatgggttacatttcattttatagcccttaacagtatgtgaatatttttaagtaaatatgttgtatcataacaattttaaaagtcatacaaaaaagttttaactactgaatttgaggtttgtgttaccttagcaataaaaggcaaaaggggttatgtaggcaaatttaaaatatgataatatttatagaaaacatgagtcctagggtaatcaaattttcaaacattgcattaatccattcaatacatatttactgaatgccttctttgtgccagtcattgtgctatttttgggggatggattggtgaagaaagcaatggttcagccctaagtgacttagaatctaacagtagttctcaactgggtatgaaaaggtgtctatttgtgaggggggatggtattttctgttgttaaaatgtccaagtcaggagtcagcattggcattaattgtagaaggctcatgtgtgttaaatgttttgcaaaccgtggcacaatcaggcatagtgaaaaaatgtccttccaaaggtgcaataacacctgcaaaaggaaatactgaatcaataccatttttcacataaatgccctaattcccagtgaaccttattattttgttcaaacaagttcagttggctaagttctgggtcaaagttattaactaggaatttgtctaaatagtatacagatttgaaagcaataaggatgttcatttctacatatcctataatattcactaatttggtttagtttacataaactaatctgagtgagattgtaatgtaagtgaaaagggttcttgtttccttttttcctcatacacaattaatcttgttcataagctttggaatcaattttaaaggaaggaataatgctgcctccagagacatatctgtcaaacagtccactcctaaaacatctgaaaggcttgagcaggaataatatattaatggaattaatcttggtcaaaatctgttaatgcaaaactcaaactctggctgctgcatgtgggactcatctgatgtttttttcatcgtagttcctcaagttgatgacattcttttgtgtttgggcttatgtgtatcttggcatctggctgttgcccataattacatcttagtatttctttgacttattcctcatctaaaaataaggtaatcatctcattgcctaaaagctcccaagaaacaggttttgtgagtttaggcaaactgtgtcaagaactcttaagtcccctcttcccaattactttcatcaaatcttcccaattgcaatcagtcaaatctttttgggaagtcaaaatcttcccaactgcaatcagtcaaatcaagaggaggagatctgaataaacagagatgcatgaaaatcaacttgtattcaccactatgaatgagaaataatatttattaaactatttctcttcaaaatatctgttgcttttgttttttcctttctaatttactatgctagttctaagcattgatctgaactattgaaacaggccctgtttcctgtttattttgaaaaatttcaaattatagaaaacttgaagaacattataataaaaactcataaagattcaacagttcttaacattttggtacatttgttctccctctcttcctccttctcactctctccacttacctacctatctgcctagcagaagacacacacacacacacacacacacacacagacacacactttttctgaaccatttgaattatgttgcagacgtcattccactttcaatctaacatatcagcaaggcatcttcccagtgtaaagacattttctgtataaccacaatgccattattactccagagaaagcaaacaaaactaatatttctataacatttaatatattgcacctattcaaatttcctccgttatcctccaaatgtcttttacagatttttttcttaaatccaggatttaagttttatgcattgcatttggttgttactatgtctttagtcattattagtcttgaacattacctacatttttctttaaataaaatttactctttttttaaaaataatttcagtcagatgcttatagagtgttctgcattttgaatttgtctgattgtttcttcagaatcaggtgaaacatttttagcaaaatccagtgtgtaatgaatgctgtgtatttcttactgcgtcatagcaggaagctcaaaatacatggaccaccagatctcttcatttaaaaggcacctttctattttgcaaataacaatctataaggtggtttatttgagaccatgtaaatatcctttttccagtcaactttaacccctaattgttttagcatctatggattatgctttcttgaaatagttattttgtagcgggttaaaaaatggttattttataaattctttatttattctagaattattagctggtattattttgtgcaggagagcttctcccatatatatatataatttttctctatcattctggatttatttttgatatatcatgacataattttttatatatcatattagaatgtttttgatatataatattgttctttttgatatatcatatatttggttttttgatatagcatgatattatatctcattaccatgtggtagacttctaattgatgttagcttttcctctaatctctgtctctctcccatcctccctctcccttttgtctactctcaataccttgatagtcatcttgtatatcacaaccactctacttttctttaaatactgcctttcacattttatacatgccacagatgctcatattcatctgtgttcctaactgcttgtaaattatgtgcaaatttcttagccctatatttaagccctttcacaatgcagcttttaccacaaccctctctagtctttttaagaccagatacttctctgatatgagggaacgttagagtggattctgtctagtcctcccatatcattggtggaaaaagtgaggcacagagaatgaagttattttccaaggtcactcagtgtatttgtagtagagtccagatgagaatgctagagttcaatgtcctacattacacgcctcctctcctaagcaaaccctctgctgctgctagaagcttcatgtccatccctagcctaatgttattcccttgggcctaacttcctcctccttgttttacttcctgttttcctggattctttgaagtcttggccttctcccttgtccaggtcaggttctatcttcccagacctcctgtaatcatgatggtccgtgacacttacttggccatcagccccacaacctggcagcattacatgaattttggtccttctttactcttttattattatttttcaggtgagcagtaatgcaagctcattttaaacaactaaaacaatacaaaaaaacagcaagtaaactgtgaacatctttctatcttaaccttcaggtaaccactgataataaactagacaaattaactctatacactttctctacacatatttacatatccccagctacattcccaatgtctaggatagtgcctggttcctgtcagtgagtgaatatatgtgagtggaaaaacattcatgtttacctccatatatagtcattgttttaaagaatgatcccataataacacacgatgttctgtgatttgctttctttttctatttacctttttaatgaataaatatcaataactagactgtaagccccacgagggcagtcccagccactgtttcaggcttcttgttttcccaggatgtggcacaaatcgatgtcctcatacattattactgagggtgactacagctttacgtgcttgatgaatctcttcctcaactctgaagaagccttaaggttcacaaagactcctgttcctctaaagaggaattattaatcagctcaccaaggatttcatggccaatttcagtgtctaatagtgaaaacgatgtaaactagaaaagaaagtataagcgaggagaataatatagcagacaagcaggaccctagaaggtggcaaccaactttgccaccttgaaaggcataattctctatactggagctgccatcttgaatgtggacttttgtgggaagtattaggcagaccacataaatacagccttaactccaagcattactgatttcaaaaaatgcttctagacatttgggaaaactagaagcagcaacagaatcatttcaaaactctcctgaaaagacaaactccatacaataaggagtgagaaagagtgaccatcgtctggaatcatctctccttcatcactttcctttgttctctgaagcatatatcaagacttcataaaagcagtcaaggctgtgctgaatctttcactatcagtcccaagtggatattataagcatcagaaaaattttccatttacacaggcagggaggtattttcagtaatttatatcttttctaattactaaccaattctctctttccagcctcccaatttagcacatagaattgctgctccctgcagaaaacaactctccagcaaggtgtgagtttccatggttagttgccagagcttcagatgtgaacggagctgcaaagccacaatccattcagtagataaaaacatcaagaaataaagttccactgcattcgttcagttcctagcacaaagtgaatgctcagtaaataataggaaggaggggaaaagcgaatcaggagaacagaaaagaaaaggagagagggaataaagggagaagaaatcaaggcaattgactttcaaactgtttgtgaccaagaatttaactgtggaaggagatcactaataaagataatactagttactgaatactgaacaagagggtattgtgttaggcttgttattgttaatcctcccaagaactttgctgaggtcaactttaagatgggaaaactgaggcacagaaagattagatgcttcgaaagtagcagagctaacataagagatacggtctgtgtggtgcacacactgtgtcctttctcccctacttaatcttccctcttctcttataatacctgctgtctccagccttaggtctgcaggtaacactcctatctttgacagtcatcaatgttgctatgtgcttccaaatctacttctgctccccacgcatacacattcccttccccataatatcacatgccttctaacagcagcctcgtgccggtcatcacaatgggccactttgcttttccatctcagtaaacagccccctccaggcatactgtagtcttggtgtctacaggctgtttccctgtttctttagggcaagcttggtcagtgcagggaccagctttcctcaacagctctgccactttgggtattagagagcacaacaatctcccagagcattttaacgtcaaacccttttaatattcctgtggccaagttcagtgccttctcacccagctccttccttgaattatgcttcagcctatattggggccagttctgtgagaggctggctgcaggttctgatcagcggtgggctctgccacatcttgtgagaccaagaggcattaagtcagtaagcacaagggcagcagtcatccagaaggggaagaagcactggaggctgcctgaaacagaggacctggaactctcaaactccattcactgcactaacagttgccagcaacagaataaaatatatgtgactagcccttgctgttcttggcacgaggagttccatgaaacccagacatataattctgcattctttaaatcatcatcctctatcttttccctttccaagtttgcattgcatgcagtttcctgttgcattgttttctcttttgtcaaactcctaccacctggaaaagttgccatgtacactgcactgtacaccgtacaccatacactgcacactgcactgtaaaggtgtggtcccttgattctcattttttttcctctctattataccctcaccctttcctcccattctcccctgcagggtctcacctctgtgatcctctcctgatctgtctctctgcatctgtgactagattcccttcacttcttccttccttacctttcctctgcggctgggctgtgtctatttcctcctcctgcagctggtctcacttgctttttcttaccacctccctctgagtgatctgcctctactttcctgctgcatcctctcttctcttctctggttgatttatcgtgctttattgggaagacagcctatgactggctgtttaccacctaatttctggaattgtgttatccttttgaagtccaaactgatgtgctgtgaaagtctcataattagacttataaaaataaatctttctcattccaccatcaatacaactaaaacactgggttagctgtcaaatacaggcaagccagaggagcttgctcctgaaaactaaaatagcaaaattatctgtgctagcatttggaaatgctatcttaggctgtgttgcttatacataatgctctgtgactctaagtcaaggacaagcctcaagttagggtttttccatgtagggcttctggagaaactccttaggatttataggtctctggagcttcttcaaaatccacttgttcctgtctactatagagacctgctacatatcaaagaaccaagtgaatgttcaacccccttcttaacaccatcattataaactgaatgttctaaattctatatttgctcctgaactgacccttagtccttgcctagaaccagtcagtcaacaatagctcaactttgggcttttgggtatgtatgtagctcaaggtttatatcatctgcattgtaacctccatttcttacccatcctttgccaatattttcttccctcttaaaagtatgaaataagtactgaaatgtttcaatttttgtatggccctaagatacaaaatacgggttgaagaagcactaaggggaaaattcacatttggagatgtgaaaaccatgaatattatattagaagacagatgcatgcatgccatccatttgcagagaatgcatcattgctaaatattgcttctcttcaaagttatgcataatgagaaagtcaggtaaaccaggaaaaagtatggatttttggatgaataggagactaagcaaataactatgcataaaaagcataaatcactcaccaacaaattgtataaactacaatgtgttttccaggataaagtgtgtgaaggtatctgttgtatgaatacaaattcacccttcttttctttctttttcaggcttgtgagtgtttgacaatgtaaattattcttcctgagaacaagtccacctgaggattagtgaatgggtgtgattttcaaccaaaaaaacttgtatttagctgccttctttctcacacctataagttcctggctaatgttgatatttatcaaatgctgtgtgcaataaaaacaagtatttccctaaagaaagtaaattgtgctgcaattgtttatgtgtgtgtgtgtatgtatacatgtatatatgctgtgtataaaaatataaataattttggtaattattgatgagtagataataccttagcacatttatgttcctaaaggaagaaaaatccagggataggtatattttcaagaaggcttggtagatttggctctggcttgtgtcatcatttagctttggaattttgtactttagttcctttgtttattaaataaacaacaaacaaacaaatattgtacaagaggaactctggtattccattcggagttatgattctgtgattctatcttgtggttttaaaatacctacatactgtaagatgtttgattctgcaaagagctatgaacctattctgccttttcccatgcaaaagtcattcttttgtttactcatttattctagaaacatttatttgtgatttactatgtttatttatgatttacaataggttctgtgccatgtcccatggattcaaagattatttagatagcctctgttcttgaggagctcagtatatataagatgatctcctactttatagaattttttctcaaagacctaactgtagaaagtcaagctttctatgcaaataactcaatatgtacccataactccaagtcctgacgctaactggtattgtattttggagaagtggtttatcttctgtgttaaatctctgaggtagtgtaatagaagggaaagagtgtgggttttgtccagcagactcaggattggaattttgactctgtacatctattaagtgatgataggaatatctacttcaaaatggttgcagagttatattgagaactgaataaggtgatgcagatgaaaacccactcaatgaatggtagcttttgcttttactatgggaaattgaagaatacttctgctttgtttaagcacccttttcaaatcagtaaaccaataaattcattttttctggactaaattctttgaagactcttttcttagtataatctatggctgtaacctctatgcaagagtctgtattaggttgaaccacacaaaattgacaatattcaacttgacctacagaaatggcaacttcatatggttcagcctaataacattattaatatcactaaaagaaaattttaatttctactttttaatgtaaatagcatgtacaatttcaatttttttctagaagagtatttcctcactaaaaagtatgtttagtgtgtaaaattcacgacatttgctgttttgattaagaaaaataatgttaaaataaatcttcctggttctttttcccaaaatagttttaggaagtttaaatttgagttaaatgttgtgaaaattttagcctcaggaaatgtgaaaagggacattaaagtcttatgtattgttggctatcagggaaaagagtaaatctttgaccattctaaaagaacaacattggagttgtcagctaatgagctgaaagttgttctgtgatatattactgagcaaaagattagaggaaactagtataacagagagaaagagaaagagagccctattttttcccctgctgtatatgtggcagagactgaggactgggagtgtgtagaagtgtgagagaaaaatgtgggagaagtgtttaaagtgttccaaggaaactaaaatgaagacaagaatatgtatgctggggttcaggttttcaaaacaagctagcttctacctagaacttgtcatcaacaccctttactagtagcttttgaacttccatctgtctactgagctggaaacactcttcttcgtagccacatgtcatgctgccacccttgccttgggaagctcaattcaaatcctacttctcctatgaaattctccccagttacagggcattttctagaagaactgttatttcctctatccttaacactaaagcaaaatacttctatgtcttccaactctcccatcccaagtgttttatagatggtttgtggttgtgtttaacagtaatagatgggctaagaaatatatttgtccatctgatatggcctcaagactatctagtccacatttattgaacatctacaatgtgccaggggctgtgtcatgtcatgtactgaaatcaataaaaataagacttgggtttggtatgaagaagatcacagccttatgtagccatttttgagatgtataaatgaataatcctatgaagcacttatgatgtttctgaaattctttcctcataaggtttactgggaatcctataatcccaccatttgagattcactgttttggtcttaaacttagtagatatactgtgaaaatctcgatatagttagttaaaataatgctttgcctgtttcctaacattcaacctcagtgtgaactccttcatctgatttctttcactgaaggacagacaagaaagagcatgaggacactagacccctaggtaccatagagtgtgaggagggaccagaattgtgggaaatgtacttgaggtcagcttttatctggcaggagttgcacaatgttacagagttgaggagatgggatgatgaccagaaggccaatgcccattcctcttagagttgaagctcattcttagagccttgagcactgggactgttggtggcactgtcaaagaaggcaggaccacttgctttgtgtcaggcaccatgatgggtgctctataccccttggcacatttaacccccataacaatcctttgaagcaggagtcattggctccattttataaataagaagactcagtttggggaagctaagtacttgtccaaagtttgcacatctagttgatagtaaagcagggttcaagcctcttgctggttccaaagccatactttttcatcttcttaacctttgagaaataaaggaatccagttaccctcaaaaggcaggtactacttcaagggaaatacttttgaatgcaagtccatttgaggaccagcctcgtgccgtatcagaggaagacaatttcaaagtgagaacaaatttcatttccaacattttcaagagcagaaacaaagattgtttataggatcctctgagatttgataaaaaaattccatcctttgcaggaatgctttctcccaagccctctaaatgcctgcagatggtcagctggctcctgcttgagtaactacaatgcagtgacacaaggccttttcactccacccacagtgcttagcacagtgaacagacacattaagtcctcagtaacatcagaaaatggagactgagtaaggttgagtgacttgttcaagatcagttaggcgatacatggtttagtatttaaaactaaacctgttacgaactcttgcttttagatgatgcctcttttggttctaatggcattttctagggcaacacaaataagtctaccttcatttctgcagaatggtcttgcaagtgctttatcaacaaaaacaacagcagcagcagcaacaacaacaaaaataacagccaacatttatcaaatccttccaggtgcgaaatgttacactaaacaccacatgtattatcaatttctcctcataacagccctatacgtagacacagtcatcattttattgataagaaaactgaggcacagagaagttaaataaattgccgaaattcacaattacaaacaacagagtcaggatgcagactcacttttttttctttatgtgcacttttatttttacattgtagagaaagtaatgacttctaaaaagagtatgtaaatgagtataatataagcccatcagaccaaaaaaatattagaacgtatttaaaagaatcaggatttctataaaacaataaacacctagatcatacattcttttggaccaaatggcaagtgcatatacatacaaggcaagtactggcacatcagacgtatcaaaaacaccttctttgatgcaatcgcttaggaattgtaaaaaataagtatcattcagcatctggatgctaataataaaagcgatagaggctaaataaacagggccgttactctactccctttcctatttcctatttttaggaattcaagtttattcaaaaggtttatatataatcccaaaactgctatttctcttcttctataatttcagaatgatagctttacacaactttaaagcttgagcttcttctgaattcccaaagtgtttctgtgctcctttacaaatgggccacatcttcaagggtcagctttacctgtgtaaggtctgcaagaccattctctctcagatacgaggaacactgaagaatacatcattcattccatagaggcccttaattatgtggaaactgaatgcgctctcctaggattctctaaaatgctttctgttcaatctgttacagatgggccaatggcccaagaagtataacctttcattttcataatttcataagcactggcaatcacttctttgtggacattttcccccttgctctagatcttgatcaattcctttatctgagtttagatccttcagagggacaccagcaatgttcactccactccacacaggaacacttgagtccccatgctctccaaagatccacccatggcagcttccagagtggattccaagcacttgcacagtcaagaaatggaaatgggcagtgtccagattacagccatttccaataatatgggttttgaaaaatgtactcaatttctaagctacataaattaagatatccactggactggaaactatcaatttgcagcaggactatattgagtaatattagacatcattaatttaacgatggccacatttagactgactaaattaaagtgtttcacctttttcctggcatgcacctgatgtgataatcactaggttggagtttgcagagatgagataatctttgctggaagcactatctggcagttttaggaaaagactgccatgtttaagatccattgtctcacacccttcaattcaccattatcaacagctacaaaggcaacttcatccctcaagtcttttaataacatggtgattgcacgggccatgctaactgatccagttcttataatggagaccttactgtggtgaataacctcctctgaagcaaaattctcaataaattcattctggatagttaccatcacgtaaccagaggtgggaaggttggttaagggccagctgaccctgtgatgtgcgttctctgttggtgacacagatttatcctggggccaagaaaatttactcccatagtgcctacgctccagctggaccacagaactcctgcagcccaccttggggatacacacacaagaggtggatggagcagagaatggaagaaagtggtgggcaagctgcaggttgagcttgctggggcaagccgaaagaacctgtttgaatgttcagtgcctttcactttacttcagctattgcagttaccaagcaaggccatgcttagctccctgcacacaggcctcatgggggcctctggaaagtgcttctgatgtctgctcagattaaagcagtaaaaaggcttcttctttagctctgtgtgaatcctggagaatacaaacaagtattctcttcaatatctgacatggataagaggccaacccagatctctggaattactcatttcctgtttttagtaggtatgccaagtcggacccactctggctcctgagcctatagcttaagcatcactgtgtctaattccctctctttctctctccttctttgggacatttcactttgcccttcaccctctaatatatcatgtccaggaaccttaatcctattctgtggcttcttgatatctttataaaaatgcagcaactagagtggaacatatagcttagatagagtctaaccagtgtggagacagaaggatgtctccttcccacattccaggactacatttccgtaaataggctccagcctattagcctattggcagcatcatcagatggctacctaaaaccacaagatcttcttttaaggagctgttgccatatgtctccattctaaactggtacaattaattttggaacctgtattttcccagactgtctgtcttagcagagaattttgtatgcctggtaaatgtaagtagttaataagtatttataggatttgtgtcaatattttgctaccttatggctacttactagcttaatgcctctgaacctcagttttttttcactggaaaatgggaaaatagtatattccctggtagtgctacaggaggttcatatgagataatacatgcagtgtaaggtgatgttattatcacagagaatctaggtttgaattccacactagaaaggtaattataactactaaacccataatcacagaaaccacagcctacaggtcctataactatcccaaacataagattatatgcccagatttcaatcagaaaacattttacaattcctttcccccaaaggatgttcaacgtttgctttcattgccctctagtggttgctatacaaaagatataactacattttgtttgtttctcattttgatttttgagatgtcagacacaatatcttataaatattcttcaagtttggttaggttacacacattcctgtcagctggaaacctttaaataatcagcctatagggacagtacctaacattgtgtcctgcgcaatacaggtgtatactgcccatgcattgttggccatgcatttattttactagatctttactcagaatctactgacttaaaatagtaatctagcttcattcattcattatatatttataagatatattatatgtcaggtaaacaagacaagcattgtcctggcttacaatagagtaaggaaaatggagtactaaacatgtctttaaaaattaacatggtaagtgctgtcataggaagagtatgggatatacaaagcacattaagaggggtacctaacttggaggtgcttctgtgtgtttttggaaggtgaagtgggaatggcaagagaaggcatttagagaatataacaatctaagatttgaaggatgaatagaatagaagagttattcagaagaaggtggggtggggaaagttttcaggagaggatacaatgtcagatatagttacatgacagagaaaagactgacttttagagatatggctggacaagttaagagaagctatatcgaggaattgagactttatttggatggttaagttataaccaatggactctgaaaaaagtatgaatgtatgcctttaattttaatttctgattttaaaacttttattatttaaagggaagtcttaggctgggtgaggtggttcacacctgtgatcccagtgctttgagaggctgaggtgggaggactgcttgaggccaagagttgaaaaacagcctgggcaacatggtgagacccagtatcttagaaatattttaaaaattagctgtgtatggtgatgcatgttcatagtcctagctatttgagaagttgaggtgagaggattgcgtgagcccaggagctcaaaggtttagtgagctatgattgtgctactgcacaatctagcagcagtgagaccctgtctctaattaaaaaataaataaataaaataaagggaagtctttattcataactaacatacgtttagtcataactaataaaaaattaattgttcaaaaacccttcagtgcatcctttttatcacacaaagttctctcaaacacatacattcctagcatattggagctggaagggcctttaaagatcctgagtctccgtcttttcactttacagaggagtgagaagatcaggagtttgttcaggttgtcctgagtaactgaattgttgctcctgggagctatttgcttttcctagcctagcccagtgcttaaactcctcatcccgtttattcagaggccaaatagtctcctgcatctggtgtcttgttggtctgggctgttgataattcttgagcactcctgcttttcaaaacttctgcattggacttcatgttcttcctttgtggcctgatgaaaaaatcgtttatcttagacttgcagtgaggatctgggaaggtctttccattaccaaggaaaacatgaatcctcctcagaatacctggtgaggttttgccttttctatggaactcccttgcctcactgtacttttcttatagtataattcggggtggacctgcttattacttctgttagactataagcatcccaaggacatgacacatggcttagtcatcattacattccacatagcaaggtgacataaacacagaagcccctatcaagttcgttgtagacagggatgagaggatacatgaataaacagaggaatggagtggaatatcttatttcctgacaggaggtttaaatctatgttagtaagggtatgaaagctatatatattttttccttcagggaaagatggtgagccacccaaggtgaaaagagaatctctgacaagcaagcaaaaattaaggttgtactctttgtcataagaaatgactatgaatatgaacgtaaaaagacattagagaagaaaagtcaggaaaaggggaaagataaatttgggtagcataagagactgcccaaaggactttaaaaccagagatacctgacgttcatttttaagtttttacatgtttatgcaaatccactgccatctttttgaggcataagtcctgtctgctacacacaaaggagatgctaaggaacacttgcttgcctttatgttagaaacagaaacagtgtgattttttctgatgttctcaattacagagtctactgactcaggtctatatgtgcctgatgatgatcacgagccccatcaacaaagggagttcccgctcagcatggaggcagaccctccgccaaatgaaagaaaaatgtaggccaggtgtagtggctcacacctgtaatcccagcactttgggaggctgaggcaggtggatcacctgaggtcaggagttcgagaccagcctggccaacatggtgaaaccccatctctactgaaaatacaaaaactagctgggcattgtggtacatgcctgtaaccccagctaactgggaggctgaggcaggagaattgcttggacctgggaggctgaggttgcagtgatccaagatcatgccactatactccagcctgggagacagagcaagactctatctcaaaaaaaaaaaaaaaaaaaaaaagaagaaaagaaaaagaaaagaaaaagaaaagaaaaatatagtcttcattcttcttaattctatcataaatctgagagtagaataataaaagtacatgaaaaactacccatagcttagtatagtttatgttacacacaaaacctgagagatataggcaataaatgttcctggaatatgttttacagcaacattggtccatcaggaaagtttccctccaggaaagattctgaacatagagaaataacaagaaatcaaattataaggaagattaactattgaccttttcctgacccctctatttctccccttcaagcaggagaattataggtcagtccaacgttgaagaaggagtaacatttctcattttgagctttctcaagaaatcttggctatcagagctcccagctgattcctagtggtttcttatgtttaaatacaggaccctcacaataataataataataataaacaaagtcacaaatgttactttcaggtttgaattccacttgaattcattgagttatattttaaaaagctatcattatgataaccagttttaatactgtgatcaaatacaatcactagtatgaaaactgggcaaaaggccacattccactagtgtctccagttcaatgcaaaatcttttactgccatcttgtggatttttaggaaataatcccagtcactacatattatttattgtcttacgggaacaataggttcataggccagtttatgaaaataactgaaaaaaagtataagaaaagagcagctaaatagtcaggtttccatctaacattatcactttgtattctctactaagcatctctgaggcttggtttcttcataaaaagttgttattataataataccatcccctgcctgtctcaaggttgccataagaataaaaattttaaattgctccataaatcaaaagtactattcagaaacaaccaattattatcaatgctatcagccacattattagaatgacgatacctaagcatttcatatgtaacaaggtaaactatggttcaggctgaaaagtccagaccttggtacctgctttcagagtgatttgtctcatcttttatggctttcagggcaagaaaatggatgtttcaaatgaaaatattccctggagatagttgttcctggggcagaaaatactgtgggcctgacaactgaggaagggaatatttccttttttactgattcactgatgagcaagtgagccccgacatttgaaaagcacagcaaatatgtagtataggaacagctttttccagtgaaaaatgctacccctgggatcctatctactgatccatatttagttattctctggtaagttattcatccaggatttctctcttccaaccaaccgacacttaaactggaaaaccaggcaataggttggctcatagatgtcacagacaacttaaaaaagaatcttctgagaatttcagggaaaaaacttagaacaaaatctccaaaagctttcctttcccattagcgaagacttcaagttctttcatctaatttattcatcacctatgaacacctgtgtgtgcctagcactgggttaggttctgggatgcaatgatgatgcagacataacgcttatgcttactgacctccatactagctggaaagttcacatctcataactcatgatatctgctgcttcaagctctgcagttgttcagaacctgagcagagaaagggccaatgctgcccttgggaatttgaaagagagaagcagctcatgtatgagcaatttgctgttagaggacgctcatcgactctccacttatgtcagctgttgagagcggtcattgcatgtggtggagtgaatggtgtcagaagtggtgatggtgatgatgaagaagataagatgatacttggaattaagaaacttattatggattttttttagatgaatggattttaaataatgtcagcgtgagaagaataagtcatagtagttgtttctttttatcaatctgccatgcattacgaccatgttcatatcttatgtctccactaagctatcagcccctgaaggtgagaacaatgtctgatatacctctctatttcctataaacactagaataatatttgacagtcatgttttcattattgaacacttataaagtgccagatacttttcaaaactcttcgaatacagcaataaacaaaataaatcaataagagatattcaataaatcaaataattaacaaataagagtcacagccatacagccaaagtgttttccacttcttccacttaatatacatgtatatgaattgctaaataaatcaccaatttccttctctctactgaatcatttccatcaacatataaacactgttacaaaaaacaaactctaccctcaagttcccattctattgcattcctctctagagcaaactcaaaggagataactcttctccttgtcattaaaagagggaatttggatggaaaggcaggaggaacttgtcgaaagatattaagtggaggagtaacatgatcaaagttgatagaatctatggagttggtgtgaaagatgaaaaaaatactgactttgaagctgggcagacctagagtccagtccttttactacagtctggtcttaaccaaattatttaacctctcagaatctcagaactttgacctgcaagataatagtaatcaaaccatttgaagttcttactaggtaggaagcacacaatatgtctctcatcctttgtcttcaattcttctccttttattctctcaggcctaggctcctcccactagaggcttctctctgaaataatttctattgtttaagaagcacttatgatccttaagatactagacctaaaacattcctcaaatagagctcagtgagccaaataatccccgatggtcatttatcatttatctacccagtgttcagatatgcttcttatttggggacaattcaagacaggaaggaggcacagccttacccccattagagaagctggagggggcagctattcccttttcccacccctcagcagctacaacagggcaagtcaagcagatgttccagttgggaatttagcatccccacactaacgtgtaaggtgcatggagaaacagagatttttcatggcagtgtggtttggctataagtggccagtggtgacagcccagcacccttagtaggaggatttcctccttggcctctgagcctggttcctcaggcttcctgaagagcttgtagactatctgttatttctccaataaattcttttttttcatataagttacctggaactgacgtctgttgtctggagtcaagaactccaggaggtaaattcaccaatcaagctcccatcaggtatattcctagagtagttagcgttagaggtaagggagcttgtcatgaaagaaggaggcctatacctagagtcaaacaggctttgagttagaaaactgttgaacccttcagtttcttcttgaataaaacagcagcatgatcactttcctacctatcctgaaggtaccctatgaggatcaaatgagataatcacagtgagatactttatacatatatatggtaatgcaaatctaagggttattagagattagctaataaaataggttattctgaggcccaaacaaattggactaaaaatcagtccactttttgactcaaaagagatttcaggagggatgatcaagtcgatgatcactccttctttaaaacttgagaactctttgcacgatttcccctttatctgtgatcagctgttataccacagtttagatgtttacatagagaagacactttgaaacttgtataggaagtccttgctacccaaattttttggaagaagagaatatgtcataaacatattttaaatgatcatcaagtatttagcatttaatatgtaatagaatagttaattaacatttttctgatctataggaattcctcttagtcaattaggaaatgatctgtctgaattggaaatatattccattggccagaaatctaaaagctttaatgtattctgaatcttcaggacagaagggattaattggccagagcgcgagatgaataaaactgagaggggtcctaggatttccaactgccttcagagaagtgggcaaagatgagtcattcattcattcattcattcattcattcgttcattaaacatttgctcagtagctccgttctaagttaatcaacaagggagcagagatgaataaaacacagtttcatcctcaagggaagcttcaaaggatctgaacgttgcttctaagtgcctcaatcttacagccttcgtatacaatggcttcctgtggtgactcatatgtctccttttaaatgctctttttttaggcatttatgcttttttcattaactagactttgagtatggactgcctcagacataagtaaactgccaaattcaattctttggtgaaggcctgcatcgcagaaagagcatagctttgaaatcagaagcaacagtattccaaataccaccatcattactgattatctgtgtgatcttggacaaattatttaatttctctgagccttcaatccaacaaggttgttaggacaattcagtgaaatcacagcgcagtatccagcaaaatgctttgtgctgagcatatattcaataaaggttaggcattttatctccaattctctactggttttgctttctaggggccctctttgttgggaagtttcccctccagaatccttcttacttccccaggctgagctaaggatggtctcttctttacgcccatgtggtccctggaacttaccgttagcatttccatgttatattggaaataatctatttatttgtctgtctcccttcatgaggctacatgttcactgaggacacaatgatttttttcacgttgcatccttagtgtctagtagcttttggtactttgtgaatgtctctgagctctgcaaacaagattttaaggtgaaaatttacttccgtcaaataaaatacttgcaagaggttttctggagattatgacagaattttcaaaaaatatgtttcacttgatagtaatttatatccaaagactaaaaaagttattttgttaaataatgttaaaaaacactttatcagcatttaaaaaatttgctgcaggacttctcagatctttcattgaattatgaaccttttttatgaagcatttcacacatccgctattatacacagttttggaagtaccactgcgagaaaagctggtgttttactggtgcactgagttaagtttcagacttttgaaagctgcttacagttaaatcctttgagtagtgatattgtgagtcaggtgttacaagtctgatgttaagtacatggttcccaatgtactattttcactgcaccttgctaagttgtgacatatagtatgtttatgacacattgaataagcaagacttaaggaatataactggaaaggagcaatgttaattttgtttccctacacagtttgctgagtgcccacagattttattgtttttctttttgttgttgttgtttttgttttttatatatacacatatatatacacacatatatatacacatatatatagacatatatatacacatatatatatacacacacacacacacacacatatatatatatatatatatttttttttttttttttttttttttttgagatggaatttcactcttgttgcccaggctggaatgcaatggcatgatcttggctcaccgcaacctccgcctcccaggttcaagcgattctcctgcctcagcatcctgagtagctgggattataggcatgcaccaccacgtccggctaattttgtatttttagtagagatggggtttctccatgttggtcaggctgatctcaaactccccacctcaggtgaactgcccaactcagcctcccagagtgctgagattacaggtgtgagccactgtgcccggcctaattactgcttttctttaacatatattatacagccggattctatgtcagacaatggggatgctgtttaagtgacgcttggggcaattcatgagttctctggtcccttttagataatggagggtttttccttgtctactccaagttccttttcgaggaaattcagtgaacaagatggaggtaggagggagctcagcacagaggggacagggctgctgctccgtccccactcagtgatatggctcttcctttttgtacaacagtgaaacacacttgtgtgtggtttgttagtaaataactgctgtcctgagccctcctgagtgacccacaactctggctccctagaagtccccactgccctgctgtctggcatctgtggcactacggccattcattgtgtggatgggtgccagggttatgccaaggtgtgaaaattttgaatagcatccctgaccataggtaaagaaaaatccagagtggctgaagcatcagtgagagtaggggaagtattgtggatggggcaggctgtccaggcaggcaggggccagactctgcaaaattctgtgggctgtgttaacaattttaggctttaagaacagcaggacaccattgaaaggctttaaagagagcaggaaaaggatatgattagataggctttttgtacagtttcctctttccaaaggctggaagtctgtatgtgatgggtgatgtttatatgcactaggcaatcatcaggaataaagaactctgcccatagtcaggccctgctgaatacccacactctggtggctgggccaggaggtacagcctggctagtggggctctgaagccaaggctgagcaagagtgactcccctggagcctcttcacaagccatatctgttttcatttgaggtggtcttgtgatcaggtgagcagtgagttctgagctgtgcaggaagaaagatccagtaaggtagggagaagtctaaatgggctctacaattaagagaggcaaaagccagaaatgactgaagagtcaatgtgtctagatgcagtgggttagagagagagagcaaatgcctggaacaagcatgctggtttggagaggcaacttccacatggtttctggaccagaactctaaatttaactggtcagatttaaggcaataagcttttacctcctcaaaaacagcatcaactccacttagttggatttcacttcaaagtttaagagtatgtcctggctgatacagtaccttgaaatttctgaaaccttactgatactttttcctgaagggagagtagtggttttgctggagtttgggtgactccaagttttgaagatgagagaagagaagctgaaggtgtggcttaggtgaaaggtttcataagatttctgatttaagctgtttcacttttggggacaaggtgaaataatagcactgagatgtggagatgagacttgtccctaacactgcataggccccagatcctctttagtatttcagagcgtgcttgtttcaggaacacacagagggagagagagtttcttaggcagagaacatcagtactgaaaactaggaaagcaaggttccttcatgggaccgggaaccagagccagagaggaacggcacggcaggtatggcatggtgactggaagggatgaggtctggcggctcatatgaggaccacttcaggaaatcgaagaaataattttggacatctttactggggatggcagtggagaggtggaagcaacaacaccagcagagatttagaaatgttatttgaggtaacaatataaggtgaccttatcagtaccccaagatggagaatagtctgtatagtgctcatattctgtttaattaacttgaaaatagagtcctggcaaatcaagtccttcccctctgcacgtttctaaacatgaagataacctgaaaatttttgaaatacccatgtcagctgtgactcatttttactctttttaaatcaacaatgcaatttaaattctaatttggaaatccagttacctattataccttcacttcgacagctgcagcatttcacttctggcaatacatattcccaatcacgtatcttgaaacacactttgttaaatacttaaagtccatatcaagaatgagctttggagttagcaagtcagctggggtgatcatttttggatgcctgaggaatgaataaactaaaattgcttggagagacaggaaataatctctttctaggggtattgcttctctgtgctctgtttcacattttttcctaacaaatcactgaaacaaataataagagaagcatttctagctttccttctgcagaaagaatgcctgaggaggcgactgcactagttaatgtgactgcatgctgaatgccctaaattctcctccatgaatacatcaagaatatggttcaattactgaattccgttctgcaacaaatccctgagaaatagaatacataaaagagaaactagaaaagatcacttataatacatgtataggatgtagcccaaggtgacaatttctttgtctttgagcatcttaaatatttaattttggaattctggtggggataaggggtaggcctggaaaaaaatccctataatggagcttcaggaccctccatcttcaggttgctaagtaatgtgttttgacaatgcatgaacactagatggcacccataaccttaaaacatagtaaaacgttacttcccttttctgtataggcaagaatgtaggaatcagtcaattatggggattataaaaattagctgggcagagtggcaggcaccagtaatctcagctacttgggaggctgaagcaggagaatcacttgaacccagaaggcagaggttgcagtgagccgagatcacgccactgtgctccagcctgtgcaacacagccagactccgtcacaaataataataacaaatctactcgagcatttcccactactggtgtcctgtaagttactccttatgtaagggtttggtggtcaaaatgtttttgaaagccatagacttcatctgctctaggagatttccaatggacacaggtaaacatgttttttagaagttcttcattgaagaagcctgtacaaatgaacctattacagtagcaacctattacaatcctgctgtttcagtgttctacgaaacacactttgggaaatgccaatctagtccaatccctgtcccaaagaaggaacagcccaaactatccaaaagaggccctccttatacatgggtatctgaacctttttaaaaaacaacagatacagtcttaaagcagagttgatagtaatagcaacacttattgaatatgtatactatgacatgctgtattttaagtgttactgtctcttctctttcttcagtgtgtgtgtatatatatatatgtgtatgtatatgtgtttatatacatatacatacatatacaatacctggcacatagtaagccattaataactaaattacctaggaatattctatagtctgtgtgtgagagtaggaatggacattctgcccctcattagaaaggttattgtctattatgcaagtctcttacctatgaagaacaattgagaccaaagacatatcctccagatcccttccctggggattctacttcctttctctgaaactactacattattgttaacatgacttatttgcaaattaatcttacatgacctattaatatgtattgaattttatttagctttttttttttttttttttgacagagtctcactctgttgcccaggctggggtgcagtggtgtgatcttggctcactgcagcctctgcctcctgggttcaaccgattctcctgactcagcctcccaagtagctgggactacaggtgcacaccacgatgcctggctaatttttgtatttttagtaaagacagggtttcaccatgttggcctggctggtctcaaactcctgacctcaggtgatctgcccgcctcagcctcccaaagtgctgggattataggcatgagccactgtgcccagctagctcttgattgttatttagagtttttgctttgcattttccaggaaggttgcttgcccctgtatgtccagtgcaagttatagatgaaaatattttatcttccatattccattattagtaattcttctgtgccattttgctttccacattgtaatgtttgagcttctcaagactgttcttttctctcaatgttaagcaattaaattccaatagtgaaccttgaagctagccattttcttatttatttatttatttatttttattattatactttaagttctagggtacatgtgcacaacatgcaggtttgttacatatgtacacatgtgccatgttggtgtgctgcaccctttaactcgtcatttacattaggtatatcccctaatgctatccctccccacttgccccaccatacgacaggccccggtgtgtgatgttcgccatcctgtgtccaagtgttctcattgttcaattcccacctatgagtgagaacatgcggtgtttcgttttctgtccttgcgatagtttgctgagaatgatggtttccagaagctagccattttctagctagctacaggtgaaatacattttgatatactaaggaaaaatgttccctcttctttctcaactgaaaaaagcagataatattttcctcatcatctgtatttgcaaatgttatacataaaaacggatatgctgtgtgaacttcaaagattgttgttatattctgtgaattataatatctaagacgactataattctgattggttgccttatttactgtgtggtcctggtaataatatttaaatggataaatctatttttgaagcagaaatacttgcgagttttctttgtcaagccatagagtatcactagatcacctttttcctctcacatgtatggaggttaaaataaataaagcctatggcttggtggattttttatttaaacagagttagagagtctaatgccatctctgtagctcaatttctttatccttaatatgaacataacaaggcatagtgttgttggaagactaaattatttatgatagtgactgactcaaaagtaccatgtaagtattagttctttattgctttatgtgttcccgaatgtgatgtgcacacagtgcggtgtgcaccaagaagatgtgccatagagactgttgacaatattttgaaaagaaagtgtgctgagaggagaaagaacactgacttgagttcagctttatagtcagtagctgtggagacatagacagatcatttagcctctccaaatctcttttcttctgatctggaaaatgggagtaataataataacctatcctgccacttagaatgccttagagaatctctagaattaatgcatgtgacagtgctttgtgtctgggaacatttaatgacgatatgaatgctgattgtaatgaaatgacaaagtggtccgcaagtatacagaatgtaagccaggatgatgaagatacgttagtatgctttaggtagaattttagaatcaatcttcaggctatagtgacttcttaatgtaccaccatatttattcaacactttttcattcgataaacacttcttttttgggagactgctatgtgccaggcattgtgctaaatattgaggatataaaatcatataagatagagaatttgctttcagagaccgtaccacctagtacagaaagacagacatgtaaacgtatatgcacaataaggtttgatagctgccagttatatcttacatatcatgaaagtattgaagaagtaggtaagggaagtagtttaaggaatgatgctcagctcttggatggcagaacaaggtcctggtgtgggactatacgctgtatctcccatactcaacatccttccagagaactgcacctgatgagtaggcagaggccttcatatgtgagaggaccacagtgacacatacgacaaggctattcatgcaaatttccggacaccttactaaagtcaactgactgtatgatgttattcaggtaaactgtgtgtgtgtgtgtgtgtatgtcagagagagagagagagagagagaaagagagagagattttcccattttttgaagggttggaatggtggctaacaaatataaggtaaattataagattctatttataaatcacagccataaaatgaaaacaaatttttctaaatgcacaatgaaaaccacaaactaagtgctttgtttagttatgaactatgaaccataatatcagccataagtactggctccttatgtaaccctccgttattattttcatgattagtaaaattaaaatataggcaggaacactcacaatggatttaccctatcatactaaggaggaagcttgacatagtagaaggagacagccaataaatatttgaataagttaaaggaaacaggaaaagaaaggaagaggaaagggaaattagaaggaagggggaaagtggcaatgagatggaagaatgaaaagagggagggaagggatatggtaggtgtaatgggcattaaaatggaatacttaaatcccagctctgactctctatagttaggtaaactttgacaagctggaagtttatcttcatttgaacatgaggcagtacctttcagagtgattgtgagaagaataaataatagttatgcaagataagtcagaggtccattgaacaatgtgtgcctatagtcaccaatactgcttgcttaaacatttgctaagatggtagatcttatgttaattgttcttataacaaaaggaaaataataataaaaaaagaagagaacaggagaaaacttttggagtgatggttgtgttatggcatagattgtggtgatggtttcatgtgtgcatacatatctccaaattcgtcataagtatgtacaactttttctacgtcaatctcatctcagtaaagtacccttgaaaattacttacaaaataatgccctttgcaccaatgcagatgccactggaggctattatcctaagcaaattaacacaggaacagaaagccaaataccacatgttcttacttataagtgggagcgaaatactggatactcatggacataaaaatagcaacaataggcactggggactcctagagtggggagggaaggaaaagggaaatgattgaaaaactactgggtactactctcactatctgggtaatgggatcaattgtatgctcaacctcagcatcacgtgatatacccatataagaaacatcgtgtgtaccgccaaatctaaaataaaagttgaaattattaaaaaggtaaaaaaaaaggtgcttaatacattgttgctgataattcttgaatttagttgaatggtgccactgctacaacttagtaccatcagcaaactctatatagcattatcttatgcatttttttgtttttacatttgcaccaaactatacacattataaaggtacagtgtttagagtatggttatgagtttgggagaaaagtctgtttttttaaataaaataagtaatatatcatttttaaaaaggcatgcttctcaacgttctgttggatgcaaatgtgtctcagaacatctagaagaaaacattagcaccttcgcctttatttgagggaagtaagtgccacaagcatcaaggacctgaacaccatttaaactgtgacatgtagaccatgcttgatggctcatgcctgtaatcccagcactttgggaggctgaggcgggtggatcacctgaggtcaggagtttgagaccagtctggacaacatggcgaaaccctgtctttacttaaaatacaaaaattagtcggatgtggcggtgggcagctataatctcagctactcaggaggctgaggcaggagaatcacctcaacccgggaggcagaggttgcagtgagctgagatcctgccactgcactccagcctgggcaacagacagagcgagattctgtctcaaaggaaacaaaaacaaaaacaaacaaaattgtgacatgcaccagaagtcgtgatgctctcatccactttcctttgtaattaaggtgcttttggtatcataattgaaagttatgactttttcattgatggcgtcagatatggagggaataaagattaaagaaacatactcaccgataggatctggtctcctctctggagctccccacttaggtctgctggtccaccagccagaatgaaggacacaaaaataccttctccatcttccccaccgacaatgttgaagcccaggccagtggagcctttgtgcaggactaccttgcgaggctctctgcagaaagaaatagagaacacagctcagagggtgatccatttaagatttacgttgcttttactttcaatgggatatatgatatcagcaactcactacttgtaaaattgtttctcaaactaagataacatttgcacatcaagaaagaggctaatatcaggacagatgtttgagttccccactgcaacaactaccaaaataccatgcaaaaaatcattccttcattctaaaaaaatttcttaaactacctttacttctacttttcttttgtttaaaacatctctttttgtatcaagcaccacagtagtactcagtatgacggatgcacacaaaagcagggagggatttttgggaagaagagactaaggttgaatgcccagatcatgaaagatcttacaagccaggttgtgggtttgttgtttgcttgactgttaattaaaatttactgtgtaggccatggggctcattagaagattctgagacattaagaatacttaaattcattttaggaaaattaacagatggtcctatggagggctgacggagaggaaagcacagatatgatcggaggtgggaaaaccatttaggatgttgtctaggaatccagctgtgaggaagtcacagcctgaagaagggtgacagcagtgagaattttaaaaagggcaacatgagagaggaaatttgaagggagaagcagtaggtccagagatgactcagacattggaaaaagaggagagagagcatctaagtaactagcaaaaggagagatgagtggaatccagggtcatgagaatgagtatgattttgacacactcagttccaggaaatagtgagatatccaggtggagatgttctgaagcagctggagacaaagaataggaatatgggccttcagagaggactataaatacatatttgaggatcatcaataaaaaggtcagagatcaaatcttgagccaatagttcactgagtttgtgtacagctcagaataatatggaattatagaatgtaaaaagtcttaaaatgcatttagttcaattttctgtatcagtagttttaaaaagtgtttttgcaagccttaggtttgaccaagttgtcatttgcatcacccaccctcctctcccaaacatctcagttcatcttctattttccagctcttaatgatgtaagaatgagaaagagccatcccatgtattttatactaatggctacacaaagaatttgttacttgctatcacatttccatgcataaaatgatgcattatgtatatatgccttattatgaggaaaggtgtaaagtgcacctcacaacttgaactgtaagtaataaattatgtaacaatgcattaagtcagaggtaaagtgacatagagttaactcatttcattctacaaatactttgtaaacacctactgtgccaggaaggtgtttcaggtgctcagaatgtttgcaaacaaaacaaatatccctgtccttgtgggcttacaatctaatgaaggtagaccactaataaacaatagatgcaataaataagttcattatatagcacgttagaaggcaaaaagtattttggagagaaaaaaaggcagagcagtgtaggagggataggttgtggtgaggagggcctgggtaggatggattgagaaggtgacattttagaaaaaattgaagaggtgaggaaactagtcatgtcgctataaaaaggaagaacattctggccagaggaaaggaacagccaaacagagatcctaatatggaagggtgcctggtgttgtcaaagaagaactaggaggccactgtggctgaactgagtgaatgaggaaaggagaatggtaaacaatgaagtcactgttttagttttctattgctgaataacaagttaccacaaatctagcaggttaaaaccacagccattattctctttcagttctgtaggtcaggagtctgggtggacttgactgtgttgcctacctatgctgaagtcaaggtgtcagccaggctcagctttattgcaaatttctgtggaaaaatctgcttccaaatgtatttaggttcctggcagaattcagtttcttgtggttgtaggattgtattagtcagggttcttcagagaaagccaacatgagattgcacacacacacacccctatggtatatacacatacacacacacccctatagtatatacacatacatcataaggaattggcttatgtagttgtggaggctgataaggcccaggatttgtggctggcaaattggagaccgaggagagccagtgatatatattaaatagttgtaggctgaggctaagcctgaaggcagatgaagactgctgatgtcccagcttgaagacagtcaggaagaagcagcaaattcaccctctcaatgcttttttattctattcaggccttcagtggattagatgaggatcacaccccttggggaaaacaatctgctttacccagcctattgatttgcatgttcatctcatccagaaacaccctcacagacatactgaggaaaatgtttaaccaaatagctggacactcaatgactcagtcaagctgatacatgaaattaaccatcataaggaataaggtacccatttccttgctggccatcaactggggcctctctcagctcctataggccatccacattcctcaccccatggctctctctatcttcaagcaactaatggcacattgaatcctcttcacatttggaagctctgacttcctcttctccaactagctgaataactctttgcttcttaggggtttatgtgattaggccaggcccacccagataattttcctatcttaactgattagtaaccttaattacttgcaaaatcccttttcttatgtaagaacttaactgtgggagtaacaccaggaggtagatatcatgggtccctcttagaactctgcctaccactatcagagagacaacggtgcattaatcctgcagggccttgtagatcattttaaaagctttgacttttactctgatagaaatggggagcctgtgaggaaatgaattgacctgacttacatttgtaaatgattcctttgatgtaaaatagagtcctcttgcagctgggtgggcatggcagttcagctcccccttgatcacagaacagcagggagggagacacagagcattcacctcattctacctcattgccactaggtgggagtagaagttcagctccgcgcttggatccactaacaccaatcggggagagaagatggggtgctgactagcactgccttgaaccaccttattctccttacctttgcatgggggtaggagttcagctcctcacagggccctgctgatactatcctggcaggcagagtggttttccaactagtactgatttcctctttctcctacttcattgccactgtgcaggggtggaagttaagcttcttgctggttcccatcaatattaggagtaggggaatggaatgccaactaacgccacctcatttcagcctgttgctgctgggtaagggtacgagttcagctccccactagaaagtggagtatcgactagcatcacctcgtacccccttgttctgcctatttgctgccaggtggggatggaaattcagttcttgttctgtctaccaacaacagcctagtggaagaagtgtaaggccatcttagagttgcctctcctggctgccgctggtagagccagaaacctagctctcggcatagcactactgacactgcagggttgaggggacagttttttctttggtgtttggctagagtaggtcagtattatcaaaagttttccggttctattagtctacctgtttttcccagtcatttatctaaagggagcaggttttacttggggctgtttttgtctgtacttattggcggttccaggctgcaggttctccagtgctctgtccaaatacatagcaagcaaaaaaaaaaaaaaaaaaaaaaaagaaaagaaagaaaaagtcctgggaactcactacagtatccttcctttcctagccagtttgttgcctcctttccaactctaaagtcttcctacatttgtgtttttctactcaaggttatttgttttgttttgctttttaaataagagggtggattagagagaaatggggatacattttaaacgtagaggccaacagaattttcatgaaaaggttattgtcgaaatctccccctttccccagaataaacacacgtatagacattcttagtgggtccaacaacactgaagctctatatagtacatatagatggagggaagagagtgattaggactctgacatttgtccctgtgctagatattgtgcttgatgctttatatgaatcatttgatttattcctcaaaaaaatgaaaggtatactgattttgcaactactttaaaacaggaacagaaagcaaaatagattgatgattggatagatgggtaggtatgtgatagagaaagtataggaaaatgttaatagtggaatctaggtgacaagtacacggatgttcattgtaacatttttaaacttttccttatgtttgaaaaatgtttataatgaaattatgagtaaaataaataacctgatgaagaaatcattagggcaaatgtttagattagtgaaatgagactacttgtctaagcttttaactgagtttagtaagcagcaaaggcaggattaaggacatagattttctgtctcacaatccaaaagtctagaatacggtatataccagagattgcaaaccagcaagtcaaaggctgaatttgactcataatatttacaaatgtttgaattagctgcccaagtttaaaattaggaaaatttgcatgaaatatggatttgtggcttcacatgaaaaaagtctggcattccatcaacactagctcccagttttgctgtgaggcaacacttggtttagagaatgggcttctttagaagggtcattcatgctctagtttgccatagtcctgacctctttctcctgttcccagacaaaaaaaaaaaagctgtcattgtaccacatttgcacttcttataaaattaagaggaaagtatttcttgtactcatactcctatcaaaaatgggaaaatgaaagctttatggagggaatcatattttaataaaaatgggagagagtaagattcctatggaagtaaagattattcttacatgtttaatatgcaatgtgactttatgcaggaagaatacagctttcaaaggtcattatgaaacatcattgcccattacccatttatgttacccatctgggggcattttgttagtgacctttgcactttgacatactgcttcctgtctttaaaaacagaaaacatataatgtttgcatgacagtagattttatttattttacctggaccccattgatttcaaactatcaaaacaaatcttttaaaatatattatttggaatttttgaaactcagaagatttaaatgccttttttaaaaacagaattttatattatagttaattatgatacttactttaatagtgaagataaatgacaaaaaataaatttgtaaaatggaatgcaaataaaatgtcctaagcacacttcaaatgatttattttttctaatttaaatttcttatcctaataacctattacagcaatctgtagattttaaagcatttcacatatattttcctgttagaggatcaaagccctttaaagtattacaagtcctattttaccgatgcttaggtaaatcggcttgtctacattcacatagccagaagcatcagagctagtctctttgctgtaagttaagtgtttcatccatttgatggagagggaacttaaacaatgaaaatttttaaaaactaagctaaaattcaagtatatttaaagtatagtagtatacattgaagtatatataagccagaggaggattcttaatttaaaaaagggattacgatatattacagaatatagtttccaaaaccattgacactcaaagattcactttaactgcccttagctcttatcatttgaaccacatggttcaataccgcattccatgctgccttgcactcttctctctctgaatgtcatggtatctactccaaccccttcatcccctctaattcaggttttgacttttaggataaactcccaacttgaagtctccttgatcctagtttcaatcttccaaatacattctcctccctaaaatacaaatcagatcaccttactaccctgcttaaacgtctccaggcaccctatgttccagccacatcaaagtccctgtgcttccctgagtttgacatgttgcttcatacctctacgttttggctcaggccaccttaaaactcagttcaaccatcacttctctgaatccccaggtacatatgataacttgttccttgggtccacactgtgtcttccacacatgcatctattgcagcatgttttacagtgtgtcataattgctcataccttcttctcaagaaaatgtgaactcctagaacccaggcaccagcatttccccagtaatagtaagatgcctggcaggtagcagaaactcaggaaataggtattaaatgaatggataaactcccacagtgattaaggtctccatttcatattataattaattacacgaatgtctttccctcttcctagattttaaccaggtatgtcaaaatctaaattccagagatatagatcacaaaacacaaatgggcaaagcaggatgagaaggaaatatagcaaactggaagacacatttcatctaaaagggggctgctgctgctcaactctggacaatcgctccaagcaggaatgtcaagcaatcttgacagattctctaatttttaaagataagccaagaatctagatatttatataaatttcccagaattcaaatatgacaatggttaaaaaaggtaaaagcatggtgcaggtcaaactaaagatgtctgttatgcatccagctatgaactgccagtgtgagactctgccttgttagaagtttgatggtgcatttgacatctgcttcatgtttttcgcttccatggtgctcagaatggtacttgactgatggtcatttaatattccacatttagcccatccttttcttcacttttcagtttctcccattctgtaatacccttttatcttactgtttcccgtttgtcttttttttccttttatattacagctgctcaagacccatgatcttcatgataaaccattctcaaacattttgagcctagctgcttttgcatgcatactgctgaggctaatgactctgggtctgattaatataatagcccacatttctaagaactgttttgtgtgtgagggcattgtggcccccagtgagatcataatatcctggaggtgaggtatcatggtttactttctaggtatacctaatactcatagaacagtgttcagtcaacatctgatgattgaataaataaacacaatttataaataactcaaatactttttatactagaatgatttggggactctgatttcctattttattcatcatccagaattcatattgctgaaggctctgttactaatcattattatacatcattatacattgacagtggaacaaaattctatctctcatttctcattctgaaattagctcagggattgtaatcttctagaaattttccctgatactctccttagtctctctactctaggctgggttgggtgcttcacctagcaatcttttcatgtatctatcataatgcttattccactggattggtttatttgactccctttctagctagagtgagcaacttcagggcagagacccatacaaaacgacatacgttggcatttgctttttgtctccaatacctggtacataagaggtgctcactgtcagctaatttcatattatgttttaagtatggaatgtatagaagacataatttggtcactcacaatatcagcagttttaaaaacaaagttagatagctacttaaaaatatgtatcttacccatccatccaacttccaatagacaagcatctatggagtacctatgttgtgttaggcactgtgaatacaaagattaaagagcctggggtaggaggagccacatgtaaacaaacgcttatagaagcctaggaagtggacaagtgctatgacagaaacttgtgagcaataagctaaagtagccaagagtaaggagcggccagccttcttcttaaaaggtattattcttttaccatcatcacttagatgaaatgtgctatattcatttatgcagtttttatttttctcttaatattatgtaaaaagtctttaaaattataaaacctttggatgctgagcgaatggagaaatgccagcctgacctgctgcaagctgtgacagatcatcagcagcataatcttactcagctggagtctcagaggatcctctaaactagtcaggatgttttgaggagaaaggaggtgctgtaggctttctctctttacggcagatggtttaagagtgttcatgactcaaaaaggaaaattaccgccaggcttggtggctcacgcctgtaatcccagcactctgggaggccaaggcgggcggatcatgaggtcaagagattgagaccattctggccaacatggtgaaaccccatctctactaaaaatacaaaaattagctgggtgtggtagcgtgcacctgtagtcccagctgctcaggaggctgaggcaggagaatcgcttgaacctgtctcaaaaaaaaaaaaaaaaaaaaaaaggccgggcacggtggctcatgcttgtagtcccagcactttgggaggccgaggcgggtggatcacgaggtcaggatatcgagaccacggtgaaaacccgtctctactaaaaatacaaaaaattagccgggcatggtggcgggtgcctgtagccccaggtactcgggaggctgaggcaggagaatggcgtgaacctgggaggcagagcttgcagtgagctgagatcacgccactgcactccagcctgggcgacagagcaagactctgtctccaaaaaaaaaaaaaaaaagaaggaaaattactacttacactgaagtctttctcatggccattcgtgggctattccttgaactctgagcgtctgggggcttgggaagttactccagtcaaatcctacaacctccatggtgagaggctgtattgggtagtgggaattaagatataaatatgttttcattgatctttctaaagaacatatcttaccatgtttctctcttgctcaaaagccttctaaggatctgtgtaccttttaggataaggtctaaacttctacataggcattcaaagcttcctattatttgacctcacctacctctccaccacttaacttcattgtgcccctttgtatttcatatttcagccttacaaagttgccaaccacagcttctcatcccaggttgttcctccttgtctttgcccaggctgtttgctgtttgctttggctagaaggatgcctgccttttcctgctattctcatctatctaacgaggtcctacttggcctttaagactgaggccaggtacaatctcctctctgctgtcccctctaccctcacctccagaagaactgacttttttgaaaccacattgtcctttcattgatcacaccactatcactgcctttactgttctgaaataaatttatttacccatccatctatgctgtcaatctgtatggtcctgaaagacaaagataaaggacttttaggtccttgttttgtgtaattttggaagcgggtacaggctgagcatataagagacatacaaacaaaaatattgtttcatgaacggaaaaaaaagtgagtggttgggaaaaatgatactgagttctagttctggctctcttgggatatgtgggaagccaggattgtcctctacaggtcgggttccttgcttgggtaatggagggaataatgtttgtctcatggggaagtgttgaaattccgataagacaatgaactaaaggcatctagaaaactgagaagttttaaagaaaattaaatattgagatgctatttccagtaatttggcatattagatattctgaaaacccctttcattacaaagcagctaaaaattctgaataaaatagttataaaatacttttaaatgcttggctaagcttgcaagtaagagaaatcttcagaggatgaaaatgaagcagaaatgcaaactcagaagaaagcaagtactgagaatagcagcagactgaagagtgatgagctagtgtgttagtgtctagatttgatggctgcatgaataggactgtgtgagcccagtggtgggattagatcagagacacctgagcaaaattaggaccctgtgaggctacaccccaaacaaaaggataaagtacaaaaatattagcacttcaacaatatccaggatacatatctatcctgattttggctcatagggtaaaaaaaagggcctgggggccaggcgcggtggctcacgcctgtagtaatctcagtactttgggaggccgaggcgggtggatcactagaggccagaagttccagaccagcctggctaacatggtgaaactccatctctattgaaaaaaaaaaaaaaattagctgggcatggtggtgcatgtctgtaatcccagctacttgggtggctgaggcacgagaattgcttgaacctgggaggcggaagttgcagtaagccaagatcgcatcactgcactttagcttaggcaacagagtgagagtctgtatcaaaaaaaaaaaaaaaaaaaaaaagggcctggggaactaatcaaggcatgtttgaatgtcaaataagttacacttgcaaacagaattgataaaactgaataaattgggagaataaaggagggagagtccacctgagtcgtagaagaaagatcttcgcaatagatctccagagctgtgaggtcgaggtgatctccagctccagctgcaggtggctaacataaatgtgctgtcctggtggtaggggtaacgtatgagatgggctcatctggccatcctagctcaatgacagtagtcattagggtcacttgggtggctaatttccctctcagagtccaggctcaccaagcctccagctcattaaaaatataatttatcctagtgtttttcctattgagagcaatgtgctagttatagcacattctggtatcttgagtagttacattttgcatcatatattaaaaacatggtattacagcatataagcttgattactcctggatacactgacaaaaactgagttccagagactgtagatggaaggcccagatctagtataacgacaacccaaaaagggtctattacccgtggaagtcatatgggaagtctacagctagtcttcctgaatcctttttccttcatttctctattaaatgcaactacgttcacgtgaacaatgttattaaaaagaggagatacttgtaggagatcaaaaagatctttttagtagaatgagaagacatgtattaggaaacttgtgaagagaggggcataccaaaggtggtcacatggaagacaacaacagaaggcttcaaagctgctggttgattacaaccttcttatatctaaatgagctagctcctcagaaggatgcagtataatgtgtgcctcatatttaaatagttaatttggtcagttagccaaataatcagtcaaacagattattgggcatcatacagatacacaaagatagagggttttgttgaactgctatttgaggacatgttattaaaataatagaaagaaatctgtcatcataaggggggatctatgcattaaatatacaatatagagcaggctgacttcagcaaaataataaccacactgatacagagtttatactaaacatactgtggttggtactgtgtgggataaaacaaccctactagagggggatggtatgggatactgtgatattgggaaagagtatgggcattggagctacatagatctaggcttgaatcataatcctaccaataaatacttgagtaaccttggtgtagtttcttgaggtcttgcttttttggctataaattgtgaacagtaatatctattttctggcattgtgaagatgaattgaaataacataaaaatactagaatcacacagcaagtgcttggtaaatgctaactcatttcctttccctctagaaagttatgacctttgaaaggcaaatagtcacacataaagtaataaatcaacattgcaaagccacatatgttaagtaccaaatgagtattgtggatgaaagatctctgtgttaaagaacaaatattaagtcatatagaatgtacaatctgaactagatcttgacagatgggtagaaattaggaaagtggaaaggaaagtagagggtatttccgtacatggcatgagcctagggccagagcggagatatgcaagatgtatttggagaatagtgagtatcccagtttgaataatgtgcaggattggcttcaaggaaaactagaagactgaggcagactgggaaggaacatggatgccaacctaaggaattcacactttatacttggataatgtgaagacattgaatgtttgtgtactcaggggagactttgtgaatgcaataacttctatttgtaagccttaagtgtttatgttacattgttctgtttctacagccccccaagtttgcctgcaatgaggttaattaataattctaaaggtctctaaagacacttctgctgcaaagtgaggggctttgattgaggctgtaacataaggtcttggatttaactgctaagatctgtctgagttctttgtaaaactcttttccttctcttctctggagtaaatcttagaattaggcacacatctgagactacatataacaaccttggtaaatggaatcaatcagacaaattaaaaaattttcttctcgcaacataaatcaactatagatcaattagtttgatttaaaaatatttggagtactttcttatccacatatcaaacatgataatctaataaccaagttccacctcaatttgtttttgtctaaatttctcaagaaaataaacaaagaaccaattttatgttgctccacatacgttctcacttttcataaccataccttctaatcattatctcccaagccaaaaaaaaaaaaaaaaaaaggattacccctctttttcttttatttcataatgttttggttgccaacttattttttaagttatatatactatccataataacaacaatttgcttttgctccctgttgcattttgaagttttaaagataagttaattataaaaggaatgttttttgataattataacaggaataattttagcaatcttgttaaactaaataaaagtaaaaaagtaaatatctattgtacagagttatttttcatagttgtgtcatttgttctcaagctctcatgactggtgaaataatgtctgaaactattatgaagctggggcattagcaaaactaatattcaaaaataggattagagaaaaaaactctgcatattcttcttgaaggcaaagtacactttatgaaagattttttaaaatgtctttcgagttgaagcattatggtattatgaaactccaattaattatcaaatgttcaaaccctctacaattagtgtgatatggggaaaatggcttgaattaaagtgaaataattgggttcaagtatttcatgttttatcttaactctgatttggatatatccatattattgtagaaaaaactttaggctgaggcctgttttctagtcctgactccaatattaatgcctgagtgtccttgaaaacagcctctgaacaagtttccatattgtataactaggggaggggtgaaaaaggcaaaccagaatcgccacgatcccttccagttctagcatttcacatgcttgcttaatgaaaatcagaagtggggcgttcccatttctaaaaccacaattccacttgatgatttaataaatatttagtactcaccttcaagaaagtggagagaacagaaatggctctattgttaggtcctctccaacttggcctctcttcagcttttgacattataaacgttcctctctgtatttccgtaattgaaattttgggaaatgttctatgtatctgtttgcccaatatcgtagctaccagtcatatgtgttagtaagcacttgaagtgtggttggtgtgatggagaaacttaattctcctctttttcctttcctctagctctttcttggaggggtcctttgtctctctaggtctcagtttaaattgtgctctgtgaccactccatctaaactagtcccccacaccttttttttttttttttttaatcacggcatcttgtaaggacacttatcttacagtaaattaattgtgtttgtttgtttgcttgttgcccatctctcactagaatgcaatctctatgagaactacaacccccttgggcctctagcatctagtctagtgcctggtacagattaggtacagattagtgcctggtacagatattttttgaataaattaataaataggtggtcttatcctttgctatattgataatccactaattcatatctctagctcagatcagtcttctctactccaaatttctattcagttgctccagaatgaaatcattattttctcccagaattttttttctcccttttgttccttatctgggttaattgtgtctgcccaattttcaaatcagaaacttctgcattttcttctctactgctcatctagtacttccaatcatccaacaaatgcagtcatctttaattcagaaatgcctctcacgtcatcttagtattgttgccttagttcaggcccatgacatctctgccagggatccctaactaggattctcctaacaatatgaagtaactattaatttgggctccatggacttcttcaatctcaacttccaatacattccttctggcactatacctatcaattatgcataaattcctgtgtggccctcatggtcagactctcctgtgccatttgtgtgttcttcctctgtttggaatgcccatctccagatgaaccagtttatccttcaacaattccacaggcacatttagccatctcctgggcagtgttcccagagcattttatttgggggcattatagcactatcacttaaaaatagatacagatatacgtatctgtcctctaccaactgggaattctttatgcacaaaaaatatatctattcaattttttgaagaatgacttattcctctgcagtagttaattacccagctttggtttcagacacacatctaagtttaaaactgagatttgccatttattagctacaagactttggtcaatttacttcatcttgttgaacctcagtttttatatcccaaaatgggtataatggtagtacttacattgtggtttttgtgaggattaaatgggataataaatgcaaattcctggaccatattaataaataagggagataaataaatataaataaataatatatataataaattaataaataataaacaaataaaaaattgcaagctcttaatagccattcaaatgtttatcgagcataaacatttgtcaagtattgtgttatagatgaagattattatgaccgacttggtcctcatagaatttctaatctagaggaagaaataagacataaatatagagacatagatatttgaaacgaaatgtagaataataaaagagatacataaaaattgttatgagggcctgggatagaaagaaataatttctagatgggggtctatggaaggtttgctgaaggagatcacactttaattacacaggaaaacatggccagaattatttgctttgtgaattacttctctcagcatagcatgtgctttgcaagggcagatgcaggttttatgtggtctggaagttttacaatctggagctccttttttttttttttttaaaaaaaaagcataaaatattacatttataacgcgaatttcttatttacccagaatgctagtgcctgacatctaaaatgtgcttactgtaaatgaactccctttcccccggccttcgtgtctccagtacccagcaaaatgtctagcaaacaaggtacaagagcttgaagaggtccatgtaattgaagggcctagggtttcaaggtaaatacacttctggtgctgtgcttggcgctggaaatataactataaatacaatttaggtcctgacttaatgggctctcatcctagggggacagggaggtaagtaaaaataactaattataataacattcattcatccgtaacatttggggtaagtgtgtgtgtgtgtgtgtgtgtgtgtgtgtgtgtgtgtttttttacttgagacggagtctcactctgtctcccaggctggagtgcagtggcgtgatcccggctcactgcaacctccgcttcccgggttcaagagattctcctgcctcagcctcccaagtagctgggattacaggcatgtgccaccactcccggctaattttttgtatttttagtagagatggggtttcaccgtgttagccaggatggtcttgatttcttgaccttgtgatccacccctctctgcctcccaaagtgctgggattacagtcatgagccaccgcggcagcccggggtaagttttctaatagataggagagcactgatttgatatagagagatggggagtgggataataattaatgaataaggaaaagcataaattaaggaagtcagggaatatgtggtgtttgaaggaaagcaaatattttcactggactacaatgtaccattctagcaggggtgtggtggagacatgaaggcagaggccagatcaggaagaggttcttagacagggcaaacagagattcaattcttaatactcagaagaacagagcagaatatttgcatatactttcttcattcatttaaccaaggtttggccagcagctactgggctcgaccctggctgagccttgcacatacaaagctatacaagagctctctgtccctgaaaagtttacactctgcattatgtgttgaattttgtgtctccaaccctaaagaaattttgaggccgggcgcggtggctcacacctgtaatcccactactttgggaggccgaggcgggcagatcacgaggtcaggagatcgagatcatcctggctaacacggtgaaaccccgtctctactgaaaaatacaaaaaattagcctggcgtggtggcgggcgcctgtagtcccagctacttgggaggctgaggcaggagaatggtgtgaacctgggaggtggagcttgcagtgagctgagaccgcggcactgtactccagcctgggtgacagagtgagactccgtctcaaaaaaaaaaaaaaagaatttttgaagtcctaactgtcccaataccccagaatgtgacatgttaggaaaggattgtggcagatgttagatgttaagaagaggtcacagtggagtagaatgagtcccttatccaatctgacgggtctccttataaggagacagccagggctgggcggggtggctcatgcctataatcccagcactttgggagtccaaggcaggtgaatcacctgaggtcgggagttcgagactagcttggccaacatggtgaaacctcttctctactaaaaatacaaaaaaattagctgggtgtggtggcaggcacctgtaatcccagctactcgggaggctgaggcaggagaattgcttgaactcgggaggcagaggttgcagtgagcggagatggagccattgcactccagcctgagcaataagagtgaaactcggtctcaaaaaaaaaaaaggcggggcgtggtggctcttgcctgtaatcccagcactttgggaggtcaaggtgggtggatcacgaggtcgggagttcaagaccagcctggccaaattggtaaaaccctatctctgctaaaaaaacaaaaattagccgggcatggtggcgggcacctgtaatcccagctactcaggaggctgaggcagagaattgcttgaacccaggaggcggagattgcagtcagccaagatcgtgccactgaactccagcctgggtgacagagcgagactccgtctcttaaaaaaaaaaaaaaaaaagacagccatgtgaagacagagatacaccaggagaatgccataagaagatggaggccagtgttggagtggtgcagctgcaaaccaaggaacactcgaggttgctggtaaaactccagaagctaggaagaggcaaggagagtcccctacaggtttcagagggaccagggcctgctaacactttgattttggactctagcctccagaactgagagacaatacatttctgttgttttaaacactcagtttgagtagcttgttatctgagacctaggaagctaatacgttctggtaggggctacgtgagccaatgcacaaactgacatgaacatcacctgcctagaggggcaaaaggagtcactgaggctgactcaatccctatgacctgtcacttcagaaaatggatttgaaataaaagtataatcataccagtgcagttttgggagctgttaccaggtgcctgggcagaaagccttatattcaaatggcaaagctttccataaacctcattaatagaatttcagaagttttcatgtagttaagatatgtatgtaagaattactgtggaaaaaaaagacaaaggactaccatgaatgcatcattaattactattactgaaattcattttcaaagataatatgtaaggaaatacaaacatcttactaacctttagctgtagttgaactctaaaaattctttcctttaaaagaaacattcaactgttctcttctctgggggtatcacaggtgttgtcctgtataaatgtcctgtataaatgttttaccagctacaagttctgtttttttgctaattctaggggaggctttacataacaattagttcagccctgatgagttttctaattccttcttttctttatcaggaaaaaagaggaagagcattgcttcccatccttgctttctcaattgagaaatttcattgatcttactgacctactttccctttctacccagactcctgcccttagagcagaggttagccaaactcttcttgaacatggcattcttaaagttattcattaactatttcctttagtcacagcaaaatctgaaagccaactttggacactgataagaatgggaagtgatttttagaagaatcatcaaaatttttcctctaaacaaatatgtgtagcctcatcttctgacaaaccctcaaaaatactctaaattccaatcacataaaatccccttgattttctccgaattcctagcttttctttaagtggactctttccctcaccttggtctttccatgtatagtcctttctgccagcagttggcttcctctcttttatatacctaggaaactttccctcattcctcatgaatagttgaacaacatttggtctcctcagctctccctaacactagttcctctaggattctattgcaccaaattcatattgtgattatcctaattatcacactctatctttttatccatttaacaagtatctgttgagggtctactatactcctggagggctccactgtggctaggattattaccataaagcagatggtttctgctcccaagaagttcacaacatagaggcttattagaagagtaaactagaaattataagccagaacactaaagttataatcttgtacaataaaaatttatttgcatacttgcttttctcacttgactctgagattcttgagtattttatttactttgtgagttagtgtctgatatctaaaaagtacctaataacacccattgaaaatgaaaactttcagtaaactaggaataggggaactcctcaacttattaaataatatctacaaaatccctacagctaatatcatgcctaatggtaaaaaaaacttgaagctttcccactaagatcagaaacaaggcaagaatgttccctttcaccaccgcctttcgtcatcatactgcaagttctagttaatacaatcagacaagaaaaggaaattaaaagcatacatattaggaaggaagaaataaaactgtctttgttcacagataacataatactctttgtataaaatccaagataactgccaaaatctcctggaactaataagcaattagagcaaggttgtagaataaaggattagtacaaaaaagccaattaatttcctatatgctaatgatgaaaaagcgaaaactgaaattacaaatataatgccatttatattagcacccctgaaaatgacatacttagttataaagctaacaaaatatgtacaagacctatatgaaaaaaactacaaaactctgatgcaagaaatcaaagaactaaataaatggagagatagtccatgtaaatggagacctagaaatactcaatattgtcaacatgttagttctttccaacttaatttgtagatttagtgcaatcccaatcaaaatcctagcaagttattttgtgaactttatatggagaggcaaaagaccccaaatagcaagcaaatattgaaagaaaaaacaaatttggaggataacactacctagcttcaaaattttctataaagctatagtaatcaagacagtatggtattggtgaaagaggagacaaacatggtgctagaacaactggacatccacatgcaaaacagaaaaaaataggtagacacagacattataccctgaacaaaaataaactcaaaattcatcacaaaccaaaatgcaaaacacaaaactataaactccttggagatactgtaggagaaaatctagatgaccttgggttttgagatgactgtttggatacaacaccaaaggcatgattcatgaaagaaagaactgataagctggacttttttattttattaaaatagaacatatgtttttaacatatgtaaacatatggacagtttttattttattaaaataaaaacagtctgctctgtgaaagacaacgtcaagagaatgaaatgacaagctaaatactgagagaaaatgattacaaaagacatgtcagataaagaactattattaaaaatatacaaagaactcctaaaactcaacaaacaaacaaaatctaaaactgacaaacaactcaactaaaaatgggccacagaacctcagacacctcatcaaagaagataaacagatgacaaataagcacatgaaaagacgcctcacatcatatatcatcagagaaatgcaaattataacaataatgagataccactacacgcccattgaaatggtcgaaatccagaatactgacaaaaacaaatgctggcaaggatgtgtacctgcacttattcattgctggtgggaatgcaaatggtatagtcactttggaagatagtttggtggtttcttacaaaactaaacatactcttactatatgatccagcaattgtgctccttggtatttctccaaagaagctgaaaacacatgtccacaaaaaaacctgcacctgcatgtgaatagttctagcagctttattaataattgccaaaagttggaagcaatcaagatgtccttcagtaggtgaatggataaatacactgtggtacatctagaaaatggaacattattcatcaccaaaaagaaatgaactaccgagccacagaagtacatggaggaaacttaaatgcatataagcaaaagaagccaatctgaaaaggctacatactgtattattccaactatctgatactctggaaaaagtaaaactatggagacactaataaaatcagtagttgatggggtatagggggaggaagggatgaattggtaaaagaagatacaatttttaaaaaacttttaagttcagggatacatcaggaggctgaggcaggagaatcgcttgaacctgggaggtggaggttgcagtgagccaagaccgtgccactacactccacctgggtgacagagactctgtctcaaaaaaaaaaaattttcagggatacatatgcaggtttgctacataggtaaacttgtttgttgtacttgaaggtttgttgtacaggttatgtcattgcccaggtgttaagcctagtatctattagttatttttcctgatcctctccctcctcccaccctccaccctctgtcaggccccagtgtgtgttgttccccactatgtgtttatgtgttctcataatttagcttccacttataatgagaacatgtggtatttggttttctgttcttgcattattttgctaaggataatgacttccagctccatccatattcttgcaaaggacataatctccttttttttatgtctgcatataattcatggtgtgtatgtaccacattttctttatccagtctatcattgatgggcatttaggttgattccatgtctttgctattgtgaatagtgctgcaatgaacatatgcttgaattttctttataatagaacaatttatattccttggttatatacccagtaatgggattgctgggtcaaatggtatttctgactctaggtctctgaggaattgccacactgctttccacaatggttggactaattttcacttccaccaacagtgtaaaagcagtcctttttctccacaaccttgccaacatctgttgttttttgactttttgataatagccattctgactggcatgagatggtatctcattgtggttttttgatttgcatttctctaatgatcagtgatgttgacctttattttcatatgatagctggccacatctatgtcatcttctgtaaacttttcatgtcctttgcccactttttaatggggttgtttgtctttttctgtacattcctttaagtttcttaaaggatatttgacctttctcagatgcgtaatttggaaatattttctccaattctgtaggtggtcagtttactctgttgatagtttcttttgctgtacagaagctctttagtttaattaaatatcatttgccagtttttgctttggtgtaattgcttttggcaccttcatcatgaaatctttgcctgtgcctatattctgaatggtattgcctaggttgtcttccagggattttatagttttgggttttacatttaagtgtttaatccatcttgatttatttttgtatctggtataagaaaggagtacagttttaatcttctgtatatggctagccagttctcccagcaccatttatggaatagggaatcttttccccattgcttatttttgtcaggtttgtcaaaatcatatagttgcagatctgtggtcttatttctgggttctctattctgttccattggtctatgtgtctgtttttgtgccatgcagttttggttcatgtagccctgtaatatagtttgaagtcagctagtgtgatgtctccagctttgttccttttgcttatgattgttttggttattaaggatcctttttggttccatatgattttaaaatagtttttttctagttctgtgaagaatctcatggtagtttaacaggaatagcactgaatctataaattgtgttgggaagtattgctgttttaatgatattgattcttcctatccatgaacatggaatgttttttcatttgtttgtgtcatctctgagaaccctggtaagatacttaacaagaagatcatccccaagacacataatcatcagaatctccaagttcagataatttttagggcagggaaactattttgtatgacaccataattccagatacatgtcattatacgattgtccaaacccttagaatgtgcaacactaaaagtgaacgctaatgtaagctatggaccctggatgataatgatgtatcaatgtagcataatcaattctaacaaatgtacttctctggtggaggatgttaataacaggtgaggctatgcatgtgttggggcaggacacacatgagaattttctacattttctgctcttttttttttttttactatgaacctacagctgctctgaaaaataaaatctattaaaaagtggttaatgaatacaagttctctttgctcctatgtcctaaatacctggtaaaatagtaggcacaaagaatatgatcaatgaatcattatggaatgaaaacctaaaagacatctaaatctcagtgcgaacaagttgatcctaagaactgattttgataaaaggaagattgcagcactggggaccaaaaacaaaggagggtggttaagagatgaagacattcgatctagcacaatgaagctggggcaccccaaatatgcaacgtgtctgttttgctgagtacgagttctgatctatgtaaggccaactcaggactcttcccaagccctgcttgctgctgaaaattacatggaaggaattcttgctgtcagacaagaaaaatggcttcttgggtatgtcagggggtcaaaaccacactgcaaaaggtgctttcttgcatttcatacctcttcccattatttctccactgaaatcattccagtttccccataatgatcccttcttctggcaaaataagtcaaaaggcatgaggaattgaaaaagaaaaaatcagaggaatgaagactctagttcactctcattatcctccagataaaatggagctcctggtcagaaaattaggaggcctgacttctggtcttgaatttgttgtggccttggaaaatcttctgcctgtctcttacccttagatcattttctcacaaggaggtggacattataatatccttttttgccccacaatggctatggcccttgagtaaattgaaagaaggacattattataaagcagctctccatagtgatgtgtgttttactgacacacaaggccaggtaatgataatgatattttcttctgcaaaaaccccatgcactctcaaacacaaggcttgatctttgatagccatggttctcttagatgtcaagggtgacaggtactgatgtggcttatagtttttttgtaagcccaaattatttgctagcattgacatattggaatacacaaacacaaatgcataaaaatgatgatctagcactcctataactttgtaatgatttcaactctgatatggtttggccgtgtccccactcaaatctcatcaaaatgggaatttccctgcacaggctgtctctttgcctgctgcaattcatctaagatgtgacttgctcctccttgccttctgccatgattgtgaggcctcactagctatgtggaactgtaaatccattaaaactctttttcttcccagtcttgggtatgtctttataagctgcatgaaaatgaactaatacagtaaattggtttggggagtgggacactgctgaaaagatacccgaaaatgtggaagtgactttggaactgggtaacaagtagaggctggaccagtttggagggctcagaagaagacaggaaaatgtgggaaagtttgggactccctagagacttgttgaatggttttgaccaaaatgctgataatgatatggacaatgaaatccaggctgaggtggtctcagatggaaacggggaacttgttgggaactggagcaaaggtaactccttgttatgttttagcaaagagactggaggcattttgcccctgccctagagatttgtgaaactttgtacttgagagagatgatttagggtatctggcagaagaaatttctaagcagcaaagcattcaagaggtgacttgggtgctgttaaaggcattcagttttaaaaggcagagcataaaagtttggaaaatttgcagtttgacaatgggatagaaaagaaaatctcattttctgaggagaaatttaagccagctgcagaaatttgcataagtaatgaggagctgaatgttagtcacctagaaaatgtggaaaatgtctccagggcatctcagagacctagatctttatggcagcccctcccttcacagcactggaggtttagggggaaaaaatggttttgtcggccaggcccagggtccctcttccgtgtgcagtctagggacttcttgccctgcatcccagccactccaaccatgactaaaaggggccaaggtagagcttgggccacagcttcagatggtgtaagcctcaagtcttggcagcttccatgtggtgttgagcctgtgatggcacagaagtcaagaattgaggtttgggaacctctgcatagattttagaagatgtatggaaatgcctggaagcccaggagaagtttgctgcaggggtacagtcctcacggaaaacctctgctagggcagtgtagaagggaaatgtggggttgaagcccccatacagagtccatactggggcaccacctagtggagctgtgagaagagattgctatcctccagaccccagaatgatagatccactgacagtttgcattatgcgcctgaagaaaccgcagacactcaataccagcccatgaaagcagctgggagggaggctgtaccctgcaaagccacaggagtggagctgcccaagaccatgggaacccacctcttacatcagcatgacctggatatgagacatggagtcaaaggagcccattttggagctttaagatttgactgccacgctggattttagacttgcatgaggcctgtagcccctttgttttggccaatttctcccattgagaatggctgtatttacccaaagccagtacccccactgtatctaggaagtaactaaagtgcttttgattttacaggcttatagatggaagcaacttgccttatctcagatgagacttgggactttggacttttgagttaatgctgaaatgagttaagactttgggggactgttgggaggcatgattgattttgaaatgttaggacatgacatttggaaggggccaggcgtggaataatatggcttcactgtgtccccacctaaatctcatcttgaattcccacacattctgggagggaccctgtgggagataattgaatcatgtgggtgggtctttcctgtgctgttattgtgatagtgaataagtctcatgagatctgatggttttaaaaactagagtttccctgcacaagctctctctttgcctggtgccatccatgtaagatgtgacttgctactccttgccttccaccatgattgtgaggccttcccacccgttaaacctctttttctgcccagtctcaggtatgtctttatcagcagtgtgaaaatggactaataaaaattcactaatatatgccatgaattaacaatgaaatcggtatcaggtatatgaaaaggtgcttaacatcactgagcatcagagaagtgcaaatcaaaactacaatgagatatcatttcaccccagtcaaaatggctatatccaaatgacaggcagtttcaaatactggtgaggatatagagaaaagggaatccttttacattgttggtgggaatgtaaattagtacaatcactatggagaacagtttggatgttcctcaaaaaactaaaaattgagctatcatatgatccagcactcccactgctaggtatatacccaaaagaaaagaaatcagcatatcaaagagatatctgcactgctatgtttgttgcaccactgtttataatagccaagatttggaagcaacctcagtgttcatcaacagatgaatgataaagaaaatgtggtatgtatacacaatggagccacaaaaagaatgagaatccagtcattttcaacaacatggataaaactggagatcattatattaagtgaaataagccaggcacagaaagataaacgtcatattttctcacttattcgtggaatctaaaattcgaaacaattgaactcatggagattgagagtagaaggatagttacccgaggctggaaaggtagtggtgggaggtaggtggggggaaggtgggatggttaatgggtactaaaataaatagaaagaatgaataggacctactgtttcatagcacaacagggtgagtaaagtcaataataattgtacattttaaaataactcaaagagtataattgcattgtttgtaactcaaaggataaatgcttgaggggacagacaccccgttatccatcatgtgcttatttcacattgcatccttgtatcaaaacatctcatgtaccccataaatatatacacttattttgttcccacagaaattaaaaattgaaaacatttttaaaaactaaaaatggaactactacatgattcagcaatcccactactaggtatatatccaaaagaaaggaaatcagtatatcaaagatatctgtgctcccatggtgattgcagcactattcgcaatagccaagatttggaagaaatgtaagtgtctaccaacaaacgagaatggataaagaaaatgtggtacaaatacacaatgcactactatccagccataaaaaagaatgagatcctgtcattggcaacaacacgaatggaactggaggtcattatgttaagtgaaataagacaggcacagaaagacaaactttggatgttcccacttatttgtgggagctaaaaatagtaaaacaactgaacttatggatataatagaatgatggttaccagaggctgtgaagggcagtggtgggggaaatattgagatggttaatgggtacaaaaatatatttataaatttataaagaatgaataaaatctagtatttgatggcagaacaggttgattatggtaaacaatattttaatgtacacttaaaaataattaaagtgcataattggattgtttgtaacataaataaaggataaatgtttgaggtgatagatactcccccactccaaaaaaaaagagtggtggcagcagcattcataatattactgtctacaaactttaaaactctgtacaactacagagagagagaaagtgatgactagttggcttatctcccttagtgaagaaattggctagaagtggagaaaattggtcacttagggaatataattccccttattccttaggtcatagtagaagcaggaactttaacaagccatcacttgttgaatatggtctgtgcttgggagactgcccagtaattacatgatagggtaggacctagcagctaccctgaaggacttttgcactcagtcgagagaaacttttcaacatggaaaaaggagaaaactacaggcattaaattgtgtggcagagatatgatctgttatataggcaatcaagaagagatactggcattgtgtatgtaacagtgtccaataaatattttgaatgaaacagagatcagtggagaccccagatatctggaaggaacctatgtgtgttcacatatttgagctagcacataatgtgcatgggctctagacttactcttttgtgtgtaaataaggaggtaaggtgtggtgacattctacccctaaatattctttttacatctactactattcctgaaactctgctctgaagaaatcagttttggggggtgtagaaaacgtttgaactcttgatgtctctttctaaatgaggcttactcactccactatctgtttctttaccatgtgctgtgttctgtcttccacattactgattgtatctcctcagggtgtgtgagaggtgcacaggaaatgttttgttaaatggacaatgaatggagactttgtcaattgagtcctggcgtggaggaggaagaaatgggttctagcacatgagaaagaaaaagggcagatgggatataggaagagagatcagagagggaacaaatccctacttgtatctactgtttgttaagtagtatggtaggccatttatagacttaaaaaaataaactgtcaaaaaaatcctatgtagcagatattaatctccacttttagattaaagaaacagagactcagaaaggtttagtaacagctcaaggtgataagactagtaattgcggagccagaatttaaatgaagttacagatatgccaaaaggccatcttctttaaattataccaggctgctataccaaggagagagacttgaggacaagcaaggacttcagggatgcagtgaaagcactgtaagagaagggatgctcacacattttattatcaggcaacattgatattgaaatgcaatttcccatcaatgttcataattaatgcttgaccacaggagaattctcctttgcaaaactgaataggctgtgaagaacatggctctgttctatacttccatgtagctcttacagacctgtgcttaggagaaaaaaattcccaactcttgatatcagcccatgtaagcatgcaacttctttagtttaaagagggtgttcatttacccttcaggtttggtaatcacctgataaaaattactgaaattccacccgaacagtgctagtagcttccctcaaatcagctgcttgttcttttgttctgtaattacaaagatataatcacactgaattactataattttcaacattctgtcaccctattagtctgagttcttcaggggcaaggcttgggcctttttcttcttgattttctcaaatatctcaccagagtgcttggcacatactagacattcagtaaatgcttagttgaacaaatgcataagaagttaatcaatcaaatcaatgactgaatgaataaatggtgcttgtcccctgcaaaatcctctttgagcagtctaattctctatgtaataagcaggagcctttaccaaatgtgatccattggtcaataaaggttgctgactgacatcttaaaagcatacttcggtggaataaacatttaccagcactgaaagtcagcagagagattaaataaaggataaacatcgctggctgtttccctggcaataaaggggcatctggtctgtggcataggatacagacgtgctctttctttaaactctcttataattggtcagaagaaggaagtaaacagaaatcctgatggaatttaagagtctctgagggattgaaatatatgcagaaaaaaaaaccagatttcatttggatatataaagatagatgtctcaagatgagtaatataatgaaggctgacaaatgatacctgaggcaatcctctttgtttttggttcttgttagccatgccaccttccaggtcacagccaggcaaggtaccaacagaatgaaaatcattatttataagcagttcaatccaaggtcaaatttattgtcccgcaaatattcatcagataagactaaggctgtttctactcatgtgatggatgagccaccagaaaacccctctgaccacgacttttgtctagacttattttcatgaaagataaagacaagacggaaaaggacttttgtcagtcagactaaaagacgtgattggaatgtatgtgacatttctgttaaggcaggatggtctagtagtgcaggagacagccatctaggttgcagtcaagaatccttcccttcccagacacatgaccttggggaagtcactggtcctctgtcatatctgtagacaggataaatgactcttacccaaccaccttacaaagctgctattaggatcaaatggaataatgtccctgagatgcctttgtaaattatattgcactatgcaaacataagcctggtatcttcatggtgaacagcgaaaaaaaaaagacaagaataaaagagaaaaaaaagaaaatgaatggcaaattaagactaagagaaaggaggaggagaaagtttctgtagagaagggaggggaaagggagaaaatacagaaaataaaaggggccaagggaggaaccggtagaggagaaggaaagatgcagcagtggcaatgaacgatctcataattctggcacacaggtagataaataggcaaacaaacacataaacataaaaccgaaggaacagcagaactggtcagccatgggatttagaaaatcatgtctatgtcaagaccacagagctctgataagcaagtggaagaccccatcaggcagcctcttaggaggagacagtgagtcaaccatgagtcagcctccttattataaatttctaaatggaaagcactactgagttcatgttgttctcatctgtgctctgctcagtcatacactcagacagatttgtaatcattgtgcagccattgataatgaccttttctttgcctagtcaaggtctattggtcattcagataagagccttccatgacctccctgaccaccccgacaaagtcagatgccctattataggtactcagagcatcacagtcccccctttttttttcacagagcttgacacagtaacagatttatatttatttgtgtgattattcaattaatgtctcattttctcccccagactgaggacagagtcaatgtctgctttgctcatcattatattcctaattgaatttattggttggcatcatcataaacagaatcaagttaaaaaaggacagtattcaaagagaggtaatggtgcaaatgtcaagaagaggttggtgctggggctacagttagaaagtttgggacagataaaatctttttgatagtttaagcaactaaatcttgtcatggaataatggttctggttttcattttcataacagacttatgactgggtgcttttttgctcctcgttggttaattcagcatattaactagctctttagtgacatctcagtcaatgtcatgggtgagcatattattattagcattaataactgtgagtactgattaagaggggcaattttctagttggatattctgcagcacgctgttttggatatatttaattatataacaacgaggagaaagtttattcacaattacattgagaccatttttaaacccatttattaaaactttaaaaggttttcaaggaagatatacacggtatgataagtaatcatgctgaaactcaactatgtccagaaaatagggagtatttaaaaaataaacatctctaacttcaattgcccagtggattctgtggcagccctacaaggtcaatactactggcattgagcagcccgcagtatgtgagtccactaaacagggcagctcaataattctcataacgagactcctgacctgtgacttcccggcttcttcctagtcctgctgggcaaaccagaagcctacagtttggagatattattcctccattttttctaattcggtacatttcaaggtgagtggaatcattatacaagtttgttccccatttaataacatttttatttgaaagtagatttttgacaatgattctagttaacaaaaaactccaaaacctcagaaatcatattgagctctactttgtattttaatgtcttactcaggcctccaggttggccaactcataataacaaaacacatacaagtttggggaggtaggaaagggtagtgacttaaaaatgtgggctcaaatctcagttctgctacttaacttctccaagctttagtgtcttaatccataaagtgggttaaaggtacctaaattgttattagagcaaaatgagagccacataaaacacttacaacacatatcagttactattaaattaaaatatacaatatttaatgttatatttttagcccttaaatatagaaaaaatattctttttgaactttagagtctgtgtgttttcaatacctgctttaatgatacagtactctgtattcttcgatttatgtttatttttcttcattttaaggaaggctttcttttatggaacaataatgatgatagtggataacgtctatacaagtatttacctagaaaatctagattttctatgtcatcttgcaaaatatttttgctattttgttagtccttgaaattccacgtttggaaacttctgtctgttctaaacaagaatcaatggtttgtttatgtatttatttatttttacacagttgttatttgaaaagcagatggcaacagaaatccagtccctgtgagagaattagaacccatgtcttcatagcccttaaatatttcctagctctccatagtctcagcattttttcaacactgataaatttgggagactccttaaagattgctgtgatgacaccttttatattttaagcgctacacatgtaaggaaaaagattataaggcctagaaaaggatgtcttacggagtaaggaaatggaaaaaaaaatctgttcaccctttgaaatgaggctaaggaaaaggagctgacagctcaagtaggaggagaggtggaaattccagggacacaaggaaaaatgaaaaggaagcacgtgatgctgaactggggggacagcgatggtcagaggaatttgctgctctgacagattcctaatgaatcccctcgtttttaaactctgaagatctatctcccccacccagggatggaaggaaggcctgcaaactttttgagtccttccaaacagttaagatgtttttagcaggtgacctggcagcattaataaggttgggactctcaaccaaagctttcttacccagaactttcttattcaggagacaggtctgtctttattggactataagtcacaaacataaatctttttggggggagcagtttgatttcttccgatcatttctaaaaatcaaatgggtgctcatctccttacttttcccatattctttataaataaactcttcagctgacaggaaagcaaaataaagagaatgacacatacatataaatacatatatacatatgtgtgtgtatatatacatatacataaatacacatataaacatacacataaaataaaatgaatattattttaatacattctaaaaatagacaaaaatcctttgccctttacccaacttgcttctctgttttgatagagtcacttaaatatctgtgataagcaaaggctcagattttcgaccagcgaccctagcaactaacagcttaaaaaaaaaatctcttccaagtttcaaagagcacttccataattcagtatatttatcagcatgtcaactcctccctgtccccaacactacttagcactacttttgaaggtcagggtgtgctgaaggaagttgagcattcacactgattacaaatcctgaggtacagatggatctctgaatgtgtggatagagatgactcaagccaactagcccaaagggccagctacctaaagtccaacggtcccttaaaagtttacgctccataactaggaatattcctagaagtccataagccaaaattttgtctccaaaatgttagatttggaaggcatctaataccttgtttatttaactcaacctgatcacttcgtatatgagataacagacatcttgccaaaatcacacagtaagaaatgttagatctgggttctatgtactgattcaaagatgacctggtgattttcggatcacattctgccatgatcatatattttggaaccaaacatctgagtacttagaggaaaaaaagacgagtcttttaggtcagcatcatcctgggaaatctgaagcacattagctttaaaaaaaaagcttttcccacccaggcaaaaggagtaaaggagagaacaagagagagaataattccattagaggtcttgtttccagatgttccttggaaaggatacctgagctcaggctcagaacaccagagtctccccagccccaatggagccatggtttcatgagcctaggtggccttaaagtatgggaagggtgtcttttgtgccaaacagtggtacatggctgtccctatggagttaggcctgccctggtgagaaagtacaatagcagtatcatcacaaaccagttaacttgaaaggatgggttcccttagatctgtttataagtaaaactactttttgtttttctttttgatactcatatacttctggatttgggagacatttttggtggggttagttagacaaactatttattccataaaggattccttgaagaatttccctgaaggtggtcatttagtttccttttaagtgctacttgtaaaggctggccaacccctttcagggcagctgttttaccaatgtgaaaatgctactagaatttgtactagaaaattctgccattaagtgtgtcactaaatgaccttgtaaggtaacataaagtgccttctcctagatgaaagaaagctttctgagtagctgaagatacttcttactcttagcagtgttaacaaaatgcttctaggtttttgcacgtgattttattttctatttttttaacctctgccttgctgcagacacatcccttaaaattcaatttgtgccacctcccctgagaatcctcccttcctttccagaggcaaatgcttttaaccatttcagcttttaaaaaatttgtatacatttaagaggtacaagtgcaattttgtcacatggccatattccacagtggtgaagcctgtgcttttagtgtatccatcaacagaataatgtacattttacccaccaagtaatttcgcactgtccaacctcctcgaagtatttcactctattgagtctccaatgtccatgtgtatatattatttagctcccatttataagtgagaatatgtggcattcgtctttctgtttctgattgtttcacttaagataatggcctccagttccacacatgttgctgaaaatgacatgatttcattctttttatggctgaatagtattccattgtgtatatataccacattttattcatccagtcattcgttgataggcacttaggttgattaggctttttaacggaaaggtttgaggttaagccagaaaacatgaaactgtgccccaaactagcacactgtgaagggctcagctgtgggggccaactctcaaactagctcatctaggtgctacagaagagtgattcaattttttctgagaagaagcttcttttttttggtattcagcggtgtgcatgctaattgggggactcttcattcctattctcagactctgctttcaatcccatctgttgtcactaccctaacgtctctgagttttccgggtttggctaggcagatctgctctttgctgagctgtaggccccttcacatagtgctactgcactgtggtagggcttcttgtgggtggcaactcgggagacataatccgaggaaatgtcattctaatagaatgcaatgtaaaaggtaccccctggagttgtacaaccctgtttccataggtgatcaaaggctgagattactttgtttttcaccgatcaatacccttcaatcagctttctgttgcaaagaaatataatgaaaccatttggcctttgatgcccccttctatttccttgatcactaggagactgtccttttaaacaaatattattatcccattagcttccttttaatagggtctcaggagaaagaggagattagggtgtgggctgtgtctgtcaacttgaaactgaaaccagaacttattctgctaatagggatattattcttcctcattttgtctggcataattatagatgattcagatatcaatttaaaaacagcagtgactctatggtagaggactcaattagatagttttgttgtctcaatggatcaaattaactggaaatctgaaatatctccacttattttatgtcaagtaaatagcaacttgggtgaaaattatataaacatatggccttttaaactacattcatttaaaaaatatcctatgtagttgcttttcacaaaagcattaggaaggagagttttcaaataatgggatttgcaatttcagttgattgcctacactgagcagtataacactttaatgggaaacctgttaaagacccattggcctatgtaagatgaaaaataactttcccactatgtgcacgttatctcttcatctgacaaccagctgggcatgtatagcacaaatttttgtgttctggactttgtagaggattactgagacttcgccttctaaatatttcagtaatgctaagttatttctacctgaaatatttcattttatatccagaagtgttttacataaacaaatacatataaacatatttaaaagcaagtgttcaaaataagtcttcaaactaatctagcctataaaaataaattttgttttttttcagaacacttagactaagtgtatatttaactagtacttattgacggtccaatatgtacctgatacttttatttttaaaaattggtgagtttgggctgggcatagtggctcacacctgtaatcccagcactttgggaggctggggcgggcagatcacaaggtcaggcgtttgagaccagcctggcaaatatggtgaaaccccgtctctactaaaaatacaaaaagtagctggcgtggtggtgtgtgtctgtagtcccagctattcgggaggctgaggccggagaatcgcctgaacccagaaggtggaggttgcagtgagccgagatcacgccacttcacttcaatctgggtgacagagcgagactccatctcaaacaaattggcgagttgtatactattttcccttttagctgttgaggaaacccatgcttagagaggtgaaggtcgctgatcaacaacaaatggtagaggccaggactcaaaccaaattctttgactctagagtaagttttcttccattcttatagggaatagaatatattgtgttattcactagatataaggcaaattgctttatgctagttgggacaatagatcactatgaagtttatacagtttgctatttttttgtaaaaggagtcactctggtgttttgaagttagggtaacacctttacatttttggcctcatcagagaagaagaaatggtgattatgtcaactacagagttcctctaactcaagtggaaaacagtggaaattgaaaaatattcttagggcaaattgctaataagcttttgctaataaaaagaaagaaaacaaaagtttggagatagccttagaaggaaatgccattattcatcatagttgaaggaagtctactttgtgctgatggccaaaatgtgaaatgatagccaccctgagccctgccaagagaggtcttcaaaaggaataataaagtgaggtagagacagtggtaaaattagtccccacacccttacctctactgcaaacaacacctcagctacatagtatgcacatggacctctagtaccatcccaaacagcaggttattgattctatttaaagatttttaaggttagagtcattctagttcttcattatttttttcacacttaggaaattctgcacgatgtctaacttagcctgaatgtggtttatgaattgtacaaccagtgctctccacctcaataaagtcttttcgtaccacattatagaggacagagccacacagtggagtcaagcttgatttcaagtccaagctatgctactttctatacaagtacacttgggaaaattacttaaactctctgagaatcagtgttcagaaaaaaaaatacctatcttgtaggactactttagaaataaaatcaggtaagacaggtgatgtggtttggctgtgtgtccccacccaaatctcatcttaaactgtactcctacaattcccacgtgttgtgggagggacctggtgggagataactgaatcatggggcagcttctcccatactgttttcatgacagtgaataagtctcatgagatctgatggttttataaggggaaaccttataaaaccttggctctcattctctttcttgctgccatgtaagaagtgccttttgccatctgccatgattgtgaggcctccctagctacatggaaatgcaactccactaaacctctttcttttgttaattgctcaggctcaggtatgtctttatcagcatcgtgaaaatggactaatacaacaggtgattggtagataaatagatagagcctggcaccaataagcactcagtaaatgttagttttttttcttcccttggaggaatatttatgaacttgtgctgttgggcaaatatccatgtatgcttcagtcctcagctcaagagttacatcttttcaggaaccaacatgacctgctccctagtaccctttggatgaccatttacagttaggtatccctcctggattctccattaatcccttatgcatatctcctatagagtgtaatgcttacactgtatcacaagtgtgtgtttgtatttctatcatttgtactagacaatgaagccctctggagggcaagaagaaatcttgtttgacttattaaatctagtacctagcacagtgcttggcacataaggtgagtttcctagatatttgctgattgaaagaaaaaaagagagagagtgtgtgcgtgtgagagagacagagaaagaagagtggggaggtagggaaggaaagaaagaaagatagaaagagaaagagagaaaaaaggacaaaagaaagagaaagaaagacagaaaaaaagaaagaaagaaagacaaagaaagaagggaaggaaggaaggaaagaaggaaggaaggggagaaggaaggaagggaggaaggaaggaaagaaggaagggagggagggagggaaggagaaagagagacagagacagggagagaaaggaagacttcatattccaaggctgcacagtttaagaggttctgtattattatcttacccttccagggagacggcccgttggagagtcattgaaggctgacgagttgcggtgctatgttgggaatgactgcaagaaaagacagaagaaacacacatcatttatttattttttatttttttatttttttattatactttaagttttagggtacatgtgcacaacgtgcaggttagttacatatgtatacatgtgccatgttggtgtgctgcacccattaactcgtcatttaacattagatatatctcctaatgctaaccctccaagaaacacagatcatttatttaaaatgtttttgaacattttaatcggtcctattgtcaataaccagtcttgaaagaaatacagtagagattaaatatttggtgataggtagaaccctccaccaaaatatagtactctaccagataagagttaatttttttataatttgattttaatatgtattattcaaaagtaagcttttaacgataggtgaacattaaaatgaacaaacatatttggaaaaggtaattttttgcccttggaatgagataacacagagcataaaaacatacatttctttatgatgcaatgtattttttaagctgcagaataattttttctaacaaaattttacacagaacctaatctgtaaatcaggtaaattatatttagttagtatagatgtatttattagttcaaatttgcaacacttattgtaaaattagttaataataattgagctatttgatgaacacaaaacttgaaaaatgagacttccagctgcatatcaatcttcaaatttaatgtagttctagattttgattacctgtaacaagaaaagactgattttgtagataagtaatataaataaaatgataatatctaacatttattgagatctgaaacacttttctaagtgtttttaaatttttatgtctcttatttctcataaatgtatgaggtatgtcccattcaacagatgaagaaattgagatacagagaggattagaaagttgctcagagtcacatggtaacttcctgtgcctgaaatggcattgagactgtttgattctagagtcattttaaattcttacaacaatttttcacatttttaagaattcatcttggaatcttagaatattctttagaaagagatggcaagagaatctttcatctgagataggcacaataataataattcaacagccaactttactgaatgtgtaattttagtttatagtattagttaaatattttggttgaaacactatttacatatacacataatatatgaacaagtgtatatatacatatatgtataaaagaaacctgagtctaggatttctcagcacaaacatggcaaatgctgacattgccacagagaatcaaactacaggctgcagagtctttcattcagaaccttggtcaccacaggtgggaagaggtgttttcctgtgacacgtagataatatttgtctaaggttgagggtacagaattttgagaccatagctgaaacctacagaatcatattcaagttaaagactgtgcctcttcaagttaaagactgtgtttcctggtatccctcacagtgccaagatattcattgatcatgttttcaattgactagttgaaaagcatcgtagtattcaggacttggactatgtagccagactgcctggctcaaccacatataccaatgtaaccttgtatatattacttaaatcgctctgtatgtcagcttctcatcttataagactgggatagtaacaggactttcctcacagggttattataagaattaaatgaatacagtatttagaacaatggctctcacatggtaaagctatataagcatttgttaaataaataaaccattatgatttagcagagcgtgtactttgagatgtttagtaccaaataagaataattactgtatttagaccacttcagttagtcatacagtcagtgccacaaggtgtatatttctgtgtataactttagtgataaatatcaaattaaaatatattttctattacaaaaatatcataaatttacaagcatataaaataaaacattttctattaaaaaatattacaaaattactggaaataaaaatgagaaattaaaaatattcacctatactcctattaccttctttcacattttaccgagttatctaatgtagttcttataggagtcctctaaggtagatataagtattcccatacacaagaaaacaaaacatatagaatttaaaatgattttcagaaatcaacagcttgcaaatgtggagccagagtccaaactaaagcctaccttatcaccaagtgggtgtactttccattctatcttactgactctctacgtgtccatatgtatttcacatagttgtatatatatacagaaacatatgtaacttcatatcctctgcttttcctaacatttaagcatttctaatatggtctctataattattattttggagttacataacgttacttcctatgaagatataattaattaaccaccgttgatagttggatatttgggtgatgtttacggctttaatattataaacagtgctgcaatgaacatgttgatatcaattacttttttcttattttacaattttcttcagatgcgtttcccaaaatggaaatgcttattagtttcttgatttatgttattaattacttttcaaaagctttgtatcattttattgcctctaaaaatgtgtatctgtactagtttccccacagtcttaaaagcactgacattataacttttaaaacaccctaacaatttaatagatgaagaatgatgcatcagatttgtaatgagcatttctttgtttattagtgagaatgaccatttttttccgtatacttattggctaattgtatatcttttgtgcaaaatgtctaatcctttcctttaccatttattttccactgatctagaaagtaccaacagttcttaggcagctcaattatggtcactaaccaagattaataagtaactgtaatttctgatagctttctcatcattagctcagcccaaaattaaaacaaaaaaaattcagtaatctcacttcacttatcattaccttataactaattattttgttattctactctattccaataatatcctctttaaagttttagcgacaaagtaaatgcaaatggtaccctgaggtgcacagagaatttgactccttttatattacacatgcaaggttagccagtttctcctagcatgtagatttggaacaaacagagccttttccaaaatgtaattatcctttcactctcttctaagacaaatacagtgaactaagataaatagagtcaagacctgtggacacaaatgaatttttgttattcccaaatataatagtaatgtccaagctatacttgcaggagggatgcttgtagtggatgtttggagctacctgatggtgactacaactggtattttaaagaacaccaaacatttttcccttcggaccaagtaggttctatcgtttccacattattggctacataaacaatgtggtgtagagttaccatcgctaagaaattacaggtaaccttttcctgtctctttcacctcctcaggaagagaggccagtcagatggaattctgagaactgttgtagaaagaaccaagggaggaaatcacagctaaaacatgctgctctgttctgccatctcattttcctacatatccataatagcacccagggctatgaatcactaagatttattcacatgcccatttctcctacaaagtcatgtgtgctttcagagcaaagtattgggtttcttcatctatacattcgcagctcagggttggcacacaaaagacccttcatcaatgtctttttgaatgatgaataccatggattgaattccatctatctgtaaggcccccatgacttcttgcttttaaattctgcaatagcatcaagaactaggtttcatccccattttcaagggaaaaaagtgcttgctcctctgagacaaaccatattgttttataaaaagttgaaatcaaagctctgtgactggtctatatagagcacctgaaacacattgttagaaaatactgaactcccactgagtaacactgacaaattctttttttctttggtataaataccacccattatttttaccacatatgctcaacttccacgtcagtgacttttgaagatgatttttatgaagatcacttaataaaggaacttctctgtcccacccacaccacctcattagtaagtcatgaacattcatgaagatttaagtgacaatgaatagtgggtgggtagaatgagcatgagggaggctcagcatcatgctacaacatggatgctggagaagaagtcccctgtcgcctggtagaaaacctgtggcaccaattccctagttaggtagcttggctgaggtactaaattgggcaactgtggagataaatattactaagcctttttaagattcaaagagaggtataagccctattgcctgtccaaatgatgctgtcattaaataaaattgaggaagtgcacaatagagtttcctttccaagaactctctgattttttccaagtaaaagactccaaactgttgcctaaaaaatgaaatttgaatggtgctgaaagatgtattcccattgctgtgcttaattaagaaatttttgagcatctgaattgaaattgttctattacacatggaacacaaaggtcctagctggtggtaacaaatggcttttaaattttctccttctctgaggcaatgagaggcaggataagtggtttttccaatatgttgtaatattaaaactatgttattctaatggacagcacaaaaagttttttgtgtactttattaattaactgataacaataaagttacttaatgtgacttgtaaagtcacattcatcattaacatatcttcttatggatattcaatattgcctatttttccacttctaatgaacttgcatttatccttgtcatatttaactcttcatctctctcttgcatatttgtatccatcatttatttaatctaccttaatatttctttcttctctttttctgtctactttccttctctcttaatatagcgcatgcattaaattgtcactattcttaaaaagaagagtatgtcttggatatccaatcagtacctcaaatttaacataattaaaacgtcatcaccttcccacatgaaactggatagtcctccagttgtttcattgacacttaacatgaagtgtcttgtacaattacttatatgttgtagttatacccaataaatgttaattgggcacttattatacaccagggattgtgttaggtgcttgggatgactctttcattcctcaatattgtagtactcaataaatatctggtaataaagagaatgatgaaagcaaataaatcatttggcccatgtccaaataacatggatagcatttttcaataaatccccaggcatatttaattggcaaactacctaagctatgtttggaagaatatataagtattttaaaggatggtgaaggaaaacaagacattttgagactcatgaagagcatgaccaagatcatgaagggtcaaaaatatgtggtgtgctctggaaacttgagtgtcttggcttggccagagcagagtggccaggggtaaggtcaggaagctgactgtggatgggcaatgagggacaatgaataccctgccaaggtctggtcttacacctgttggcaatggtgggctctccaaggttattaagtggggggaataaaggggtcaagatggagataacagtgattcagaaaagtaaacctgaaactattctgaataatgaaaggaagtggaggaaatctatagtcagggagactaatagtaaaccatcagggtgaagaatattaataaatgcctaaacttgaataatgcagtaaaaattaagaaaagagaatgtatttaatacatttagaggtagaatattcaggaattaataagaaggagctaaggagaagacactttgattccagtgatctggctgggtaggcatttctcctcctgaaagtgaaattatcctacatataaagggccctgtttttcccagggtataggaagagttgtgctctcttctgtgacttttaagcaagccttcaaaaatagacagactctggtgttaggattgggggaggtgaggaagaatgaatggagaattccaccattgactgaaaggaccacggctctattaacagaagtgcatgtgtgtaaaggaaagtgcaagtgtggatagaaaaatataattgaatttgattttgtacaagattagcttgatgaacctgttacacatgtgggaaatatgatctatagtggacatctataattattaaaaagttcttccttctcttggcgtgatacccatctgtccacagtagccactggatgactgagatattccttgcatcttcaacccttacaaataaacattcataacacttttgattctttctttatgagatagtttcaaggttcttagttatctttgcttgtatgtgcttacatttttcttctgatatctattaagttggtgcaaaagtaatagtggttttttccatttttttaaaaaaaatgataaaaaccgtgattacttttgcaccaatctaatatttaaactgcagaatgtagaaatgaactcatagttccagatgtgttcagatcagggaagagtgccatgagatgctgacttttctccatttggatcccatactcctgtcatagcagcccaagataacatggacttttacaatttgctgaattttattgctaagcttagagtccactgaacctcttatatatttgtgacctcaaatgattaaaaatcaaatctatcatgtacttacacattggattttgggacccaatatagttaccacatgttaaatttaatggtaccgattttgatctagattttaagtttgttaagctaacattcagttatcaatttaattcaataagtatttattgagcatttaagatgtgttggccattatagaatttcactatttcatctagctttatatcatcaaattttacatttttatttaagtcattgattataataaggcataaggactgtgcattgtggcaaatcatcacagatctccctccagtgtaatagttagtccacaagttgcgctgttgagctctcttaagcagcatccttttaatagactaaccaatcttctccactctgtcagtgacaggcagaccaatgtccacagcaagcagaatgtttatgtcccataaatttccattcctttcaggtgatttgcatactaacaaagaatcaattgtaattattcttaaatctgtttattcttattgcatttgtttttataattacataattaaatgttgcaaaaatgaaatgtgtacaaaaaagccttgtctctatcaagagtaagttttctgatcttgaaaatctaaaaaaaagtatgtattaatagttaaaaatattgctgtcaaattaggtctgagagagataagatcaaaaaatattataaaataaagaatttttcacttagttcacttttaattcttacctacatttaaagaaatccagcatggaaagtatggatgatggattaagttataatttacgtaagaaaaatgaaatagaacttcagaaaaaaaatgggtcccaggtttctggccttacaagtcaatttggtatgccaaatattttaaagcaattaaagaacaatttagacattggaaataacaccatcaaaactgtggccagacgttgaaaattccagaaaaaatcttgaccctcacatataaaaaaaagatgaaggaacacaatatgttaactgttctcaaattaaaagtgtggatgacttatagaaatgcaaagtgtaagattgtactaatgataatttgcttaaagttaaaattgtggacaattaagaaatcaagcatgttgggacaaacagatggatataagtatgaagaaaaacattaaatcaaatttagagcccccaatttttcattccatagccaaagatactcaaaatgtgcttttactttatattaaatggcttcactcaacagtcagcaatgacgtggtgactcaaaaaataaattggatatgctttattgggagaaataccatttttttcttttaaataccaataaaacactcattttattatgccactatacaatcatatttttaaaacttaaagtgaagtaattaagacatgcaggcagttttttaaataaatgaaatgtttaaatccaaactttagactaacaagtcaataactggttctggatgtgcagggtaggaaaagttctcttatatgaatgtctaataggattatcaaccaggtattagttctttccttatctttaaagaatagcatgggagaatttggagtcttcttataaaggagaattaggttaagttgcacagccagaatgtggttaaggtgagatcgaagacagatgcaattctcagcccttggttttctccatcctgtgccactgcgacccatattcttctctgtgacaacagttaaatgacgaacatggcagcccaaacactggccaatcaagcatgtttgtcccagcatgcttgatttcttaattgcccacaattttaactttaaacaaattatcattagtacaatcttacactttgcatttctataagtcatccacacttttaatttgagaacagttaacatatcgtgttccttcatcttttttttatatgtgagggtcaagattttttctggaattttcaacgtctggccacagttttgatggtgttatttccaatgtctaaattgttctttaattgctttaaaatatttggcataccgaattgacttgtaaggccagaaacctgggacccattttttttctgaagttctatttcatttttcttatataaattataccttaatccatcatccatactttccatgctggatttctttaaatttaggtaagaattaaaagtgaactaagtgaaaaatctaaaaatcccactcatcactgttaggtagctgagagactctgagagtacacttcaaatgctgaactaatctccatgaaaaactctttgctttaaagcaataatgagaaatctcagcattttgcccagtggactgactcaaatggattatgactggcctcaaagcctgaaacaccaggagcaaaatatagtgttttaacacagcgggcatattcctgcctttactcattttgttttgggtggctagctatacatcattcttctaggcttttgtagtataaaagctgcatctcagaaagcaataaggcacttagtaatgtatgaacatgtatacaaaaaaaaaaaaaccctttccccacagaccattcttcacaaagaaaatgaaaaactgaatttattatagcttaaatcaggtattagatagttccataaatgtagctacttcaaaaaggaaagcaaattttagttagaaattttatagagctggtggagccaagatggccgaataggaacagctccggtctacagctcccagcgtgagtgacgcagaagacgggtgatttctgcatttccaactgaagtaccgggttcatctcactagggagtgccagacagtgggtacaggacagtgggtgcagggcaccatgcgcgagccgaagcagggcgaggcattgcctcacttgggaagcacaaggggtcagggagtttcctttcctagtcaaagaaaggggtgacagatggcacctggaaaatcgggtcactcccaccctaatactgcgcttttccgacgggcttaaaaaacggcgcaccaggagattatatcccgcatctggctcggagggtcctacgcccacagagtctcactgattgctagcacagcagtctgagattaaactgtaaggcggcagcgaggctagggggaggggcgcccgccattgcccaggcttgcttaggtaaacaaagcagctgggaaactggaactgggtagagcccaccacagctcaaggaggcctgcttgcctctgtaggatccacctctgggggcagggcacagacaaacaaaaagacagcagtaacctttgcagacttaaatgtccctgtcggacagctttgaagagagcagtggttctcccaggatgcagctggagatctgaggacgggcagactgcctcctcaagtgggtccctgacccctgactaccaagcagcctaactggaaggcaccccccagtaggggcagactgacacctcacacagccagatactcctctgagacaaaacttccagaggaacgatcagacatcagcattcgcggttcacaaaaatccactgttctgcagccaccgctgctggtacccaggcaaacagggtctggagtggacctctagcaaactccaacagacctgcagctgagggtcctgtctgttagaaggaaaactaacaaacagaaaggatatccacaccaaaaacccatctgtacaacaccatcatcaaagaccaaaagtagataaaaccacaaagatggggaaaaaacagaacagaaaaactggaaactctaaaaagcagagcgcctctcctcctccaaaggaacgcagtttctcaccagcaacggaacaaagctggacagagaatgactttgacaagttgagagaagaaggcttcagagcatcaaactactccaagctacaggaggaaattcaaaccaaagacaaagaaggtaaaaactttgaaaaaaatttagacgaatgtataactagaataaccaatacagagaagtgcttaaaggagctgatggagctgaaagccaaggctcgagaactacgtgaagaatgcagaaacctcaggagccaatgtgatcaactggaagaaagggtatcagtgatggaagatgaaatgaatgaaatgaagtgacaaaggaagtttagagaaaaaaagaataaaaagaaacgaacaaagcctccaagaaatatgggactatgtgaaaagaccaaatctacatctgattggtgtacctgaaagtgacgaggagaatggaatcaagctggaaaacactctacaggatattatccaggagaacttccccaatctagcaaggcaggccaacattcagattcaggaaatacagagaacgccacaaagatactccttgagaagagcaactccaagacacataattgtcagattcaccaaagttgaaatgaaggaaaaaatgttaagggcagccagagagaaaggtcgggttacccacaaagggaagcccatcagactaacagcggatctcttggcagaaactctacaagccagaatagagtgggggccaatattcaactttcttaaagaaaagaattttcaacccagaatttcatatccagccaaactaagcttcataagtgaaggagaaataaaatactttacagacaagcaaatgctgagatattttgtcaccaccaggcctgccctaaaagagctcctgaaggaagcactaaacatggaaaggaacaactgctaccagccactgaaaaatcatgccaaattgtaaagatcatcgaggctaggaagaaactgcatcaactaacgaccaaaataaccagctaacatcataatgacaggatcaaattcacacataacaatattaaccttaactgtaagtggactaaatgctccaattaaaagacacagactggcaaattggataaagagtcaagacccatcagtgtgctgtattcaggaaacccatctcatgtgcagagacacatataggctcaaaataaaaggatggaggaagatctaccaagcaaatgggaaacaaaaaaggcaggggttgcaatcctagtctctgataaaacagactttaaaccaacaaagatcaaaagagacaaagaaggccattacataatggtaaagggatcaattcaacaagaagaactaactatccaaaatgtacatgcacccaatacatgagcacccagattcataaagcaagtcctgagtgacctacaaaaagacttagactcccacacaataataatgggagactttaacaccccactgtcaacaatagacagatgaatgagacagaaagttaaaaaggatacccaggaattgaactcagctctgcaccaagcagacctaatagacatctacagaactctccaccccaaatcaacagaatatacatttttttcagcaccacaccacacctattccaaaattgaccacatacttggaaataaagctctcctcagcaaatgtaaaagatcagaaattataacaaactgtctctcagaccacagcgcaatcaaactaaaactcaggattaagaaactcactcaaaaccactcaactacatggaaactgaacaacctgctcctgaatgactactgggtacataacgaaatgaaggcagaaataaagatgttctttgaaaccaacgacaacaaagacacaacataccagaatctctgggacacattcaaagcagtgtgtagagggaaatttatagcactaaatgcccacaagagaaagcaggaaagatccaaaattgacaccctaacatcacaattaaaagaactagaaaagcaagagcaaacacatttgaaagctagcataaggcgagaaataactaagatcagagcagaactgaaggaaatagagacacaaaaaacccttcaaaaaattaatgaatccaggagttggttttttgaaaggatcaacaaaattgatagaccactagcaagactaataaagaagaaaagagagaagaatcaaacagacgcaataaaaaatgataaaggggatatcaccaccgatctcacagaaatacaaactaccatcagagaatactacaaacacctctacgcaaataaactagaaaatctagaagaaatggataaattcctcgacacatacaccctcccaagactaaaccaggaagaagttgaatctctgaatagaccaataacaggctctgaaattgtggcaataatcaatagcttaccaaccaaaaagagtccaggaccagacggattcacagccgaattctaccagaggtataaggaggaactcgtaccattccttgtgaaactattccaatcaatagaaaaagagggaatcctccctaactcattttatgaggccagcatcatcctgataccaaagccaggcagagacacaaacaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatacgcaaatcaataaatgtaatccagcatataaacggaaccaaagacaaaaaccacaggattatctcaatagatgcagaaaaggcctttgacaaaattcaacaacgcttcatgctaaaaactctcaataaattaggtattgataggacgtatctcaaaataataagagctatctatgacaaacccacagccaatatcatactgaatgggcaaaaactggaagcattccctttgaaaactggcacaagacagggatgccctctctcaccactcctgttcaacacagtgttggaagttctggccagggcaattaggcaggagaaggaaataaagggtattcaattaggaaaagaggaagtcaaattgtccctgtttgcagacgacatgattgtatatctagaaaaccccatcgtctcagcccaaaatctccttaagctgataagcaacttcagcaaagtctcaggatacattatcaatgtacaaaaatcacaagcattcttatacacaaataacagacaaacagagagccaaatcatgagtgaactcccattcacaattgcttcaaagagaataaaatacctaggaatcccacttacaagggatgtgaaggacctcttcaaggagaactacaaaccactgctcaatgaaataaaagaggatacaaacaaatggaagaacattccatgctcatgggtaggaagaatcaatattgtgaaaattgccatactgcccaaggtaatttatagattcaatgccatccccatcaagctaccaatgactttcttcacagaattggaaaaactactttaaagttcatatggaaccaaaaaagagccctcatcaccaagtcaatcctaagccaaaagaacaaagctggaggcatcacgttacctgacttcaaacttgtagtatactacaaggctacagtaaccaaaacagcatggtactggtaccaaaacagagatatagatcaatggaacagaacagagccctcagaaataaagccgcatatctacaactatctgatctttgacaaacctgagaaaaacaagcaatggggaaaggattccgtatttaatacatggtgctgggaaaactggctagccatatgtagaaagctgaaactggatctcttccttacaccttacacaaaagttaattcaagatggattaaagacttaaatgttagacctaaaaccataaaaaccctagaagaaaacctaggcattaccattcaggacataggcatgggcaaggacttcatgtctaaaacaccaaaagcaatggcaacaacagccaaaattgacaaatgggatctaattaaactaaagagcttctgcacagcaaaagaaactaccatcagagtgaacaggaaacctacaaaatgggagaaaattttcgcaacctactcatctgacaaagggctaatatccagaatctacaatgaactcaaacaaatttacaagaaaaaaacaaacaatcccatcaaaaagtgggtgaaggacatgaacagacacttctcaaaagaagacatttatgcagccaaaaaacacatgaaaaaatgctcaccatcactggccatcagagaaatgcaaatcaaaaccacaatgagataccatctcacaccagttagaatgccaatcatcaaaaagtcaggaaacaacaggtgctggagaggatgtggagaaataggaacacttttacactgttggtgggactgtaaactagttcaaccattgtggaagtcagtgtggtgattcctcagggatctagaactagaagcatgccatttgacccagccatcccattactgggtatatacccaaaggactataaatcatgctgctataaagacacatgcacatgtatgtttatttcggcactattcacaatagcaaagacttggaaccaacccaaatgtccaacaatgatagactggattaagaaaatgtggcacatatacaccatggaatactatgcagccataaaaaaacagtgagttcatgtcctttgtagggacatggatgaaattggaaatcatcattctcagtaaactatcgcaagaacaaaaaaccaaataccgcatattctcactcatagatgggaattgaacaatgagaacacatggacacaggaaggggaacatcacactctggggactgttgtggggtggggggaggggggagggatagctttcggagatatacctaatgctaactgacgagttaatgtgtgcagcataccagcatggcacatgtatacatatgtaactaacctgcacattgtgcacatgtaccctaaaacttaaagtacaataataataataaaaaaagaaattttatataaaaatagagaggtactacaaaaagcaccaattggaaaattagaaatgggaagattttcgtatgccagctaggattttaggcatctaattcaaattgccctggatatcttttcatttcacataggaaagaaatttttcagaataacacactctgatttttattcttcgacaacattgaaaaggtagagttttttttttggaaaaaagggcagagatctggatgtcagaaatgtggtctttcccccatgctcataatgaactcagtggccctagataagtcacttcattttccttgttttgatttttccttccattccttttcagttgttactgtcctctcctactttattgagtgtagatgggagacaccactgtgatggggaaggagcatgggcttgggaaccaatggacttgggttaagaatttctcacctttcttaatgaggttcttgacaatctcaaaactgaacattttcatctgtagtcctgtcatcatataatgtaaataatagtaccttttcacagtttgctctgatggggaaaataaagcagtgtatgtaaaaaaagttgcaaagtatgaagcatggaaaatagtaaattgaaattacttcccaggaaggcagagtgacgtgggtataggtgtctctaaatgctgacctgaacctgaaataaccaatgggtcgaaggaaggaaaatacggctagagctaagaatggaatctgcaggatatggcaattgcatgtggtgtgtgagtgaggaatccaggacaacttccatgcttctagctggggtgactggtcagcagtggtgctttatactgagaaaggaatataagaataataatagatttgagggaaatacaattattccaatattgtatctgattagtttgagggaatatgcatgccatcaaggtagagatatctcattaaatagatattacagtttaatctcagaagtcagtaatggtctaaaaaggtacattttggagtcaatattgtataggttcatatgaagccatggatattcctagaaaggttgtgatggaaagaagtgaaaactgaaatgaagacttagtgataggaaacattataggatgagtagcagaaggtaacacagaaaaaaagactaagaaggagagaattgagaggatgcatgagggtaaagaagagaataagaaggcatgtcagccaaaaacgggagcaaggagatagttttagtgggaagactttagtcaacagttgctaaagaccttaaagccctaaacatgaaacagggagtactgctctttggagtttggaatatattctgtaggcaaagaagaggtcatgagcgcttttaagcaaaattaaaacatagccacttttgtagtttagaataagcctttcatgatcctcaggtttataaaacagctggaaaagggttagagacagtcaaggatatgtggagagaaagcagttctgaagaagactggcatgaattccaagcctttctgttctagcattttcagggaccagtccttacagagccattctgtagagcaaatagaaccctttaccctgacaggggaatgccacatttcccatggcaaccgagtgtgggttccaaggctaagaaatgcagaacacctcctattattttgctgggttctaattctacaatctactttccttattgatttttcatgcagacatccaaataaatgtaggatgtttgacttcatgggatctgttagtctgtttgtattagcctcatggaaaagccccagctgtataatgaaagaggagatgtttcacttgacatctgcaatctgaatcttccttacaatggtcatggcagagtaattccttacagtggtcactgtagagttatcaccctcattgtaccaataggtaacagaataaaaggccaattgttcagttccctctgccctactatttatactccaaaggtaagaatcgcctctttctctggtattcttttcggttgaatatgttccaagtagtcatttgttcacctaatcttctacttattaccagagctctagtattgaaaagaagaaaaagtaagttggaaattaagagcccaacatgataaatgcaatgctttctaagattttaaatttgatccagtaaagtgaaactagtcactgggaacaaactccttccatttaaataagttagcgctttcctctgggattaattttctgacacaaagcaatttttgcaaacatttgtggctgtaaacagcttgataatatttagtattcatagccattagattaccaatataaggcaaatattaaatgtaaaatatcaatataaggaaagtatctaaacactaaaatgttttgtctttggatctcaatgaaaatcttccaaatgaagcttttaatgaatttcccattaatgaaaaatgactacttattagcaactatattgtatgcaagttacaactttgtgaggatgcaagtgagaggatttgaaagggcataaaggtaacaatttttaaatctatgatagttttcttacccttcacatgtcttaagatttgcaaagaattaaaaaaaaaaaactcacctctagaggccaaaagttttatcatagtttgttaagttaatagaagattcagacatccattctccatatctcggcttcccaatcacctaactggccaatacccatttgttaccacctggtatatgcaaggaattatgcctggtatgacaaaggaaaaaataaagcctaaaataaagaccatgatcttcaagcatatataatctaacttgcgagaaaggacatttatttggtcattccagttcattccctcccatgtcagtttggcctacaatcttcctttctgtaaatagaggtaccgctcactgagttcagttgaaaaatctaggcattttcaatgatttattttccatcatactccatacccaatccattaacaagttgttttacttctaccacagaaatacaccctacctcttcagtgctaccaccttaatggaaacaatacgctctcttagtagactgttaaaacagcgtcccaactgatttttctcctgtcctgcagttacttctcactgaccaagattgttttcaagcataacatcaggtcataagttgcccaactcacagaaaacctctcaaagacttttccattgcagttagaataaaatacacagtccctttgagggatatcaaatcctgtggccactgtctgtcttttgttgctcattgctccccactctgtctatcactccctaacctagccatgctggccttcttcctgcctctcagatattttcgctagttctctctaagggcatctgcattcattgattgctttaccccaggttttctcctggacacctccttttcattcagatccctgagatgccttccctggtcttctagctaaaggtgttccattcccatcccaggtattatatagcctcctacatttctccatatcactgattactcacggaaattatctgtttattggttcaattttgtatttgttgacttattttccaattgagagtattgcttccatgagttggaatcaggtaaacttactgagaattctttaatgccatgattccagtcaaaaatcattgttttcatattactactgcatgctgtgtaccttgcagaagtaatgctttcttagactccacttccccactgccttggttctttgaaatacctgaggaaaatgtgttgacttcatttaacaggaagcatccagtcaaacaccctgctggaaattattatgttactcaacttcatgtcacattttatactaaatataccattggtttgtaattgctccaaatcctttctcccacctccaaactttatcaaggcatatcctcattcatccttatttagccaatgtttactgagcaccacatatgtgccaggaaacaaccaatgtattccagaattcactttactcagtcgtctacctcatatttgctaaattattctccttgttgccttcttgtaaccacccacattctgttataggacatttctgtatctactgaaattcagcactgtgctaggtagtataagagttacaaataggaagcaagcccagttcctgttactaagaatcttacagtttatatagagagatacataagtaagtgatagtgatcaattaaccaaaaacaaaaaggaagaaagaagaaaagaaagagaagcaaaaatagactgaacactattagaacagaggagatttcaccctagcctagaagtttacagagccccaaggaaacaaaaaaggaaacaaaaattttttaaagattttgtttgccctaaaattttgagaaagttttccctctgaattaaataaagttaaaattgatacataatggttgtacatatttttgggtacaggtgctattttaacacctatatacaatgtgcaataatcacatcagggtaactgggatatctatcgcctcaaccatttatattttctttgtgtcgagaacatgacaaatcttctcttctacctatttttaaatgtacaacaaattattggtagctataatttccttactgtactatggaatacagaacttgtttcttccatctaactatactttttttacctttaaaaaacttattttccccagccccttctcttcccagcctctgataactacattctactctctgccttcatgagatccaccgttttagctcccacttatgagtgaaaacatacaatacttgcctttctgtgcctggcttattttatttaaataattacctacagttccatccatgttgttgcaaatgacacaatggattatcactcagccatgaaaaacaatatgaaattgatttgcatttttaaaaattttcttctgggccttgaagtttctaaatactttaataggatcattttaggaataagacaagttataaataatgcacatacatgtgtatcaggaaacatcatattactaagaactactgtcttttttttttttttttttttttggagatggagttctgctcttgttgcccaggttgccaggctggagtgcaatggcaagatctcagctcaccgcaacctccgcctccagggttcaagtgattctcctgcctcagcctcccgagtagctgggattacaggcatgtcccaccacgtctggctaatttttgtatttttagtagagagtgggtttctccacgttggtcaggctggtcttgaactcctgacctcaggtgatccgcccgcctcggctttccaaagtgctgggattacaggcgtgagccaccgcgtccagccactactgtcttttttaacacagtagtggaaacattcattaggtgagcgaaacttcataactacagccatttccaaacatcttttattttgggaaaacctcagccattttcttcacacagggccctttaaacatgatacttgacaactaggcaaaactccaaaggaagcactaagatgatttcaagagccacagtccctgctattgttctttacccagcctgctgctattcattcttcaggacttatctcatgcacactcagattcaggaaaagaatttgcaagctctcagctttgtttccacagcacccaggcatgtcctcatcaaggcatttcccacatagcagtaaagcactattttaaaaatgtctttttccccagctaggctgtgaactccctgaaggctgcaaccataacacattaaccattgtacccccaaccccatgtctagcacagttcccatctattgaactgaacactgtaatgctagttatatcatttccattgagttcccaagcaaaaatactcacttttatcaagacgaaccatttgtacttgcatttaatgaagtcaaatgaatataccagggactctcttatgtatacagtacacttgacaaggggtgggggaaattaatatataccctctattataccacaaattcactaaaaaggacaatataaataatggaagaatccatttactgccacttgagaatacagtggtgaaacttaattttggaataaaatatgaaaacgacaataaatagattctgctctgctccaataaacttatatcttattgaaggtatctagttgaaatagcagccataaaagttacagaggtagacgatttaagcaattagccatggcaggacattatagggtttactgctgtccgtagctggtctgcttaaacaaggctgaaagccatcaacgcagctgagcatgaaattacagaatcttaatctgcccacataaagatgctcactgttattacagtcaaatgtcatatttaagttaattttgtgaaagatggaccagccatattttcttttgtgaaacaaaacaaaaggaagaaaatagcttgaccccgtaaacaggcacaagtctgactacattctcttacgactgagttttttattaattaatgaatattaaaaatacagaggttaatcaagaaaatgcaattttatagagaaaatagtttagtggttgtctggggctggggtgggaaaggagattaattgtaagtgggcatgagggatttactgggggcatgaaagtggtttatcactgatttatggtgatggatgtaacactgggtaaagttactaagcattattgaattatacactagaaatgggtgaagtttattgtatgtaaatatatgatgtgaaattatgtataataaatcagtctagggcaaaatataaagcttgaaactacagtacaagattttttaaaaatcatgtgtcattaagcagtgttgtattttttaagctctaaatttctaggttgtttataaaagttttcatctgattccatactagcagaaagcatcacttttaatagatgctggtcacctgataataacactcatgttattcaataacatgaattattcaataatactgataataacattcatgtttagtcacgctttcctctccagctttgaaaccagagaagcagagagccactgctagccagcagagctaagttcaatgtggtggatacatccaacagtgtggatgtgattttactgttaattggctttggttagttactcctatttgggccatagctgaattacaactcttggatttgaatctttgtggcataaaaatattaagaaagaagcaatgaggaaacaaacaaaacagaaaagcattgattcaaagggaagaacacaaactacccttaaggggatactttgttttccaatgcctttaaccactaatttgaacctaaactgatactgaaagaaaactaccaggacccaaattgtgtattctataaaaactctgatattttaaatgttaaattacttgaaacataaatttctttgaatctctgctctctaaataaccctctaaaatttacttgaatactaaaatactatttgttactatacagggcagcttgataaagtggaggctgaattattcattaaatcaatcacccattgatttattccacaaatatttactgaatgttctatgtacaagtactctctaggacccaaagataaaggagtgaataaaatgaaaaacaagacaaacaaacaaaccctgtcctcattcagcttgccttgtcatggtgggaactgatagaaatgaaaactaaaataataatgagaatacatactacttatttagaaattactatgttgaatgtgttttgttaattgctttatacacattatcttatttaatcctcctgatggttgtatcatccccattttgcgatgaagaaactgaggcttggaaaggtaaaatactttgtctcctctagtcacaaaaactagtaagagataggattgccccttagtctgttaaagtccaaaggctgtgcttttacctactgtaaatgttgcctatacaaagggccttgggaactttggggaattgactgactgccctcaaaatttgcagataaaagtatcctttaggaactataataaataatagagatctatgtgtaaatgtgagaatttttgaatcataaattataaactaaacataaatatatatttataaacatttgcagagatacatctaaatgcacacatatgtatgtgtatacctatatattggatatgtaaatataaaaatgactttattacattcaggtaaatataagtttccattacctcaagaaaactataatgactgattttctcatgctagggagctttagttaatactttgtgtctaaaattgtaaattataaatttgtttttgtatagactcagaagatagaaaagtcataacgacattttcttcatttactaataaggctattgataatggagactttttcttttaaatactttcattagtctatgctagtattgatcaaatacattaaaggactgttttttattcttttttcatttttctattattactttctatgagatattatttaaaaaataaatctcattggcaagagtattttttccaataatcaacttaacatttatctgatacaattgctccaactacctctatccttctccaattactcctacatagttgtaacacaaggtatcctcttctattttagctaaataaatcttgtctttctcagatgttaacatctttcaaatatttatagactaataacaaggtcctattaattttactatttcatcaaactgcacttatctacttattttcatatccctgtataattcagaaaaaatatgactatagcataatatggataatattgtccacattttattttaacaaccctaccaagtatcataaatatatgagagattatttctgttctgataggtgaggattaaacagcacagctcccattaccaggtgtcagatggctgaatttatactgtctgtggagtactttttgcatacagtgaatgaggatattttcaagttaaatctttggataaataaatgtcaaaggtaatcatctttgaatacatgacttactcttgttgctaaatctgttctggggaaattagcctatcaagggcatatccattaattcctgagatttttctccgaaactttgtagtcttaggtagagtcaccagtctcacttcttgaaaagagacttttcagtactgcacttggatctctgtctccaaacaccatcctgtcttcttgatctcacaggccaaaaagctcagtcatgtaggatttatccctctcctgcatttctggaggtgtgaagtgatgttggttctacttttagaacattttcacattggtctctgatatggattagctctgtgtccccacccaattctcaccttgtggctcccataattcccatatgttgtgggagggacctggtgggagataaatgaatcatgggggcaggtctttcccatgcctttctcatgacagtgaataagtctcatgagatctgatggtatcaaaaatgggagtttccctgcacaagctctctcttctcttgtctgctgccatgtgagacgtgcctttcaccttctgccatgattgtgaggtctccagccacgtggaaatgtaagtccaataagcctctttcttttgtagatttcttagtctcttgtatgtctttatcagcagcatgaaaatgaactaatacagcaaattggtaagattagagtgcattgctgaaaagatacccaaaaatgtggaagcaactttggaacttggtaataggcagaggctggaacagttcggagggctcagaagaagatagggaaatgtgggaaagtttggaactccctagagactggttgaatggctttgacaaaaatgctgatagtgatatggacaagaaagtccaggctgaggtggtctcagatggaaatgagaaacttgttgggaaatggagcaaaggtgactcttggtatgttttagcaaagaaacaggaagcattttccccctgcccaagagatttgtggaactttgaacttgagagagatgatttagggtatctggcagaggaaatttctaagcagcaaagcattcaacaggtgacttgggtgctgttaaagatactcagttttataagggaagcagagcataaaagtttggaaaatttgcagctgataatgggatagaaaataaaatcccattttctcagaagaaattcaagccagctgcagaaatgtgcataagtaatgaggagctgaatgttaatccctaagaaaatgggggaaatgtctctagggcatgtcagaggtcttgatggcagcccctcccatcacagagccagaggccaaagagaaaaaagtggttttgtgggctggtcccagggtacctctggtgtatgcagcctagggacttggtgccttgtgtcccagccactctagccatggctaaaagaggccaacatagagcttgggctgtggcttctgagggtgcaagccccaagccttggcagcttccatgttgtactgagcctgtgagtgcacagaggtcaagaattgaggatttggaacctccacctagatttcagaggatatatggaaatacctggatgcccaggcagaagtttgctgtagaggtgggggcctcatggagaacctctgttagggtagtgtggaagggaagtgtggggtaggagctcccaccttggggcactacctagtggagctgcaggaagagaaccactgtcctctagaccccagaatggtagatccactgacagcttgcactgtgtgcctggaaaaatggcagacactcaagccagcccatgaagacagctgggaaggaggctgtaccctgcaaagctatagggccagagcttctcaagaccataggaacccacctcttgcatcagcatgacctggatgtgagacatggagtcaaaggagatcattttggagctctacaatttgactgcctcactggatttcagacttgcatagagcctatagcccctttgttttggccaatgtctctcatttggaatggctgtatttacccaatgcctgtagccccattgtatctatgaagtaattaacttgcttttgattttacaggctcataggcggaagggacttgccttgtcttagatgagactttagactgtggacttttgagttaatactgaaatgagttaagaatttgggggttgttgggaaggcatgattggttttgagatgtgaagacatgagatttgggagggggtaggggcagaatgatatggtttgactccgtgtccccagacaaatctcattttgtatctcccagaattcccacatgttgtgggagggtcccagtggaagagaattgaatcatgggggtgggtctttcctgtgctgttcttgtgatagtggagaagtctcacgagatccgatggttttaaaaactaagtttccttgtacaagctctctcttctcttgtctggcactatgtaagatgtgcctttcaccttctgccatgattgtgaggttttcccagccatgtggaactgtaagtccaataaacctatttcttttgtaaattgcccagtcttgggtatgtctctttttcaccagtgtgaaaatgactaatacagtttccatctgacggtactaatacagtttccatctgctgttgtcatagtgtagcaaagacaaagtcagaagacctggatttgatccaggatccaccactgaatagcttggttaccttggtaagtccacttaactaagccttaatttcctcatccacaacatgagaaaaataagtcttcatgatttttttttgtgtgacatcaaacacaatgtatgtagtatatattatggaagatatagtaggtactcaattaatcactaaatattattactattattactttcaccattattaactacttttccactattcaaggtatttttttttcttgaattcatcctttaaaattttatcaaagtaatcgtgctaaacactaattcacaaatgtaattcgaaagcctttcatgatccaccatttagccttatgtccctctgcatattctataatgtattcactctgggctactcagcctttctcaaacatctcatgttctttcatgccactaggcatttatatatggctccccttgttctggaatatccctcccctatctcctatttcttgctgtacttgattctgtagtacccaccacagattactagccttcattggaaaataaaagtttagagggttcatttgaatcaagattgaatgaatcaagattgttatatggatataaaaactgctacattaacaaaagtagcatcaagaacaagggagggaatatttacactcttactcaccaatcagcctgcacaaggggtactattttggattcagaaacaattactcttcaatctgaagatcagaatgataagtgattttaaatcatgccaaatgaaaagcaacagaaggcactggaaatgtttaatctagaaaagggaaagctctaagcaaattgtaaacatgtgcaacctcctcatctgaaatgggcagtggacttccactgtgtggtcccagaaggtagcactaaaactaataggtattaggaagacagaaatgcatcccaagggaacccttcctaatccccaggaatataggaaggcagattggacaatatgaagagattcagtttcctgcccctgaggataaaaaagcagggtatggggaactggaaatgatgctgaagagtcttaaacctctaaatggatagtgggcaagatgagttgttatgttcctgagatgtggtgactcaaatgctcagcttccttgagatttttcttacgttctcagtcaggataattcacacacatttatttttttccattgccattgttctatgatcatagcaccgtccatacaacaaatcatatctccattttacccaattttatgggtaggtatttctggatgagaaatgtgttatcgggcaaccacagcctctttaatacagaagatgctcaataacaggtattgatttaattttataaatatggacaattcatttatcttttcaatgagtttccttagcagtaaatatgagctttaaatttgatgatctagtattctaactaatgctatatagtaaactccctaataattagacatataaagattactctctactaggtaacaaatatgagtactaatctaaaaattaatttttgaaataagtaggaaaaaacctatcagacccattttatatcaagaatatttgaaggtagatatgtacagagcttcatctgatagagtattctgttactcctgaccttctctctgggtagaatttcatagaatgaagttcttatggttttataaatagtattaattgattctcagtctcagaaaatgtttctggtagaagtagaattgttgtatgtttatcctgagcactttattgaaatttattgtaaacctttgcaatcaggctaaaaatattcctttattaacaccatcccttattggaaactgggggcttaggcaaattggcagcatcaagcaattcttcctaggccatttgtactgttatttccacaatgagtgtagttgctttatattttcaaccaattcacatcttaaaataagtgttcattggtgatttccagaaattagaagcaaactaaacctcctgtcattcaagaatagctacataaattattgtggattatattattgatatgcagtagtcccttcttatcttcagtggaaatgtgccaagattggatgcctgaaactgcaggtggtaatggaccctacaaatactgtgttttttcctatgcatacatatctatgataaaacttgatttataaattagacacagtaagatattaacaacaataactaataataaaatataacaatgattacaatatgcccacatcactactcttgtgctttgggggcattattaagtaaaataagggttatttgatcacaagcactgcaatactgcaacagttgatctggtcactgagatggctcctatgtgactaaagggtgggtagtgtatacagcatggatacctggactaagggattattcgggtcctgggcaggatagtgagagattttatcatgcttcacaaaatggcacataatttaaaacatataaattgtttatttctgaaattttccatttaatatttttagaccatgattgatatgcaaaatcatggacaaattgaggaccactgtgctgtataattataaaaattagtgttataagcacaatgtgacaatttgaaaaaaaaagtttatgatgtaaaagaatgaagtaaaagatgtaaaattttacaaatacttataaatttaacagcttaaataatgatcttataaaacatcagatctgattatataattcttgggagacatttatgagcctcttgcatttctgcacatgttgctagcagaagcactgactgtctttgttctgggctatgttttcaaagatatttgtatagtatacagccttgaaagatagacacagtatctctggaactagttcttttgtttactttttttttttaaccatccatcataataacaataatgcatttctccatagtaaagaccaggcaggattactgttcctaataaaagattcaagttccctacacttggggttcttttcctataacacaaccacttgcatgtgcaggcatcacctggccttctttgtgttgcactgtgggaactggagctcagggaactgctgaaaatgcttttattctggctacagctattattataagtaataaagtctctgattcaggagtgaagaatcttctgtccgtatccagtacagtgtaggaggcttacttattagactgaaaatgaagtaaaaaatctgaggtccttcattgttcttgacattcattcccttgcttaaaccagcttaatctactttcagtatcatcccatgcatttaggataaaattgctagtaataataataataccctaaaacaacaataataatggctaatatttaatgagtggcaaacattgtactaagcatattacatgtcatataatcctcacattgatcctattgggtagatgtgattgatatcaccacttagtaggtgaggaaactgaggcaggggctcagtggtttggaagaaataagggtcatgatacatattagtccaactgttaagcagtttctctcacttttgatctgattcttacccatcctctggggctccattaaatggaacttccttacaaaaaccttcctttgaccttccctctagtcttatttcctcaaggaactctggtcttttcctttgcagcacttatcacaatttatgttaattgtatgactaactgaggaatcctgtgatggcttatatatggtatgtcttccatcttacagagacccacagcaaagggatgaggtctactttgttctccaaagcttttagcaaaacagatgataagaagtgtagtgaataagcagacatgtttaacatggtcattcttgcttacatatatgttttatggaccacttattgagaatcaactaagttgaaacattttgcctaatttattgttaagcacttctactcactaaattccctaaatgccccaatgaactttcattatcatcttttgatgggttgttgctttttacatcttaatggtctaattcacctttgacgtaagccatttgtacattatcaacatactgttatgcagctgtgtgatagggtgggccaaataaattttaatatgcaaatttcccctttaaagaagcaattttagtaaaattatattgttttgcactataaaagctcacaaaataaaagttggaaatagttttgtgaatagctgtgttttgttagaagtaaattcaagtttccagcttgctaattggaagattgctatatcagatgtctgtctgtctgtctctctctctctctctctctctctctctatatatatatatatatatatatacatatatagttttgcactataaaagctcacaaaataaaagttataaatagttttgtgaatagttctgttttgttaggagtaaattccagtttccagcttgctaactggaagattgctatagtagatgtctctctctctctctctctctctctcacacacacacacacacacacacacacacacacacacacacacacacacacacacacacacacctcggcctcccaaagtgctgggattaccagcaccagccaccacacctggccaagatttcaataattaataaagacatacatacatagttcgggagataggggagcacggaagtataataggactatttacaatatggtagaggaggtaagcctcataagaaagttgatcactcattcattcatccatctattccaaaatattattagcatctacttttggagagagtagtgtgatgtgggtagaacacaaaggataccaacaatatcatccatgtatcaagtgcttactgtgtaggcaatgcaaagcactttatatgtgccacttaattctccagataaccttcgaggtaaacattatttccccactttacacatgaatctcatcgaggttaagaaacttcaccaaggtaattgggtcaatgagcaaaggtactggaaaccaacgaagaaaacaaaaaccaaccaacctaacaaaaaaagcctaaaaatatcccctgtcagtatggctccgaaagttaaccacttaataaccacattatcagggcttactccttctgcaagggactttcaagtttatcggtaacataaaataagcacagaaattaccgtatatacctaatataagataaaagtactataacagaggtaccagaaaaatactatgaaattgctaagaaggaagagccagtttcttccaaggtctgcagaggaagaatcagaaaaagatccatgtaggagatggcatttgaagatctcgcactgaagttgtcaatgtgaagactgttttaaacagtgaacacttaatatgggagaaacagcttgagaaagaagaaatgagagaacatttaatgtgggagaaacatcttgagaaagaaggcatgaaagaaactagaaggatcacattgcagaagaattagaatatagttaatcaccaaacacttactatatcccaaacattggggaataaaataggaataaaacagcacagtgaggaatatgggcaggtaaacaaattactatttagtatgatagcagaagtatatagaaaatacaaaaataatagagaatagaattgagaatacaagatcatgtgaccttcctttggttcacactgagtaaattaggatgatagcatccctggagtgaacgagagttattttcaaatatccagataccctctctaagcttcactatttttgctttttaattctgaaaaagaggacaataacagcataataggatgggaaggataatgacttacttgataggatgcttgtgagatcaaatgagctcatgtatgtaacaggtttatcccagtgctggcccatcaacatgctcaataatggtcagttattattattaatattataattattaattctttctgacactactggtaaaggaagaaaaatcacactcaggaaatgtggcaagaagtttataagcaagcctgagttccttcctgccctggaatttaaggccctccattttatatacagttctagtttatggttttggccttgtctgctgctgctttgcacacaccttcaagctcatctagacaactgccaccagcacctccactctccgttcccaaggcacccttgcctaagttcaactgaccatccctcctcagcttcccaagtagcttgcctccattatggcaactgtcatgttatattataatcatcattttataagcaagtttattggtttctaaagtgcaattcaagtacctgcaacattggcatctcctgagagctcattggaaatgttgcttcttatgcacagtaaagtgttagaagtttggtctagagtatgtatcccctgagatcagaaaacatttttttcatctaagtatccgtatacttattgccatctggcaaagaataagcttttaatgaatggtcactacatgtatgaataagtgaatgagttcatagatgccttctcatctctattcctttattcaagttatttcaccttcttttttttttcagcctcggataccaacctttgtcttcccactatgttaaccttcctctgaacacttgagatctttctcttctcagcacctcctgaagcaccctgtattgattatgactgtctttttttctctctctctctccatacgcacatgagcatatatgcatgcacacacacgagcatatgcacgcatgtacatacacatacacacctacaaaaacagagcatatttttcatctgcctcacacccacgattagcatttgtcctagagatcaaatatagtgtccttttttatcttcccacaattgtctaactgagccattcctagcagagtaaacactatttgcttagtaagtatttgttgaattaaagattattgcacatgactgttagagtaggccactggccaaaggaagggactcaatatgcagcatttttttttttaagggacagggtcttactgtcaccgaggttgtagcagagtggtgcaatcacagctcactgtaacctcgaactcctaggctcaagtgattctcccaccttggcctccccagtagctaggactataggcctgtgccagcatgcctgcctatttaaaacattttttcatagagatgaggtcttgctatgtgcccaggctattcttgaactcctagctcaagcaattttcctgtctcagcctcccagagtgtgggatcacaggcatgagctatcatgaccaccctcatatgcagctttttagcctctgcagactctgcatccttgcctcactgagtatcatcttgaaggaatgaaaggaaatacaaggttttatgccatatgctattcaagagatttcagtttaggtgctggaatgacaattggcgtgaaagcagtaagacccttgttctagtagggcatttattactaagttgctacacaaccttgggcaggccattttcccttttgtgggactgttttcccatctgtacattatacactgagcactgaaacaaataatgtctgagactcctttcagtgctaacgctctttgattccatccagctgcaaggtttttgcaaatagtaattaatcagagaaatgagtataataattcgtggcagtaaactgagtatcattccatgctagactggtagcactgcaactgacaatggaagccactgtcaaagacctcacttacatccactctggtgaatagcaagaaagcagagtaagtttgggaaaagccgtaaggtcatataatgtggcagtaaaaagtaagaaggcagagaaactacggattgttataaaataaataaatgtttaacttttcaaaattactgatgtccatttcaaattttaaatttatgatgaaacgaaatggggagaaattaaatatctgaaaaaagagagacttatgctggacccaagggtcattaattgttatgcttcatcaaatgattactggttgagggaaaaggactttgatccctggagacagtattgctcaagggtttgaatatatcacaggcttatcttctgttccaatcttcctctgagacatttgatacaggtcaatacaaagaaagcttgggaagactcttcctctactccagggaagcagcctcaatgtctccatgtcctgttcctgccctagaaagtgatccactggagattctaattaaatttgctatctgaagatgtgggagatgtgtctaattatgctaggctctaaaaacaggatggagaattttatctgagtcttttgttagtcattaaattaaatgaacagttcagtaataaacccagcagagtaaatcaaccaagtgaagtggagtgtagactacattgaaaagttggactgaaaaggtgtcaaacctgtaggagaactgcagctgctgagctctgtaatagagtatttgagaagttaatgtgcattgcaaaagtgtggatacactatgctgtgacacaagaagtgtggttttaagggagaagagttttagagtcatcaaattgacataaaatgacctcaaagctgacaacttttggaactaagaaaatattcgattaatggtcagtcagtgttttcattaaagtttaacttttcttctactaaagaagtcaaggtcctgtgaaacatgaacatcaaatgaacggtcctggaagcaccgtggagaacttgttttctttgttatttcaatttaatgtcctgtagcatggtagaatgactgcatttaacaataatacatagtttcaaatagctagaaggaaaatattaaatgttcccaacacaaagatattataaatgtttgagatgatggatatgctaacctgatcaccacacattacatgtatcgaaacatcactgcactccaagaatatgtacaattattaatactttaaaaacttaaaagattattcaaggaaaaagtacagctattttaacttagagaaaaatgtggttttcatacaggtactttgagaagacatttcagttgctcttcatgccccgacagctatcattgtcgtgatgattattaaagatgacacactgaacatttgagaacccactatgtgtatggcactattctacttttatggggataccaacaaattgatatcaagggcctctatattcaagaggtttacattaatatagttaatgagacaagaccacagaaatgaatgatttgccgattacacaaagtaatctttaattgagcaataatagtttggcctaaagtaggcaaaacatgatatgactccaaagaagataggcactcacaaaggtagaagtgctcaagaaaaaaagtgatgtaaataataaatacttgagctagattttcttatactgatacagttatgaaaaccaaagaaagatgggaaagtagctcagtgtagaggaatagcaagggcagaggcagagagaggaaggaacaggggaatgaagctgacaatagacagaactgcctgaattgagaagtcaaataatgacaatctaaggcaaaggtgtaggtttgggtataacaaaatataattatcattctatattgcttttaccgtagttattttttccttcagggtacagtttcatattagcaaaactaacaggctaaacttataattttctactcctcatgtaacttgtcttagattgagtgtttctatgaactaaggtttttttttctttcattattttttaatgtgtgggatttttcctttgcagttcagatcagctcctctgtatacacagtgttaatgactgacatttaagaatgctggttttacagcaaaattgtccatctcatgtgttactgctagcttctgttgcctctgtaattctcaactccatttcaatgttagcctcataacatttaataatatggagttattaaatcactttatttttctatttagcaggatcagagctacaaaaagtgttctctaataaggctagcgttgtataatgaatcagcgaaaatagtgagggattaatttagaggaaaaaaaccttaggaaataaaatgacattctttatgcctgttactaaaagaaaagcaaaaggtttttttttgttttcttttttttgacagtgcaattacaaaatgtgtttccttattttggtgttttgaaagctgtacagataacttgttaattcctaccccaaaggttataatataagcagtttagagcaatggaaaaaaaagaattattgaaacagcaacaaataaaacacaagagcaaaaatggcaatcatattttgcacttatatactctcacttgctgaggggctatcagcatacaagggctgtcatataatgcagctatatagaaaaaaagaaaacaaagaaaaaaataaaaatgtcatcaaaattatataaaatttttgtcaaatggagacatatgtcaaatggagacatatgtgatgtcagggacatcacaaaaaccaaaaagtaacattattgatgacgacttgtatatatagtaatcatccaacttatgactgggttgttatctttaagatgtcttgtttgggtccccaatgtgtctggactacaggctgcaaaacctagatccaagggcttttgaaaatagtgtccacagccaaaactaatcagatgttcaaacacagtgtctaccaaatgttgtgcatgagtgtacaaaaaatggcaccgtgaaaagagtgctagctgatttcaagagggtgactgggggactgcatcaagaacacacagtggcaggaacgattttaatgaaaaatcctgaagacaaatccacgttttagttttttaaatgaagcgcgttaacataatatctactatctatcatcaccataatttcataaaataaaatatttttaacaccaaaattaaagggagattccaatctcaggaaggattcctcccaaggaaggacaatgggcaacccgatactgatatttgtatgtgtacattgcaaagttcttcttttctttctttttgccccaggccagcagaaatttggccatgaatcagctcaactctatggactcgaatttgggaaaacactgagagaacatccatgagtgctggaattacacagatagaatattttatagtatgcccgcggctttgtcaaaggttggggaagagcttaaggagccaatttaaatagtgggaagaataaggcagtgagggctataattatgtccaagaaaggtttctatctctattttaattcaaattgaatgcagtcacctgaccccattagttaatatcccacagacttctcagtgtcaatctgtgtgtttgtgtgtgtgtaaacatcccttaacttctctctcattttaatcatgttaataaattaacatattccattcttgataccctgtcagaatatgccctcgattatagcagctttgtatggaatgctaattgttttcctgtctgctatggtctctgttagattgggagtctcttcaggaaagagctaagtctaatttatctttgtattctcagttgatggcacagagcatttcacaggatcaccaaatacagggctcttatgggagtaaataaatgaataatgatttaaatatattttttttattgcttaaaaaaccaacaactcaatactttccaggcacattgctggcactagggatagaggaaataattaaaacagagtccttgaactcaagaagctcacagtctagttgataaggcaaacatggaaatcaagtaattaataataataataatgtaggctaatttctataactttggaaggatggaggaggtcccctcacccatgctgagaacttcagggaggggtttctggtggcaccaccaaaaacacatttcttgggcttattaacagttactcatgtgaacagacctgtttgtgggagctggtaatgaggtggccaggtgaatggtacatgtgcccattaagagagggaggaggagtttcaaaatggaagcataagcaaggacctcaaagaaagggagacttttgttttttctgtgaactgaaagaactgatatgactgaaggacaggtgatgtggagattggaagattaatcaggtcaatgacaaccagatttgcaatgcagaatgctccacatgggctacagtgtggataatgaattgcaggtgcatatagacagactgtggtgaaaaccagtgggtaaatacttcagatgagcagtgattctagttggatgtagactggagataatatggaaagactgcagaaaaatcattcaagagatattaaagatatatggatatgatgcttggtgatatagtttggatatttgtcctttctgagactcatgttgaaatttcatccccagtgttggaggtggggcctgggagaggtgttttggttgtgggggcagatctctcatgatggcttggggtcatttttgggagactgagtgagttttcactgttagttcctgcaagatctggctgtaaaaaacaatctggcatctcccttctctcttgctctcttcctctcaccatgtgatcctggctcccctctgctagaagcagatgctgacatcatgattctcatacagcctgcaggactgaaagccaaataaacctcttttcttataaattatccagctacaggtgttcctttatagcaacgcaaatggaccaagacacagagatcaagttataacaccaagatgtttttctagattcctcctactgatttgccttaacttgatctctgatctcttttccacagaagtacttagcttaccatgggccaaatgcttttcatgtataaactcattaaccctcattattatcctatgagatggatactttttaaaaaattctcattttatggataaggaaactaaggcataaagaggctacacggctagtgagtagagccaggatccgaactcaagcacatgcccttaaatgctaccccacactgttgatggtcattagacagtggatttaacaggagacaacaatctgaatggtaagtgtaatgaacatactttttgatgtgcttcagagcatttgaggatcgatatccggtaggtatgtatgtctggagccaagatctaattgtagatatagagacgagagacataggcacatagtttaaaatcagatctgtgggtgtggatgtgttccactcaggtgggtgtgcagagtaggaagagaaggaaggaatcactgggtgaaacagacacataaaggatgaggagaaaaggagatgcctaatgagacagagaagaaaaagtctgagatgcaagcacaacagtgagcctggaaacaggattctggaagtttaaaaaaagttttaggaaggagcaggcaacagaggcaagtgtacaggaaaataagattagatagggactgaaaagtttccactggatttagaaacaaagaatcttggcaaccttagtgcaaatgaattcagtggagggctgggggcagaacttaagctccagttctctgaggagtaaatgggttataagaaagaagagatagtgtagacaactcttctggctgggaaggagagtattaaggattagttttatgtaatggaatgatgattgtagtgtagcaaaagcaaacaaaactaggttgaaatctcagctctggtagctatcatctttatcagtgaaatagaaataaaaatacctactgtatagatttattattaggattagtgattatttttgcaaaacaccaaacaaaaagtagttagtaaatgagaactatagccatgttaaaaatgtaaaaatctgaaaaccttcttctgaataatttatttgaataacctttcatagacaaattaaaactttttaaaattattttttattatttttatctgaatatttgacattataaggacatagtattaatgtcactgtggctatataaattatttaacttttaagtaagaattttaagtaagctttattgagatataatttacctacagtaaaatcacttatttaaagtgcattgttcagtggcttttagtatatttacagaattgtgcaaccatcatgatggtcaacttttaaaacattttcataatctcccaaagaaatcccatacccatgatcagcatctcctaattcccatagcctctccctctagccccaggaaatcactaatctattttatgactctacagatttatttgcctattgttgacatttcacagaaatggaatcatgcaaggtgtggctctttgcgattgtcttcttttacttggcataatcttttcatggtttacccatgcgtaacacgtatcagtacttcattcttttttctggttaaataatattccattgaattataaagacataccacatactatttatccattcatcagctgatgggcatttgggttgtttccatattttggctatattatgaacaatgctgctatgaacatttgtatacaagctttgtaaggatgtatgttttcatttctcttgggtgcatacttatgactgaaattctgagcctaatgggagatttttaaatttagggttttttttttgttttttgttttttgagacaaaagtcttgctctgttgcccaggctggagtgctgtggtgtgatcttggctcactgcagcctctgcctctcaggttcaagtgactctcctgtctcaacctcttgagtagctgggattccaggatcatgacagtatgcctggctaatttttgtatttttagtagagatggggtttcaccatgttggccaggctggtctcagactcctggcctcaagtgatctgtccacctcggcctcccaaagtgctggtattacaggcctgagccactgcacccagcctaaatttagtttttaataacaaaacttaaacatgcttacagacaaaacaatttaaaattgtataaagtgaaggataatttctttccccatcccaatcatacttccctgaggtaaacactgttaacctgaggtaagttttatttccttccttccggtcttgctctatgataggccatgtttcttaacatgaaacattatggtagattgtgtttagctgaaattacaggctggtgaatgagaaaaagcactaccacctgaagtctctgacccaactgctatatccgtcacagactactggtgtgactgtgtgatcttgggtgagtctcttgattttgctggagttattttctcaattttttaagtgtttgggtggaaagttttctgattcaggtcaagcattatatgatttaataatactaagggtcctgaggatgcactattagctttaggcttatttgcaatgtgtttttctttccatttctttttacttatcattggtagaaggaacttcagagaaaggcaatgacaattaccctcaccttgccaaccactgacatttgcttagcatgctaaacaaactttcagagttactggtgttgaaaataaagtccttttgcaggtcttaatttgtttcttttcaatcttctaagtttgctgaatagtttttgttttattaccttttacagagtcaatcagagtggctgagaattttgcttgctatgtaccttgattctacttttcaaagtctagtcatgctcattacaatgacctaacctatgttagaggcatccacatatggtgaaacttctccagagcatctgatattgacacatgtttagtatagatgaaaaagactttaacaaaaagcagacactgttatagtacataatagatgggttgatgaaaatcagtttctgtgtcctaactctgaaatcaaaaaatcccaggggaaactatgtgcatcaccatcccccaagagaacaaggatgaaatctgaccctgctggaaggacttccctctgtctgccagttcttccgcacatatccttgagcctgaagaagagcttccattaaatgtgaactcttcctttgagctataagactataaatcacagtcgtaggtaaatacccaccacttgtcattccaatgaatgtctactacgtgctcatgtgtcacatgataacatacagcatggttcctacctttaaacagatgacagaaatatattctgttttcatagttattactagagttacacagttattactagaggaaaatctacaattcgattctggctgttcttgaagttcattattcccttaggcattatgggatgaaagtgcatgaagaagaatgaaggattgtttgcaagtccccttagtagctgattttgaacctaccaagcagaaaggtagggtctgaaaacagtaataatgtgagaaggcagatgtcccattacaaagagcttggatcttgaacacatgtgaatttctacttgttgacctagggaaagagagagggctccatggcattccatgaaagaggtctcactgtgggctaaagcaagaacatgagatacattagggggccttttacagagaatggaaagaagaaaccaacagtatacgtataggtgagaactcaggagagacaactagcattgtggagctatgatttacagcagaaggtctttgatcggaggttcataggtgctctcgacctattggataccagtagctgcctgaggcctcagtggccaaggcattcactcacacctatcctgatttcctacagttgccatccccattcttcctgtggtaattctttaacttcagggttttaaaaggtatatcgtcttctaagaaaaggtttgttgctcctgaacctgaatgttaatgctacttaacaacaacagaaacgtccatgtttgtcttttttgtttctctgctgggaaaagtgcctgaattagaggctgactttatgagtcacaagaatcccagaggaaaaggctccagtatgaaaatcagggcagggaacctggccagcacaggaacagagctgctgtggaagatagaaagtgaagtaaagtccctgcctgaggaaagaggcctcagctgaccatgggtcccacacggcgcctgtcaaagggcagagtggggatctcagtgctgtaacatgagactcccctctgtgaagtcacagcccaaggtggaaaaatcttggtcaaaaaaaaaaagtctttgtaaaataaattgaaggcttctcatcttgcctctgccagacactgcccagttcttagaagtctagcgtcaacatggagctccagtgtggacaagagtgggaaaggagatgcatatccaacataacatcactcaaagcaattgggacagtgacaaaggtgagaagagtaaggaagttcttgtaagtgaggagatttctatgggaaaacaataaggaaagtgttgtattgtgaaagtgtggaaatggttgcctaggacatcttgtgattcaccaacaggccctataaggagggaaagaataaccacagaactccagcaattataatggtagaaatctggtagaggctctgttttatatttcacagctgctttcctcatgtccagtgtagcttagggtctacaggtaccataggccctgtactatttcactgatggtgagaatagtaagaacttaccaagtaactggtcagatagaaaggaaaacggggctactatctgaccttcaggtttcccatgcagagtctctgaatacccagcattcaataaatacaaatctatatatagctatggaaaaaaatcaggctggatccaaaataaataaggcagaagctgattaaaattcatacatatttgaaatattctatccataataaatttctagaccttttattttcttatttctccttttttacattacaggtggctgttgactatatccacaaaagaaactctctaggtccagtggtccctaaatcttctgagaacaggggtcagccacatctggattgcatatcctcagaagtgctaaccttataatatgaatttaatgcctgtttggggtctgagtgacagtttcctcatctggaaaatatagaggttggactaaactgtttagtccaatctttgtacccaaccatctctgaacctatgttagcatctagttatttttttcccataaggctgatggaataatatctttacaattatgccggaggcataggaaagaaaacagagcatgaattagatgaatttgaaggagatctaaataacacagagaaatgaaattcttattcatatcctgatatccatcttcatttgggtcaatttattatgttaggcaggttgctcaaagaacacttggtcacggggatgagttagggctgaaatctagtctgaatgctgttcaccatgccacagaccctgacacagtgcgtgccagaagaaggggagccttcgtaaaatttggacaaaggctttggccgcttagtagtggcccagtgtaccctctccttttaaaagcaagccataaaattcctctttaccctctaaggtattcatttcctctggcatagagtgatcttaagttttagtattcaatttggaacacacacacctactgactttaaaagccctcttcaagagatcctttaaacctcatatgagctgaaggtctacagaaccaaattaaagggttgatagggaaggtttattttctcttctctgagaggcagattttaatcttttaattaaaataaaattctacattctaaaatatttagatctctatataaatacaggcaggcttgcacagcccttcccccatactgccaaccctaccattcatctcccttcacaattcactggactcactattaagttatgaatggaaacagtcttttataacagtcttttgaaaaaaaatcattctcacctcagcctgaggtatctattgggggggtcacaatacatcatctcacatatacaaatataatgatagctaaaatttatggagcacttcatatttatcaggtattgctctcagcactttatataaaacctcttgaaatccttataggtaccccatgagattgatactacaataattgctaccttttagaaaagtcccttgctcaagtttacaaagctagaaagttgtggaggcaaaattcaaactctaatattttgtgttctagagtctagtttcctaaccatatattcattgtctgtctatctatctatcttcatatatcaatcagtcatctgttgatatatcacctatctactaaaaagatgtgactattgtttaatggggtgtacttttctctgaagcagaattcaatacttgaagaattactactataatattcagtcaatatttattaagcacatttaaaaacacagactctagtaccagcctagttaggttcaaattctaccttagaaaggttagctaactgtttcatcacctgcaaaatgggataataataacacatacctccctgggttgctgtggagattaatgagttaatttgtataaagttctgctgggtaggtaacaagatgataaacagtgattgttgtaatcattatcctcatagttgccatcatcatcatctgtattgtcattgttactattagtactatatgccaggtacgatttttggcacagggaataaaatgataaataaaacaaaacttctgctcaaataaaattaatattctaagtgtaatttctgatgacctcatttgcaactatctcatctcattgtttccatttgtttctcaaaccatgtaccgtaatatttccataaaattgggatgatcatagctaccgcataagtcattataaggttaaaatgagttggtacatataaaacttctggaatagcgcatagcacctaagggcacccaatacacatcagtggttttaattaatatctacgcaatgggtgttatggtttaacgttactatcttgattctgagtcctacaatttgttgccatggtgatttttgcatagaattttctcataggtagtttccttcacaaaggaatgcttttgaagctgtgcttattctctgttttcttattgctacccaataatttgatggttactaaagtaaatacaaagattgctcccaaaacacaaacagacatactaaaactaacagaaaatattcacatcatctcagatagagatattatctcacttttaacttttttttaaaaagctaatcaattaaatttagattgctttatcacggagttatttgaacgtcacagaataggaattctggagtaaaaccaatctggtttcacttcccaactctgttatctcaaggtatttgaccctcatgaagcctcctgactctacctgcctgggttgttgtgcagagtaaataagagcttttaaaacagggtgagttccttgttttctgttgtcctttacattacaaaatgttaactgtgcttttaaaacaattattgaattcttaatgaaagaatatcttcccgctagtatcaaaaaatagtgagggacaacaatgaatgctgtaaatttaagaaattatctattgagacaatgcattaatataaaatcaaggggtatttctttccatgtaaaccctttcacagattgcattgcagaggaaataggctataaaaccaaatgtagcaagagtggcctctgtcactctgggagtcaattaatctctccttattttccttaattcatattgggtttagtgatcacctacttcaaaaagggagtgacagcgtttgaaaaataagctactacataaacttagaaaggggctatgccttgtgagtcattctcagagggctcagtctcttggttttaattaaaagtgaaataaagaattctttaagattatatcagccttttaagggcataagaaggtcactgatttgtaagcatcttctttctttttctaatggtgctgtttcccagattgaatcgtgtgaacaaggctcaaatttcctttcagaatctacagattcgtggcagagtggatgtgggaagtggggaacagagtgagaagctacagtgtacagagtgaacgtgattaaggctctgtgagaagatgagcttggatgtgagaatgccttgggtacagcccagattcctccaattgctagatcaaaacacacactttgcaaaattaatgagattattagaaacaataaactacctatgtaaagtgcctggctactgatctgtgtaccataaagcggctattattttgtccacactcctgagaagaaacatgtaagacagaaataccactatgagtagatagaaaagtatctcatataagtataaaatcacatatgggattagacacatgctgccatttacagggagcctataaacgtaataataaaaggaaaaatatgtgacattgattatgatgacaagaaggatggctgctaagaatgatagaaggtctcagcccaaacagctttcttatgacctcaggggatttgcctgaactgataaacattttctacctgatttgtgatagcaacaaaaatcaatatacatgagttcaaggctttaaaatagaatacacatatgggaacaattaataatgactaatgtggctagtgcctggatgaaaattcatttgctcaatttcccttgatcatcacagcaatcctatgaggggaacagcacagatacaattattcttctcactttctaatgagggaattgaggctctgagggtggtaacatgtttagctaaaatgcacatgattagtatggccaaatgggaggcttcagacctagacagttcgggcacaatccttagctcctctgtgacttcaccttgccactacctcaaacaagggacccgatatattttgtctcccttccctcccattgttttctaaagagttttatgtttaagtgtacttattgtggacaagagtgctcattctgtccaacaggggcaaagaatcaccctccagtaaatatcccaagccagaaaattcttcccctgagtcagtcaccaagtaccacctgttttatttaataaatagttctgaatccatttgtacctccctatctcgatagtctcagttcagttcttcattatttcaaccctgctctataatataatactaactagtttccctgcattcaaacttttcccacacaggtggcagagtgatctttttaaaaatgcaaagcagcttgtgtctttgctcagctttaaaactcttcaacagctccccactgcctataggataaagtacaaaatcctcagcttggtaagtaagatcttctatgatacacagctgcctttttctccaaccttatcacccacccaatagccctcagccacacaggtagtctggtagtcccagaaggcattgtgtgcctttatataacacgatgcttaacttattcctatttcttttacttggaacacatctcttccctaatcctactgataagctcagtgtcttcatgaaaatgcccagaaaaacaagggcagagttaggtaattcctcctatgtttacctttagagacttacatgcacttctattagagattagttttggaatttgtatttgattttgtatttacagactttgaaacagttaaaacattaaaggcccagtaaattttctgccactctgcaaggaaagaaagcttgccaaagataagttttagtattcaatttggaacacatatacctgctgactttaaaaactcatttaagggatcctataacttcatatgggctgatagtctacagaactgaattaaagggttaaaatggaaggtttactttctcttctctgagaagtaaattttgaagccttaatgaaaacaaaatggcatgttgtaaaatacttagatctctataaaaatacaggcaggcttgcacagcccttcccccatactgccaaccctaccattcatctcccttcacaattcactggactcgctattaagctatgaacggaaacagtcttttataacagttctttaatacaaattaaaattcattctcacctcagcctgaggtactattcaggggcttaccataactctggcatatgattgaggtcttataaaataaagatcttgctctgcatcccaaaactaagaatggcttgaggctgccaacgttatgatttctacaaaggtggtaaattataaatgtggattctctgagcccagcagagaacagttagaagttagacctatgagaagatgagtgtgcatttttcatagataatgcttcttatacatgattagaaattgatggctaggtgtggacggggccatttctttgtgtatgttaatgcctctgcagaaggaacagtctgaggtcatatttgcttccaacactaccgcttgtaataatctgattgtagttatgctaaattaaataagcaggaggcccttaggttaacgctgtctccatactctgagttcccacataacaatctgaaacctaacttagaagtgttacacagagtagcgtttcagatactcacaagcagctgggtttcagtcaattgcaggcagccaactcatcacaccgtgcccaaataaagcagatgcctagctgtagcccatcaggtgatttctctgctttgcttctgtgtacaggctataaaaggttgcttctcaaactgctcagtggagctctctaaacctcttctggttctgagtgctgcctgattcatgaattgttctttgctcaaataaactctgttaagtttaatttctttaaatttgttattttaacagctacctagagattaggtacatttgagaaactgaggccttttagcagatatatatcacatggtaagtaattcttcatttatatgtctgtgagatatttaaggggagagaccatgtttttttcacctttgaatccctaacattaaggatgatgcctggtaactagttgaagtcccatgaatatatatatccttcagtgagtgaagatgttttatgacgatatagtgcttcacagttcatttcccatccaaaacctgccaatatattttaattagccttcatctggtttatctcagcctctgttatcaactgcaaaataacaataattaggaccttttatgtaaaaggacaaataaatgtatgccataaatattgataaaacagccaagaatactattctccttgccctagaaatatcaaaagctgaaaaacttactctcccaaagtagaaaaaccaattaaaacatcaaaattaccttttttcaaagaaaaagagatgtactagataagcaggagtcccatagaaatcctatttgtttttcaaattttagtttgatttcaggctctgcacatttcttgcttctgcaagcattaagaagtcaattcctccaaacataatctgcagccataggcactgtgccaagtaatttaaagtgctttcctaagaaaaactaacaacttctctgttttcttttaaacggtcttacagaagtaaattgtgtgtacaattaattcatccctgaatgtttgctattaattcaaagagctgagaacttgggtattcccactgaagctcagaaaatacagaagactgactcaggttgcttttgctgactaacctttattcttctaaatgtggattaggaattaaactgatgtaaatgtaaggatggtttcacatgctaacttttccagagctagtgcatattctaatctgaagccataactgctatatcaatatgggcaagtttctggaatagacttcaggaatttttcaaaagctctgaacaaaatatacatcattatctactgcatcctaaaaatcaggcatttcttcaacatttttggctttttcaccttgcacctttgtaaaaagttgtcccattatagtagcatcttgcactttgtggatgatccttgataaggcttagctaaataaattaatagatatatttttataatatcttttttagggcaaaagattctagaatatttatatttaaccatgaggtgtaataagacgtagactgtgaagatagtagattgggttccacaacattactagagttggataagggtttttctatctaattctaagttctcatctacttccgagggtctatatgttattcaagaacacagagaacagcacacaggtgatggtgtcaaaaatggaaccagaatattttactttgcccctgaattattggctgcatttcaagatacagtggcttggagaggtatttcccattggaaaaataaataatatctgaaatgaattactgagtcctcacgaagaactgacaggtgcctaatggatttataatgtagacaatcaccatagacatagtttatggtgaaagtacgacataaagtaagttctagttattatttgtttctatgcatggattcattcattcatggagtagttttatatacctactaagaactaggtaaagcgcagcttgagcttacgacttgttttcaaacaggtaacagtttgcttgtttgcagattttatttccatgtttatgtattcatccaataatcctgagctcctgctagccagatactgtactaactgttaggaatatagcagtgcccaaaaatacacaattccactcattgcgcttacagtgtagcaggtgatacagtcatgaaaatcacataaataaatgtacaattataaattgcttgagtcttatgaaaaatagaaagaaaatatataatgggggcctgattttctgttttagagagcttctctgaagacgtgcaatttaagcttggatctaagatgaccagaaattaatcaggcaaagtgtaaaaagagctttccaattccagggaaaagcatatgtgaaacacttgagactagaagagatttagtgcattttgtgaataaaaagaaggccaacatgaatatgtggtcagcaaagggaagagtgaaatgaggtatccaagaggcaggcagtggctaggtcatgcagagcctggatgctatgttaatgacttcgcattgcatcctaatgcaaaaggagatctgatctgtattttttacagatcactttggttgcactgagaataagcctggaggtcaacagtggaaatggtgagaccaattaagaagctattataggtgggagatgatgggggcttggattaaagtggtggaaatagaagtaaagaaaagtgaataaatctgagatattttggaggtagaatcaacaggacttgaagatgaattgaatggcagatatgagggaaaacatagtaaggatgactctcaagtttttggcttgaacaatgcggtagatgtgtgtgccatttactaagttgaggaagtatggaggaggagcaaagtggggtgaaattaagatttttggtgtcaatgcactggtagtgacaaggccactaaaatagctgtctgtgtgtttttgtgtgtctatgactgtttttctacaaagataagataaagaataagataatggaaaaagaaaaaaagaaggagaaagaaggggaccaaattagaataaattgaaaatagaatacccaaaaaggggaatggtggatgggggttggggcctggtgcatatcagaattagggtgtgtaatttgaaaaaaaaattcaacattgtactataatgtttttatttgaaaaataaataactatggtattcatgatacagatgacagaaagcaagctgaaaagaatcatatctggcaggtgcacatagaggtgaactgttatcagctacttcttcgtgaatttttcaggaaggatgcttcaaaatccccattggaatggaaggaaaccaatgtaacttttacattcataaaaaaggaacacaggataaaaagaaaaaaaatatttactgacacagagccagaagaagggaaggaatatgagaagtcgggataaagatagggaaaggatagaaaaagagaaatggggggaaatttttttccagtgagcaaaaatggctaatggtctgccaggtcagtcatcatctgggtttgaatcccagctgtcacttactaatggatgatcttgggcaagtcaggcaacttatcaagtctcgattttctcatttgtaaaacaaagataataataacatctacctcaaaaaattattgtgaggattaagagaaataattcataagaagtatttaacaaaatgcctggcacagaagagctcaataaatgttagctacccttatgtagctgactataggtacataattactagcaagtcattacaggtatgtggctcttctcacttccttacggctatggtgactttgacctttcagctttaaaatggcatagttcactgtatcaacaaatagttttaatgatttgttaaaaatataggtggacttaatgaatatttataaagtattctgaaatattagttagactttaattattgcaaattaataaaaaaatgccctagctgatttacatagtcaaaaatgtgttttctcatttatttctggaaatgttagatgtaatttaaaatttgttatttaactctcctagagagaacagtaattgacttccaaacttattctttcaaagtatcaaaaaataaagatgatattcttagcagaccctcttgatatatccatcttcactctgaatcgttctaaagtctgtattttttcagctctaacaatattatgaagatattcctgtctgaaaaaataactatatagacaccccattctgtgtaggaacattacaattgggatctctgtttagactgaattggaactaccttgtggaacgctgaattctatttttcttgctttcctctctctccaactcaggctactatgaaaagaggaggtcttttttgttatttatcatatataggctttggaatactaacacagaattgtgtccaactttcagacttagaataatttctttacaaagttgttgaaagactcaaaacattctcaaaacattctaaggtcaaatttggactctacatttattggcaagatcatactgagggcaatacctttaaccactctgaacttctatttcttaaaataggctgggagcagttaaataagagaatatatatatatgtacatacataggatggtaacataatataaacattaattttacgttccgtgtggtgagatggaaccaactaatcctgtagttttggacaagttgcttaataccttaaagactcagttaaatggtgatattaatctaatattttagttaaaatattaaatgataatagtgcatatttcttaggccatgttatgcctggagcatagtaagcacttattaaatattatttaaaaatattcaacaaatgttctctttcatccttctgtatgagtgaaatggtgttaagttccaaaattaattcttctggaaaaatataatgaatgccttattaaaatgtataggaaccaggaacatgtggagcatcatgtgatcaatgtctaagtgctctgtgatcactccagggaataaaacaaaacaaaaaggcaatgttcttaatttctcccattgcaccaagggaacagcagaacatctctccactttggggaagatgtttagtgcaagagaagtgagcagaggcggattctacccatttatccttgtggaagcacatgcagttcgagaagatgaagtgaggaagcgcatgcagtacctggtcatctcagagtcaggtagcaggcctaggtggtagtgggaatagggagctgagaggaggaagcttttgtcacactcaacaggggaatagtgcctgggagaagcaggcttatcacatagtttgttcacagtgctgtaaacaggttccggaggcctggtgatacaagaggaagagaaagatatgcatggttagtacatacaaggaacacctgtgcaaccagtagcatctcagcatgtgcaaaagtaaaaacaatgccattttatcttgatttgttactaaaagaaacccaattttccacttgtaacttttcttataataaagactttattcctcagactcttctgtgggtaaaagtggccccatgaaaatgttcagtccaatgtgatgtgagtgctctgaagtattttgtgaactagaatagctgcttataaggaagctcgtttagccagaattcttgaaattttgttctctcccatttcctccgtttacttacctggaacacagacatgatgggtggagcttcactggtcatcttagaccatgaagcaaacttgaggataaagccaaaaaatacacatagtggaatataaagatagaacctgtgtcactgataatatggagtggcactataccaactctggactagctacctttgaattccttctatgtggataaagataaactgtgttgttcaagctaggatcatttttttcttatataaataggacctaatattaacagatatactcctacaaaatttaagactgcacatctaatacaaagaaatagtataaatagggcctactacaaatgctaatatatttaattatgtttggagtccatctaatatcttctgtatacataggaaatgtaaagaatgttattttctttccatataatttggtcctatgaccacttggagaaatttctgcatcttaatttgaaaatattattatacacaaaatggtagctgatctaaactgccagcacagaaccttagaagaaaggattcaatgacttcttttagatcataaaacattctcatgataatgtcatttcggtaacattgttgtttctgcctgggagggctgatccaattttctcagtctgatgttgactctacagactaagaaaatgatgtttccaattttctcctagtccttttacctcagtagcaccatattctgagtcacattttcacaatcaaagctggctaatggagatcttttaaaaattcctggttatattgtatttaactgaattctttattcagtttctctttgaaaatattttactttctgaaaattacaataaattcaagccaatgaaaatgagatcctgtattttgtccagggttgaactcttgaaacttttatttgaatcttttgggaaccattttgtgaatataatattatcgtttgattcacatatttaatagatttggtgtttggagcaggctttaatacctcggattttagaagaaggctcttatttctttgctttcagtcaccttcaggatggtttcatagtggactgatatttgctaagcttaattcttcaccgttcaaagtcttatcaacacagagaaacagttactgatatcgcaggttcattttacctttgtttcaccttctatttcttacctatttatttacttgttattttgtacattcactggctaaagaatagagatatcacatccagtttcttttgttgattgtgagagcacttaatatctcagaagatgagtagatgaaagtataccaaaacataacaaaccacttgacaaatttgacaaagccttcttgcaatactgacaaggttctcttgcaatcaaacaacaacattaaaaatatcagtaaaaatcccctttcaagtggcataaaaatggggttcacatttgaagattttttttttttttttagacgtaatctcactctgtcacccaggctggagtgcagtggcgcaatctcggctcactgcaaactccgcctcctgggttcacgccattctcctgccccagcctcccgagaagctgggactacaggcgcctgccaccacgcccggctaattttttgtatttttagtagagatggggtttcactgcattagcaaggatggtcttgatctcctgacctcatgatctgcctgcctctgcctcccaaagtgctgggattacaggcgtgagccaccgcgcccggcatatctaatggttttattacagcgctaggattctgtcatatattctatcatatagtatgtatattatgtactagagcacagtacagtatacagaaagtacaacataggctacagtctgaacacagaaatggcacatagtaggtatttggtaaatgtttgaatgaatagataattttttttttttttagccattctttgcagagggaaattttaaaaaaccttctggttctttcaagggagccataagctactctaaatttttcaggccattataaattctcacaggttataccagaagaaccagaatcccaatgttatcatgaactgagtggctttaagtacttaattatagcatgtgcgcatggttcatctgccctcaaagggataggtttcttgtgcgtttgagtttagccactgaaatgcctgcccatagttcctgtgagagtcgctccaatgggcacagtgggctcctcacagacttctcggccctgagttccagaaggcctaatactgggagccagcattcttagtctttccctgcagttatattctgtgtgacctctgcccatcagacaaacaagaaatgccgttttataaaccatcactgaaatctgggtggcagaacagatgccactatcacttcccatttagttggtaaggaagtgccaaggggaaatgacttttggcagcgtgaatcagccagtcataattgaaagggcctgcttatcctattataaactgccagaatggcctaggtcagaaggtagtgaatatgaaaatccaacccaagaggcctatctgtggatgcccacagagggagggaaaagtatttgaagatattggtacaatctctaagtgaatttataaacaaatcatttctcttgctgtccatttataaagagccatagataatgacgttgtagctcatctgctgagccatcagcatttatttgcacatctatgggtttataattgcaggttcttatagcatataattagcacaccctggcccttggtgatctctcttttctctgaactccattagcacttgctatttgttctatttccttgtcatttttaattgctaatccacaatactggtgtatgttggagggaggtgcttcatctataccttattcttaggaaaactactttgcctataactgctccttcccatttggaccacttgcactatcaaattcagtttcctccctaaacaaagcagtttagaccattggattaggattgggcccctcaccttgcaaccatgatctgtatggtggggctcaaaaaaaagaaagagagaaaaaaaaggcctaggccatttggattctcctatggaaggtgaataatgtgaataaaggagaaaaaattttcagttaacagaaaaaggaaaagatgcaaacatggagaaggtagctgtagctgtgtccactaattatagagcaccagagtgaagctctatcaaattttgttgctaaaatgtctagaggttccttgagtctagaataactgtctgggttcattcttacagcagggttatgagagctcatgctattgaatttctttgatgattcccatatgacattagttgtcaatcagctacccatctcccaccctgttcccttattggaagttagatctgatctcatgtttgcaatcactacagtgaaaataaaacaggcaccttgtttattttcacatctctttcatatcacctcaactagactatgcctcccaaagccaacagacaaaaccttgggcctctatgtaattacatagtacctgagactaataccagactgactctatctttaaaagtttgatattttgttcattataaattcttttgcattaattttattttctaaaatatttcattaaagtatttttgtcttaattgctgtttctcggtgtccccttaaattttgcacccaacatgagtacctcactcacctcactatagtccctgccctgtatcagagataatgtttaagacagtgataataatgactgtgattgtaaatagtcttcatctgtgtagcacctgaacctacaaggtcaaaggaatatgactctcttctctcagagataacaatgagagtgacttacactttattgagttttctaactccctaccaaagagctctcaaagccttcaggctgtctcaggcagggacctcacctcattgcactgtctttattaattcacaatgctctctccttctctagaatattagaccctggaggatcaggaccaaatctcatgtgtctttgtttccccattactttcctcaatgcaagaatgtattactgaagtactgtcatagaaaatgaaaggaactgtgaaatgaaaagtgatcagtaccttttattctcttttcccgagccagaactaaaaggggacatctaaaattacaaaaagatggatttgggtcatatatgtatatgattttgagcataaatttcttcatcatatagactgatatggctaaatctgcagaactttcagattctccaaaggttatcctgctatggttttcttgggttgccataataggagggggcatccaaccgcatgccctgtatttgcagaatatagaaccaaactgcattaattatagcagctgggacgtcaagggctcagatgcctaagtatctaatatattgccagatatcatttgaggaaaaaggattgtaactttaaaagggtgcctcatgctcctctttacaaataatacactgtttattgggccaaggatttggaaaagtataagaggattgaattccagtcctgggctaatagctcttaagggtgggattttgggaagccctaaaagtaattaggggataaaagagaattagtatcaggctgtgaactatgtggctcaacatgtgaaatgacattataaaaatggttaagaaagaggctgacttctcttatactgaactttaagcagaaaggtattagtcacttgattaaggtgttatacaggccttaaagtatgatatagagacatctaggggagggattgatctaggtgatttgtaagaacctattcgctcccctaattccaagcaccactgaattgggcactcaagaatttccacgggggcagttggagtagatgcctatttgcgccacgcttacttaactcttacaaatcttagctttctcatttatagacctaaaataatatttaaaaagatttttctgtttaccagaaaaattataaattgcaaaattatgcacagacctaaattattatgagcaccatgttaagtacaagcaaaccaaactaggtttagatctggctctttcaaattctaccttgtatgaccttatgctatttcttaacatcctcatctggaaagtgggaatagtaatatcagcctaaagatgattgtgagaaataggaacaatgtgcataaagcacttagttcagtccgtggcacttactcagagctcaccaaaaaggagccattattattatcttgattatcactcttagacactcgagctcacaaggatgcataacctcagaaaatgttggtcccctttgtgagaattcctacaaataatattcttcacccactcacttagaatcagtcagttcacacgatagcactttcatgtaatgtgaattctctacaagagggttgaaccaaggaagtaacaatcgatggcttttagtctcgcaaaaggtactgcacaggtgccttctaaagactcacttttgctctgtatatttaaaaggtaattgatcctctttaatagccctggaggttgatgaccactttctctgtacttctcaattattttcactgcctctaacaatatagcagccccaactctaacgcccgatttgtacctggatctttataatggtttgctttcccgtatggttcacagctgtggtatcacatcagattgttgggtcataagtaatttgttattaataatagtttagataccacagtctgcaaatacttactatttaaaagtagaaattaggattggttcactattttttctatgtaaacatcactctcagttatattttactgtgtttattgaggagtttattggaagattgaggagacaaagggcagagtaagagctgcatcatttaaagttgttttgaatattaagatgctttatttccttaaaaagtgtttgggtttcaacaaaattaggctctctcacggcagtgggttgtaaatgggttatggagtgtttcattggaataagaagttgaatattaatgaccttgacaatggtgattgtaacaaaagggagagggatctctgtttttggtattgggtgagggtgtccagctatagtagaatttttgtggctttctgaaagatgtttaaacaaatatagtctaagagtcacagggtcaatattatggccagatcaaggccgttgagacatggatttgaattatttgaggaaggttcaatatgtcctatactagtgtttaaactcttacacttttgtaaacctgcttttaaaggctttgtattgatttttaaaaaatttttaattgaactcataggataaatatagatctacaaaatgtcaggttagtagttactaagaatcgtgatggaaaaaaaattaagcatgaaataaataggaggaatcacataaaagatgagagatttgactacataaaaatttgaaaccagccgggcgcggtggctcatgcctgtaatcccagcactttgggaggccgaggtgggcggatcacgaggtcaggagatcgagaccatcctggctaccacggtgaaacccagtctctactaaaaatataaaaaattagccgggcttggtggcgggtgcctgtagtcccagctactcggggaggctgaggcaggagaatggcctgaacctggaaggcggagtttgcagtgagccgagattgtgccaccgcactccagcctgggcgaaagagtgagactccatctcaaaaaaaaaaaaaaaaaaaaaaattgaaaccactgaagcaagaactcataaacaagcaataagctggggaaaacatttgctcaaatatatttatcaatattttaaagatgctcctacaactcaataagaaatgcaataacattttagtaaaaaacaaagacaattagtatccaatcacaagagaaaatacaaatgacaaatacacacacacatataaataacctcactaggaataaaaataacacaaattaaatgatacatcccttttacctatttttaaaaaaaggatcttgaaattgacaaatcacaatttagttgtggtatgttgaaacagacactatattgctggtgctatggagtgtaaaacctccttaaaacatttcaagaaagcaatttggcaatatatttcaggagttttagaagtaatcctgtcttttggttcagcaattctactctagtgtgctatctgaagaagaaaaataaaaaatatgtacaaaagtttctatagaaggaaagtcattgtgatttgttataacagcaaaacagaataaaacaaaacaatcaaaatgtccagcaaaagaagggtatggaatataagacacattcacatgacggtttattgtttaaccattaaagttaatattcataaaacattttaatgagacaggaaaatgctttattttataatgttgaataaagttaaatacaaaattgtatatggggctgtggggacagcaggaagtgaaagcacctaattctcttaccatttcagagagagactgagctaagaatatgtgaaagtaaacactgctgagagtagcaattctagtgcaggtttgaaagagggtgaaagggtgaaagagggtgaaaagggagaaagagagtgaaaggggtgaaagagggctttctagaaagtggtaacagcacgtgcagatttaaagaggaatctgcaaacatgttccatttagggagtttgttaatggtttgagtagataattgaaaagttaggcaggtcttgagtacaattttaaaatccatagttgataagaagttatggaagacagtgttcttcctactagttggaattaaatgagtacaatcattttggctattcatttgtacattcattcattcattcattccacaaatatttaccaaaaacctactttgtggcaggtatatagtaaaacaatttaaaaaatggtccctttgtttgttgaacaaacattttgtttgtaaggaaatctgattgcaggaacagagacttatttaatctactttaggtaacaggacacatgtgcatagaaacccagaaaaagctgtgtgataaatacggaagagtgagatctaaggagctggatctctacagctttcccttcaagataacgctgtttcttttgtgctacttgttccttctgtctcaaatcaccactttgacctctaatttataattgagatactttctacctgatagcttcttcttgccctcagtttctgttctgtaatgacatcagctggcattagactcacaatggatcatcgggcctcctttacatcataaatcactagcttcccctttcactgatcattgcctcggttgaactgcttttcaattaaacattcctaactgagtatttgttggacttagtacacctttttgagtaaaccaccttattggttacttgttagcctctggattggcatcctttgggccaagtacactccctgtctattcagctctcgctagcagatgagtgacctggtccttatgagtttggtttgctttttcagcagaccggtgggcagggcacaattgtttaagctgggtatcccactggtattttcaggtttgttctgttgagtatactccccacatcttcatattcttagccagtactatgaaaccacagtgtagagaaaaaaagcaaggccattcctttttgagaaaaacttggaaataacaaaagagaaaggaaagtgtgaggaacattacaaaggcccccaaagagaaggtctgaagcttaatatcacctacaatttctttctttttatcatggtgtcaaaaatataatattacagaataaatactctacctctaaaataattcttttctttcctcggaggctcgaggatgattgacattagtaacacctaaagttgccaaatctgataaagctttgggttttaaaattcacaccccccacaagaatttctgaatatatttagcaaaatcacattttctaaagtagaattcaaaatgtttattcatctatatacttctgtaggccaattttacattactaagacaaactctacaggggggaacactcttatacctttaactgaatagatgctaagactgaatataacagcagcttcctagatggcaaaataatgttcagatataattctctacttgtgaacaggaaggataaggtggctttaatcgaatcacttaaatggatttctttcacattccttggaagaggtacatttccctctgtttcatgcagctgtttccatttagtcttctgtgcctgttactgtaaacaggttatgaagattgtttggtggccatgagggaaggataagacatgcataagaacaagagattgttgtagcactgccttgctctctttagagaaggctttttgctaagaagcacctttacatatattggtccttccttccacccctaaacattagaaagtccctggtttctatcagggtctaactcctactttctccataaagtctgttgagtacacctgattgtagatttttctctcttcttaactcccatacagtatttcttcatgattgccacttggttttgtactttgatgtattttaaataataataacaactcacatatatcttgagaacttactatgaagctggccctgtgctacatatgctttatatacccgatgttattaatcctcccatgaaacctaagacatatgcaatactattatctgcaaaggttggcattaacctgcccctcctcacatacctgacttgtgagtggtagcgcttggctttgaacccagattgtctgggttcaaaccactaagtgttctgttgtcattgttttaaacactttctgtagtatatacttgccctcagtgatctgattatatttcttggtcatattagcaattatacctcctattttaaaggcaatagagaataggacagaggaaacaaactgtgattctcactatctagattcaagtccggccctattcctttaagacatgtgatcttgggcaggttgtttacctctatgcctcagtttcctcccctaacccaggaatagtgcttgggtcttagggccttacgagtattagacgaaatgatgcatgaatagcacagtgcctagaagacaatcagtaaatgttttgactactatagatatttaaataggaaatctggctgtaggccatccggtttatacatctctcttgtcatgtctgtggatgtgaattcattcatgagagacgattccctcttatgaggacaaaaccatgtttctggccatgtctagggttacaagatttagctaataaaaatataggatgccccagttacatttctattttggaaacataacaaataattttttagtataaatacgtgactattacatgaggcacatttatactgaaacttattcattgttgattattatttaagttcaaatttaactgggcatccttatttggcaatctgccagccccatcaccttgcaagttcccatgcattgctagtaacctgccttccagcatatacatttactctgtaataaaatttacttgtttactctgactctccctttagtttgctatgttcttttatttgtttttaaaatttatttatttaattaatttttttttttgagacagaatcttgctctgtcacccaggctggctggagtgcagggttgcaatctcaactcactgcaacctctgcctcctgggttcaagccattctcccatctcagcctctcaagaagctgagattacaggtgcgtgccctcatgactggctaatttttgtatttttagtagagacagtttagtcatgttggccagtcttgttttgaactcttgacctcaggtgatccgccggcctcagcctccccaagtgatgggatgacaggtgtaagccaccacacccggtctgctacatgcttttaaatcagcatatgtgcttaattttgtattttcagtgctcattaagatgtctctatttatatctatccccatatacacatctatactcaaatctatacataagcatgcagatagataattttaaaataaaagttgctcatattatacatattatgccactgcttttatttttaaatttcacattggatattagacgtttttctgtgtcagtacacatggcaccggctaccttttctttaatggctgcaaaaacactctccacacactggtgttggtagtataaactgctgaacctacagttcagaaatgttacttccagaaatctgttctacaaaactgagtacaataggtgttcacagaattgtcattgtcacagcatttgtagaagcaaaccactggaaaaaatatttatgttcattagtgctgaatatagttttaacgtaggcattaaaaacattcctgtgtaagtaaatttgatgacataaaaagacagccacaagatattattaagtgaaaaaaattcattagcattgaatacagttttaatgtaggcattaaaaactttcctatgtaagtaaatttgatgacatataaagatagacacaccatattattaagtgaaaaaatcgagttaaaataatatatatacagtttgattcagtttttgtgaataataaaaaatattaagtacgatcccaattttacttagtagagaatgagattaaaaagagtctagaagcatacgccagggaatttgttcaatatcatttatgaatgatatgtctacataaaatttttatttgctcccactatttcatgttttctaaatgacattaagaattattaatgacataaactgagcaatagttataaatctgtatatatagtttgatgccaattttgtaagaggcatatctgtacatctgtaggttaatatggaaaagttaccaacatgttaatagtgctttctctgaatggcgggattatgggtacttttgatttccttaaatttttttttgtattttaaattaattttttaaaaatattttttgtaccccataaggggatagatcttgaatgttatcaccacacacacaaaaaaggtaactatgtgaggtaatgaatatgttaattagcttggtagtggtaatcatttcacaatgtgatatggtttggctgtgtccccaacaaaatctcatcttgaattcccatgtgttgtgggagggaccctgtgggaggtaactgaatcatgggggcaggtctttcctatgctgttctcatgatggtgaataagtctcatgagatctgaaagttttataagggggagtttccctgcacaagttctctctctttgcctgctgccatccttgccttctgccatgattgtgaggcttcctcagccacgtggaactgtaagtccattaaacctctttcttttgtagattgcccagtcttaggtatgtctttaccagcagcatgaaaatggactaatacacaatgtatacacaagaaaacatcaagttgtaccccttaaatatataaaaatttgtcaattatacctcaataaagctggaggaaaaaactattttttcttgtaactccaggggaggactgttagggatatgtattgggtacttttcaattcagccccaaagatccacacattcttaacccagaaacagaaaatatgtattttttcaaattagtactgtttccttattaatgagcaacttttatttctatgtagtgcctaggtactaactaacatggcattatgagaatagtgaaagttcattataaataactggttatgactaacaagatggcttaactggtatcaccatatttgctatttaaatttgtcaatctcaaatgtcttcagttatgcaaatatattctgttactaacaagattctacttaaagtttagtctacttcggggaaattatgtgctagctacagccattttatagaaaagatgacacaaaattaaagcaaatttacagcaagtatagtcttttttactggtgcatctattcactcaacatatttactgcccttagaaaacacattgggaggctatgaacatggtggaaagagcgcaagcttttgggctagaagatctgggttcaaatactgttcttccacctatctgtgtgactacagggaagtatctctattgcctgaatcttggctgccttatctggaaatggccttttaagatctaccttataggactgctacaggattaaatgagataatatacgcaaagccttcacaaatcacctgccatatggtacatactcaggaaacaactatatttatataccagatactaacctatgtgatatggaagataaaaatctgctcttgacataaattcttccctcaaccattacttcgtcttggagatgcgtgtatgtatttgacaaaataaagctaaaaatgactaagcattatgggagggaaatagacactcttccctcactgacaaaacacattcttaaggcaaccatacatatggctttcccgtttatgctcttttaaagtctcagaaatcaccactaaagaatgtatttatataatcaaacactgcctgttccgccaaaaccttttgaaaagtaagtaaataaataaataagagctgttttcttgtacactgttggccaaagtctttcatgcaggttgagtaagatcacaaattaaactgagggacagatgactagtcatgaagcccaagaaagacagcattaattgcctattgtgaggatctagagaaaactgtgctttattaccgatcctgactggcccagtatagccgatggaagtcagaggtgctgttaagtgaactactggaatgaggacacagggaataacagaactagatggaagagattttttagaaagactagcaatagagccaaaccttctgtctattatatctaaccaatccggaatagattcaacagatgagagaagttttaggacaatacattccaatcacagcttagatagacaccaggcaacaaaactgctagagttgtaataaaagccaggcacagtgaaaagtaatggtcaaaatatcaaagagccaacgggctccacagaatcttgaggtcagcccagaataactccgtgcagcagggtggtatacagaatatagaatttggagcaaagtcaccccattatcttcccttttgtctccttaagaaatattctataaaatctatgtgatttgcctaaaatctggaattgggttttttagatggtgaagtagaggagggaaatggttgaattctagattattacaagaatggagggtccccaaatttctcagtcactatatggtcacaaataccatcacctttaatctgtacaacaacaaactttcacggtggatattacatatagcttttgcataatggtggcacatggtggcgcacgcctataatcccagccactcaggaggctgaggcttcagaatcgcttgaactcgggaggcagagattgtagtgacccaagacttcatcattgcgctacagtctgggcaacagagggagactgtctcaaaaataaataaatacaaaaataagtgggagggagtaggataactgaaatattaatgtgagttttgagcttcctgttttttcttcccaagtgtgaagcagataaccagacctttatattcccttgcctcagtagagatctgtaatacagaagaaaagcagaattttcccaaagacttctctcttccaggttttcgttcctcaaaaatctgagctcctaaactgttgatgctcagggtgagctctgagagaaaaggcaggcaagatagagcctattattatatatttggatttaaagaaaataaaataatgctctgtcaaaatgcatttatagagtgaagtgcatatccgctacaggtgtttttaaatagctgatgcctttagttataaaatctaaatactgttgtacaaattctgtgtttggtaactcttgctcaggagcaatgattttctttgcacattatcactagtagtctcagtggtttagggtcgtccgctattttaatgaaaatttatcctatgagagaaatgcctctgtgtgtgtgtgtgtgtgtgtgtgtgtgtgtgtgtgtgttttctaatgtgcttttactttttgcattttgctgttacttctggtaacatgattttccttctctttccttctttccttccttccttccgtccttccttccttccttcctttccttccttccttttctctttctctttctctctctctcttttttttttttttttgacagagtctcagtctgtctcccaggctggagtgcaatggcacaatcaaggctcaccgcaacctctgactcccaggttctagcaattctcctgcctcagccgccggagtggctgggattacaagtgcccaccaacactgctgactaatttccgtatttttaggagagatgtggcttcaccatgttggccaggctcgtcgaactcctgacctcaggtaatctacccgccttggactcccaaaatgctgggattacaggcttgagccaccacacccagccaacttctggtaatatgattttctgaggtcaaagacacaatgaatttaagacagtgattcccaaatctacctgtgcatcagaatcacctgtggatattttagttctgtttttgacacttatgtcccacttccaccctggacatccagatttggtagatctggcatggggctaaggactctgttttctaaagagatttcacaggtgactaatgggctatcagagttgagaactacaattagacccgctctttttgaaaaaggtcggaaatagtcacatttttgaatgacattaactctttcggtactatagaatacaaattattgtgctaacttattatgacttaattatattccatggataaatgttaatatttgtagagtgtaaatattaagttcttttttcaagggaagacaaaaaattgtgactttcattatttcactggcgaatacacacacgtgcacatacacataatttttaaaaaatttttgttagcagaatttaaacaaatatttctctctaagctgcagaaaacaatggttctggggatagccctaccttgctttagtcaggcagaccacattctcactgtgagtgccacactcagttgcaactccaacatagtttcccttagttctcacaaatttaaattcggtataaccttattagagctactctcaatattatatggatttagatgtatactctgtatgaaacttcgacagtatatgatcgaaactaatattatgcagtgaagccatggaattaatgccactcctaggaactggaaagcgtcatgatagatgttgctatgcatatatttaatttctgtgctcatataatgatggtctacaaaaataaccactgcatttactttttaaagtttatgatacctgaatgggaaatctgaatatttggggaatgcaaatatttgtgattactcaacattctagattttttttttaagtttttaaatgaataatcagtttctttaacatagacttttctttttgcatgacttttacaattaggcctggtttttgacagattcttcttaattaacatcagtatatgtttttaaaaggcattgaaatatagagaaaacatcactgaatcaatataaagtcacaaaatctattcttaatacaggtacaagtgtagtgtaaatgtatgttttattaggctagctgtaagagtgtttcccccgcattcacttcttaacctcactctaccactcccagctagctcaactatcatcacagcggaagccagtcctataatgactatggtttcctggactaaaagtcaacattaataataataatggccaccctgaatgtagctcattttgtgccaggctctgtttgaagtgttttacatggattaatttatttaatcctgataataacccgtggcataggcatggatggggaaactgaggcacaaagaagttacataactcatccaaagtcaaatagctagtaaatggtgagcccagactcttttgagtctaacatctgttctcttaaccaagatgttatcctccttctggcttctggcttctgagtttgtcacttactttctaattgtcaaaggcgaaatcatggaatctatcatctcaggttccaaatctgtacaacagatataatggcatctctccgtccattttgtataaagtcataggaattaaaatgagaaacaggaaagtatctgtgcagtactagatagctgtgacagtttactagtactattataaattcagagcaaggcttcacaaaattggctttgaaatatttgactatcacatttatttcagctatttcgttttgccttcatctcttatctcaaggtggaaaatgagactttagaaaaagattaaagcaaaacaaaaaataaaatctcaggctccaatggatcagttgataacattcccattaggaaggagtatacatgagaaaggactcacattgttctacttcaaggtcaatccaatttttttaaagaaaacctaggatgggggtggatatttaaatgtttacatgcagtgagacaccctcacaaccacagctaagttctttcagcaaatgcttattaaggcagccacatggggtctatgtaatggccagaatgacaggcattaaggactgactccccacccagcactccatggaagttgattgctttctggaacaggttgtgtttctgggaggaggcaaccacataaaactttagttctacctttctaagtaaaagaaaaaccaagactagcttgaaacagagagaaaattctagaaatcttaaagttaataatgctacctatgtagtactggaaaaaaaaaaaaaagccatacttgagttggtctgattcttgaccttgttatataccaactgcatgttaatagcataaagatatggattttggagcccaactgcctatgtttagacaccagctttgctcattactagctatgcaggcaaggacttaactgctctgtgcctagatttcatctgtaaagtgggaataaaaataggatttacctcatggagtgatgggaaggttaatgggtttatatacttagagtgtctaacacattgttatgctagacaaatacttatcttttcactaatctttcttgcttctgcttactcatgcataaagtgaaaataataacaccaatctcaaaaattaattgagatattttatggaaaatacttagcatagactggcatatatatggtagaaattcaataaatgacagtaattattaacattaattcaaaatgaatttttacattttttctaatattgttgtccctatggtctccagtgttgattagaaataatttacaagagagtatgaaacattctttttctctaatgggtttaaaagcactgtagaaaccaagtaaactaactgagattgtagactaaatgtgataatatttgaaaggtatccagcaccaagcagatctcaataaatggtgttcctttcccatagctctttaagattcaataccatgttgtatgtgataactacacaaataggttttaactctaatgatcttttcccttccttacccccattttcttggattaatgtctttttagattatcaacaataaaaaataagaattgttgctcctatgaggatggggaaggaggaagcaatttaacatacgttaaatgccagttatttgatttccacatggtatctctatttttcaacactaccctgccaactaagttattatctcttaattacaggtaaagaaaccaagggataaatagtgcaaggtcatagaactatttaatggcagagcctttaattaatctttagcaaatttctaggatacaatgtagtattattaactatagtcaccatgctgtatattagatttgtagcatttactcatcctgcataactgaaactttgtatcttttgactaatatcttcgtgtttcccccttgacatgtgcctagacttatccagttccaaaagtcatgctacttccttccacttaccttcctgcctctaaaaaaataaatatcttagaaatactagagttgaaaaaaattgaattacacaagattatgggtagggccttcaataatggacctttaaaaacaactgggattaatcaccataagttttataagttataatttggagactagttcccagatgttaagcctaatctatttacctcttattttctatatggactgtacattttatataatgttttatcgcttgtagcttccatcacttaccagctgagtcagccttgggttagtcaacatcagttacctcacgtgtaaaagggggtaattatagctgcctcctggaattactatgcaaattaaccaatgtatatcaaagcactttgtaaactgaaaggtattacacaaatatcagttatcactattaccacaattcttatgaattctaagaagtatttaattaatatctgcttataactgaggatgttctggccctgaatattgtttgtaaaaaatacaagcaaatggccaggtgcagtggctcacgcctgtaatcccaggactttgggaggctgaggtgggtggatcacttcaggtcaggagttcgagaccagcctgaccaaaatggtgaaaccctgcctctactaaaaatacaagattagctgggcatggtggtgcatgcctgtaatcctagctacttgggaggctgaggcagtagaatagcttgaatgcgagagacgaggtttcagtgagctgagatcgtgccattgcactccagcctgggcaagaagagtgaaaccctgtctcaaaaaacaaacaaacaaacaaaaataagcaaatggcttgggccacagaatgaatagaactcctgcttaagtatccttgcatgtaacttttacaatattgtctcccattataccctggaccctactgaagctgtcacaaggaagtcttagatactagtggctaattcctattgttcttttccaatctcagtcaccccctggaagaagctgttcctgactcatcagtctggattagatgccttttctgagctccacatagctttcagtactgctctccaacacagcatgtatcacctctattatatttttgggtttatttgcctgcccccccctccacacttccactttgctgtctttttgaagatattacacactggcaaatatttgttgaataaatcaaagtatggaaagtgaaagattgaataaatgaaacgagagattaacaaaataaatgaaaagaaatgtagaggaaaaggagaaagagaaaacatgggaattaaagataaattaagagacataagcatttaaattagatacagtattaaaacaagcatttccatatacagctgatgggaatgtaaactgagaccaaaaaaattcaaatcaatctgatagcaatatcaagagttctgtaaatgttcattaattatattatattcagtacacaaatgtttactgagtattatatatgttccaggcactcttacttgtgctgggactaatcaatatacaaaacagataagtccctgagccataaagcttatagcccagtacaggatgacagacaacaaacaaatactcaaataaaaatgatgtcaagcaggaataagcactagagagaaaaataaaagggaacacaggacgaaagggtgatcgtggatggctcatatttatctgaggtctgagatggcctctctgataaaatggcttttgaccagagaggtgaagaaagaaaagcaaaccatgtggacatgtggatgtggaagggaaaaacattcaaggcagaaggaggggcaagcacaaacttcctgaagcaaagtatgcctactgtgatcaagtaacaaggaagtctgagtatcagtgaagggagtggtgggggatgaggtcagagcagccagctggagtcaaatcataaagagtctcataaataagggctttagatttcactccagatgacgtgatctgaatttaaaagagtaatgtatggtgcagcatgagtaacaaaggcaaaaatggaagctgtttagggagctattgcaataattaaatgatagatgatatgaattgactagtgtgctggtagtggaatgtggcacattgtggatgtattttgaaggtaaaacccacagaatttgttgatggactgcatatagaatatgaaaggcggaaaaaaagagaaggcaaaccccaaggtttgtgacctgagcaacagctcccatagaaccgtcatttattaagaagaggaagacaagctgggtgtggtagctcacacctgtaatcccagcactttgggaggctaagggcagggggatcacttgagcttgggagttcgagactagcctgcccaacatggtgaaaccctgtctctacaaaaaatgcaaaaattagcccagcgtggtggcatatgcctgctatcccaactacttggaaggctgaggtggaagaattgcttgagccccaggaggctgaggctgtagtgaactgagatcgagccactgaactccaccatgggggaaagagtgagaccctgcctcaaaaaaaagagagtaagactatggaaggacagactgggaataaaaagcaagagtttgtgtttggacatattaaatatgcaatgtttataagacaaccaagtgagatgctgattaggcagtggaaatttggcatttatattaaatacatatataatcaagagatgaaggcagaaagattgtataagcacaataagaaaatcctaaaaataaatgtctattaataggaaagtacttatgtaaattatggttcagttatacgataggctattatacagctactaaacatgtttttgaagactaagaacattagaaaattctcaagatataatgctaaagcaaaaaataaaagcaaaaactctctcattgcacatagtatggtccaaattacatgaataaacatacagacatggaaaaaactcaaaggaaaatatttcaagtaattatctctctgtggtaggaaaaacagtaattttagtagtttttctttatatttttattttacagtttttctacaaatatatattacttttataatcagagaaaatgaaattagacaaaaataaaacattgaaagaaaaaaattaaggagggctataaggtagatcagtaggtaataaaaagcaaatggatataaagatggaaaaaatatctggagacatatataaagcagtattttcaagatgtgtttttacacagttatagtttgccccattatctatattaatacaattacctagaagtaaaaaatgaacgacataacccaaaacttatgaaatttataaattgatagtgtcgtaagaatgtctttggaatgcaatgattgtatctcacaattttcctatattttgttcaggtaattactaatattaatatagtaaactcacccacagcagctaatgatataggacaggagtcctcaactggtcaggtctatggcctgttaggaactggccacacagcaggaggtgagcagtgagctttactgcctgagcttcccttcctgtcagatcagcccctggcattagattctcaaaggagcgaaccctactgtgaactgcacatgcgaaggatctaggtcgcatgctctttatgagaattgaatgactgatgatctgaggtggaaccatgaaacagtttcgtctggaaacccatcctgcccctgccacctgtccatggaaaaattatcttccatgaaagtggtccctggtgccaaaaaggttagggaccactgatatatgagatggcaggaaatcacccagggattgcaaagtgtcatggacaattgctaaagtatacatctgtgggcaattaggaatcagatatcttcttgtcctatattatcaccttatggatgtatgaacatgaaaataaactcctagaagaacagaccatgtctattttcttgagtcacagtataaatcctctttcagtgtcatacagattatggccagaaataagcttcacattgtgttcatgatagtggttaacttgtaagaggatagggaccaactgatggttggcttctacagcggtccctccaaaattctccattgcctatcatcaatccttttttgcatcaatgaactaaagaatgaaagcaaggatgaacttactccattaaaaatgtaatgcaacattgattaaattactattcaaattttacatgtatagcaacaatagctatgtatatgcaattaccatttccataaaattatagagcatagtgttgtgtgtttatgtctggctaactcatgagcacataggaaatgataaatatctataggagccggttttaaatttctcattagtgttgcatttttgctaatatttatttccttgaaagcaaacagcagcttaacgtgttttctaatatatatttggatgttccccttgaattaagatttgttagattcgccattagcatacccactctctctgcttcctacttctagtaggatagttctatgaatgattcttcatggtttatataagtaaacctatgtggtttaaagttttgtgtggtcagttttctctttattgtttatttacattaataaagagaaaactctccttgaggcttccacataatgatctatctgtctcactagttttgtctcactcccccctttcatttctacactttgcttcaaaacatacattatagtaccagtctctatgttggagaaatcagaaatgcaacacagagcaaaacaaaatctcagagacatttgttcatgaacctttaatttggttaagttttataatgaactttgtaaagtctgtaaggagtctgatgtcatgttttgcagaactttttaagggaaaagctacctagagttagctattgagagtcactatgaattttttaaaagggcaaaatcaacaaattttccatcaaaaaatcatattttagccagagggaaaactgatagactagtttataccatatttgcttccactgatttctgtattagattttcattgcagctggtattagatattcattgtagtcataaaaattaagattctcaataaagcagtcagactatatgactctctgtaataaaatattctaatgtgttctacaagataaataagttgaaaaatccatatacgtagattacaacatgtttgagcagctgcgtaatattgttggctacagttccataaataatttgaggatatttgccaaaaagtggttttatttgtatcacggttcatcttaaaatccttgttttttcaatagtattaataacagctaacaattatcaggtacttatttttgccaagcacgttacatgtactaactcagtttattgtcacaacaaacctatgatgtagaaagtattattttgccccttttataaacggcaacacagaggcaaaggggagttacataactgattcaaggtcacacagctaggaaatggtgtgattcaaacctaagcagggtagctccaggacccacacacctaatcactctgttattctactgtaattctaaagccgggtcagttgcctgcttagggtactctagctgttttccaccatacttgactaaaagtgacagtgacaggaggcagccaaacgcctaggcagataggggtgggtaaccagtgaaaccccaccttcaagcaaaaataacagcctgaaacccatggcccaaagtgataacttctactcctgttcacccactctcccctgattggttctttctggataatgcctttttaccaatcaaatgttgccttttccaaaactacctatggcctgtcctgccctcatcctatgtatataaagactccaggctcagtcaataattagtgaactgggagatgcagaccctccctcaattggagtggacaccatctaatcagctgccagtgcagctaggataaaagcaggcagaggaacatggaaagactagactggcttagtcttccagcctacatctttctcctgtgctgggtgctttctgccctcaaacaatagactccaagttcttcagctttgggactcttggacctttgaccacagactgaaggctgcactgctggcttccctacttttgagattttgggacttggactggcttccttgcctctcagcttgcagatggcctattgtgggacctcaccttgtgatcatgtgagtcagtcctccttaataaactccccttatacatccatctcctcttatgcatccatcctattatttctattcctccagcgaaccctgactacagcctgacttcagggaagaagacctgttcttcctgtcccctctctagctcccctccctgctgagagacgttttcatcgctcagtcaaattatccgccttcactatcatttaatcatctgtgtgacctcattcttcatggatgctggacgagagcttgggaccactgagtgcaggtactcagaaaggctgtcacaccagaccttgccaccaccagaggagggcagccgccccacaccatgaggcaaggggccaactgagctgctaacatactgctgtctacaaatggcagaactaaaagagtactgtgacaccctctctggggctatgggattatgggcaccctcacctggatgccaccacgctcccctccaggagacatgccttgtctggccatgggccccacacggagcttgctcctgtgccagtgcctgaagcaaccagctggatcccacactcactcactcacatgccccctcccacaaggggttgagcacggtgggccaagtagacagggtgcccctaccgcgagtccagtgaaggggccaagagaaatcctgcatcaaaagcatataagaaaagatttctttcctgtataagaagaaacttctagttcactcagaatggttttaagtcattaaatgtaaactaaaaagaagagaggctagaacatgcttgtactgtactctgatgaggtgttgtctgatccttcgagagcttgttcctaatgggtaccataaaccttgagccattattaagggacagtttatataaaacacaattaataattggcaagtttgtgtaacttagctcagtgtttctcaaacttgggtacttaagtgtaccttggggtttgtggtatttgccagggattactaatatcttcagaaaacctttctggtgtgtcgacttcattttaagactcggaagaaaaataacgtagtttgtaataagaatatttttactttaaagcaaacaatattctgcaagcttttgtgataaaatatacaagattttatgtgtttttatgcttgggcagaaatcttcatgttctacctcagagcctgaggagaacaagtttattttctaagttaagggcatgtgagtagaaacatttgacaaacagtgggctggcttctaaccagttctaatccacaaagttaaacaataagagataagaaaaacagaacaaaaagaaacaaataacagtggcaaatacttatgctgttcctgaaagactactccataggtaataaaaactataaaaatggtcagtagtcaaaacagtctgactaagccaggtctgctcttcacgtggaacatgggctattaaaccttgctctgagatatagctcggatttctctattcctcttctcttccattgctaccctcacttcagtcccaggtgtcataatcttttccctctttttttccagtggtctctctactccacacagcagccagaactttttttttttttttttaaaaacataaatcagatcagttttcctgattagtactcttcaatgaattctcaatgaacttaaaattagacctacactttctcattacctgtgaagtcctacttctgcttcctgcttccttatctaacctaattttctgcctgctcccattatctcatctctttctggccaaactggactttatgttgcaggaacacagtaaacttattcctgcctcaatgactttggctttgctattccctcttcttggaatgctatttctctgatctttaatcatcaccactttctactttttattcaggtctcagtccatatgctatctcctgagagaggcactgcctggttatcctacttcatattgttctcttccccaatcactgctcatcacattatcctattttacttcctttgtagcacttagcactaactgaacttaatgcatttatttatacatctcttattcaatatactaaaatgtaaattccatgagggcaagcaccttgaccagtttgttcaccattgtgactatgttgctaataactatgcttgacatgggtagaagctgaatattcactgaatgagcaaataactgaacgaaggagaaaaggcaacttgaatatatattagatgacatggctagtaagctagtgttctataattcggagacaatagagtagatgtggactccagactgatgagattatgtctgttcagtaagtgacagagtcaaactggtgaatattagagttacagtttggggcagttcttgtaaagtgtctgtggacaagaaatctttattgaggctttttttatatgatgctttttaatgaactaaatgatgtgagggaccaataagtagaggcagccagaaagacacactaaattcacagctaggtaaacttggtttctaacactgagaaatatatcttttacagttataatttaggtccctgggtttcataatgctatttatcacattcataacttgggaaattaggtccctacatcttgaaagagtagttttactttgcattaccaatttttttgtttcattttagtactgtttgcatatcctaagtattttcagccagatagtgatgatgtgtggtttgcctctcttctgagtaactagggaaaacttggcccagtaaagatagaactcatagttaccggtaacatacaaaatagacactgttaccaggtaatccttgattgaagatagtttttcataattgctactttcttactccagccaaaaaaatagtgcacatatacatgggctctaaatctgattatactacttacaaatactggaccagggaaagccaacaaatcactctgggccctgtgtctctggcccaaccagaaagagagattagactctatatttacttatggccctttctattctgacagtctataatgcctgagacaaaaacaatctcagtattgttgtaatagctttattttccaaaaattgaaaatcagatatctacatcacaatgaatgccgatttatagggactcagtgagcatgctactaagagattgtatccaaaactttttttatttgtgacttttcttctaaattcatggaaaaataaaacttcccagtttatgcaggtgtacatttctttaatagaaatagattaaaaaatctacctaggttattgtagaattatttgaatcaaaattgctttaaaattcttaccgtacatccataacaaacgtgactataaatcaggaaagtagagaaacatttattacaatagattaagatatgaatacatggaacaaaagttttccaatttgatgtgattttataggttatgggaaagttcccatttcacagacatgtttccctactggcccaagttccgttattagagatttattttcttgatttactattttaggaaaatacaaagtaggtctcaaacataagcacctaaatgaacttagaataataatttacagagccttctaaaaatgacaacattcgtgcatgttaacatattaaaacttcacaattccatgaagaaattagaagatcctttatagcgaatctacggatgagaaaatcaagactcacagagatgaactgacttgttcagagttatctaggtagtaagtggtaggacgagcactaccaaccagggatgcagggatggggcctttgaaaacagacagacctgaattcaaattttgattctatttgattgctgtatgctatgaggcaattacttaacctctctgagaattttttaatctgtaaaaatcaagaataagaatatcatataaataatataggagcaataatatatattacagcacttattgttaacggtgaatagtaatgatccttttgtttttattactctatgtattgttaatcttacagctagggtgcataggagagaaggaacaggaatataaagatgatccaaaggtaggtaccattttcctttgtgagtcttatatttcaagttctaattcttgctttcattttattctatttcacattcttctgtgagtctgcacaatctatcccactaccacaaatgcccttcctcatctcttgactctctgaccaatgcctacacagttttcaagtactaattagagtcatatcctctttaaaactttctttgatgccataggttattcctatggcattcatgtaatactcatactcatttagcagtatttcctaagtgtctcttgtggtgttagggaactctgctagtgctacataagggcactttagagaactgaccctacttttgcttgcttgcttctgttagtaattctcagacttttgaattttacagatagttaacatttaaaaaatgaagactaacaaaaagttgccaatttttctcttctaagtaaaaacataataaataattgccaaattcttttacaaaagaaagggcattttgattacaaaatatataatctcaagattttgaaaaaaattaataaattaggctttgtggaaaacttcatggagggggttctgcataaattagggaacaggcattggggaatccattgatttacacattttttttttttgcctcaattgaatagttcttagatgctatttcttattcatttgtgcatctctagtgcagcaccaggtgtcttataggaagtattcaattaatatttatgaatgagaaagtgaatctgcctctgagcaaatacctctgagacccatggtaacgcctacagtgtgaagcacctatgagagaacaccaacaatggtaagagagtggtggaggggtgtgtatgtgtatgtttatgtgtgtgaactaacataatttactttaacagtttgccaggcaccaaccattctgattttgtagggaaatactagtgagactgtcctctaggggaacaggaaaggaggcaggggcaggatctaagatattgaggcatatctcacgtgtaccgtaaaaatatttcatgtgacatctgaagtggattaagattacagtaagtatagttactgtaaatagataacattcgttgagtacttataatgtgccaggcacctttctaagttctttgcattcattagctcacttaatcatcacaacaacctattgagatagactcactttctattcccttgtacaggtgagaaaactgaagcttgcagaggttaaatgacttgcccagggtcacacagtcagtggtagaggtaggtttcaactatggtctagttgtttttagagctcatcaaaactctgaggtccctttctagccacatatttctatgatgaacatagttttatatgacttggttttcatttttaatattagaaaattaaaacgttttctcttagctaggattttaaagctgttaaggcactcagtttttctacttattaataaaagctatgtgaccataagcaagttccataacctctttgaacttcaatgtctacatctctaaaatggagatgaaagcctttttctgtgtgtttttcggaggattaaatggatagtgtataaaaacagctagcagagggtctggattatgaaggggcttgaataaatgttaattcgctatggggcctagtaacataaagtgacatttctaaattaaaatcatatcaaatattagtaataggatgagagcaaagagatcatcactctggtggataaaggtgcctgtatttacagaattccttagagagccgtgaggattatctttgccgcagccctcattttaattaagagcatagagatcagacatttcagcataggaagaagcttgtatttgatttacatggatgcacattttcagcgtctaaacattccattccttggctaaagatataaagagctacttcagcaaacctgatattgcaaaataaatggaaaatgcttaatcatttaaaaagatacaccaaagaacagaaagatcaaagcatccacatataccagtgaggaaagctttcctctccggcagaaagtctctactttttgaaaggctgacaaatgacttcagttagacaggcagggtataaaaccaaaacaacccatctatcattctttacacacaaacacatatcgaaattaagcacacatatgtatacatgtaatctcatttttgataaaagtattgttcatggagaaaaattgtggaacaatgtgtaaaacataaactcattttgtaaaaataatgtcaggccccacgtatatctgaaaatacatttgtatatgtttgtaagaacatggagaaggtatgaaaggtttatgccaggtcgtcaccttgggtaccctgggacaggtcactctggagggagtttgggggaaatttttgttccttgatcttctttgtattcctttgccaaatgtaatgaccagttaaagacaaaaagtttttacatttacatttctttattattcatttacccattgaattccactaaccaaatatataatattggcatgctacttccttccttttgaatctcagcactatcttctcttctcaagtattaatacttaccttacactatggctgtaaagcttaaatgtgatcagatatagaaagtcttaataaatggcaaagtgatgtataagtgtatcttactatttattcacaaatattttgtgattttgctgcctatcagaggacaatgacacagttgcaatgcacctgaggcaaaactacaataaggttgaatgggacccagaagctttagttagcatccaaaacaacacctgacatgttaggcaaatgtgatttctttctggtaataagagcaaatccaattaactaacaggcatatctgacctggtgtagtcgtcgtcaacaagcatgtgctttggaattggtgagtaccttcctggagagatgggtggcagggaggttttatattctaaagtgccattgttgccagagagtagatggttttccattggtggagaataagctaagaggtgggggaaaaagagaaaagaaacctgttatgtgggtgattcaatgtgtcatgctatacttcagaaaaatgtattaaaaacagaaaggctttgctgcatgccaaggtttttcttgtcctcccagaggggggagttgcagcttatttgcatttaatatatacaagcacatggtgacctttaggataggaaagacttaataatagttaagtctgtaatgccagttagtctaatttggtgaagagaagaactggagaagagatccagcacacatattttcagaacaatgattaattttctattgaaataaaatgttagctttctaatttcagagctcacattgttttcacataattaatatccaattactgagagtaaaagcctcctaaggatcaggttctcctgtgagactttctcccaaaatatactctattcccatcccacaaaggccaagaactctggcctttctttttcattcctccttcctaatgtatctcccttttaggtgactaaaaacacctcctaactgggtctcttgctcctttctctctcctcaaatccattttatatgttgagatgaggtaaaacctcctgaaattcagcttgaccacactattctcttacttaaatgttctccattgttgttatgtatttaatatagtataaactctcctctttgccattcttgcaagatcaatcaattttaataccccccaacacatatcctatcatccgcaaacataggctgtgcttcctgacatctgtacctttgttccactgtaccatctacctagaatttgcctctcctacctaacccatctcagatgttgaaatctcattctgaagatgcaactgaaatgccatcctatgcatatttttctgatgttccaaagacagatgatgtatctcttttctttgagttcccaaataacatttatattcacctctcccatggcatatgcatacctcttattctgccaaatattgcttttatttatatatctgagttagccttcctcccaacaaagctctttgaaggccatgattctatctcctctgcatcccacatattaccttacaatgtgccttgtacatactgaaattactcaatacttatttgttaggtttattagagtcgttttctcccttttctgtctttgacattgaccttatatgccctgcatgaagtggctcacagactatcagggctgattttgctacattcttccagtttgaaaaactctgaaagttaaaactctttcatattctaaggtaagtctgatctcaatttactgccagcttgaaaacatacatattttggaggtaagttgtttcagaatcatcattaagaaaagcaatagctaatgcaatgggcaggaaataaaattgttcaacacatttctctcaagagaaacatgtaagtctgagagaacttgaacaatttgcttgagaccatagtactaattaatggccagttctgaagacgttccaagtttccagtctcacaaatggactctcaacatttcagaatgagcaagcttactactgttgacacaactatcccttacatttacataacaaagtaaattgcttctaaatctagtcttcaaagacagaaacttagttaagattcgtgttgacctattaagaagaggagaacatatgaggcttatgcaacagtggaaatttgaggaccccagcatagtctcattagttgttagttgttgctgcagaagtcccacttccagctcacctctattgccatagtgactgataattttctccagcttacttgccaatataacaaattcaagtaaagtaaaagctatgtgatggtgattgaggatcataatttcgccattcaattgcaagatcccctttttcaggaagaatcatagagctacctctggtctatttgccagtctcttttctaatctactactacagagatctgaagttggaagaaataatatgatggcatgagagtgatcatgctttaggagcttgagaaatagcctttcaaaatgtattgcccatacactactttaatcacactgtcctcaacattaagcctttccataatggtgggcatgccaactcattaggagatctcatcttcaaacaggaggtaagggcctgcaaggcaacataggagtggagtttaggatactccctctgaagtatttccagaagttaaccaagagggaaggtacaagtagaacactttgtcaacagttttatagaattccagttctgcaagtctggcatgctatttgaagatgacaatggtacttacagtgagtaatatcaggtggaccataaggatcagtcatataaatggtagtgggtttgccaacttttaaataaactacctctgatgtgttctttaatattgctactgcctcttcgtgtgttacttcttctaaactgtagttgtttacctgaaagggtgaaaaagatcaatattagagttaaatctatggagcagaagaaaaatattcaggcaagaagatacctggaattataaattgtgataattactgtccagtatccttgacataacagatgaattaaatgcattagtcaaagcagataagtacaatcaatgattctataaaataaggttgcttctgcctttttttaaatgaggaagtgatatacagtaatggaattcagaatagtatttgtgggaaggaaaataaggagtcaaatgccttttttgttatgctatagtttctatgatagaaaagtaacacatattagtggaagaaaacttaaaaaagaagaaaataaaaatcattcatcatctccctacttagatatattgccttaaacaattttgactttattatacacattgttttggaacctgctttttaaacctagagtgactagttgtttgtagcagcaatgtagtttaacaagatgacttttgttttctgcagagcattatgttgcatgactacagtataatgatctaaccagtttcttactagcgcatgtttagtttgcttctaattttttaaaactataaataatgttgcactaatcctttttctatatttgtgcacaactctgataatatttctttgatacacatttacccatacaagtgaaactgctggaccaaactatatgaacattatcagggcttttgatacctagtgtgaaaatgcctgtttccctctggaaagatgaaccggtttactctcataccagcattatatgagagccctcatttccttatagcttcgccaaaccttgattttttcactttaaaatggttctcatcaaaatgtcatttaatatgagtctattcagaacacgtcttttcaggtgagcaagttcaagggtaccctattgtcattgtgttaacagaaatgcctctttctttattgcatggaaaagcctgtgatacaaatgatacactgacttcatggcagtggcattacagtgggtctctgcaccacttctctgaaatgattttaagataatctctctaaaaagacttaaactttgaggaaattagaataaacgttaattcaggaagtatttcaaatacctaggttatccgtatctggctactatataaaaaaataaattttgttgtgtatatttcaggttcacagcatgatgttatatcacacatatagataataaagtggtcactatagtgaagtaaattaacatatccatcatcatagttataattttttgtgacaagagcagctaaaatctacttatttcgcaaaattcctaatataatacaattttattaactatagtctttatgttacacattagacctctagacttgttcatcctacatatctgctactttttatcctttcatctgtatctccccattttccacctccccctgtaaccactgttttatcctctatctctgtatatttgacttttattttttaagattccacatataagtgagatcatgcaatattgttccttctgttctggcttacttcatttagcataatgccctccaagtctacccatgttgtggtaaatggcaggatctcccattttttaaggctgaatatttcattgtgcatatataccacattttctttatccttttatccactgacaggcatgaaggtcgttgccatatcttggctattgtaaataatgctgcattgaacatgggagtgcagatatctttacaaggtggtgatttcatcttctctgggtatataacaagaccagagattgctgggtaacatggtaaatctatttttaatttatttaggagcctgcatactgttttccataatggctacaccagtctgcatcccaatcaatagtgtacaagtgctcccttttctccacatcctcactgacatttgttattctcatctttttgataatagccatcctaacagttgtgaagtgatatctcatggcagtttagatttccatttccttgatgattagtgatattaagcacctttttgcatacctgttggacatttttgcatcttctttggagaaatatttattcatgtcctctgtgcatttttaaaatcctgttaatgtttttctactcttgagttgtatcagttctttataaattttggttattaacctatcatcagatatatggtttgcaattttttcccaatttgtttcattttgttgattgtttcctttgctttgcagaagattttgaatttaatgtagtcctatttatttttccttttgtagcctgagcttttaacgtgatatccaaaacaacattgtcaatgacaaggtcaaggaagcttttcccctatgttcttttctagaaattttatggttttaggttttacgtttaggtcttttagccaaattgagctgatttttgcatatggcattagagtccaatttcattcttttgcatgtggagattccattttcccagtatcattcattgaaaagactagcctttcttcatcatgttctcttattttctttgtcaaaacttagttgaccatatatgtttgaatttatttggctactatttctttaatgacataattgtttaattactttccactggtataatgtaaaattaaaataaatgtcccaaaagcattggactgaattcctatagtacacattatctatactatctaattagcacttcagctataccatactttgcagcactactattcgtaatctttattattttgctccatgttgctatgtaagttccatgtgctagttaatccttggtgatgtagcccaggttagggactgtggaactggagagaattgaacctgactgatgtgtttgaatgctggctgtgagttctccattaagccgtaagcttctctagcacctctcacatttctcttctagataagacatgttcccttaaatcttttttcatttcagtgtctggcatttgtttattcactgatcaaatgtttactgcatacctgttatgtgtcagactctgggccagatattagagatatgataaataataaaaatgataatcaataatcatagtaaacacatatagcccatattacatgccaggcactattttaaagtattttacatatattaacacaatcaaactttcacgataacttatgaggtagctattataattaccttattttacagatgagaaaagtgtgtctccaagaggttaagaaacttgccccaagtcattgatctggtaagtgtcagaggcagaattcaaagctagacagtttggctccagaaaccatgctgttaaccactcagctatactacttcttccagatagacaaggtccttgctttcatgaaacccacattaataatacacaattgtttgtggaatgaatggatagaagaatagactcatgcagagagggagaatgtagaggaacttcaggtatggagaacatagttgataatggcagcccttaataatacagaaataacacgataataataataactaacatttatttaatacttgcatgccatatattttaggagtcctatgtcacatattttgacatgaatcatataacttatcatgagaagagctccaggaagtagatactattaatcaggcaaattttacagatgagaaaaactgttttttaaagagattaacttgcaacaaagaggtcacactgcctccaattgtcaaagccatcaattggatcacaagcctccttacgagatgaaaatgagattatatttgtatgttgattcattaaaagctagggctcatatcacctgttctttctccctttaggagaacagggtttctttccgagtttacatataaaagtagaataaattccaaagtattataaaagcttgaggaatcattatatttcctgcttaatccagtggtaatagtatactgcatcatcctaatacactgaccagtcaaaaaataaataagtaaaatggaaagcagcttaacatatctcactgatctcactgtctcttcaaaaccttcttatacatttgattaatcatttattttagggccattaccacttgtgcttagataatgatttattttttattctttttatttttttgagatggagttttgctcttgttgcccaggctggagtgccatggcgtgatcttggctcactgcaacctctgcctcccgggttcaagcaattctcctgcctcagcctcccgagtagctgggattacaggcatatgccaccactgccagctaattttgtatttttagcagacacagggtttcaccatgttggccaggctggtctcaaactcctgacctcaggtgattcacccacctcagcctctcaaagtgctgggattacaggcgtgagccaccacacctggccgataatgaatatttacatgtgatgttctatggtttaaaatgtatatgaaagtgggtgtttcctctaaaaaaaaaaaagattgcctaaggcagcttttaatactgtgactatggcccacaaaaacatctatactgagagaacagaagagaaacagtatctggtggcataacacagggggaatgagaagtcaataataattaaaaataaaaaccaaaggctagaaactaactggattagattataagtgacagcaaagctctgtttctgacaagggctcattgtctctctcctcagagtatggaaactacacagctcattagattatcagtgaaagagaaatgtggtcagtgcttattaaattgcaccttttgccatttttaaggtgggcagtgaaatgatccagaaaatattaccttcaacaacattttcatagagtgactttgctaacagagtcttcagaccacgaggaaaatttttagaccataaagcagaagttgagggaaaggtagtggtgagaaatggggaaagaggatactggggagaataataatagtggtttaaaatagtggtagttcactcagtttctatttggtgactgaaatattgaaaaatttacttagatttcagtcacagaacaggtggtattatgatactggcaacagaatgtagtgattaaaagcacatgcttttgagtcacgcatactgaagcttagaccctggtgcttcctagctgtgtgatttggggagacttgtttaaccttgtaagctttagttttgacatctgcaaaacaggaatgatagcagttactgcttcaaaaggctattgattaaaatgtgttggcctatataaagtgacaggcacaatacagttcttaatgttagctcttatcactaatactattgtcatcatctgtaagcaggatttcttggtgaaaattttcgctgatcattttcttataaacatctgtgaactgatgagtttaattagggtgctgctgatgaagcttctgtgtggtctttttaaaaattcagaatagtaccggatttggaccaaaaagtgctcttttgtgctgaagtcttcaaaatgttttccacaaaagtgagtttgtttgggttaattatgtgtgtgcattatcctatgaactctcaagataaagggcctacagctggagctgattgtatgcaatgagaagggacattacactgattggctagttgctcttgtcattgtttgtcattgtcttttttattcttttttttctcatttgcatcaaatatctgcctataatggtgaacactgagcaactggcctggtttcaaggaaaaaaatcatgtgaatttgattgaagtgctctctgtggggtgcaccacacagacggggacatatgtgcagcctggctgtgtgtttgctaataggaaagaggactgaggccaagaaagagaggctggaggtgagatgactcattctctcaaacagaagagggagcactgaatttgaacatgatgcagacaaaggaaggcaaaccagctgaagaaagaggtgccaggagacttgcaaggagacatggcaagttttgtgggaattcaaatgtgtgtaagcaaacataaatgtaataatacaaaggtgggaggtgtgggggcatgagaatataataaagaggaatgagcaatatagagatggcaagatactgacctttccatgttcttgcaggaatatcagtatggtgggatgaactgggaggtgattacagacattaaggttacctaaggcatagtacaaggaaatgtggaactctagaatcattggtaagaaaactctaaagttaacttttaaacaggaaacaaagtggctgatcattaggttgtaagataaattaaaaagcagaccaatccaatgtagtaatgccaatgctatgaaaataaatatgcataaaccaaggattaaaatctccatagtactctgaaattaactattataataaaatgtattcaaaataataactattaataaataaaaggcatgttagtaatggttatctttggataataaatattttcttgtttttcatcttttcagaaatgaatatgtatgtcatagagcaaaattaactctaaatgagcaagaacaaaaactttaagaaagaacagaagctaagtacagtggtgtcattatgagacacacacagcagcatctcatgagtaatgaaaatcggaatgggaaaaaagaaagttaatttctcaaggccaatgaatagacttaaatttactagaaataatattcatatgttaaaccttgctgtttctagaaacgaaggcaacttgatacagggagaataattttgaacatagaatcagatcagatctggttttaattcctagtttcacgaatttaagtcagttaacatatttactaagaattcattttcttacatgtaaaatgggaattatacttatttgtagatttgtgtttatgagaaaagaataataccatgaagttgaaaagactctgtatgatataaagtagcatacgaatagaaatcaaacagccataatcagacatcatgctttgttgatcctgctgctgttcagggctctttatgtagaaattatcaatccctatattgtgaaacacttattcctacagtgcctcttcccacctccaagaatgatcttctcaagggcaactgattagatcatattcatctctattcccctagctgatgcaatataaatagttggcacttaataagtgttgaggtattaagctaagttttaaaaaaatgatcgcagaacaccaaaggaaaagcaatcaaaattccctattttatagaaagaatgaagcatttgtgttgcattctattttacatttgtgttgagtcagagagtaaagcaataagaatgaaggtcattcaagcaacaatacacatttattggatacccactctgtgccaggcacaggatataaggatgaaaagctggtacagaatcttagcaccagatcatattagtttataaggtacacagtcaaagctccatcattgtgattctattcttccttcattaatcattaattcatttcttaaccttttactccatataaagaaagagagcaagcaagagtgattgttttgatttactcaaatttcttctctagcagaggtcaccaaaatggacagtatgatatgaaccctagggcaatccactgggtacaagagaaaaacatttgcatttctattaatattaatcacatggatatttatatttctatttccattttcatatgttttaaaatgtaaacaatatattagcatagtaatatatatgtaatttagagtagagaaatatattagtggcaacctttggagtgtgctattaagataattttaaaatgacagcaacatgatacttacagagcagattctataaagagggctattacactgagtataagcaaaataaaaaagagtgcaataggaggttctaacccttaaataaaatatgtcatagcaattacattgtattataacttattacatttgagataaattagaagagagttcaagaaacagttgtccaggttttatcctgttgtttcagaagtgactttaaactcaggggacagaattttgagagtgaactgttctaaattttttttagccaattgcaggtaattgctaaattatactctactggcttgatagaatgagcactaccaccaaagttgtccttaggagatgcagtggtagcagcagaatgggctaggatgtggttagatcaaggtaggatggtggttcttaacccggctgcacattaaaatcatttggaaaacctaaaaaaataaaataaaatgaagcatgatccctaccccagaaatccagatttgattattcagggttgactgaggactgggtattcatagtgttcaagagcttatcttgagattcaaatgtgtaaccaaaatcaagaatcagagatgttgacaaaaccagtgaaaggaatttaacttcaggacatcaaaatctatgtctgaatccaatttcacaatttactagttatgtaatattggaaatccctttgtctaagttctaactgagttctaactttccttctgaaaaataagaataacagtaatgactgtcctaactacctctcaaagatgggggttaagaataaatgaggtgttgtaggcaaaagatcttttcaagatgaaagcaatgtgttgttggtaggaaagagacatgctcagagagttacaggtcttgattctaagatatctaaggttggtataaccaatgaatatgctttaacatcccattcattattcagataatttctacatattcgcaatgtcttcaatttgattttcttattgatacttggatgaaatcaggcaattttgtagatttaccaaaaataataacaatttcagtcatcacaactaatactcattcagaaacttgcattgtttctactcacatttcctaaagtatttcatggctttactctaggatatttattttcaaataaaaataagatatgctcacacatagcacatcctgagtatattccactaaacactagttttaggtgttttgttaagtattactctaagaagaaggctccatgataaaacagatttgttaatcaaaatcaaatcacttacttgatggcaggacttcacagaatttttaatatgctaaaattcattgagaatcttcaagagaattgggatacaagttgcagaatttagcaaacgtatttggtcacagagtctattcacgtgacacagaaaagagaacaatattttaaagcatacttttggaaataccaatctaatataatgctactatggtacagaggccaaaatagaagaccaaagatggatgtgacttgcccaagacagattaggtagaatcagtgctaggtgcctgtgactgaaatccagctttctcatctgagtccagtgtctttccgctcgacttcaatgtctctgttacttttcctgtcacttactacttccctttaaggaaagaaaacacaagaactaattctctgtaaaaggtataaaagttctctcactgacaattttttcttcaaatgtcgagcaggggttatggaaagaagaggctaagattttaaaccttaaattacaatgtgccaaggggctttgtcaactaataactaatgctgtccctgcagagaagacaatcaaattatcctggattcaacatttctggtttatatagaaaaaggggaagaagttaacacttttctaatatattgggctatatgtatcaccttggaagtgcttaataaagccaatatgtgaaaatatatgaaagaatttaaaaatctgttatgctgttaaactctgactaccactgaaattcaaggccaagagaatctatttcatctgagactacaacactaaaccactggtacaatccacaaaatccaatgtcactgtcactttaccatttaaaaaacaaaacaaaattctagtgaacaataaattctaagtgacaaaggaaatttttaaaaatattattttgctaaaaagaacatataccatgtatttgggtgacccattaaacatcagagtggtctgatattatggtcatcttatttaaaataccaagaggtttattgcaaaggtaacagacagagtaattgtttctttaagtagaatatttacaaaggtcacatactatactattacatggaatttttaaagtaggaaataaaactgtaaggaatataaagaagttttgtaataagtataatctatttacagaagataaatgaatatgtgataaaatttactggaagagagagaaaaggtctaaaacatcctaaaaaactgagaagtggagaagtggaaagacatagctctttcaaacatatgtggaagaggaattagtcttcacctttttgttttcaagtgacagagctatgaataaagggggacatttacaggaaaatatattttaacagaattttaaggaaaacattttaatgatacttattacctaataaatagttttcgggaggtattatccatccttaaaggaggttctatgagaggtcagagactgcttcacatgcttgcttttctgatgcaccaagcaagagttgataaaagatgacctttaagatacatacgttaaattctgagatataagaagaatttcagggagaaaaagtacccaatatggatggtatgattcaggtggtgcccaacattatagctattttacttgagaaactaaaagagttattgttattactaactctttaaaaaatgactgtgctctcagtagagggcagttgctaggagacttcctgaattgtgagtattcagccatgaaagcctaaagaaattaatggagttttattttagaccagtttacttacagaactctgagtgaataatatatggtggaatttttcctaagaagtgtcagaaggaagtggtgcaaattgctttagaaagaatagcatatttagagaaaaatatgcagagtgtggtacagctggtacatcatagaatctaaatcatttgtccttcctttgtgggaggagagtagaagagggggaagatacaaagaatatgaatgtagggtagtaaagagaagaggaggtagaaaggaatgacagaaggagagcattaataaatatttttgggttgaagcaagataattggtcttttagggtggcttcagtgattttgtctttattctccttttcagggttattttgcttgcaaagtataaaatgaatcattttctttcatttccagtttcaacttggaagtactaattctgtcttccttacataagagaggagagacctattactgttgaagtttctttaaaaaaaactatgctttaaaactcaaaacaattaaggattatgtcacagctattttcgaaatcatttttttttgagagttcatcttgacttctattacacactagacatatatgaactaaccagagatgtgaatgattctctgtactcttaaaatcacaggaaatatatttccacctccccctttttttctgatattggagtagcatttcagattttggagattagcttaaggcaaagtaaaagtcatggaaggcagtgtataaataacattaattatgaagctacttttcagaagctagtagtaacttgcttagtaataaccaaaaggttgtgcagcgttcacaatgctagtattaattagctacatattttgaacatctactgttactggataccaaagaaagtgggttatttaagaatcttccattcttgttataagcttcctatgatccagtaacttctcaaaggctttgcaaaaagcataagtccttgctttttgagaattttttttgtgcacccaagaaatgtaaacgcaaccatcactgcttcttgtgcaggtgtgtgctttaacaatcagggctgcttttggcatcaagagtatgagctattaagagtttctaaaaaatactgacctaactagtcagttgcctccaccttatatactattcaggcaagccttcggaaagtacactactgtattcctagtccaaaataaggtaggcatgaatatattcaaccttgtttgcacatacaccaaggaagaatttaaatttttgcccttaagtagttttgttttaggcaggaggaaaaacatattcaattttgaggtaggtaatcaacaggaatgagaaaaatacaagacagtctaagatctaacctttgtccgcctttctaggcttatgtcttaatactcccgaagtggcacaagctaggttatttctagttcttaacagactactgtgcttttgcacaatgctctcaagttcagcttaagcaatgctcctctggaagttcacaccctaactcgactgtcactcttctttgttttcttctagaatcctgggattatctgaataataaatgccatcacattctacttttaatacatacttcatctctttcacctagtgcactatgagttactacggggaagaatctgtgtgcctatctttctgttttcagtgatgatatactgaaagaatggtgtaggaatagaaatattctatttaccagtgctaaggctttttcacaaaaccaggcagagatctgctcatttttactctgtaaacttggaaaagttaatttattcaatctctattttgtcctaactagactgatcattatatctacgatgaatatcaacaaaatggtaataaaaaatagtgtagtgcctggaaaatcctttgacagaattatttggagcaagttttttttttttttaaatttggaaacaaaacaaaaaatttaaacaaaacttcaagaaataagcacatagcatttaccatgatggtacaatagcagtggatgaagaaataccagaagagctgcctgcaaccaaactcatatggaaccgtgagtcaaaggtcaaaccagtaactatctaagacagtcattacttgagaacgaaacggtcttcatttttcaacttagcactatgtagaatatggttatcacaatttattctattcccaagacaacatttcaagcaataaagtttatattccagaaagaagttgttcaggtcttataccttaatgacaacctttgttgtccagaagatagaacaacatcataagaacaaacttttacatcaaaaacaaacaagcaaacaaacaaacaaacaaaaattcagaattgcttgagaatgaaagtggtagtggcttcaggtggtaaagcagcccacaactgttaactttaactttgactgaagtcattaatggtatattttttgcccatccagttttctcaagacaaagttccttcctgaatagcagctactgcctgagacacagtaggtgggcagcatgtacttattaaaaaagtaattaatgaatgacaataatgaataaaggaggaaaggaaagaactgactgacaaattcaaggaaactaatgaaaccatgttgcacaagaggcagtatagcttggtagtaatgagtggtgctagccagattgcctcaatttgaaacccagttttgtccattattaaacatatgactatgggcaagtcagaaaacctgtctacatctcaattcttttttgcttatataaaatgtactgctgttagaaatatgttacattacaaaaaagccctttataaaagaacatggaacttagtaaatgccaggtcaatgttagctatcaagattattacaaagatcttatctaacacaaagcttactgaacacaaaggtcattggcaactatgaaattagaccactgcgattaaacacagctctctaaagctgagggaagtaggcaaataaatataaaatttggaggttcaacctccaaaacttgcacaggtcataaaaattaattttctgttgagattgggggttgatcctccccagacacttctcacaaaattgttggagataatggctccttgcagacagattagaagtcctgttttacaagggtagacatgtgactagacagatacactaatcttacttgagagctacctactattaatttacaatattcgattattatcctgtagattttggcatacaacagtaaatggacataaggcagttttattaacacagtcccaaatgctttgttgcttataatcgccttaattttgctttaggttatcatataactccatggttcagaaagactggctgtgtgtcaatgtcaatcactgcctaggactactgaagcatgtgagaagctggcaaatgaaatagctataaccctgtctaaggggaggaaaggaagagatccatttacacatgtagcagaactcagattataaattcttggaagtcaggagctgtgtctatactggttgcacaaaggactgtggaaatacgcttatcagtaagccagggtgttgtttctattgttatgcaaaccccacctctccagcagtctataaatagtaattgctctccctaataggagacacattatgttggaagaacaacagataatctctatgccatgtgtatctaagaaaattaatgaaaatttagatttgttttgaaaatgtcaacaaaatagatacattgtacatgtacttttgaaatctcttactcataaatctgctgtctcttcttttcaatttttgtccaagttctaaattgtggacccctcacaaaatcatatgttgaagccctaacctccctgtgactgtatttgaggataggctctataggagataattaaggttaaatgagttaaagatggtgctgtaatccaataggactgggccttgtaagaggtggctttgtaagaagagaaagagagagacagatctctctctgcataaacacccaggaaaggccatgtgaggacacagtgagaaggtggccacctgcaagtcaggaagagagccctcaccagaaacctaatcggttggaaccttggactttgtagtctccagaattgtgagaaaatagatttctgccattttaagccacccaccctgtggtattttgtgatggcagcctgaactgacaaagacagtcatacactggaaaacaagagctttataaatatacacacagttttgctggagtcacactcaccattagtagtctatctcctacttgcaaccttccatctttttgtgcagctcctccatctataattttagttacataaatgctgttgtctccaggaatgtgttggttccccacacctcctgcaatactgaagcctaaacctataagaaaggaacagaaaatggaaagccttgttttgttgttgtagttgtttttagaaaatgcagttagccacattttaacagtttttaaaaatgaatcctcaacttattgtaacagcaataaataacactaaaaactgtatttcaatctcgttatttaaatatttgaagaattgttaatgcaaatgaggcaaagattttgaagtcaaccccatgtgagtagttttgttctatttccagactgtatgcctaactgctgttcctcagctatcctgtttataagggtaactggccagagcagggatcaggtgaagggtgtggaggaatcctaggtgagccaggaaaaagacaagtatagtcctgctcattgttgactctatgggctcattttcattgctgttgttactctagcatagagaacagaagtactgccaatcacttgggcagagacctggatactcttgatatttcaagatgagaaatagaattgttcaaaaattgcacaaattctgaggcaagagccatgaataagttacactgtttatatacatgtaataatttcagagagaagataaggaaaagaagctagatgcttgcctttcatgttttgttctcttgccaccttgtcatattttatatttcctagcatttattgttattaactgattaactaattgtgagactagtcacacaaaaaagtgaattattccagtatacagtctaaaaaattaaaaatattccttaaaaatattctattggaaaataaagaataaaaagaatgttaaaaaattaattaattaattaattaatttaatttttgagatagtctcgctctgtcgcccaggctggagtgcagtggtatgatttcagctcgctgcaacctctgcctcccggcttcaagcggttctcctgcctcagcctcctgagtagctgggataacaggcacacgccaccatgtctgactacttttttaaatttttagtagacactgaaaatgttggccaggctggtcttgaactcctgacctcaggtgatccacctaacttggcctcccaaagtgctgggattacaggcatgagccaccacgtcctgccaaaaactttaaaatgtatacttaggctatattatttttataacatggcagaatatcaaatcattttaaacatggcgattgtctcttttaagagatgattttcactgtactatggcttatacaatcttaacttatattaaactatgaagcaataacaagaatagaggacagtcatgcactgcataacaatgttttgatcagtgatagagtacacatacgatgatgggcccaaaagattataatggagctgagaaatggctattgccaagtgacatcatagtcattgtaacatcatagcataatgattactaaggtgtttgtggtgatgcagtgtaaatgaacctactgcatttctagtcacatatataaaagtatagcatatacaattgtaaacaataaataatacttgataatgataataaataactatgttcctggtttatgtatttactacactatgctttttattgttatatttgagtgtacccctctccttattaaaaaaaatgttaattgtagaaaagcctcaagcaactctttcaggaggtatcctacaagaaggcattattattacaggagatgacagatccatgctgtaacattttacatgttattgctcctgaacatcttccagttggacaagatgtgaaggtagaagacaatgatactgatgatcctgaccctgggtaggcctaggctaatgtgtgtgtttgtgtcttcatttttaacaaaaagtttaacgtgtaaaaaaaaaaaaaaaaaaagaaaagcttatagaataagaatagaaaaaagaaaatactttgtatagctgtacaatatgtttgttttaagctaagtgttattacaaaagagtcaaaaagttcataaagtaaaaaagttacagtgagctaaggttaattattgaaactttttaaaaataaacttaatctagcctaagtgtacagtgttctttaagtctacagtagtgtacaataatgtactaggacttcacatttactcattactcattcactgatttacccagagcaattttcagtcctataggttccactcatgctaaatgccctgtacagatgtaccgttgtttatcttttattttttactgtactttttctatgtttagatatgttaagttacacaaatagttatcgttgttttgcaattgcctacagtacgcagtatagtaacatggtatacaggtttgtatccaaggaacaacaggctatactacatagcctaggcttgtagtagtctattctatttcagtttgctaagtacgctctattatgttcccataacaatgatgacattgtctaatgatgtatttctcagaatgcatgcccattgttaaatgacacatgaatgtattttaaaaagttattatgagatcattttaaaggaataattaatagactctttaaacgtataagaatttttaaaaatctctttcagaatatgtttgaatgctcattcagtacaatacttgcagcatacattttcattgcattttacaatcataagataattaacatgcaaattactcaagaagacagatattaatcaagggccttttgactacagacataatttctatagcttacttggcttaagacttttttagaaaaaccacacacctagtaaaataataaagctatcattaaaatatttggcattttatacaacaataataaaaaatacttaaaaatattaactctacttcactatacttttattgaataaatattgggtaaggttatgcactcttaagatagcataaatagttaattgaaaaatgatggcatagtaaattataaagcaacatctctggaattatatttgaaatgcaatgatcgttaaattaaccataatagttgttaaaaataaatggaaaattgatttaaattgatagggcaattaaagcaagtgttatctaatttccttgtgatgtgagtaattatttttactgatgctttgccaccccatggaacaatgaatatatttgtttgcctcagatttacaatttgtttattaagcaaatgatgaccaaagagtaaaataccccaaactggcttttcctataaaatttaaaatacatatcagctcatgtttcccaaaactgttactttattatacatgaaaatagggaagttttaaaaaatgtatttacaaaagtttcttagccacgtgctaaggtcaatctaccatatttataaaagtacagaggttattccaaactctgaaaagagaaggctaaaacaaattcagagactccaatttacatccactatgccagcagtaaatgccacggtcttagctacaagaagagctgtagaaataaattaccaccataaaaacgggtaagttcaacaaacagagcaagtatgtagttgacatttgaagttgaagactgcacaaagacaatgaaagcactatggatactgtagatagatagatgatagatagatagatagatagatagatagatagatagatagataaaaatcgagtaacattttttcttgagattgggtttatgtgcttctttttaactagtgactctattcaaggtgaagcaaggtatttttagtaaatgttcctctcagagccagagcatgtttctgaatgtacacaactagtaatttttccaatttcctttactttgacataacatgcatgtgtttaaaaacaattaaaatttatttaacacttaatcatattctaaatattcaattcagatgatgaataaatctgtagtttatgtctacattgagaatttatgtttatttacaggtggaaatatctatctgtgctataagattgcatctatcctcattcatttattcattcacacatccattctttcaataagcatctcctgagtacatactgtgcgttgtattacctgctgctatcgagcacggccaaagtaaatgtaaagaattttttttccatttttaatttttagttgttatggatacataataaatgtaaatagggtgcacatgataatttgatacaagtatacaatgtgtaatgatcaaatcaggataattgggatatccattaccttaaacatttatcatttcttagtgttaggaacattttaattctactcttagttatttcgaaatacacaatacattattaactatagccaccctattgcactactgaacactagaaagatctatttcttttatctaactgtattttttatccattgaccagaaacactgtaataataatgacccaaaagtgagttcatatgagtgagtgtagttgaaacatgtctgaagcaatgttctaaacccagataatgcaagcaatttttggatagctattctatgaagacaaatgtgggctaggaccactgagcaataagaccaaacacaaattacctgggtttttcttgcatagactctgttaaagcaggggcaggctctctaccttataagacctagactggctaaggcatgccatgactaatgcccctgtcccccatccctgttattaatctcacatgtcttcccttcattagctaatttttccctccttcattccactcaaaacacacttgcatccttgacgtttctttttttatttttatttttttgcctttaacttttaagttctggggtacatatgcaatatgtccaggtttgtcacattggtaaatgtgtgccctggtagcttgctgcaaagatcaacccatcaatgtgatattaagcccagaatccattagctattcttcctgatgctcttcttccctgcttccctccccttgacaagccctagtgtgtgttgttttcctccatgtgtccatgtgttctcatcattcagctcccacttacaagtgacaacatgtggtgtttggttttctgttcctgtgttactttgctgagaatgatggcttccagctccatccatgtccctgtagaggacatgatctcattcctttttatggctacatagtattccatggtgtatatgaaccacattttctacatccagtctatcattgattggcatttaggttgattccatgtctttgctattgggaatagtgttgcaatgaaaatacatgtgtatttatctttataatagaatgatatatattcctttggatatatacccagtgatgggattgctaggttgaatttttttcctctaggtctttgaggaattgccacactctcttccacaatgattgaacaaatttatattcccatcaacagtgtaaaagcattcctttttctccacaacctcaccagtgtctgttgtttttttgactttttttttaaaccaatagatttttttattttattttattattattatactttaagttttagggtacatgtgcacaatgtgcaggttagttacatatgtatacatgtgccatgttggtgtgctgcacccattaactcgtcatttagcattaggtatatctcctaaagctatccctcccccctccccacaccccacaacagtccccagagtgtgatgttccccttcctgtgtccatgtgttctcattgttcaattcccacctatgagtgagaatatgcggcatttggttttttgttcttgcaatagtttactgagagtgatgatttccaatttcatccatgtccctacaaaggacaagaactcatcattttttatggctgcatagtattccatggtgtatatgtgccacattttcttaatccagtctatcattgttggacatttgggttggttccaagtctttgctattgtgaatagtgccacaataaacatacgtgtgcatgtgtctttatagcagcaagatttatagtcctttgggtatatacccagtaatgggatggctgggtcaaatggtatttctagttctagatccctgaggaatcgccacactgacttccacaatggttgaactagtttacactcccaccgacagtgtaaaagtgttcctatttctccacatcctctccagcacctgttgtttcctgactttttaatgatcgccattctaactggtgtgagatggtatctcattgtggtttttgtttgcatttctctgatggccagtgatggtgagcattttttcatgtgtttttgggctgcataaatgtcttcttttgagaagtgtctgttcatgtcctttgcccactttttgatggggttgtttgtctttttcttgtaaatttgtttgagttcattgtagattctggatattagccctttgtcagataagtaggttgcgaaaattttctcccattttgtaggttgcctgttcactctgatggtagtttcttttgctgtgcagaagctctttagtttaatttgatcccatttgtcaattttggcttttgttgccattgtttttggtgttttagacatgaagtgcaacttacaagggacacgaaggacctcttcaaggagaactacaaaccactgctcaatgaaatgaaagaggatacaaacaaatggaagaacattccatgctcatgggtaggaagaatcaatattgtgaaaatggccataccgcccaaggtaatttatagattcaatgccatccccatcaagctaccaatgactttcttcacagaattggaaaaaactactttaaagttcatgtgggaccaaaaaagagcccgcatcgccaaggcaatcctaagccaaaagaacaaagctggaggcatcttgctacctgacttcaagctatactacaaggctacagtaaccaaaacagcatggtactggtaccaaaacagagatatagatcaatggaacagaacagagccctcagaaataataccgcatatctacaactatctgatctttgacaaacctgagaaaaacaagcaatggggaaatgattcccaatttaataaatggtgctgggaaaactggctagccatatgtagaaagctgaaactggatcccttccttacaccttatacaaaaattaattcaagatggattaaagacttaaacgttagacctaaaaccataaaaaccctagaagaaaacctaggcattaccattcaggacataggcatgggcaaggacttttttgactttttaataatagccatctctctggtgtgaggtgatatctcattttggtcttgatttgcagatttgcatttctctaatgattactgatgttgagccttttttcatacatttgttggcagcatgggtgtcttcttttgagaagtgtgtttatgttctttgtgcactttttaatggggttgtttgtttttttcttgtaaatttgtttaagttccttgtagactctggacatcagacctttgtcagatgaatagattatacaatttttctcccattctgtaggttgtctggaactctgatgatagtttattttgctgtgcagaagttctttagtttaattaaatcctgtttgtcaatgtttgctttcgttgcaattacttttggcattttcgttaagaattcttgcctgtgcttatgtcctgaatggtatttcttagattttcttctaggtttattatagttttggcttttatacttgtctttaattcatcttgagttaatttttgtacaaggtataaggaagggatccagcttcaattttctgcatgtggctagctatggatgccttcagctttgttctttttgcttagcaggctcttttttggttccataagaattttaaaatagcttcttctagttttgtgaagaatgtcaatggtagtttgatgggaatagcattgaatgtataaattactttgggcagtatggccattttcatgatactgattcttcctatccatgagcatggaatgtttttccatttgtttgtgtgatctctgatttccttgagcaatggtttgtagttcttgaagaggtccttcacttctcttgttagctgtactcttacagccttgatatttctagagtactccgacatagtcatagactgtcaatttagggtctttgctacagctgttctgctacatggaatatgcttctttcagggctttgttccagtctcaatttctgtaggagctggaacctaagctccctatttaatgctgtcccctgactatatatatttttttccttatcctgctctagttttcattttctcttagcacttattaccttgtaatacactatataagtcatctacatattttgtttatatgttttttatgttctgtctccttggtgaaaacataagctctgtaatgaatggttttttggtctattttgtactatgcaagtagaacaaaaccagttacatacttgcctcataaatatgtattaagtgaaagaatgaatgaacaaatgaatataagaggacaaggaaagtcccatgtctctgagaaagtccccccttaaagatgaaattagtggctttgaatgagcaaggggcagaaacagtgagccatggtagctgcagtcagtaactgtataaggcatcacattgcctcaggtaaactttgatgagctctccatcctcaacctgtacagggtttatggtaagcactgagcaggcaatgggacaacagcagaggcagcttcactttctgattctttcgtcttataactatgcaaatttgagtttccatttctttgtaataaaggagtaagtatatctattatctagcaataatagatacttgataaataaagtgctctcaataaactgtcaggttgttgggaaaacatgacaccaacactttggcataatctgtctggtttggatgagttctatattgctaccagcattatgtgagggaagcatgacttacttcttagaggagaaggagaataattaacagaagtttagcatttggactgggtcttgataggtgaagttagaactgataaaagaaaatgcacatttaaaaccaacatgtcttcagattccaggctggataaatgactaaagagtcaaccgtcctgagttatgtcacacagggctaataaagtcccactttactgatccaaaaattgaagcaaaaatgcctggcaatcaaaacatgtatttatgatacagtaagacagggtagtccctactgaaatgaatacaatgagttcctgactcaaattggatgaagatttgtgtaaggaacacttaaaatggccaaaatactgatttcggggaagtgatagttttgtaacaactaaagaaaattggttaccattttgaaaagaagtgtccatgaaaaagaaatagctctggaccatcacatgatgacaaactagtccattataaaataaagtcagtgaacagagttggtagttctcaccccaaaacgctgattataacaccacctactgtggaatgttgggctattaagaataagactaaacattactgcatgtgggtcataaacaaagctgacacagaaaaatgtaagtaatcatttcacaaaaggaagtaaaatcagtgaatatttcagtactctagtaaaagaaaaaggcatgccaaatttaagcacctaattgctcaagtaattaaaaatgacctgtttggcaatcacttgacgcacatacagaatttcaggattacatcaattatagaaagctgggttcatctttccaattttcttgcatatctccaagcagtgatttctcatgtcaacataagaaatgcaggcataagcacagggaagtctgaacctgattaaagcctttaactgaaagtttttccacacaaaatctttttcccatcctgtaaaaagagaacaccatgaacggatcgtggttcactcttttcccttgctgcccgcctacgctgaggaggaggtgtcagtgagaggtggggcctgaagcagaagcttggcagcagagattgatactgtgctgaagctcagaataaatactcaaatgctttgaaaagttatgattacaatgtacccgaatattctttgcgggtgtagagaactaagccccatgatgtcttataatcattcagtgaattggttcaactttatttcatgtgactttcttaggagagagctctgggccatctctaaacaattcaaaattattaagcatactggtcctgtcagagtttatttaggatctgctaggtaaggtgtttactgctttacagaaagcactagtagttttctgcacattctgtctacatggttttattaaaggaaacacagaatctatcttgaaccctggctggccctgtctgagaaaacacccaccctcacaggcaacttaacttatgaatgtgcataagtttcagctaaaaaacaacaaaaaaacccttccctgtaggaactggtctacactgatgagagactacttgtcatctcttcctttttagaaagaaaattttgctttaacaaataccaaaaaaaagtatgttttattttaatttgagagagtagttaatcacactggcgactgccaatatggttaattaaaagccaaagcattatcttcttactctttggatattctctggattccaaagacaaaatctgaggttgaaagaagtgattctgcttaaaatttctaaggcactgacaaagcatcttcaatcctgcttgaagaactgctcacaggtcacccaattaacttactatagccacagcccaaaactttttcttctattacatatcttgtaatacccactcatacctttagcacattgctttaatacctattttattctgaaaaattcacatttctatacctatcctttctgctttccctttgttcaaaggaagaaacattatttctcttttgtaaaatgaaatcttcccctgcacgttagggctttacttttttcttttttctttttttctctctctctctctagagtattcagttccttagcctcaatgcttttcttcttttatggatttggccattcctctgtcctgtcctgaaaagatctcttcaacctgccacagcctccttaccataataactgaagtttttagacactgatctgtagttccacctctatttctatattacaaaccatccttaatcccatccatctggccccatacaccacaatctactcacatggcatctgttataggttgaactatgtcccccagaaagatgtgctgaagttctaactcctggtacctgtgaatgtaattaaccttatttggaaagaagttctttgcagatgtgacttaagaagatgaggttatattggatcagggtaggattagggtccattgattggtgcccttataagaagaggaaatttggacacagaaataaaaaatacacagggagcaatttatgtggtaagtgacacagcgattagaatgataaatctgtaagccaaggaacatcaaagattgtaagcaaccactaaaagctagggaagaagcgtggaacaaactcttgcatttctaagttgtactccagtagaactaacctgtgccagcctttcttcctctatttaactcattaaacacttactgatgactacttatgtgtcaagtagcagcctaaatattgttgttacatcaataaattagagatctagtgttcttgtcctcatgcagcttattttctactacagaataggacaagtataaaaatcatgaaaatgcagtgtggtaagtgctgctatgagaggaatagtggctatgggagcatataggtgggcggcctaccttgggctagagggggtagtgtcagagaaggataacttcaggtcattatatgcaatctgagacctggaagataacaatgaaccaagaaaataagggagtggggagacatcatccctgcagagggaaatatatactcaaagacccagcattgagagataacatggcttagttgagaaactcagaaatgtttaggtgaaagtaataagtagttttaggcggagtgcagtctccacaaggaaaagaaccatgactgtagaaccatgtctgtagaaccattaatgtacattcagcccttggtacttggatatcaagaaatatccaagtatccaataagtgaataaatgaagataagaggtcactccctccactgaattagaaaaggaggaaaggacagtggagatgaatgctaagattgtaggataataacaggacactaaagaagttctcatcttccatttactctggtaacaagaaaggatgatcatcaaccaagaatgagggaagtagtgaggtcagagaatgaagaaatcacagatgtgttggaatagctattagggaaaatggaagatataattgcttagagaattgcataaaatggcaaagagctgtgttgattgtctagtgagggtttggagactgtagattaataatagcactgttctaggtttttttcctccagtaattctcagaagtctagatataagcatggaaaatataggcagttagattgaattgccttacatattaatctcttatgtgcactaatctttcctttttaacaaaattatatgatcctagaaagtaggggttgcacaaaatagactatgttagcacagtgctgacatatagtaattgttcaataaatatttgcagaaataattaatgactaaattgttcaaagaccaaatggtcacatctcataggtatactttcaaatgtcaagcatcctacattaagaaagatatgtatgctttagttgattgctttagctcaagggggaaaaagtatatgttgagcatttttaatgtgccaactactatattggctggtgaagaattaatgaagagtatgtcagtctcttccctaaacgaacattaaaaatgaccaatgacagacacaattacatttctttactcaaagaactatcattgaccaaattgttttcatccttaaagatcaaatagtcaaaccacaagttgactgcttatggggctgtatgatagaatgtgattagatgctgtcctacttgtttatggactacttcattacacttgaaatggaatatcctccaagcttccatcattaaaatataaccaaattataggcactgcctctagctatcaagcacatctgtctatgcagtttttccaagttaatttttgctgccatgcaaaccaaggtcattaaacactgacctctgaatactgtctacactgtcttggaagtatacagattccagcacacaaagccacaaaagttacatagattatttaaaagatgtaaaaatcatctcacatgttgaagtttgatgaggatgtcccactggcagggttgttgctggagaaagcaagctgaaatatctgaagggtaactcggtggatcttgaaaaatttccattcacaaacgcctgtattcagtaacatctcctctgaaaagttcttcctcctagtcgccactcctttaacttaaaagtactctctctctccactgaccacatctaacggtttatctgtctttatctcatttttagtgatacatcattttctacatagaattagaatatagttatttataggaagggttgatatttagaacatttaacagctggtatgaaatgaacaccaactaatcacaatacgtagctgccataaataactgctgtgatatgcacaaatatgttgtaggaatatctcattcccccacgttggatagttaccactttgaaggtggaggggaaaataacccttttattttgtatgcccaggggttttatggacaaagtagatacttgaaaactaattttttatttttattttaaaagacaggggtctatgctatgttgtccaggctggacttaaacttctgaggtgaagggattcccccaacctcagcctcccaagtagctgggactataggtgagcaccactgtacccagcttcaaaactagtttttaaaatgaattactgaactaaataaaaatcactggatcttttttccataagcatactttaacaaaccatgcaagaaagggatcggggtaaaataatgcagtgagctacttcatcattcattaaaacaacactcaattccaggctatcttagtttcctagggctgcaataacaaagtactaaaaagtaagcatcgtaactaacagaaatttactatctcaaagttctgcaggctagaagaccaagatcaaggcattagcagggttgagtcctcctgaaagctataagagtaaatctattccatgcccctcttctggattctggtgatttgctggcagtacttggcactccttatctcatagatgcatcatcccgatctcagtcttcatcttcacatgaattctccctatgtgcatgtctgtttctgtgtccattttttttttttttttgtaaagacacttgccatattggaatagagtctaccagtacgacctcatcttaacttgaccgttagcaaagaccttagttccaaataaggtcatatacataggaatgggggttaagacatcaacatctttttcagggacgcaattcaactcataatactggaactgggaaacaaaaatatgaacagaatgcagttcctattgtcaaggatttcacagaccaatgtggaaagaattataaataaacagcatatgttagtacattggaaaaaatgaagaaaggcaggttgtatcatgcaaaacttctgaacttccaggagataatgacagtcaagtgcaagtccacatgtagaaatagaggctcatgaggctccagaagtgccatgttaaaaagtttagaccttatattagtggcaatgaggagagagactttgaaaaattttaaccatgaaaatgacttgatcagatttggtctccctccattttccttgttaatacttgctgttgtttaaaaaatacatcaagctatcctaagaaaaaaagaacaaaactggaagaatcacattccctgacttcaaattatgctacagagctatagtaaccaaaacagtatgatactggcataaaaacagacacatagacaaaggtaacagaatagacagcccagaaacaaatctatacatctagaatcaactcatttttgacaaaggtgccaaaacatacactggtgaaaagacagtctcttcaataaatggtgctggggaaactggatatccataggcagaagaatgaaactagacccctaactattgccatatacaaaaatcaaatcaaaaggcattaaagacttaaatctaagacctgaaaccatgaaactactctaagaaaacattggggaagatttctatgacattggtttgggcaaaaatttcttgaacaataccccacaggcaaatacaatcaaagcagttaatggacaaatgggatcacaacaagttaaaaggcttctgatagtaaaggaaacaatcaacaaagtgaagagacagtccagagaatgggagaaaatgtttgtaaactacccatttgacaagtgattagtaacaagaatatgtaaggaactcaaacaactctaagaaaaaaaacaataatatgataaaaagatgggcaaaatatctgaatggacatttcttaaaggaagacagacagacagcaaacagacatatgaaaggtgctcaacatcattaatcatcagagaactgcatatcaaagctacaatgaaatatcatctcaccccagttaaaatggcctatgtccaaaagaaaggtaatgacaaatactggctgggatatgggaaaaaggtaacccttgtacactgttggtggaatgtaaattagtacaaccactatggagaacagtttggacattcctcagaaaactaaaaattgagccactatatgattcagcgatcctacttatggctaccgaaagaaagcaaatcagtatactgaagcgatatctgcactctcatgcttattgcagcactatttacaatagctaagattttgaagcaacctaagtgtcgatcaacagatgaatggatacagaaaatatggtacacatacacaatggagaactattcagccacaaaaagaatgagatctagtcatttgcaacaatatgggtggaactggagatcattatgttaagtgaaataagcaagagacagaaagacaaacatctcatgttctcacttagttgtaggacctaaaaaccaaatcaattgaactcatggacatacaatagaaagtaaaggatggttactagaggctgagaagggtagcagggagcttggtgggggaagtagggatggttaatatgtacaaataaatagaaagaatgaataagacctactatagtccaaaaagacaagtaaagtcaataataacttaatatttaaaaataacaaaaagagtataattggattgtttgcaactcaatggataaatgcttgagaggatggatatcccactctccatgatatgcttacttcgcgtgacatgcctgtatcaaaatatctcatgtaccccgtaaatatatataactactatgtactcacaaaaactaaaagtaaaaaaaaaaaaataaaaaataaaaatacttaaaggggtgaaaaactattatcagacttactgccttatttctgactatacatttaaaaaccttttatgctcaattcaggcattctattactacacatttcaagtgaccatcatgggcacttttaagcacctaacacatttttctttctacaaacctcacaaaaagacctgtcaagaaaatcattctaggtccaacaatgcacagcacctcatgccttatttctacttctttctttatgatagaaaatgtagtcagcctttaacttggcctgataaaaactgtaaagactatgccaaataagaccaggtgcagtggctcacacctgtaatcccagcattttgggaggctgaggtaggcagatcacttggggtcaggagaccagcctggccaacatggtgaaatcccatctctactaaaaatacaaaaaatttagctgggcatggtggtgcatgcctgtagtcccagctactcaggagtctgagggataagaattgcttgaacccaggaggcggagattgcagtgagccgagatggtgccactgcactccagcctgggtgacagagcaagactccatctcaaaaaaaaaaaaaaaaaaaaaaaaaaaaaaaaaaaaaaggtgtgccaaatagtccctcatacaaacaggaaacccaaatcgtttatcaggaaagaagaggtgacaattttagatactgagaatattgaagtacttgccagaagtcagatttcaggctttgggaggccatggcgggtggatcacttgaggtcaggagttcgataccagcctggccaacatggtgaaaccctatctctactaaaaatacaaaaaaaattagctgggcatggtggtgtgcacctctaatcccagctactcgggaggctgaggcatgaagaatcacttgaacccgggaggtggaggtttcagtgagctgagatcccaccactgcactccagcctgggcgacagagtgagaccccatctcaaaaaaaagaaaaaaagaaagaaaggaatacaattaaagtggaggaggagcacactctggtcttggaattccatttgagaatttagaagtgtcatgtttataatttttcaattttgtttgttgttggcttgctgtaaagcaatataaaatatttttgttataaaataaataaaaaatacatcaaatcaggagcagcctaatgatggctgactagaggagttttgtacttgtctcctccacaccaaagaaccaaagtagtgagtagataatcacacttcgtatagttccctgaagagaaaatactggaatgtaataaattcaacagaaaagtgacacaaaatacctaaagcaaagaagaaaaaggaagcaaggcatcctgcttgaccaggatcagctgggagatgagagactcctcaatatgggagaagtataaatgagacatctttagtggtccacattcccactgtggactcctgcaatcctagacatgggagaacccctcaactcttgtgggtcctgaaactaacataaggatctatgcagaaattctgtgatggcactgctccaagaagggaggttgcactgggtcttacacactctgtgacacctaagcagctacagcaagccaccgttttagagtcctgcccccaacagtctgtgtactgccctggaacccagcagtgccagggctaaggtgcaagagaattgtggactgtaatccctgggtctgagccataaggaaggtgtgggctacttcagccagggctcaggcatgtagttcctgaacaaggcatgaactacagctattggggactgaagcataagtaaggtagtggctatcacaacaagaattgaggcatgagtgctgccagggatgaggcatgagtgatgtaaacattcccgccttgccagcagtccaaccttccacagtggcaggacagcagtgtggctactaccagtcacacctgagcattctgctggtggcctgggaatcatgacacctctgcctaccatagctgatgctggcatccaccattaggaagcctgaggacaagcctgcctggcctggctttgtcccttcttccaccctctgggccagggcccagcccagtctatcaccattggtaggtgaaaaaatcctcccatgtgcttgagattgggtctacctagccagccacttactcctcagctggcacctacctgcatgtaccacctgtgggcctggagactggctagcccagcccatcacagccactgccaatgccagtgtataccactcaggacctagagggttgtcctaccactatcactgccattgtccatgccatgccaagttcccaggggcctaataacctgcccacctgcctggctcactgctgcaactactgacactgaataagtcaactggaggcccaagaattggcccacctagaccccctaacattagtgtaaccatacagtatactggggctcaagaacagacatgctcagctcactgctgccacccctggggcccaaagattggactgcttggcatcccactccccagtagaacttcatcgtatcctccacttataactgcactgtacaccaccaaggaaatcacagatgcaaataatgctgtttaaagtcaaaagaaaaatcatacaaagactacattattgcacacaacaagaatcaaagccaaagtgccctacacaaccaacaccatagatacatcttcaggaaaaaagtaatcccctacaaaagcaaattaaaaaaatgagaagaagtgacttataccagatcacacagatatcaatgtagtgacactggaaacattaaaaaaaaaaactcaatatgataatgtcaaagaaacacaataattctctagtaacagatcccaagcaaaaagaaacatgagtaaatcaataaaagaattcatattatcaattctaaagaatctcagtgatatagaagagaattatgaaaaccaatacaaagaaatcagaaaaacaattcaggatatgaatgacaaatttatcaaagagatagatatcatacaaaagaaccaaacagaaattctgaaactgacaaattcattgaatatatcagaaaatacatttgaaagcttcaacactagattagatgaagaagaatctccgaactttaagaaaggtcttttgaaataaaccagtcagacaaataaagaaaaaagaagaaaagagaatgagcaaagccttcatgacacatgggacaccataaagggaccaaatattcaaataatcagggtctcagaagatgaagaaaggatgaaagggttagaaaaactatttaacataatattgcatgaaaacttcccaagtctagcaagataattagacatccagatacaggaggctctgagatatccttacagatacaatccacaaaatatcttctccatggcacattacagtcaaactgtctaaagtcaaagacaaagaattcaaaaagcatcaaaagtgtctagtcacctacaagggaatctccactagactaaaattggtttctcagtagaaaccataccgggcaggaggaaatgcaatgatatattaaaagtttcaaaagaaaaactgccagccaatgatactatgtacagaaaaattatccttaataaattaagaaaaaataaagtcttttacaaagaagcaaaaacaagaaattcaacaccactagaccagctctataagaaatgctcaagggagtcctaaacctggaaggaaaaggacacatctgccattatgaaaacacacaaatgtataaaactcactggtaaagcacacatacaaaggaaaaagagaaagaactcaaatagcatcatgacagaaagctaccaaaccaaaatggaaaacaataaaagaaaaataaaggaacaaagaacatacagaacaaccaaaacacaattaacaatatgacaggaacaaaacctcatatattaatattaaccttgaatgtaaacagattaaattctttacttaaaagatatagactggctgaaaggttacaaaaacatgatccaactatatgctgcctataagaaacatactttacctataaaaacacatgaagacacaaaataaagggatgaaaaaagatattccataataacagaaaccaaaagtgagtaagagtagcgatccttatattggataaaacagacttcaagtaaaaaaaaaaaaacagtaaaaaagagaaatcagaaaattatataatgataatagggaatcaatgcagcaagagaatgtaacaatgctaaatatacatgcacccagcactggatcacccagattcataatacaaatattactagttctgaagagaaagatagattctaatacaataatagtggggtacttcaatatcccactcggcattagacagatcatttacacagaaaattaacaaagaaacattaaagtagactttagataaaatggacctaacatacatttgcagaacattttatcacatgactgcagaatacattgttcttatcagcgcatgaaacattatccaggatagtagatatgtcaggtcacaaaacaagtctcaacaacttaaaaaatcaaaatcttattgagtatattctcagatcacatggaataaaattataaatcaataacaagagcaactttggaaactatacaagtacatggaaattaaacatgttcatgttcttaaataatcattgggtcaacatagaaattaagatgaaaatcaaaaaagttcttaaaacaattgaaaatgaaaatacaacataccaaaatctgtaagatacagcaaaagcagtactaagagggaattttatagcaataaacatcataaacaatctaaaaatgcaactcaagcaattagaaaagcaagaacaaacccatccccaaattaaccgaaatagagaaataataaagataagagtagaactaaacaaaataggtttaaagaacaatataagggtcaacaaaatgacatattggttcttcagaaagagaaaattgataaactaccacctaaaatagcaaagaagagagaacacctaaataaacaaaatcagaaaagaaagaggagacacgaccattgatacatgcattagtctgttttcatactgctatagataacttcccaagactgggatctaccatcctagggtctggaggatgggggccctcttcttacagctcaactaggtagtaccccagtggggactctgtgtgggggtgcccacccgacatttcccttccctattgccctatcataggttctccatgagggctcctctcccacagcaaacttctgcctggacatccaggcattttcatacatcctctgaaatcgaggtggaggttcctaaacttcagttcttgacatctgtgtacccacaggctcaacaccacatgtaagctgccaaggcttggggcttgcatactctgaagcaatggtctgagctctacgttggccccttttactcatggctggaatgcagggcaccaagtccagagatttcataaagcagcaaggccctcgtccttgcccacaaaaaccatttttttctcctaggcctccaggtctgtcatgggaggggttgccatgaagatgtccaacatgccctggagacatttttcccattgtcttggtgattaacgttggttccttgttcattatgaaaatttctgcagctggcttgaatttcttttcagaaaattgttttatcttttctactgcattgtcaggttgcaaagttttcaaacttttatgctctgtttcccttataaacttaagttccaattctgaactatctctttgtgaatgcgtaaaactcaatgcttttaagagcacccaggtcacaacttgaacactttgctgcttagaaatttctttcaccagataccctaaatcatctctcttaagtttaaacttccacagatttctagggcaggggcaaaatgcctccagtctctttgctaaagcatagcaagagtcacctttattccagttcccaataagttcttcatctccatctgagaccacctaagcttggacttcattgtccatatcactatcagcattttggtcaaagccattcaccaagtccctaggaaggtccaaactttctcacatcttcctgtcttcttctgagccctcaaaacttttccaacctctgcctgttactcagtttgaaagctgcttttacatttttgggtgtctttatagcagcaccccactcctggtaccattttcctgtattagtccattttcatactgctataaagaactgtctgggactgagtgatttataaaggaaagaagtttaattgactcacaattcagcatggctggggaggcctcaacaaacttacaattatggcagaaggtgaactggaagaaagacaccttcttcacaaggtggcaggaagcagtgccaagggaaggggaagagcctcttataaaaccatcagatctcatgaggacttactatcacaagaatagtatgggggaaaacacccccatgattcagttacctccacctggtctctcccttgacagatggggattatgggtattatatggattataattaaatatgagatttgagtggggacataaagcctaaccatattaattccacagaaatacaagattatcagagactattaggaacaactatgtgataaaaaactggaaaaagtagaggaaatggataaattcctggaaacatacaaccttccaaggtttagtcaggaagatacggaaaacctgaacagaccaatattaagtaggaagtctgaaatagtaataaaaagtctcccagtaaaataaagtgcaggatcagatggattcactgctgaattccaccacacataaaaagaactaaaaccaatcctcctcaaacaactccataaaaattgaagagaaagaaattctccctaactcactctatgaccagtattccctgataccaaaacctaaggacacaacaaaataagaaaactatacatgaatattcctgacgaacacatcttcaaaaaatcctcaacaaaatactagcaaactgaattcaacagcacatcaaaaagataatataccattacaaaatgggatttataccaagggatgcaagaatggttttacatatgcaaatcaacaaacataatatatcacatcaacagaaggaagcacaagaatcatatgatcatctcatcagatgcagaataagtatttgaaaaactgaacatcacttcataataaaaatgttcaacaagctaggcagagaaaaaatatacttccaaataataaaggccatatatgactaacacacagctaacatcatactgaatggagaaaagttgaaagtttctctctaataactggaacaagataagaatgcccacaaaatactacaccaaaaaactcttagatctaataaattcagtaaagttagaggatacaaaatcaatataaaaaatcagtagcatttctgtacaacaataatagtcaaaaaacaaattcagaaggcaatttcatttacaatggttacagaaaccaaatacctaggaacagatttaaccaagaaagggaaagatctctacaaggaaaactacaaaacactgatgaaagaaattaaagaggacataaatggaaagacatttcatgctcatgggttgaaagaattaacataattaaaatgagctaacttcccaaagcaatctacagattcaatgcaatccctataaaaataccagagtcatttttttttacagaaatgagaaaaagaattctaaaatttatatagaatcaaaaaaaaaaaagagccagaatagctgaagcaatcctgagcaaaaacaaacgaacaaaaatccccccaaccaaaaaaccccaaaaccaaaaacaacaaaacaaaacaaaacacaaaaacaaacaaacaaaaaacaaagctggaggcatcatacaacctgacttagaaatatattactaggcatggtattggtataaaaatagacacttagaccaatggaacagaatagagaagtcagaaatacatccacatgtttatagccaactgacatttgacaaagctgctaagaacatgtactggggaaaggacatccttttcaataagtgatcctaggaatattggatatccacatgcaaaagaatgaaactggacccctatctgatcatatacaaaaatcaactcaagacagattaaagccttaaatggaaggcctgaaattataaaactcacagaagaaaacaaagggaaaacacttcatgacactaatctaggcaaagattttatggctaagaccttaaaaccacggacaactaaaacaaaaataaacaaattggactatattaaacttctgcacagcagaaaagacagttaacagagggaagaaacaacaaattgaatgggagaaaatggttgcaaactattaatctgacaagcgactaatatccagaacatacaaagaactcaaacaactcaacaacaacaaaaataatcccattaaaaatgggcaaagggcattaatagacatttctcaaaagatgacattcaaataaagatgctcaagatcattaatcattagagaaatgcaaatcaaaaaccacaatgagatatcatcttatcccaggtagaatggctattattaaaaagacaaaaaataacggacgctgacaaggacatggagacaaagggaactcatacactgttagtcagaatgtaaaatagtgcagccatttgccactatggacaatagtatggtgatttctcaagaaactaaaaaagaactactatacaatccagcaatctcactactgggtatctatccaagggaacataaatcagtatatcaaatagatactggtactcacatgtttattgcagccctattcacaatagcaaagacatgaaatcaatctaagtatccatcaatgaataaatggatgaagagaatgtggtatctatacacaacagaatattatttggctgtagaaaaaaataaaatgtcatttgtagtaacatcgatagagctagtggtcattatataaagtgaaataagcaggtaaagaatgacaattattgcatgttttcacttacatgtgggagctaaaaagttggcagatactagaagctgggaaaggttggtggggagaagagaggtaagttaatgggtgcaaatacacttagatgaaacgtataagttctattgttcaaaagcagagtagagtggctatagttaaaaacaatgtattgtacatttcaaagtagctagaagagaggacttgaattgttcccaacacacagaataagtatttaagtatttacgataaatacttaagtatttaacactttaagtatttacaataaatacttaagtatttaatacttaagtatttacgataaatacttaaagtggtggatgcctcaaataccctgctttgatcattacatattctatgcatgtaacaaaatatcacacgtaccccataaagatgtaaaatattacgtatcaataaagatatggcaaattatattctgtgtcattggtaatatgttctctttttataataaagcatcatttattccttctcaaatttgccttttttctttactatattcagtaatcactcattaaaaactcactctaggagactttttccctcaattttctctctgctcatgatttactttgagcttttccttgttcccccaacactgactgtttgtcatatcttcttcacaaaaccaaattgtgaaaaataaaatataacacaaaagatgtctgcaatctgctaagaaactaaaagactaaccttaaatttaaaaatttataaacattttaattcaccaaaactgtcaagtgggcattattagtagaagctaactttactacctcactcgatcacccttatagggctctttgtaaaagagataattggaaaatctggactcagcttgcatcctaggaaagagtggaagttatgtaattgaaacaattatacaagcatttctttttgcaaggacatcttgctcactatgaaacaacagagggcttactcattatggttcagatttatgaagtaactaaacaatatttccagtatttattgtatggtttcagacatgccaaagaaggtgtctgaaaccactgggtaacagatgctccctcattatattatgtgacaagtgttaatattttcaattacacagcagttgagttaaggtatctttactttgccataaaatctattttattgcaactaaatatcttttatatcaaatccattaatctttagaacaatctatcctatcttgcatatccaattgtacaaggcttatagcatgtaccttttgtctttatttaatcttatacttttgcccaacttagtttaatttacacaaataaattcagctacataattgaacatctttaatgactgcttaaaagatataatattttgcatgctaaaataataaatggactattggaacaagtcacttttaatggatctgttttctaatacgtaaagagataatatatgacacaagcaccatgtggaataggagaaagattactggtataatccctggttctaccatttaaaaactgtatgaccttgtaatatgttgtttagcttctctgagaatcagttttatcaggaaaatgatatcaaggaggctaatacttacctcataatatcacagtgagaattaattatgataatgtatgagaaggaaccacacagtataagttccagtattgaaaggatatctattccctttgcattttctttcaagattgtaatgagagacaaatgtaatgtaatacatcatacactttaaaccatttacatttatttaaattttaggtattattaatatctaaagcaaaatactagaatataaaatgagttattagacacacaaaactatgtcatatcatggtcactcacatcatctattctcttatattttatttctcaaactctcttaaaatactttcatttatcctcataattggttaatcccatgaaataaaatgagacaaattacagatctgggtataaaaccctatactcttgtatcatcttcttagtgaactccctccagttactctaccttatgcttaaattgtgaattctttaagagtctctatcagtttcatatggacataaatacaatttaattaatatgcaatgtttggcttttgcagcacaattccaaatgtaacagaatgtatgaagttatctcaatgattgatatagttagctcacatgttttggagatggagttttggtaattttggtatgtatctctattcagacagctgttgacagatggaaatttggtttaagaactgttccagaacattcctccctttccaaaagatcatcaaatgcttttaataagcatattggagaagactagagagacagacatacaaaaatatccacaacaggtattttgataatagagagagaagggtaaaaagaaaaagaagaaaaaaagctctgacaagtgaagtcaggtgaattcatacatatcaaaaataaatttgcacattgggtagaggcaaaacaagatctaaaacaaatttgatcctttgggtagaggtaaaacaaggagtactatattaatagatctaggaggaataggggaccattcaaataagagttcctgggatgacccagttgtcattaggtggatcactctcttctttgtgcagttacatctagtgtctgtctttatctacagattttttcttgttttttttttttgttgttgttgttttttgacctagagtgggaatcaagcatgtactactcaaactacctctcttcttgatgctccatacctagaaaatactagactttcaataaatatctgttaacaggatgaataaacaaatcaagattgctgctgttttctttttgtatcagcatcttagatttttgattcctctagcttttaactatggtttcttatattttacttcatgtataggactaatagtataccattttggtcctgattcaggaattttaagttggaatatgcctagaagtttcgaaatgttaagatataaatccctctcacatttgccatgatattttggcattcaagatgcaaaacaaacaaacaccaccttcgatcgcacaaaacctatccccaaacctataggaaatgattctagaggtgaaaatgcagaaatatatccataaagatgctaactcaagcttctaaagctcacatactaaaatgagcatattgtatgcttcctattctttatatggtatgattttttttctgatctattcttcaataatgaggttgtataacttgaagggtgaatttagcaaggaaaagctaagctgcctatttgtttttatcaaaagtgagtttttatttgattcctacaagggtgagcagagaacagctaaagtgaaggagggaagggcccttgggtgggtgaccaagttaatacttctgtctagtttgatgctgtgcagtgtggagttttaaaggttattctctggagaaaataatattgaatgagataacaatattaaatgagggacaataatgattgtttttattatttactatatgctaggtacaaagaaaattacatttcattcactatgccttatctcatttcatctcattaaaataaaaccaatgaggcaggtattataacattttacaaacaagaaaataaagattaaagatgttaagtagttttcttaaggtcaatgatttaacaacctgtgggccaagacgcgaatccaagactgtctggcagcaaagcctttcttcctaagcttattgttctattcagcctcccagtctgtgcactgtgttctggtatcacaaactctgaagcattctacaaatacatactaatcttagtagcagaaacaataaaaatgaatttaaaatatatctcaagaaaaaatctaaatagtatgaaaatactaatatttctcacaccggcatcagctagaactcatatttaactgtaacacacgttgctaaattttagatctatataaagatttctgagaatgacataaatgatcatgaccactgacatttattttgaatgataaaatgaatgatccatgcattttaattgtattattattattattattattatttttgagaccggatctaactgctggagtgcagtggcacaatcatagctccctgtaaccttgaacttctgagctcaagcaatcttcctgcctcagcctcccaagtcagtgggactccaggtgcatacgactaccccagccaatttttttatttagttttattttttgtaatgacagggtcttgctatgttgcctaggctggtcttgaattcttgggctcaagtaatcctcctgcctccgtctcccaaggtgatgggattacaagcatgagctactgagtctggctgatgtgtgcattttaataaaaccaaaagttgatatgctaggaaaagtcctagctcctttctcaaatattgtaccaactgaagtatgacaacataattattaaaaggaattgtttagttttaaatttgataccaatagcaaaatgagagcaatcaaaatacctactgacatgatgtaaacacttgagcattattatcattaattatgtgcttgtgtctttgcactagacagtggctgctgaagtctcgagtcgatcaattaattttaatgtgtaaactgggtatacaactcttgcattatcaaatctttgcacttgaccaaattaaaaatcatctttaatttctaagcaattactttcctgtatttcgaattagttctaatcacaaactatgtaattttctccttcctcttgtcttataagcttttaaaattattttatttactttgagaagcatgaaaaatctttttggccactataaaaaataaaaaataaaacaggttgagtgaacttaaaaatgttgattttggtaatattactttaaatgtgtatttaaaggatacaataagccaattaaataaagacagcttggctgggcatggcattttatgctcataatcctagcactttgggaggctgaagtaggaggattacttgagcccaagagtttagaccagcctgggcaaaatagcaataccctgtctctataaaaaaatacaaaaactagccaggtgtggtggcatgtgcctgtggttccagctactctggaggctgaagctggaggatcacttgagcctgggaggtaaaagctgcagtgagttgtgacagtaccactgtattccagcttgggtgacagagtaaggcctcatctctaataaataaataaataaattaattaattaattaataacaagaaaaaccagctttactcttctaaatgttacagattgtgagaagactcattattgtcagttggcatttttactcctttaagtcagttataattcagggtactttctagggctaagtcaaagctctgcatctaataataaaaataatctggatctacatttctgagggtaaggaaaaagcttagtccttcagtgacagctttgcccattaagaaatgaaacaatgaatgtggccaaatatagcatttggaccatgctatgctctatgagtacaagagagttaaaaccttggcactaaaaaacactaccaccctttagtgctaatgttttctggtcatcaaataaagaaatacatgtccatagcacatttattttttaatttttaaaattaaaaaattacatgtgtttcaattcaaagctataaaaatataatgtggattgtattgtttataaaatccttcaatcaattggattttggagcaatagtttgctagatgaagattgttttttaccctgattaaaatccaaaatgggatattctctgtgagacttacatatatagaaaataacaaaacagatttcctagcatttaaatggatagttcgcttgcttttcaagactaacaaaatctgctaatgctatattttgaagtttatcaacctatgtctaagaataaataatttccacaatacagtagtagctgtcatgaaacattttagttattgtttctctggtctcaggcttttgcaagtgtccttatgtactccagatcattgtgtactatttgtaagacagaagaaatacagatcctgatttttggcaagaaacgcacagagtaggacagaagcagggagtcaagctactcttgacttcctgtttactctaatagcctttggaaaacttggtgagacttccaacatccactgaccttgaccactgttgggtcattcgatggtggcattttgtggcatttatatattgcatgtaggcattactactgaaatctttggaatatagttggcaaatgcagttgggattctctccagtttaccagggagactatgagattgtggcttgtttctgctttactgtcaaaatattcagagtttcaaaacagagtctgtggttaggttgaaggggagaaaagtacatttaagattactccccgtagagtagcacatgtgaataaacaggaggaaagcaggatcagtcagaaaagttaaataaaaaggaagttgagcacttttgcttcatttggccctttgatttaatagtcaaagaatcttataattggaagggatctcggggttaatctaatcgaatacccgctccaggtccatgcatatggtcatctagcctttacttaaatacactgtaaccaaggtggaaccattaacatttcttttttctctatattaattaattggctatgatgttattacttctatcaacaggtctcagatctgtcttttaaaggaaaagagaataagctgggttgtctgtccctataaatgatgtccctttaaataggtagaacaactacctttagaagggattccccagatcatctgtcttacttctctaatttttcagggattaaactaagacctccagaaatgaagtaatttctcagagttacaaagctgtttaattgcagaacctgagctaaaagcctggctcagttacatggaaagcagagattttgaagccagctattatagccaccttatcttctttgctctaagtgaagcagacctagtttcttctactttttctcatggcactaagcttctagacttcatactacacatctcctagtacctactatgggctagggacaagcttcacaaagagaacaagtatctaatattgaggagctcatggtctagaatggaaaaataaataactgcagcatcagtgagaagtgctatatttatgaaatatgtttaaattcctatgtgaacatagatatcagagtgattgcagaacgttattgaagtgatatttcagttaatagaactgatttgacctctttaatagcctacagcaatagtagtattacataacagaagtctccagctgggcgtggtggctcacacctgtaatctcagcactttgggaggccgaggtggttggatcatgaggtcagaagttcgagatcagcctggccaatgtggtgaaaccccatctctactaaaaatacaaaaatcagctgggtatggtggtgcacgcctgtaattccagctacttgggaggctgaggcaggagaattccttgaaccagggagatagaggttgcagtgagctgagtttgcaccactgagctccaacctgggtgacagagtgggactgcgtctcaaaaaaaaaaaaaaaaaaaaaaaagctcccctacttcagttaaaaacttccttaattaaccaaaactcataactgtcttgactggacctggagatgctaacttctcatggctagaaagctgctcttgagtatatcttcacaatgctctgcaaacaagtagagttgtacacttaccaaatagaattgtatacatacctagtagagttgtgtatttatcaagattcatctgagttttttacctaacccatttatctccctttaacttgttaattatgtcagctgctgttgctgttgctgtaattatgtaatttgattaaatattttgtgaagtgataaaatactcatcttaatgtttctataaaatgtaaggtgaatgttttggaaaggcttgtgaaacaccaaatgtttaaaacatgctattaatgtgggcaagataattatgaaaggttgaggagaaacaaagtctagaagtatttggacactcatattactttcccaatgtcttttattatcagtcaattttcttcacaaaaaatggttgagacccatggcgaccattttaaataaaaataggcaatttaatatacattaatgttttaaatgaaaataaaatgtttaaagaatcttctctgtatctgaccaatctggtcaactagtcttgttcctattacacaaatgagttcttattgactacgtaccatgtgccaggcacattgtctgaaagaattgcctgcatagttttatttaatccttgggccaactattactacaacttaacatgtaatgagtcttagaaaagttcaacaacatgtttgtgttcccacagctaataaatcaggaagagggcattccaatccgctgttatgaaaggcatgattttacaatgtactttctctttcacaatccaatataaaatcaatgatgtttcttgcacaggtgcacctgcctacatcctaatcctgatacagacttttttttttttctgtataattagttttgagataaaaaaaaggccaacatctacacagcatatctccaccctcgagaatgttacttcttgttctggaaagtccccttcctcggtttacccatttgaatacatacgtaatttggtgtagatactcattaatttcttccaaaaaattgttcccaaagaaaccacctcacattgattttttcacctttacttttgtagaatagcattcattattggattttgtacatttaatcattcacctattcaataaataagtgtcaaaacatattctcagtactcaataaatattaattagattgattttacaaacaatttataagcagaggctactatggcttaattcattcacatcataattattagttgatcactaaatataaagaagcatgtgccaagtagaaagatgattacgtatgaaagctctattagcactcactgacttagcactatcattgccaggcacttttctaagacttgtgtgtattaaccttttacatttttttgtttaaacttccaacttttattttaagttcaggggtacatgtgcagcatgtgcaggtttgttacataggtaacggtgtgccatggtggtttgctgtacagatcatcccatcacccaggtattaatcccagcatctattagctattcttcctgatgctctccctttttccactccccactctccaacaggccccagtgtgtcttgtttccccccatgtgtccatgtgttcttatcagtcagctcccagttataagtgggaacgggtggtatttggttttctgttcttgtgttagtttgctgaaaataatggcctctagctccatccatgtccctgcaaaggacatgacctcgttcctctttatggctgcatagcattccatggtgtatatgtaccacattttctttatctagtctatcactgatcagtatttaggctgattccatgtctttgctattgtgaatagtgctacaatgaacttacatgtgcatgtatctttataatagaatgatttatattcctttgggtatatattcagtaatgggattgctaggttgaattcttttggccctaggtctttgaggaatcctcacactgtcttccacaatggttgaactaatttacactcccaccaacagtgtaaaagcattcctttttctccacagcctcatcagcagctgttgtttttttgcctttgaataatagccattctgactggtgtgagatggtatctctttgcggtttttatttgcgtttctctaatgatcagggatgttgagcttttttttcatgtttgttggccacacctctgtcttcctttgagaaatgtctgctcatgtcctttgtccactttttaatgtggttatttttttcgtgtaaacttgtttaagttccttacagatactggatattagagctttgttagatagatagattgtaaaatttttctcctattctgtaggttgtctgtttactctgttgatagtttcttatatcccatatgtcaatttttgcatttgttgcaattacttttggtgtcttcatcataaaatgtttcctcatgcctatgtcttgaatggtattgcctaggttgtctttgagggcttttatagttttgggttttacatttaagtcctgaatccatcttgagttgatttttgtatatggtataaggaaggggtccagtttcaattttctgcctatggctagccagttctcccagcatcatttattaaataagaaataatttccccattgcttgtttttgtcaggtttgttgatgatcagatggttgtaggtgcatggtcttatttctgggttctctattttgttccattgttaaccttttctagattgccacatcaccttataagataggtacaattattattcttattttgttgaagaggaaacaaaggacaagagatcaagtaaaacattcccaaggtcatacagcaagaatctagtacaaccaagatttacatagaatctgagtcaaggttgcagtattaattattatactatgttgcctaaataaacagaatgatgagaataaatacaccatactttgagaacatagaggagagtattccccaatggaagtaactttttctgttgaattctgaaggaagattaggagccaacccagtgtggtattggggagagtactacacagagaacatagcatatgcaaagacttcaaggaaaaaaaaggagagagatagcatggcagtttgaggaaacaagtatgtcagttcagcattgtagagaattattatttcaaactgggaagagcaaagagaacaactagccaatgaattttaaaaaggggtatttttaaaattgtgtaaataagcatagccttttcaaatattactctatttgaataatgcattacataataaagtatagtcttctgcctacaaattcacagatgattataaacaaataaagagaagaataaaaatgtactcatagaggattttgaaaccaatgttatatataaattaaatcagtcacaattggaaaggaattctttattaagcttttaaatgaaaatgcatttatttttccatttttaaattgttattctgagatcaaatatttgaaaaatatctcacaaattatgtatctaatcaaagtgaagtttatatatgtgtgcttgaataaagagagctacaaatttcatgcagatattttaatttcatttatttagctagctcttttggaataatatcaatgaaatagctaccatgacacctgggggcctggtgtttcacacaaaaattacattttcttttagaaagtagctcattatattgtccttttaagtactaagaaaaggatgccatattcactcagtggtctctatcgtcttaaagaagaacattgaaaataaagctcataacaataattacaacacttaaaaagtatttagtacctactatgtgccaggcactgttctaagcactttaactttccatattatctttcagctctttaaaaatgccattcaattggcttctaggctctgttgtttctgatgagaagtcaggaataattcttatctggttctctattttataatgcatttgttttctcttactgcttttattttatcattggttttctgcagtgtctctatatccattgtggtagtagtttgctttatttgtttgtatttatcctgtttgaaacttcttggatctgtatgttaacgtttttgattaaacttgagaaaattttagctaattttttttcttttctttttttctggtcattatctcttccctctcctagtgaggatccagttacagatatattaaactgctaggtattactgtacaggtcactgaagctctgttcacttttccttaatccattttttgttcatttcagttatgtttaaattcattagttcaaaataatacttttaataatagtcataataatacaactaattgtacctttcaagatgacaaggaaacaactcattatcttgagaactgggtaagtagtaaaaaagaatcaatcacttacaatgcctttcttatataagctctacaactataataaatgaggataaatggctctttgcaaaattattccagataataaatagaaacaaaattgatagaaatattatcaccttaagaattgaacattaatggctgctaatgtaaaaaagggtgaaaataatattacttgctttattataaaagggcgtgccatcacctatagtctagcaaagggatcacacatgagtctgataatacctctagatccagctgccatttttttttcttttttgaaagagtagagagagacatattgaactatattatgggtatacattagagatgagtagatttggcaaactatataggtctaatggcctgagttcttcagcagataaactataaggtaaataaaatatagagtggaattcaacaaattaaagaagactgaaaagacaaattaagctaaaaaaaaaatgggcaagactaaaatagtgtatccaggaaaacatataggaatagagcatccagcttaaaacataaaggaatagatgaaaagaacataaaggactacttttaaagtcagattagtggttactttcagaaggagagaaagaactgtgattataataggcatgtagaagtgttctggtagctggcaaagttctatttttgttctaggtggtagttacaggatttttgtctcataataattatataaaataatacattaaacaatatgtattttgtatgcttttctgtatctgtgttttattgaataacaaaatggtaaaaaaaatgcatacacaatatgccgttcagtattctctatgtgtgcatgtatttgtgttttttagtaaagaaaattctatgtatttccaggagtttgagctcttaaccaggatattaaaggaaagggtgattctagaaggcagagttttgtgacctcaaggttataagtccaagtttatattgaaaattttaattctgtcaaaataggccccaagaatgaactagaagggtgaaacaaagaaaggtacatttctctacaaaataacagatcatgaattttgaatgtttccctggtagatacatagcgaaaagacgtaaggaggattttttgagagagggagtgttgtgggtttaatcttgttctcccaaaagatggtgaagttctaatctccagtatctgtgactttatttagaaatagggtgtttgaagatgattatgttaagatgaagttattagagtggtccctaatccaatgaaactgtgtttgttttaataaatggaaaatttggacacagaaacagacatgcatacagggagaatgacacgtgaagaccgaaggagaaagaagagtgattcatccctaagccacggaatgccaaagatttccggcaaactactggaagctgggagagagtcatggaacagattctctctcacagtcttcagaaggaaacaaccttgctaatatctcgatctcagacttgtaccctccagaagtatgagacacaaactttgttgtttaagccacttaatttgtggtactttgttatggcagctgtagcaaactaacacagagagagggcatgccagaggaagaagatggcagattctggactacagggaaaagcacatggagaacttgcctgtgggggatggctaaggaacttcaggactagaggtggccaggagacaactgtgagaaatgctgaggaggcactggaggtttcaagctgggggcttgaactctaaattgggatattaaaggaaaaggggatttgagaaggcagagaattttgtacatcaaggttataaatccaggtatatattgaagttgttaatatttaggtattctttatgcctttgagtaaatacatgaggaagacttgcactgaaacagaaaaggaatatgtgtatgttacgaaatatatatagatatagatgatatgtgtgtatatatattcatatacatgcagtatacattcatgttgtcactacatacttacatacatacatacaaacaggtatataaataaaaatgagtccactgtatgtttaattaatattatacacacacatgtaatatttgaatgtgagaaagagaaaatgtactcttcattcagtggcttgtatccttcgcagctgtaaataaaacaagctgaaaggcagctaaaaagatgaaatcactgtcaaggacagacacacaggaaagcagttttatttttaatgttttgaagtcataagagttatttctgcaagtgtactgcttggttatttttccttttttcattttcagtgtttgtctttcatgccttgtgggcaaggacatttgtattgctatctgcatagccccttcacaataatgtcttccattcagctctctcaggacggcatacaaagcccgtaaattagaacgattgccattaaaagattgtgtgggaagttctttcggttataaaattttcaaagccttaaagtgctagagccaattactggggcaattagagggtgactttttcactatggatactactttaagtggccctaacactaagagagctgggcccacacactttcttcctaaatcagtaggccttgggcagattgatgtcccaaatcagcaaacaatatagaaagggtatagaaagttacagaaacagaaggagggactatagagatgagtatttaactctagaacacatataataagaactgccatttgtggaatatctactgggtgcccagtacctattttctagcccctttatatactattacattacttaaaccagaaagccacactttaacattggtattactgttattctcatcttacagaaaaagtaactgagactcagaatttctatgttaatggacatgtacaaataagaatcatatccagcaactgaacctaatctgacaaccaaacctgtactatttcaacttcaccaagctgagaaagaaaaaaaaaaatgatttacaatctgttataagccctttctccccaaaagttcatgtttcaacctattcttgacgaaagagctgaccctggttgtgctgctgcagtagttctcaagagaaggagctgacaggtcttagaacttcttccagtctggtccttaagcagctgctaataataggatactcctctctgatatgcttgtcagcagcaactgcttaggaagtatgagtccatgacagtacctgtgggtggaattccaggtagagaaagaaatcactgccgtctagatacattggatgatatctggtaacatcaaactggggaaataagttacatattagcgaattttttaaacctgagtatattatttcacttttttctcattgttattgagaaaaacaactacttcttttttttttttgagatggagtttcgctcttgttgcccaggctggagtgcaattggctcacctcaacctccgcctaccgggttcaagcgattctcctgcctcagcctcccaggtagctgggactacaggcatgtgccaccacacctggctaattctgtatttttagtagagacggggtttctccatgttggtcaggctggtcttaaactcccaacctcagatgatctgcccgcctcggcttcccaaagtgctgggattacaggtgtgagtcaccccacctggacaaaacaaccgcttcttactgaacacatcaggaaagaagcaaccttcaatgcaggcaccattacagatgaaaaatactttcaagtgttaccaccattatatccacagatgcccttctgtcagattccaggaatttgtcagaaacagcaggactcacaggaaaagcttgttaaaaacattcggggcatccttttctctgaccccaaaacaccaaaatcaaacaaacaaaaccagaatggccaacacatccactatccagcaacagaattcagtctctgttcataaaaagatttgtagggagaacaacaacatcataaaacacaaccaagctcaacaacacttagtctttttgacatttactcctgcaaaatgtgctgggtgagcagaaacacaggaggaagtgttgcacacaaaagcttttgagaaataacagggctctcttctatagaaacaaaagcctcactgggccagccaaacaaaaggactcagctgctagcaggagaggaaaaacctcttcttcattctcttctccaaagaaaacaaagaaatgttagtgaggcagaaatcattttgcattatctgacttttgagcaaaagcatatcttttaatactgaaagaacggttctttttgagataatattttggaaaatgaaaaagtagaaaaatggaggaagaaacatcagaaactttttttggggggagtagggtggtgggaagtagactgcaaaacatgcttttaaaaaatacatctaggggttaaagtatattaaacaagcaggttttcaaaggtggtagccaaaatgttaatggaattcctcaaggagcaataaatctctcctgttataatccaggattcaaggaggggaaacaatgatgtagtagcaagagctgttatttgaaaaggcagctttttaatcttgtgttgttttgagaattaaagcagataataaatgtaagcagtaggatacaaaaaaaatggtgatttatctttatttttctctttttaaaaatactatcaatccaacctgaagatacccatggtctttggggagtggggataaaaactagaagattcaatgagttatttcactactaaaattataaatagtctgccaaaaattaagtaaactgttttgaaataaaagatcaccaaacaaaaaacagttcttaaatgtagtattcaataagttgattcctgaacattttcctaaatgatattgactggtaatgatttcctagctaccataatcaaaagtcgaagtcatgctatttggtaataacagcaataaagacaaacattgagcaataactgggttaattaatcttcataacaaacctatagataatgttgtttctattatctctattttataaaagcttgataatatttaaagacatcacctgagttcactaaagtagcaagtagaaaagccaggatttgaacctagatttacttggcttcacagccaagtaaatagttttatttctacttctactctatataatagtacagttggccattcaataacatgggttcaaattgtataggcccatttatatgcagatggtttctcaataaatatattggaaaactttttggagatttgtgacaattggaaaaaccccacagatgaactgcatagcctagaaatattgcaaacacttaatataaagttaggtatgtcataaatgcataaaatatagggatatactcttctatttattatttaccagaaaatatctcagacagcaagaccaaatccttctcttcatccttctccttacctactcaatgtgaagatgattaggatgaagacctttacaataatccgcttaatgaacaccaagtacattttctcttctttatgattttcttaatattttcttttatctcacttacttcattataagaatatcgtatataatacatataacatacaaaatatgtgttaattgactatgttactggcaaggcttcctgtcaatgaatactagtaggctgttcatagttaagttttgggggaatcaaaagtgatatgtggattttcaattgtgctggtatctgaaccccaaccctacattgtttaagggtcaacaatacatgctttcctgcaaagagaagtctagggatctgaaggcacgagaaagcactgcattcctaactctctcatatggtaaaaaatgcatcaaactctctgacctatagttaataatctcagaaacacacatctaactaaaggtccttatcatctttagtgcagattgagggtcaacagaagaaatacagccttgcagcctagcagcatcacaggcaaataaataaaactaaaaacagaattatcatatgatccagcagtctcacttctgtttgtttacacaaaatattttgaagttagtcaaagagatatcagccacctcatgttcacggaaacaatgatagccaagttatagaatcaacctaagtgtccattaagagataaactgataaagaaaatgtggtttatataaataatggaatatgattcaccctttaaaaaggagaaattgtgtcattcatgacaacatagatggaattggagaacattatgttaagcaaaataagtccagcaaatataaacactctatattctcatttatatgtagaattgaaaacaactgaactcatcaaagcagagagtagaatggtggttacagagggtggaggtgaggagaatgaggagatgatggttaaagagtacaaaatctcagacagggggaatatattttttctttttttttttttgggttctattgccaaacccggtgaatatagttaataatagactattgtatatttcaaaatctaaatctcaaatgttctcaccacaaggcatgttaagtatttgaggtgacagatatattaactagcttaattgttccacattgtgttaataagttataatatcactttgtatgccataaatttatacaattataagttgtcagttgacaataaaaaataaagttaaacccagttttctctgttgaaagaaaaaaagactattcagtgtatctgtttgtcattcacaggaccttttagttgtaggttggttgatgggtcagttggtggttgcaatttatttttaatttattcaggaaaatggtttaatggactcagtgctacatggctggggaggcctcacaatcatggtggaaggcaaggaggagcaagtcacatcttatgtggatggcagcagtcaaagagagacttgttcagggaaactcccccttgtaaaactactagatctcttgagatttattcactatcacaacaacagcacaggaaagacctgcccccatgtttcaattacctcccactgggtccctcccccaacacttgggaattcaagatgagatctggatggggacacagccaaaccatatcagctcctcataatacaatgggaaattaagaatacttgaatatggttctttgaatatatagaaatactcactaataaatgttttattatggtatcatgatttatttgaattgaaaacttttaaaatctcattgtgaatattcttctagaaacatgaatggaaacctttttctccagtcacacgccagtttacaactctgctggcttgaaacctaaaaataacaaacaccatattttattaaagtatttataactgacttttctgttcaaggtgctacaaagcagttgattttttaccatataccataacgtggaacagatattttgtcttctgtctcctgcttttgccagcatttatgagtcaaacagcatccagacaaagaaagaaaggaccaaagccaaattgtgtaagcattcttatattgacaacatgtttccaagaaaaaagagaagaggagagggttggatcagacaggaaagaaaacaaaataaaacaaagtagttaaaattagtttatttttctacttctgaaacttaaaaaaaattatttccagaagaaattgaaatgagtaggctgatttgagggatgaggtgcatagatgtatgatggtatgctgacatgaagagtcctagcaagagaagttataggacggagggaggaaaatagtagaggcaccaaggcagagttgtaagacataaggaatgaactctactgaggttgaccttgcagcttataatatagtacaaaaagctaacggggagtaaaggcttttacctcccactgaagtgacacaaatactgtgcatttaaaggagtcgtgcctggtttggaaaagacctgtgtgtttagcagaaaccaccctagtcatggaattaggaccatactagactcctttaggggaaaggtagttagtataatacaatactgtggccttataacgattagacttgtaaaatcatagagctgaaagagacttcaggacttgcatagtttattatccaacctttacagagaatggaggatcagagaaataagcaaaatatttaagtctataatttattggtaaagaagatagaattataaataagtactgtaaagacacataatgttctgtttaatcacctttacagttccacacttatagttatatatctatagatatagtgcctaactaaattaatgtttgtttattgactcaatgaataaatgaacacacttaaccttccccactccatattcccagtgggctaatgtggaagaaatttaaccaaaaataatccatctaatggaacataggctttggattctaacaggcttaagttcaaatcccaaaattcactattttttaaatttgtgaacttgggaaaattgttaaatcttttaatttttccatctgtaaattgggcatgaaagagttgtgtacaactttggcattaagaaaaagctcaaaaagcgttttatatctgtagaattattatttctattatattccttattattatattttttaggccctcggtcttcttttatattactcttcaaatcaagtgtcaatgggttttagggtgggtctaaaataaactggggtgctaggaggttccccagctacagggatggccactgtgggtaacaaaggtattggagatggtgggatagaactactactcaaaattaactattgaccccaagggcacagggttgtagctaagtagggcttcaggtctctcacttctgcttcaattaaagtaactttgctttaaatggacataggatttggttaagattttattagaaaaataaaagcagagtttccactcctacagtaaagttttggcaactactaactcatgtttgatttgtgcatatatgctgcttacttaggacatgtatcatacttgtgctcatcattcttttcttaattgatagtgaagacaaaggtaagagcaatcatattttttcataatgaatatacaatgatcaaaacatgaagcctcttgaagaaaatttgagacaaatttaaaaaaaaattctttatagctcttcttgcaaaatagctaccatataataagctctagacaattaaatgaataatggataaatcaactttaaacatgaaagtgttataaacatattacttacaaaaagtaagtaatgaacatgcatcgggagaaacaccttttgggataaatgattgatattaccattcacttattaactctcaccctcatctttatcagttggccaatatttaactttgtatattaattcagcaaaagttggatatcacttagtagactcaagaatgatgtttaaaattttactccttcatggcagttcagagtgatattccttccataacacaaagatttgtaaaataatgtaggtctatttaaaattccagagcatttttcaataaaatgtttgtatatttgattttgtttctaaaaatagaaataagaatgtacagaaggacaattgactgccaataatctaccagtgacaacattctgattctgtaattcattcccaagtggaaaagtataaccaatgtattttcttattagttctgtttacttgtccagattaaaaaaaaaaaaaacaaaacacctatcactgtattctagagagagcaaaccaaaatagaagacctcattgtaaaactatgcttttacaataacagcaacaaaaaatctctcttcatttcaaatattaactatgataataatgtacagagtcaaacaaaactctgatcatgacatagagagtcgaacaaatatagagtcatgatttgtgtgtattgataatatctgtccttcatgtgatctcatattcatgaattaataatcctctcaaagttatgagaactaggttattaatatgaattttgactatttggcttgctcatgattaatcacaggaaagaaaacaacaacaaaacaaaactcaatctagtctctatcacattcatctcaaagtgaaactctgtaacactgatccttgaaccatgaaataattttttttgaacatgagtgagtggtaggcttattttttcacaaccttcagagaactcaacagatgcaaacacacatgataaaaaggtttgctgggttttatcattagaccaattacagatgaattctctcttgaagccatataatttaaatgtgcccattcttactccttaccatggcctcctgcctattaaggtctttgcttcatgaaaattcctttggctggagtgcccttctccaaactacttcttgtccctggaaaatctccacctatctttcaagcctcagttcaaccttccttttctcccaggtagcaataacctctccttcttttatgtctcttctatgacactcttcttgattagtactcaaaatgatctaactatttacatgtctactttcccagtagggtgtgagcctcttgaagaaaatttcagaaaaatttttaaaaattttctttatagctctatcttcttacaaaatatctgttatataataagctctaaatgattaaatgaatgaatgaacaaatcaactttaaacaattactgttataaagtaagtaaatctaaaagtcaggatatggcaccttttctaactctacacaggattactgcagtatattagcaatttatacctatatttcttttcaaattagtattttcttttcaggattaaaaactagaagctcaatcagttactattttcctattggaattgtggagtctgccagaaataaaagaaaatgcttcaaaacactgaccaccaataaaaaagatagtataatctcttctttatactcagattaataccctacttctatccaaatcttaatgtaaataagatcaatgttcaattaccagttgaatgctcaccatacagaagcaaaggacacatcatccacatttccttgtcctaatgaaattcacactctttgcagaaatgagaaaaaaaaatctcaaaagcgagcgaaaatttaaggtcatatgctaaaatgggacatgggtaggaagggagtgcactcctcctccaagagagataaatcatagagtattagttggagtggatgagctttaccgatgaaagggaaacaagtgatatgaataatacagtaaaaatacatattgcatatttgagaagcaataataataataaaagtccacacaactctaagtggcaggtcccaggactctcgcctgtcttctggcccacttatctgtccagctatgcctcttgcaacttctctcacacttcactaggtttaggcctgtgctctgttctgaccatgctcttttctactttggggcttttgcgcctgttggtatttctgcatgaagtgttctcttcctatatttcataaggaaacaacatacttaaggaaatattatacataatgactcagtttaatgatcaccttctgaaaaggccttccttgacctctgttcatttcagttatcattataccctgcttttatccttacagcatttcctaatttacaagtaatatatatacacatacatacacatatatctgtatctatatatctgtatctttatctatttgtctctctcacacatttgtttccttacatattaatttaccttccgtctcccccaaataaatgagtgttttgaggacagagatggtgtatttttcactcaccaatataaattgtatgaccttctagtaacttaacttttctgggaccaattttcctcaattatcaaataaaatcataataatcctacaggtagacactattattacattactgataattgaggaaaatcctcaatccacataggattgtttgaaagaacaaattaacataaaatggcatcttaaatataatgcttcctattggttagagtttttgaataactcccccaattttcccatattcaaaagcatagaactataaatagctatgatatacaagttgaaaagaagatctcaaacttgttttgtcagtcttagctgatcaatgcccttccatggcctccaacacatacctttatggaaggtgaagttgaagaaactaaaaaaagaaaattcctttggaaaacattgaattaacaatatttttatctgtactctcttaaaggggaagagagagggatgcattctcctcaacccaagtttagagaaaggggttcaatgggttgactcagaattcatgatatgtttcccagattgcgaggatcataaatccagatagttgcctcctcctgaaaaaatatgtgatagactaaggttagagttcttctacctgaaaacagaaggaagattgggagctgcattggagaggagctggaattcttctaacaacagggaaaatgtatgtttcccatgaattagatatgagttgagaggagggaaactgacaaggggtgctcattaaagagactctattcaagatgactgcctgaatctcaatagaggggtggaccagtggaagctcagggacaagagatagttaaatgtggtcatccaaaggaagccttgcttccatccagaaaaccatagttttgtcagcaggaggagagctcagttctatccggaaaaccatagtcttgagtttgccagcaggaggaactcagatgaacccagaaaagccccagaaaggataaagacctgcagattatacatctatcaccagaagggtattgaaactaaattacaattataccacccataaaactaagtacttttcccatgattgctctctcatctctcctctattccagaaaggtaaaaaaaaaaaaaaaaatgaatataggaagcaaataggttgaaaaaagaattaaatcttattcccttctctgttgtagattttttggcctgaagcaggataaggttggggaaaaggatacattttaagtcaaataagggttcatagtttttattttgcatttgaccgtgttaaacttatgagactattagacttgagtagattttattataataaatgatctgcctgagattgtatcaaaaggagggatgaattaattcctagaggggtttgtgagaaggcagagagaaaacaatgaagttggtttctgcttttaccttactaagtccagcttattcagtaaactaggtatgaatgtatgtacaaggcttcacacagcattgaaagttaacgaatggcaacgatctaaacatttgttacacaataggtgcttcatatgtatgatttctctgctccctctttccagtgaaatattctttcaaaaacatagtacaggcctatctcattttattgcccttctctttagtatacttcacagataccacattttttacaaattgaaagtttgtgctaaccctgcatcaagcatgtctattggcaccatttttccaacagtgtgtgttcacttcacgtcgtgtgtcacattttttttggtaattctcatagtatttcaaaatttttaatgattattatatctgatatagtaacatgtgatcagtggtcattgatgttactatcacaatagttttggggtgccacagaatatgcccatataagatgatgaacttaactgataaatgtgtgtgttcttactctaccaaaaatatgtccttacctgttctcgctccctcttcttgggcttaccctattccccaagaccccgaggctaaataataacccttaaatggcctccaaatgttcaattgaaaggagtaatcacacacatatcctttaaatcaaaatctagaaatgattatgcttagtgaggaaggcatgttgaaagctgaggtaggtagaaagctaggcctcctatgccaaacagccaagttgtaaatacaaaggaagagttcttgaaggaaattgaaagtgtgactccattgaaagcaaaagagctttatcactgatgtggagaaagttttagtggtcgagataaatatcaaactagccacaccagtctcttaagctaaagcctaacccagagcaaggccctaaatctcttcaagtttgtgaaggctgaaagaggtgaggaaactgcagaagagaagtttgaagctagcagaggttaatttgtgaagtttagggaaataagccatctccttaacatgaaagtgcaaggtgaagcaggaggtgctgaggtagagaagttgcagcaagttatccagaagatctacctaagatcattgatgaaggcaactatattaaacaacagattttcgatgtagacaaaacagccttgtattggaagaagatgacatttaggactttcgtagctagagaggagaagtcaatgcctagctccaagccttcaaagaacacgctgattctcctggtaagggtttatggagctggtgactttaagtggaagccaatgcttatttaccaatccccaaatcctggagcccttaagaattatgctaaatctactctgcctgtactctataaatgaaactgcaaagcctggatgatatcacgtctgtttatagcatggtttactgaatattttaagcctactcttgagatgcactggtcagaaaaaaagatttctttcaaaatattgttgctcattgtcgatgcacctagtcaccaagagctcttatgcagatgtgcaaaaacattaatgttttcatgtccactaacacgatatccattctacagcccatggatcaaggggtaattttaatttttaaaagtcttattatttaagaaatactttcagaaagctatagctgccataaattgtgattcctctgatgcatctgagtaaagtaaattgacaatcttccagatgccattaggaagattcatgattcatgggaggcggtcaaagtctcaacaaaaacaggagtttgaaaaaagttgattccaactcttacagatgactttgaagaattcaagactttggtggagaagtaactgcagatgtagtggaaacagccaaagaactagaattataaatggatcctgaagatatgactgaattgctgcaatctcgtaataaaactaacaaatgaagagttgtttctcaggaaaaagcaaagaaagtggtttcttgagatggaacctactcctctggtgaagatgtgaatattgttgaaatgaaaacaaaggatttagaatattgcctaaatttagttgatgaagcattagcagggtttgagaggactgactccaattttgaaggaagttctaatgtgggtaaaacgctaccaaacggtaccacatgctacaaataaatctttcctgaaaggaagagtcaattactgtggaaaacttcagtgtcttagttttaaaatttgccacagccgggccgggcgcggtggctcatgcctgtaatcccagcactttgcgaggcccagatgggcagatcacctaaggccaggagttcaagaccagcctgaccaacatggagaaactccgtctttactaaaaatacaaaaaacaaaaacaaaaacaaacaaacaaacaaacaaacaaaaacagttagccgggcatgttggcacatgcctgtaatcccagctactcaggaagctgaggcaggagaatcgcttgaacccaggaggcggaggttgcggtgagccaagatcatgccattgcactccagcccgggcaacaagagcgaaactcggtctcaaaataaataaataaataaaaataataaaataaaataaaatttaccatagccaccccatctttcagcaaccaccaccctgatcagtcagcagccaccaccctgatcagtcagcagccatcaacactgaggcaatatcttctgccagaaaaagatgattgactcactgaaggttcagatgatcattagcattttttagttataaagtattttttaattaaggtttttttggatgtaatactgttgcatactcaatagactacagtatagtgtaaacataactgttacatgtactgggaacaaaaataaattatgtgacttgctttattatgatattcactttattgcagtggtctagaatgagactgcaatatctctgaggtatgcatatataaattttttcaaaaattttgaagcttttccttgaatatcccacataatatatcatactataataacctttcagtgaatcctttacagcttaaaaacctaggcagaggtcagtcttgcctcaatatgatttagaatggatgagcaatgtggttctgggaagttctttcatctaaaggctgaaatgcaggaacagagtaaatttgcatccagtggactatatccatcatctgataggagacagcaagtagccagagtgcagcaagagaatcaggggactgctgccctctgtaaatcagaaagcctccttatagatacaataacaagcctgtctggtgtcctggaattgagtgtggatgaagtgagaagccacctggtatctttttctggggaacattttgcagattgaccttaaatgattatatctgtgaataaattacctcatgcctctattatccaatcaatcaatgcaagcttttctttctctgccttttcttctccaacataggtgaacacggcttaagagatgacccaaatggagcttccctgtagaacaagacctttccaacctctgcttgaacccttctggtaacagagaactcactacgttacaaagcctcatcctctagagtcaggtactgttcattttttctcaagcttttctgtccgctaagccaaggtctgctgcccagtaacacctactctccctacctctgccttctggaatgacagaattctttcctattacaactctatttttctcatgtatccaacacttattgagtacttactctgtgtgagagctgctttgattaagttgtaggttcttgggggcatagcagtgaacaaaacaaagttttctaccctcctagagcttatattctagtgtacacaaatacatatatttataatacaatgtttggttgtgatacatactatgaggaaaaataaagcccttaataaagagagaaagccacatgaaaagtgtgttacaggcacaaagaatagccaactacaaaagctgtaggcaggaacatacttagaactttgaaacagttgtaagaaagctagtgttattgaaggtgcatgggcaaggggaaattgatggaagatgaagccaaagaggtagccaggggctggcaaactatggtaaggctgtggagtttgattaagtgggaggggaagctagtagatagtttgcagctggggttgatataccctaatttatgtctttaaaatattactcaagctgttgtgtgaagagactgtagagggtgcaaagtgggaacagggaccagtttgagtactactgcagtagtctgagcaagaaacgatatggtttaggttacagcagcaaagcagagttggtgaggatagactaacaggatttgcaaatgaactggatgtgagtgtgagtcagaaagagaaatccgggatgattcttctgtttttggcctaagcaactggatatcatttgatgagccaaaaccagaaaaagctggttttggaaaataaaattaagagttgtgttttgtatacattaatcttaaaatgtctattagatctttatcacatcaaagatgatattaaatataagcataaagaaaaatgtaagcatagggatggaacttatgaaacctgaagcataggtcctgatgagactacctaggagaagaggttgatagagaaatacggaggtaccaacactgaatcttcgggaactctaggctttagaggttaaagaaaaaaaaaagtttgagaacctctgtaatttccttatctaaacttatctacttgtatatcgtcacagataaatcttgggagcacattattggaaaaccaaactagcttcttcccagaatagctgatatccttcatgaaaatgaaatgttgttgctagggcttgagaaacaaggaaaaacaagtaagccagaagctccaaaatgtttttttttattttcaattgattaatgaatcaaatgtttcactctaacagatgtcccatctcaattccattactaacgtttttaactcaaaggcatcatgaatacaaatggcagcaaaactgaagctttcacaatcaactattacattttccatgataccatttctcacaattatgttttcttactgaggaattgcattgatgaaagcccagataatttttatttttaaggttacttaaattgcaagagttttcttagaaaaaattataagaaaatcttccagctaaaagttttaaaacttgtgaattacaataacaaggaattgtaccaactaagctaataggagaagtaactagctatgattcctcactgagtgggtcacagcaccttctgtgaatgaatacagactaatttcaaagtgctgaagtaaatatttagaagagagcaatccaatttcatcagctaggtcggtgtgttgccaaacattcaactttcatatttagcttccaaggactcatgcaaagtacaatgcttctgaagtctgatctaatggagccatcaggaaaaagatcattatcaatcttgctggggccatctgaaatgcttattatcagtaacaatttagggtagaaatacatatgacagataagcaagtgaatacactgctttgctatttgaagcagcgaggagatccatgtaacaggtaatatacctaaaagattatcttttattagtgaatgcaaatgtggagtctgaaatggttagcttcctattaaacaaatgaaaatatcaattctagtctgaatttaagcatggagaaagatacttctgaaaattatgcaccttttgttctaatgtctctctttttaaaaaatcttctccacacactgcttcaattcatcagaaaatcaaagcatgaacacctgggaaagaatagagtatcaaagaagacagctagttgaaatttctaaagacaagactcataaaataaagtcagtttcttttagttagagaataggtttgatatacaggaaaaacaatagctttgattcactttggttaatgtgaatctgttcagactgtttatataacatattgacttaaatgtaaaaaactgtatttcaagacagttctgattaaaggatattctttaaaggctctaataatatatcatggacaatgaaggagagagaaaagtcttcatcatttatgtactccctgtctttagcacatttcctggcttatggtggtagatactaaattaaatgtttgttgaattatttgaaatgaatccacttattcttcctcttctgagccaaatgtctttcaaaatgtatattaaatggtagtttttcccatttctccatgcatttttaacattttcagtttcatacatgttgatgttaatatttctattaactggttataatttcatggtacatagtatttttatttgtatgggcaaaaagtaatcacttttttcttgctgagactacttctctttgcatatctttgctcacctttccatttttaaactttgtgttttctttttttccttttaacttttattttaagttcaggagtacaagtgcaggtttgttatctatgtaaatttgtgtcatggcggtttgtggtagattatttcatcacccaggtattaagcatagtgcccattagttatttttcctgatcctctccctccttcccggctccaccttccactaggccccagtgtggttgttcccctctatggcttctccacaacaaaataaactatcaactgagcaaacagacaatctacagaatgagagaaaattctctcaaaatatgcatctaacaaaggtctaatatccaacatttataaggaagttaaacaaatttacaagaaaaaaaaacaaccccataaaaaagtgggcaaaggacatgaacagacgcttctcaaaattagacatacatgcagccaacaatcacatgaaaaaaagctcaacatcactgatcattagagaaatgtaaatcaaaaccacaattagataccatctaacaccagtcggaatggctattataaaaactttgtgtttttttaaaaaagtatttgcttattaaaaataatgtaatatatgtacatggtagaaaaatctaaaaggtataaagaacaaacagaaaaactaaattttcttcccacatagcttccctctctggggcaactactgttgtcagttacttttcaagatattccagatattatccatattctatgtatatataagtctgttagtctgttctcacactaccaataaagatatacccaagacttggcaatttataaaggagaaaagtttaattgactctcagttcagcatggcttggaaggcctcaggaaacttacaatcatggcagaagaggaagcaaacacatccttcttcacatgatgttaggaatgagaagtgatgagccaaaggggaaaaaccccttataaaaccattagatcttgtaagaactcactcaatatcactggaacagcatggaggtaacttccctcatgattcaattacctcccaccaggcccctcccatgacacgtgggcattatgggaactacaagatgagatttgttttaaagttttatttgttttttaagacaaatcatataacattacgcataccgcccacaatgtttaggtaatttaacaatatacacaggattttgttccatttcagtacattcattttattcattcagtactttaagtgcattcattcatttaatatatttatttcagctcctcatttttttttctagttaattttttttttattattatactttaagatttagggtacatgtgcacattgtgcaggttagttacatatgtatacatgtgccatgttggtgcgctgcacccactaactcgtcatctaccattaggtgtatctcctaatgctatccctccccccgccccccaccccacaacagtccccagagtgtgatattccccttcctgtgtccatgtgatctcattgttcaattcccacctatgagtgagaatatgtggtgtttggttttttgttcttgcgatagtttactgagaatgatgatttccaatttcatccatgtccctacaaaggacaagaactcatcatttttcatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcctttgggtatatacccagtaatgggatggctgggtcaaatggtatttctagttctagatccctgaggaatcgccacactgacttccacagtggttgaactagtttacagtcccaccaacagtgtataagtgttcctatctctccacatcctctccagcacctgttgtttcctgactttttaatgattgccattctaactggtgtgagatggtatctcattgtggttttgatttgcatttctctgatggccagtgatgatgagcattttttcatgtgttctttggctgcataaatgtcttcttttgagaagtgtctgttcatgtccttcgcccactttttgatagggttgtttgtttttttcttgtaaatttgtttgagttcattgtagattctggatattagccctttgtcagatgagtaggttgtgaaaattttctcccattttgtaggttgcctgttcactctgatggtagtttcttttgctgtgcagaagctctttagtttaattagattccatttgtcaattttggcttttgttgccattgcttttggtgttttggacatgaagtccttgcccatgcctatgtcctgaatggtaatgcctaggttttcttctaggatttttatggttttaggtctaacgtttaagtctttaatccatcttgaattgatttttgtataatgtgtaaggaagggatccagtttcagctttctacatatggctagccagttttcccggcaccatttattaaatagggaatcctttccccattgcctgtttttctcaggtttgtcaaagatcagatagttgtagatatgcggcattatttctgagggctctgttctgttccattgatccatatctctgttttggtaccagtaccatgctgttttggttactgtagccttgtagtatagtttgaagtcaggtagtgtgatgcctccagctttgttcttttggcttaggattgccttggtgatgcgggctcttttttggttccatatgaactttaaagtagttttttccaattctgtgaagaaagtcattggtagcttgatggggatggcattgaatctgtaaattaccttgggcagtatggccattttcatgatattgattcttcctacgcatgagcatggaatgttcttccatttgtttgtatcctcttttatttccttgagcagtggtttgtagttctccttgaagaggtccttcatatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgtcagctcctcatttttaaaaagctgaatggcattacagtatactatatggatgcaatacaattattgtagctattcttttgtcatttagatttttttggttcgatttttgccactggaaacactgttgcaattaatattgccatttcactcataggcaggtacatatataggataaattcctagaagtagaatcactatgccaaagggtttaagcagttataaagttaaagatattttggtattgctctccaagaatatggaacaatttatactccaccagcctccttcagctctcagaaagagcctcttttaccacacctcctaacacagtgcatcgtcacaatttttgaatgtgggcaatttgatagttaaaaaaatggcatcttgtacttttaacttgcaattattttattatgaataaggctgaacattatataaatgtatgataaatttactgggaatattttctccactctatgtcttcctgttttactctgtcagtgacatcatttaatgaatagaatttcctaattttaatataggtcaatttacccaatttcctttatagttgtacgctttcatttttaaaataaacatttatatttaaatatagaaatgttttttgtatgttgatatggtttggctatgtccccacccaaattccatcttgaaatgtaattcccacaattcccatgtgttatgggaggaaactggtgggcggtgattgaattatggggatgggtctttcctgtgatgttcttgtgatagtgaatgagtctcatgagatctgatggttttaaaactgggagtttccctgtacaagctctcttctcttgtgtgccaccatgtgagatgtgcctttcaccttccaccatgattgtgaggcctccccagccacgtgaaactgtaagttcaataaacaatttcttttgtaaaatgcccagtctcaggtatctctttatcagcagcatgaaaacagacttgtacagatgtaggttgtgaaaaagggacacaactgttttttaaagatagatgtccagttttcccaatataacttattgaacaatccattttttcccacttaatcaaattgccaactatattataaactaaattcctttatgtgtcttgtctattttcagaatctatagtctttaactttgatatatcttaatttttattttagttattaaaattttgtatgatgtcttaataaatggtaagcctggatctctctcattattgttctttttataaattttccttgctattattgctcattaatttttcatttaaatttaaaaatcagattttcttgcataaaatttttgttatttttatttaaaatttttagtataaaagtaaaaattgaaattttttgatgttgctcttcttttccaatggcacattatggtattcctttattatatgtctcttggtagcatttgaaagttacctttatatagatcccaaatgtttatcaagtttattctcttctttttaagttccagggtacatgtgcagggtgtgcaggtttgttacataggtaaatgtgtgccatggaatactatgcaaccataaaaaggaatgagatcatgtcctttagaggggcatggatggaattggagccattatcctcagcaaactaaagcaggatcagaaaaccaaacaccacatgttctcacttataagtgggagctgaacaatgagaacacatggacacatggggaaaaacaacacatactggggcctgtagggggtgaggtgcagggagggagagcaacaggaaaaagagctaatgcattctgggcttttaaaagtgtattcttaagatattttggggtattgtaaatgatatactttctgtcattatattttttagttgactactgcttatatatggacatatatgtatatgctattgatttctatattctgattttaaacttggccatcttatttattgcctaaataaattaattaaaaatttattgcttaaatttatttaagcaatttattaattaattataaattgagcaatttattaattaaatttattgcttaaataaattaaataaataaatttaaaaaatttattgcttaaaataatttttaaattatttcctttggtttatcatcataaatatattttttcttcttttcaattcatcatcagatttacatctaaaatgatacaaataacagttttgatgaagggcatattttaggaaagagtgatatgttttttggatttttaatttaatattttattttaggttctgaggtacgtgtgcaggtttgttatatacgtaaactcgggtcacaagggtttgttgtacagattatttcttcacccaggtgctaagcctggtactcaacagttatcttttctcactctcttcctccccaaaccctccactctcaagtaggccccagtgtatgttgtttctctgaaaaagtgatatattttttgaatgcttgactaaatcaatactccttgggccactagctcattttcttgaagctctatagctcctgtttggtatagctttaaagtttttctctcttctttttttaatttttgtgaagtctgtgctcatcataattatctcaagctttgctctttgtcgctattttcagtgacatctattttttcttcctatttgtaacatattcataagttctgtaatggtattatttaggccctttattgggttccctgggcttcaatctttcttttcaccccattttctacctttattttttgtatttcagcactttttaattgaatttattttaagttttcctacagcataaatcatgagcaattaattcccttctgccccttgaactataggttaaactctttgtctccttcctttgctccctccctctcttccttattttcttcttcttttttttagaggttatgaagaccaagatcacacagggttaatagcatgagctctggagccagacaccagtgatttgtgtcctggctctgtcatcatttgtatgattttaggcaagttattaaacctccaaactgtacataaaataacaatacctatagggtttcttaaaaggactaaaatatgtatgcataaaacattagaacaccacctaatacataccaggtgcttaatagattagattacaataatacgcttctttctggttttgattgcggcattcttacagagttactaaattctttcatcctgctcatgattgggcagctcaattggacattctatttgctctgatataacgcatgtgactggtttacctttgtcctttgtgcctagaattattttgttttcccacgccaagttacagtgggagtggaggtctggctattttgtgttctcatcacattttgtgcctgagcaatagctggcaagggtgttggaagagatctcggtagaggctacaggcaagtgtgtcatttttcttgtaagaccccaattctgttagcttttgagattttgttaaatgtcctacaccaagttgcatctaattggagaaatttctctaatttggagtgtggctagagaacatttatttccaccagagaatatcagcatagctactcactttaccccctttagactttctcaatcacaagtttcaactactctttgaaaaagataagcctactagctcagtgtgctcttctctggatttaatggtatcagtgagaagtcttaggattttgtcaatcacccgtacaatctcaggagggaaatgggagtcaggtagcatctgagcctctctaagcctttctgctacaatttccttcttttagtcacaggtttttaagtgtattgcattaagttgtgctccactgcttcttttgtcactgtaggcaaaattttctaatggttttggttgctaattgtccctaagttttactcattttgtgagttactgaaggagaaaataacctgttctcataatctggaaaacagttctttagtagtatgcacattgtgtttcataaaaaactttccctaaggacattatttttatgtttatctttccattatttttataaccagcccttccttatacctgtggtattcacttttatatctatatgtgctgggtaacatatgcacttgccaaattccatcttatttctgataatccaatttgtttaccttcaggttacctataattgatagatgaggaaagggtggtgaatataaggaattgctgagtcactactgagattgatatcaataggtccagatgctaggtgcagtccaacaatattacattcaatagagataaaacaagtgtataagtctacaaatacaaaattattctaaaataaaatgtaatagatctgatagccaaaacttcatatgaaataatattcaattgtcttattcttgacatgaaccaacaaaaagattcttaaaaacaaagctaacacaattttatactacaataacagaagtagagtatggagctcacgtgcacaaaattcactcactatggtctgtgcttacaagcacacaaagggatctgtatatccaattctgtgtattgttacttaggtgggatactgccaaaatttatagaaatttgtagagaaaatttatagaaatttgtagagaaaatttctctacagcaaaataaagggattaaaaatgatgatgaatcaagaatggttaatgaactgggggtcttaatctaaaggaaagagtcctgaaaggagacttgacagtggcctacaaatgtctgaagggctctcttgtgaagagttgtccgctgtagccgtagaaagcaaaaacaagattaatggaaaattttagaggaattctactttcagctcaattatagaaaaaaaaatccagtgatgggcacagtctcccaagtgaacagctaccattagtatgggaaaactttctctccagagtattaaagcataaattgaagacttggtcacggtttcctagaaaaagcctgggcatatatttatagtactgtcacattttacacactatactgtgaccactatttcctttgagggcacaccatgtttctatacccaatttttagtcttgtcttcagagcatgttcaattaatgctttgttaaatattagtttggtgcaaaagtaattgtgtgctttttgctattaaacgtaatgagtgaaaatatatgagtgaatctgtgtattgagagagatcagaatatttgacatcttagaattcttgaacatcaaaattattataattaaaaaaactgctaccacattcagttgattcaaataaatggaactatgaagaataaaattttcattttgactctactactactaaaaactcaatgactatttttaggtccctgggaagtaactattgaactgttgcttcatgtgactaatggcttatactgaacaaatcatatgtatataccttcattcaccacgataaggcactgactcttccagaaatgtacctagtttgtttcctgtgtcatttttactcttcttttttcttaactactctttcttcagccttgactaataattctcaatcttgcctaatatcaacctttattttgcaatttttcaattttcagtgaactcagtgggatctcataactagataacccatagaattttccatgtttaaaaatgcataagctggtgttctttacagatattaaaatagatttcattttatctttcctagtaagttttctatatgcgataaagtacccaaagtatctatctacaattgagttatgttcagagacaaagtctatgtagtacaggcttttgactgacagcttagtggcattaggagtcatggtccatgaatagaaagtactgcaagttttaatgtattggatctcagtgttccatagaaggcgaaaaatttaacggacattggtccatgagttgaggaaccaaaatggatttagtcagggatcatgaagaatttagcatgaagtcagtatcagtcagcagaggaggactgcattatttcagtttaggtaaatgccagtcttctaagaagatacttgggaaaaaagccaaaactactttatttattctcattcctttaatttagcattacaacttccagacctaatatgtttttgaaataaaatatttattgagtgaatagatgattgttttctgtgcatatttccttttaaaaaagtaaacaaaaagaagaacacttaaaatttaattagatgccgatacatacccaatatctctaatgcttatttaagttaagcaaggatttcaacttaggtcctagctccaaatcccagtcttttcatcaaattgctttgctgctggccataaatttaaaaaatttatagttgtatttaccacagcagcattttttttaaagcttacaaacaattccatgtaggtaaatatttaccttgagtaactattcacagcttttcacagggcttgttgtgtgaatgataaaactttaaatgttgaaaaaccaaaagtacatttagtacagtgcaattatttaaatctgaaattttcattgtaaaaataattttgacttcaaaaatttgttcaaggagccattgatcatatattctgttaaaaaattatagatcagctttaaacagcaaataagaaaactgtgaaaagaaacagtggtcatgttatccccaaagggcacatgacaggagtggcatcattcattaatttccaaaaagatttagcaaacataatcatgtgattaattctctcataatgttgtattatacagaacagtgggaattacagtggcaatatttgtagtttgttctttcatgataaatgatttgctacacaatcttaggagagagcttgtttacagacatcattatgaatattgaccaaatattagcttagagaaagagcctcccaattcacaagcatatgtcttatatccagaaataatcagaaattaacaacgtgcatgcacaagaaattctacaggaaaagtacctgggaacaaggtgaatttatcaaatatggtgtccttcatttaataataataataataataataaaagatttgctctctggtagacaggagagcggtaatttagctacaatttatttctaagaagactgtttccctggtttaagacaaatagttcaccactttctttcttattccatatattttattccaatagaaggttgcactatatatatactcaagtaaatttccttgtgtaccccagggaaccattgtggtaattcaaaaggatttaaaaaattagcactaaaaggaaaatgtagtgttttgagaactcatgccaaatagttaaatttgctattcgtgcttattgaacaaatcattgttccagcatggcctttcacctaaaacaggtccacctaccactaggaacttgatcccaggacatgagcctgaataaaaagtaaactgtttcctgtattcagagacatttttgcacatgcattagaaaatgaataaacatagtaatttactccatggcaagaaataagaaaatgcatgaggtcccctgatacagtaaacggttgggtgccagtaatcaaaccagttgtacaaactttgtttttagtttctaccagtggtctggtaaaatgcttggtcatgaactgctgaatttcagataactaatacctttgctaacctaaacatctccaagttattatggttacaagatagaaaatccaacttgttaaagaaaaaaaaacacacacacacactattgacaaagctatccatggacagatcagggaaaaaagaagaattttggtgcagacagtctcggtactaagtgttaagaacagtgcatttaattttcaattaaaattttaattcattcagtgttcattctcaataagacagctctaggcctatcaattagccaaatgactaatgtcaggaaattttcagatgacttcctcacatcaagactggatagttcactttggccatatgggcatcagaaaaaaaaacaaaaaccaggagcagatggaggagtaagaacagatctgataaaggaaatgagtatgataaatagaaaagctggtaaaatttatttaagttagatatttaataaattctcatctataatatcagatgcaagtcaagttgatatttagataagctggacatgaaatttgtcacatcagttatacaataaagtaaaaatcaaatatctagaaattgttttttgattaagtggactggtaagcaatgtgccagatgcctccaatttcttgtacatacaatttctgtaaggagtgaaaaaaggtaaggtgccaaaacatgggcttcactcatacggactcttcgcagttgaaaaactgtcagcttccatctgagccattccttttccccttgccacattgctttgatggttatgatctaccttgcactccccactcatctctgccccaattcttcccatttactacccagaactgggtcacagactggagcttgtactttccttttaagtatcacttaatgcttcaaatttagcattggccaggatagacatcattacattaatgacttagggttagaattagcggtttctttatctccttaatctgggttgttgatattcatccttttcatgccctatgggttacttggcctgataataaaagaatgaacagaaaaggaagaaataaagcacatcagaagttgttagaaatgaaagattgcttctgattgcgtcaattagtgatagctttatggagaagttaacactgaactggctcttgggggatggatatgatgtcagcagatagtggtcacaatagtaagagaagacattcaaagttgggaatgaaatgaacaaaggcttagaggaaggaaaatatggcatatgtttaagaaatggtacacagggcagctcacctgcatcaggagagatgtgaatgggacaatgaagaagagaagactgaaaccaagttttgtggctggaggagaaagagatcacagagtgcctaaaatgctacttactggcaatgaaaaactactggagacttttttttttttttttttaccaggggagaatcatgaacagttttgaatttttggaagattggtatagaagatatgtgttggtatggaagggagggaccagcaatgaagcctattatagtacgccagataagatatcaagaatgtcgacaggctgcataaatgtcttcttttgagaagtgtctgttcatatccatcgcccacttgttgatggggttgtttttttcttgtaaatttgttggagttcattgtagattctggatattagccttttgtcagatgagtagattgcaaaatttttctcccattctgtaggttgcctgttcactctgatggtagtttctttcgctgtgcagaagctctttagtttaatgagatcccatttgtcaattttgacttttgttgccattgcttttggtggtttagacatgaagtccttgcccatgcctatgtcctgaatggtattgcctaggttttcttctaggtttgtatggttttaggtctaacatttaagtctttaatccatcttgaattaatttttgtgtaaggtgtaaggaagggatccagtttcagctttctacatatggctagccagttttcccagcaccatttattaaatagggaatagtttccccatttcttgtttttgtcaggtttgtcaaagatcagatggttgtagatatgtggcattatttctgagggctctgttctgttgcattggtctacatctctgttttggtaccagtaccatgctgttttggttactgtagccttgtaatatagtttgaagccaggtagcaagatgcctccagctttgttcttttggcttaggattgagaagacatttatgcagccaaaagacacatgaaaaaatgctcatcatcgctggccatcagagaaatgcaaatcaaaatcacagtgagataccatctcacaccacttagaatggcgatcattaaaaagacaggaaataacgggtgctggagaggatgtggagaaataggaacacttttacactgttggtgggagtgtaaactagttcaaccattgtggaagtcagtgtggtgattcctcagggatctagaactagaaataccatttgacccagaaatcccattactgggtatatacccaaaggattataaatcgtgttgctagaaagacacatgcacacgtatgtttattgtggcactattcacaatagcaaagacttggaaccaacccaaatgtccaacaatgatagactggattaagaaaatatggcacacatacaccatggaatactatgcagccatcaaaaatgatgagttcatgtcctttgtagggacatggatgaagctggaaaccatcattctcagcaaactatcgcaaggacaaaataccaaacactgcatgttctcactcataggtgggaactgaacaatgagaacacatggatacaggaaggggaacatcatacaccggggcctgttgtggggtgggggaggggggagggatagcattaggagatatacctaatgttaaatgacgagttactgggtgcagcacaccaacatggcacatgtatacatatgtaactaacctgcacgttgtgcacatgtaccctaaaacttaaagtataatataaaaaaaaagaaaaaaaaagaagacaggaacaccataataatggcagtagagattttaaagagaggattaatattttgtaagtggcttccaaaaggtatatgcctgatttattaaagcagcaaagaagagagaaccaaaaggaaaaaaaggacgtccaaggccttttactgtgggtgactaagacaatcgtttgaataaatggagaggtcaaaagcaggagtaggtcatatgggtgaggggcgagtgatggaacctggtgctaaggagatatcataaggctaagttttaatatacttggagctatttctgcacatggcataccctgacacagatgcccaaactgggaaaaccaaagaaaaatcccaaacatatatgtgcattttcataaagcatagagttatatgacacatcataactcaaacctgttagaaacaaatttatatagagctaaagaaaaaatacagctgtacataacatatatgtgcatatacacataacataaatatatttacatattatatatatgcatacatgcatgcataagccaaatatatattggttctatctggaatcgctaaatattaaaagcttttaataaatagtcaattcattaattcaacaaatattctagtgcttttaaaggacctcccccaaatttttttaatctgtccatctgacaaaggtctaacatccagaatctacaaagaacttaaacaaatttacaagaaaaaaaacaaccccattaaaaagtgggcaaaggacatgaacagaaccttctcaaaagaagacagacatgcagccaacaaacatatgaaaaaaagctcaacgtcactgatcatcagagaaatgcaaattaaaaccacaatgagataccatctcacaccagctagaatggctattattaaaaagtcaaaaaaaaaaaaaaaaaaacagatgcaggcaaggttgtggagaaaatggaatgcttttacactgttggtgggagtgtaaatgagtttaaccattgtggaagacagtgtggaaatggaatgcttttacattgttggtaggaacataaattagtttagccactgtggaagatagtcctcaaagacctaaaggcagatgtaccatttgactcagcaatcccaccacagggtatatacccaaagaaatataaatcattctattataaagatacatgcaggtgtctgttcattgcagcactattcacaatagcaaagacatggaatgaacctaaatgcccatcaatgacagactggataaataaatgtggtatatatacaccatggaatactatgcagccataaaaaaggaaggagatcatgtcctttgcagagacatagatggaattggaagccattatcatcagcaaactaatgcaggaacagaaagccagatacagcatgttctcacttacaagtggcagctgagcaatgagaatacacggacacatggaaggaaacaacacacactggggcctgttggaggggaagcaggaggaagggagagcatcaggtactaggaagaatagctgttggatgctgggcttaatacctaggtgatgggatgatctgtgtagccaaccaccatggcacacgtttacctatgtaacaaacctgcacatcctgcacatatacctctgaacttaaattaaaagttgaaggaaaaaaaagaacctctcatagtattttatattaaatattatattaaatacaatctaatcctttagtcccttagtattaatgagttctttgctacttttctttatttccccttctgccaaatatggtaataagagtaaaaagattataagaatttattaagaatttacaattcttatcctgaaaataactctatgaattacatatttagatatagccattttgcagatgcggaaagtgagtcataaagtggttcatatctttgttctaggctcatggctgcttgaagatatccaggaacttcttcattacatatgtgtcttctttaatggctgaattatgaacattataagtgttcattggtatagtaacttctacagtttgtgcatttcatagttaccatttttcctgtacaaaacataaactcacaatctttactacattctcagtttacactgatacagagctctgtaatggcaaaaagtatgtatctatagagatatgagaatttaaaaacattttaaaaaataatggaggagaattgctaaaaattgtcactacctagatttaatcactctttcagtttttattaatgagtaaggtggctaaaataaagctacaagcaagaccacctttggatatcaattaataaaactgtagctttcacatttttggttttagaacttagccttaaaccacttatatgattcctaagcaacaacagcatcttaaaagaagtcatctaatttctcctgtagctttaggcttctttggcccaggccatagaaacaaacagttctgtacttgtttaattatatattaatagctccttggaagttatgatttaatgtgttcttgcgaaagtcactaggaagccttttacagtaaatctatttcctggaaacccacatacacacttcagatttccttcctttgcttgatttttggttgcttggcaagcctaaatggatttgcctaatactttcttcctacatataattacctattttcttctcaattgattgcccacatgcagacaccccaggtgcttacaatgaccaaatctataactgtgatgttagcaaggtttctacctattttgagaaaagacattctaagtcagaatgagtattacccaaatatccattactgaaatatatggctataaatcaccaatgagatgattgattctatctgagtgttgggaagattagctctgctataaagacaaaatcacatacatcaaaggttatctcaaattagtaatttttgcaatagaccaaatcaatacagagtacgaaattgaaaaactgtaaatttaatttgccacaaatcactgtttcacagaatctcttaatgttttacctacagcatacaaagggataaatctgtttatcctctattctgtgcaaaaacaaacacaatccccaaactgaaaacattcttggcattaataatctataaaatctataaaatagatttattaaatgcattaactctttaaaatagctgaagtagccatattcatattttttatattaagattaataaaaaggaaaaaagtcaatttaaaaatattttcccaaacccagatatttcacaaaatatagtgaaaaatcaatatgttaatttggcagggtttttagacagaccttctccagttctgcttccttgagatttccttttcagacacatcagaggttccctctgtcctcagagattccttcataatcttccctacctcacaaatggcaccccaactaaaaaactgaacctcatccttgaaacaccaccatatattttaccaataaatggcatcaagatagctcaaatccatttacttttttctccttcctccaagtaacccctaactgatctctgctctcacttctgccctcttcaattcattcgcttcatagcagccagaatgaccttctaaaaattacatattttatcatgtgtcactcatgcttaaaatatcacaataatttcccattgcatttcaatataaacacaaatcttcaaatatggtgaacaaagctaagcatgatctggcccttgctcatctcagccatatcatttcatgtaattaattttcatattattagactcctagaagttatcaagatcttttcctacactatagccatcacactcacatgcctctacttctatctgggatgctctcgagaccccattctttacctggctaaatgtctgttttaatttatatttcaaagcttagcttaagtgacacttgcttacagaagtctcctttgacccactatttaattggcacccccttaacaatctgttacatttattcctagtacttttcccaatttatattataggtgttttccccaccaggctatcatctccttgagagcaagaactatctgaattttctttgtgaatctctattgtctggatctgtgccaggtacatactaaacaatacgtatttgttgaatcattgaaggactacattaatgtatatctagataactctgtattatatatacataattcaatccagttagctcagttggctacatttttgatgcttactatattgtacccatgtgctcaaggaaggtcagataaactatgcacatgttaagttttttttttcttttaaagttctggaatacatgtacagaatgtgcaggtttgttacatagatatacatgtaccatggtggtttgctgcacctatcaacccatcatctaggttttaagccccgtgtgcattagttatttgtcctaatgctatccctccccttccccacaaccccggaacaggccctggtgtgtaaagttcccctccctgtgtccatgtgttctcattgttcaactcccacgactgagaccatgtggtgtttggttttctgttactgcattagtttgctgaaaattttaaatcctctggaccattttgtctctcctagttatgacgaatcacatcttccactttgttccagtgaaatcatggctcaggctccattatagagctgagttcattttctgttgcattaaaggtagttgacttcaagtgcatctctcccatttaaactttctgaggacagagacgacatctcatttatcttcactccagggtgcataagagtttccactgtatgagttaaacattggtaggaattccctttacacatattgtaattcaaaaatgaagaattataaggtgccaagtgaagttaagaccacgaggtatcatcagagttagtgtaaaatccagtttaagtattcaacttactctgattcagcactagctgtgtttatggtactaggagagggatgaggaatttaaacaatgactaaaatagtttttctgtaaatcagtaagctttatatagagaaacaaatctccatcagtgacctctggacagcgacagtagaaagaagtatgactgactcagcataaccgcaacaggcccaatagtctcacctctctctacaggaatttcgcaagagcctgctttttagggatgcgaagttatttccaacagttatctggttctcctcatctcagtagaccaagctcacttgtaaccccatctcccatacactgtatactttaactgggttattgcctaggtataccaagttgattaatactcacttctccccatttccccattccaggtcccacagcaattactgccccactccgggctcaaggaagaaagcagttcagcatgaagtaaaccagctggagccccagtgtcaaaaataaagatctaaaatatgtgttcttggtaaaattaagttttagtcatctatagcctttaagtgctctggatgacctccagctgctcagctagaagaaggtctataaatgcatgatgttactttctttactgagtggttaaaattagtatttgtcttagggctatgctgaataattacagttaattgaattacagaaatagctacatataatatatatttttaatagaaataatgggtatggccattttgtttggctttaaagctccttgcaatatgattttagtaaatgtgagggttgaaagtctttcataccactagagactgtggcatgaaaatgcttcacttttttttctttttacccagatttagttctatgattttaacacatttgaatttgacccatgaggaatctctgaatattttcattacattaccaaacaattgttacaaagtttaaaaccatatgtagtaaataatagtacagataacatgcatatgtagctaattttgttggtcggtcagtttgtgccaggccttattctaaatactttttgtgaatcaactcatctaatcctcacaacatctctaggagcaagtactattcttatttgcactttgtagatgagaaaatatggcccagagaggttaagcaatttgctcaaggccaaacagctagtgagctgcagagccaaggtactaatctagaaactctgggctgtagagtctgcatcttaaccaccaggctctattgcttaccatgtgccagctattggctaaatgcttaatcctcataaaccctatggattgatgctaccattatgatccccatttaataatgagggagcaggcccaactaagatgactctgctagcaagtggttgaaccaggcttttaaactcagtcctgagatcttaaataccacccactactgcctcctagaagagatggtaggcttattttttcaatctcatatagcattagagattaaatagattttaaagaaatgagaaatgatttactcaaagagtacagtgattatttggtcaaaatcatctaaaatatttaaataatgttaagctaattattagattttttccaaaacattaaatactattaagttactacttaatgtcatcattctgaagaacagagttcaaagcattattcttaaaaattagtatgggccaggtacagtggctctcacctgtaatcccaacactttgggaggccaaagcaggaggattacttatgaccaggagttcaagaccagcctgggcaacaaagcaagggtctgtctctaccaaaaaacaaatacaataataataataataataataataataataataaccacatgcactagtgcatgcctgtagtcccagctatttgagaggctgagatgggaggatcacttgagcccaggagcttgaggcttcaatgagtcatgatcctgccactgcactctagcctgggcaacagagtgagaccctgccttaaaacaaaacaaaacaaaacaaaaaacaaacaaacaaaaattagggtggtaattcatctgtttctgcaactcctcagagtaactataataatctcaagagatacgagaacatttcaagaacataaattttaacttattttggctactgcaagcataaaatgtcatgtaatattgggtacaacacataagaatataaccaaactttaaacatatcacaacattataaaaatataattgttatattagtacagattattttaattattatttatattactattttgccaaatgagaggatttaccatttgtatctgaaaaattagtattaatatgctagctaagttatcatgacccagtaagattaaaaatttatagaaaaacatagatgactgttaatatttttgtttttaaggatgtttctacataaatctactctttccttcttatctgagttcatatttagagtactggtttcctttaccctttgtaaccactactgtaggattttaaatctcttggtaagcactgaatgtcagaggttaaagagttcatcatacgactatcgtggcataaacttcagtcagatggtttgtcactagtgtctgtgagtcatttatattttgattacctttagggcctttgaacagtttgatttccacaacggtctccaaaataggtcgtcttctacgcacatacagccgaacgatagaccctgcttccttcagggcttccaccgctttactgtgggaaacctctgacacatcaacctcattcacccgcaagatacaatcattgaccctgcaaggaaggaaaagagtcaagattcagaagtggctagcaggatttcttaaagaatattattatgtttatctgaccttaagaagtgggaaagtaaagaatctaaaaaattttaaaatatttaaatttggaaggatgcttcaaatgaaggaaatctaaaaaatgtcaaactactcaagcctcttagccttcttcctaaccacttttgaccatactactggtcagttcccatcctaaactccagtccactttgactgggactgcttacacatacggcatagttagaagggcatgtattttaaggcctctgtaagttacatcattattttaattggtttgactgaaagttacaatttgagtggttctcagaacttactaccatgaactatatagacataacaaatacaattatttacagactaattttctcaaatttttaatttactagttataaaagtaataagtaatcattttcaaatatctgaaaaatataaaaaggtagaagaaaaaatatacttgactcaatcatctaaaataaacctattaggttgggcgcagtggctcatgcctgtaatcccagcactttgggaggccaaggtggcaggatcacctgaggtcaggggttcgagaccagcctgaccaatatggtgaaaccccgtctctaccaaaaatacaaaaattagctgggcatggtggtgtgtgcctgtagttcagctacttgggaggctgagaaaagagaattgcttgaatcccgagggtggaggttgcagtgagccgagatcacgccactatactccagcctgggagacagagcgagactccatctcaaaaaaagaaaataataataataataaattaaataagtctgtcagctttctggcaaattatcttccagtgtttccccaccctcctctccacctcgattcatcttacaatattataaatactgaagttcagatttacaaagttcaaggagaacctcagataatcctgttcctaggtgcttactttgaaaactaagaaccacaacaaattctacatcaaactttcctctttttttttttttttcattttcacatggaaaggaataatttgacatttccataaacctttccaggtagtttaaagttatgtggccatcgactccaaatatattttattttcatgataataattagtgataacattaataatggttaagagcacggggcttgagattacaaaaatttctttccctcactctgtatatccattctagtgtccccaatctcagatcaccatgttgctcagagtcaaaaatgaggggcctcctttgcttgatgcttcttttcccccaccaccacgcagtcagttctacctgcaagtatagcctcagtccatctaggtttcttcatcttcattgctaccaccctggttgaaatcaacatcatctctcaggtgaaccacctccacaaacgccgacctagccttcttggattctctcttgttacctttcaatccattcactacacagtggccagcgtacagtgaacatggttggtttgcttactcaacttgcattccccacttcctccttccaaacagtgtcccgttttgttcaggggatctttccttagcaaatatttgttgaatgtgtgaaagaataagactaagttcaatgattgggccctccatttcctaagtttgtaaccatagttaatttccttagcctctctaagccttattatattctcatctgtaaattggatataatagtaatatctatcaggaagccttttggggaagattaaatgagataaagcacatataagcacttagtacatactctcttatgtaatgaacacctaataaatgtttgttattgataacagtgcaatatttgttgatttataatattctcaactattggatactccctataactttgtggaataaaacttattatctacattatagaaatgagaagacttccaagtgattaagtcctctgcttaaagctgtcagcaatttgagcagagattggatttgatttcaggtcttcctatttcaaaatttgagcttttctctcttaggaccacatacatctaatgtgatgaatagtttcatgtatgttgtgtatatcaattcaaaatgatgactacaatgataatattatatgaaaagtatgggaagaattttgtatctgtttttgtgcataacttttctatacctgtttagttataggaactcttgcctcagtaagaacacagagcagtctcaaaatcttgagatggaatatttcacttcctaagattcggcaatgtcatttcatcataacagatgctatggctttaatagacttacacatacatttcctctctgattgacaaaaaaaaaaaaaaaaaagggaaactaccaattaaaatagttttgagaatgtaggcatcatgggtgccagctgccctgcagcagctggtcctttgagagtgggtaattttgccatctcatgataatacaaaacataatgtttaccatcactctatgctcagaatactaattatatcttaaaacactgcttttcatagaagggagtggctgacatttaaaaaaaattctggaggctatatatatctattcaaactctatttttttccttttgtatacagtgggatccttaattgtcaattgctggtgtgagaaaatcatagcctaaatcagatgttcattcctgaatatgtggatcaagtaggcagctttaggactagcagtcaggaggcctggatttgagtctcagttcttcatcatctgtgggaccacggtgaggccactttatctttttgaacttcagtatcccataaaaggagagagactatgtccagagtcagtgagagcagtaactgtactgtatagtactgtgcaggagagtacccatagctgatgtgtggagatgtgtacattgtaacctaccatagatctgaaagttcttgctattgagtggatcaaagatgtgctcaagtatttgttcaaatgtgaacagaatggaaatttaaacttttaaaggacatactatgtgcaatatcagccagtcatttcacttatttgttcttacttaaacaatttataaagtatggatcccattttaaagacagtggaattttactgacaaggtcaaagtgttggtgaaaacagggacataatttcaacctgtttttactttttctagagcttctactgatacaaagatactcagacactcagagttgattgttttaatttttttttttaatggtggtgtttgtaggggaggtggggtagtttacattcaaattctcaaaatagagaggaaagtatgtcaggccaaactagggcagtcaacttcccttcctcccagaaacttgaaatagattttggctagagggtcatagctatttaaaattaatttgctctctttaccagtagataaactttgtgagtaaagccaccaactgtattcattttgaagcatgtaagtatataattagcttcaaagtcaaggaatactttgtcacagtaacaaatgcaggctttatcatatttctgagggacattgttttatgaagccgtgagttcaagaccagcctgggcatcaaaagcgatactccatctctaaaaaacaaaatgttgtttacatatacagacttactctccaatctcactctaccaatctaattaagttgacagtttcactcttagtacttgatgttatacacgtaagtctacagtattcatctgcagcaatttcaccttgtaaaccagaattgtctgtaatatccgcagattaattttaatattctttctagaatttcctttagaaattttggtgcattccttgccaaaaatattttagaaacaaaaaggatagtctatcggtagcccgtattcaaagagtcacatctaaattttgcactaaatcaagtattttctaaaatggtatagcatcactgaaaagtaaaacaatatttagtgagttatttgttctactttgacaatataatttaaagtaacaggtaatatctactctctcaaggtactaaatattttctgcagtgtggctattcctcagggatctagaactagaaataccatttgacccagccatcccattactgggtatatacccaaaggattataaatcatgctgctataaagacacatgcacacgtatgtttattgcggcactattcacaatagcaaagacttggaaccaacccaaatgtccatcaatgatagactggattaagaaaatatggcacatatacaccatggaatactgtgcagccataaaaaatgatgagctcatgtcctttgtagggacatggatgaagctggaaaccatcaatctcagcaaactatcacaaggaccaaaaaccaaacactgcatgatctcactcataggtgggaattgaacaatgagaacacatggacacaggaaggggaacatcatacaccggggcctgttgtggggtggggggctgggggagggatagcattaggagatatacctaatgtaaatgatgagttaatgcatacagcacaccaacatagcacatgaatacatgtgtaacaaacctgcatgttgtgcacatgtaccctagaacttaaagtataataagaatatatatatataacaaaaaaatttttccgccattgaagtaagatttgtgattttacgcatttttaagtatgttaactcatttaaaatgatcatcaagtcatagtaagtgttaaaaatttaaaaattcccatgcattatgcataaaacacactgaagagaaagatagcgaagttttaatttgggtcctttgtgggtatggagattatgagcgctttaaaaagcacatttctacttttatgtttctttcaaatgttttatactggacatatatcacagcacagaacctaagaacatggcttgggaggcttggtcacagccagatagatctgggatctcaccacagctctaaaacttgggagctctgtgactacagacaagtcacttgacatctcaaagcctcagtttcttcatctgaaaatagggataatgagattgttattgactgattgttactgttattgagagaatgcatgtgaaatacatagcgtagtccctgaaaaacagtaagcatcaaaaatgttagctatcattacgaaaaagagacaagaagcatttgcataagagaatatataaagagactatagtgagggaaaaatactaaagggagaaaaagaaagagctacagtcaagatgctgaaagtgtttttaaaattttgtataagaaagggaggaagagaagaaaagaatgggattttcaggaagaaaaatataaaaatagagcttttacagcaaggtactggtacaaaaacagacacacagaccactggaacagaatagggaatctagaaataatgctgcacacctacagccatctgattttcaacaacattgacaaaaacaagcaatggggaaaggactccctattcaataaatggtgctgagataactggacagtcatatgcagaagattgcaattcgaccccttccttaaacaatctgtaaaaataatctcgagatgaattaaagacttaaatataaaacctaaacatataaaaaccctggaagataacctaggaaatattattttggacataggacctggcaaagatttcatgataaagatgccaaaagcaattacaacaaaaccaaaaattgacaaatgggacctaatcaaactaaagagcttctgcacagcaaaagaaactaccaacagagtaaacagacaacctacagaatggaagaaaatatttgcaagctactcattcaacaaaggtctaatatctagaatctataaggaacttaaatttacaaggaaaaaccaaataacaccattaaaaagtgcataaaggacatgaacagacacttttcaaaagaagacatagacatggccagcaagcatatgaaaaaatgctcaacattactaatcattagagaaatgcaaatcaaaaccacaatggggtaacatctcacaccaatctgaatgactattattaaaaaggcaaaaaataacagatgctggcaaggttgtgaagaaaagggaatgcttataattgttggtgggagtgtaaattagttcagccattgtgggaaggagtttggggatttctcaagaacttaaaacaaaattaccattcaacctagaaatccccttattgggtattatatccaaagcaatataaattattctaccattaagatatatgcacacatatgttcaacacagcaccattcacaatagcaaagatatagactcaatctaaatgcccatcaacagcagactggatttttaaaaatgtggtacatatatacaatggaatactatgcagccataaaagtaatgagatcatgtcctttacagcaacacagatggagctgcaggccattatcctaagcaatctaacacaggaacagaaaaccaaatactccatgatctcatttatgtaagtgggagctaaacttggagtacgtatggacacaaagaggggaacaacatttactgggtcctacttgagagtggaagttgggatgagggtgagcactgaaaaactagctatcaggtattatgcttattaccaggtttcagaataagctatacaccaaacccctacgacatgcaattcacctatataacaaacatgcacatgtacccccgaaactaaaggtttaaaaaaagaaaaaaataataaatgcatattcacctaaatattagagcttaaataagtcttgtttgatgaagtacaatgtaatttccttttcatatttcccttcccttgcccacagtaaaacttatagttgttttgatatacaaactttaccttttatggaagccttggttaaagattctgaccagcacacttaactcaaccacacctaactgcactcagacctcctcaagtttttattcaaaagtaggtgtttggggccgggagcgatggcttatgcctataatcccagcacttcgggaggctgagacgggtggatcacctgaggtcaggagttcgagaccagcctggccaacatgatgaaatcctgtctgtgctaaaaatacaaaaaattagccacgcatggtggcaggcgcctgtaatcccagctactaaggaggctgaggcaggagaatcgcttgaacctgggaggcagaggttgcagtgagccgagatcgtgccactgcactccagcctgggcaacaagggcaaaactccatctaaaaaaagaaaaaaagtaaaaaaaggtagatgttaggtcacagggtctgaaacaactttgcagcagctgttggttattgaagaatgtcccctaattaccttgcgctttactgtttctatcagtagtattctctttcttcaaataaatgaattaattacagaccaaagggccacatcatgaagaaagctgatcaatgtttaatgtgctgtatgaagtgtaaaaatgcatgatgaaattttaaaaaaccactagctaaggaattagactgcatgcacttaaagataacaatcaatcacttaaaaaactttcagtccctgtaatcccggtgctttgggaggccgaggtgggagtatcatgaggtcaggagttcgagaccagccagaccaacatggtgaaaccccatctctaccaaaaatacaaaaaattagccaggcatggtggcgggcctctgtaatcccagctacttgggaggctgaggcaggagaatcgcttgaacactggaggcgggggttgctgtgagccaagaccgcgccactgcactccatcctgggtaacagagcgagacaccatctccaaacaaaacaaaacaaaacaaaaatctcagaatctgttcaaaaggaataattccacacattttatgtcaattataatgaaaacagaagttatgaaaagggtcttgtttttcttctattcctgaagtcattaaaggtaggttatgaacaaataatagaagccaaaaccttattaagacaagtagtttatgctcacagagaggagaaaataatacaccccccaccacacacacacacacacacacacacacaaacacaggctgactcaaatgacttcaaatcataatggcctgccataatacatatacttaattatgtctgcctgttatctcactcttccttttatgaagtacatggaagtgttactggggatctttaaagtccatcaccagttaaggttctcccttgttgaaacttctcaccctaatgatctgtatatttcactgacctcattaggcattattagtttattaaaaataaaaaataaaagaataaaaatcagcataatttagcatttttccaagaaaggaagaggaatgttttagaggcatctgatatgggccaatgtagtaatatctatgaggcttttttttccagcaaacatccacatggttgtaggaggagtgacaagcttatatggcttaacctggttcacttgtcaagtctggccagtcctgcttttgggaatgtggaattgaaaccatgagactcagaggttctatgtgaccagaagaaatagaaacttgagagcttaatattagaggccattttcttccatgttgactataaaatttcaaaagactatctccaaaaagatggggaataaagtagatctataggaagaagtatgggcttcggacagaaggaggaattcctctaacacctgacagtgtctcagtccatggctattcttcccagcgcttaattgtccagtttgagaagatacttcaaatgtccttctaattaattctcccttttgagtaagtaagctggtgggtcttttacttgccaacaaatatttctgattaatacaggcagactttgtgaccaatactttacatgtgttatctcccttagctcattcctttttcccttttaaaacttaattcaagcttatctcatcttctaggatgccatctttggcccagttatttgctccagtgttcctccattaggtacttagtgaaaaatattaatggagttcccagacttagcaaataaaaatacaggacaatcagttgaatttcaatttcagataaacattagtaattattatttagataaacacatacattttagtataagtatgttccattgaaattaaaatttaactaggaattcaaatttataaaaatacagtatttataaaagcactcattatactgagtttatttgttttattcgaatagcattaatgcctggcacctagtgggaaaagtttgtattatatactatgttatatagtctttaatgtaaatagaaacactgaaaagtagatattgtcgccttcattccacagtagaaactaaagttgaaataggtttgtaatgacaggtaaatgatgtctaggaaatctcaaagttcatgccctataccatctacacttctctggtttgttaaaaatgattttgcgacttacttaaggacccactgtcagtcgggtccaggaccatactgtaaaccagtagagccaagccaagtaacaaaatctagatcaatctttctcacactttggggagggcttgttaaactatacattaccactgagcttccccctccagaggtgctgattcagtaggtctagagcaggagagaagagtcacatttctaacacgttcctaggtgatcctggtaatgctggactgagaccatactccaaaaaccactgctctaggttttgaagggtcattctacttggctcatgtatgattcattccaaaataaacagaaatactcaatcttatgtagacccaactgagtatgtgataaaagtcctgagctctgactccaaacccaacccctctatttgcagcttttcattatttggaacaaagcctctaagggaacctggaccaggagaccacagctgccataatgtgtaaggctgtggacatgcaaaccattttccagcactcattttctacctgaaactcttttactgactcccttccttcagctaagaccaactgatagcctcttcattccacatttaaaaaatagggcttctgctctcgtctctaactctgaatgagagtaactcgggtttatgatccatagaagccatctcctacagtgaatgtactgtttttcccctctatttgccacttcatttcccttctataaaatgcttgcaggactctctgcagctgtcatctgggaagcatcacagctttccacaatggggacagaaattgctatttcagcatcagtgattggtcttttggcactttcctggaaaagcagaggccagtaacaaatttcaagctaggctacttaatgggtacaacatggaaaagagacattgaatagaaattccaaagtgagagggtcatgggactggagattacttagcccgctcagttcaatactgtgtccactgacaggactgcttgtcaactttcaagagatgaggtgctggtacctaccacctggattactacagtagcttcctagctagttttcctgatgccaggctaattagcccctctccatttcattcaaacacacaaaaccaggttcaacttcctaaggcaacccttttatcatttcatttcccctctaaattcaagagatttgtaacatatataaaattaaaactgtggttaatctttgtattaccagtgtcaggtacacagttgtcacataagaaaaaattagcatcattgtatgacttctaaaccaaccccctttttatacctcttactgcctgctccagccaggacactatattttgtttcatgttgctttctgtctctcaaacgttcaaccaaagctagcatcattcaaaggcaagttcacactccatagcccatgaaatgtttccaaatcactcaaggctttattgtccataatgtcccaattgcaaatacatggcagattctcatcaagaagctatagatttatttgttacctgcatagaacctaaaatagtgagtactacacattaagaaatacatttaacaatgctggatttgatttcctattttcctctactcaaatctactccaatcccagaaatagatgtagatcaacatatatggaattcataattgtacattttctcagtcaagttcaatttggcattaaattgatgaacatttcagtgaaaagttgagaacaacaaggagcatggcatggtgggaagaacactgggttataagctagatatgaattctaatcctgggtttctgccactttccagttcaagtcaattttttttctctgtgtgtttgagtacagtgatcttaaaattctcttctagctctggtgttctataaacctaaattcaaggtcaacccagcctggcacctatctttacttggaagttgacagtacatctcaaatggagcagagtctgaaattaatcttatctcttccccatagacaaccctttacttcacttttaattctccatcaagacaaataatttcatcaccagaaagggaggagtgttccttcttttttagccacacatccaatctatcacattttaacatatttttattttaaaatttttcatttttagttaattaattactttgtatttatttattgtttttgagaagggtctcattctgttgccccagctgtagtgcagtggcacaatcacgacgcactgaaacctctgccttccaggctcaagctgcctcctacctcagcctcccatgtggttggaactacgagtgcacaccatcacactggctttttttttatttttattttttgtatttcttgtagagatggggttttgccatgttgcccaggctggtcacaaactcctgagctcaagtgatccacccacctcagcctcccaaagtgctgggattacaggcgcgagctaccatgcctggcctgaacctttttatttttaaagatgggggtcttgctctgtggcccaggttgaagttcagtggcaggatcatagctcagcgcagccttgaactcctgggctcaattatcctcctgcctcagcctcctgagtatatccttttcttttactctcatttattctacctaattctagcccttattgtcaatcacctagattctggggaaaaaagttgtaactagtcttcttgcctccagctttttcccctctattccatcttccaacttattgccagaatggtgttattgaaatataagcctgaatgttttatcccatatttaatggtcctcaattgctctccattgtctacatttaaaaaatccaagcaaagaagccctttattaaaatgaaatcttacttagaagtcacacaatggatatttataattatttatatataacaaatagagggagaatttctgtgatttctgcagcatagaggaaaagagaatcagagccgagcctgctgcctcattcgtgacccttcagagggctctgaggaatccagtcagggtgctatatatgactgagcagaagctagtgagtgcagaaagaaatccaggcaaaaccctttctctaagccaagtgccttggcactgagctgtctctgctgaagggagtgtctaatgcacataaaggcttcttatgagttttctaattcacataaaaacttcttatgagctactggtagcactgatcacagggttctgtggaacataaattgaatccacctgcctttttggataaagccaaagtaccttcacataacacccaagtctttccacaatctgattgctattcacttccccagccctgtctcttgctatataagtagtttcttcaaacattatgcaagttcattggtcaggcctcttcctctgcctgaattagccacctccagacccgggttgtctgttaagtacctttaaagacaaatgcatatcctgaagtagcttcacagtttagcaagagagataggaaaaatgctattaaaattcaatataagtgctatggcaagagaaatacagggtaatgcaggagtacataacaggagaaccttatttggtttttgggggccaaggaaaacttggagcaactgaggcagctgagacctgaaggccaaatagaagttagccaagtgaataaagataggaagaagtgtttcaggcacagtttagtggctgatgaggtaaggagcacagatcaagtcttgaaggtcttggtacgacatgttaaataatttggacttgaacttaaaggcactggaaagccattgtactgcttatagctagaataatgttttagaataattctccaggtacaatgtggagatgtggacttgattagatttggtaggtggagttaaggtagaagaaagcaagaattgttgttagaggctgctatataaccctgataaaagatataatagcctgcactaagccagtggcagtcaggataaagagaaggggacagacatggagggctgattagaatctaatagatgtgctgatggattgtatgtgggtagtgaggaaaggaagaaaatgttttgtttaaatgtctgtcttcacttataaatcataagttttgatttgtggtttatgacttgagggataaaatcatttgtcattcatttttgtatttttagtgcctcacagggtagaacagagttggcacagaatatatatttggcaaatagagtgaatgaattttataagtggggaagttagtcaatgacatctttgctgccagtatccacaccttttcctcatcctttccagtgactttgtcccataagaatgctgtcttctcatctcatctctttcctcctggtataaaaagaatgaattcaaatttaatcaccctaacaaacaagctatcattcataggcatattagcattaagaaaaaaaaaaagaactccagtgatagggcaaggcctaaacaaacacaattgatcaccaataataagacctcaaatataagttgagagatatatgtaatccgcacatacatacattcaaccaacatatattgaagacctgccacagagtaccaggtattgtataggcactgaggacacagttgccaacgagaaagatactggcccttgacctaggggatgaagaggtggggatttacaaattcacatcacagggtcagaagcttatgtcacttacatacaaagctagttctacttaagcacatcttttaaactttagcggttaggctttaaattaaagttcttgtttattattctcatgattattttaattctcagagcttaatttccatagaaacaggaaaattaaaccgtaagtctgaactcaagtataccatgtggcaaactgtaatgttgcttcttattttgaactgttcttcatttaccatgactataacaggtgtgtcataagccccccacccaacctccaggaagtgtggagcatcttaaaagccaaccaacatatacgtacgcagggaaaatacatataatttcattgtatgtaattgcagcagtttatgagatgtataaaatatttaagagaaaacatttggcatcttttaaaattcttgtaaatatcaaatctcatgttgttatagagaatatcaaatctcattacctgttacagggaagtaattttcagcatttgtatagttcaacaacaaatgagatacttgtattacttaaatttatttgttttcttatttattatatttccctgcactagaatataagccctatgacagaagaaatcttgcctctaattttccatcaccagtggccagctcaactcctcacaaaagacaccatcatacattcagtttttttgttatcttttatttccttcaccctctacatccaatccattaacaagatttttaatttccttcaccctctacatccaatccattaacaagatcagtagcttctagctacaatatctatcccagtccatcaacttttctccatctctacgactatcacccttgcccaagccactaccaaccacttctacccaaacatgttggctcacgggttccactcctgttttctttaatatattctctagacggaaaccagagtttctaatttttttttttttttttgaggtggagtcttgctctgtcgcccaggctggagtgcagtggcgtgatctcggctcactgcaacctccgcctcccgggttcacgccattctcctgcctcagcctcccaagtagctgggactataggcgccggccaccacgcccggctaattttttgtatttttagtacagacggggtttcaccatgttagccaggatggtctcgatctcctgacctcgtgatctgcccacctcggcctcccaaagtgttgggattacaggcttgagccaccgcgcccggcccacagtttctaatttttaaatttaaatcagataatatcaatcatcccttacttaagacctacgagctcttcctatgtaatttaaattaaaacccaaagcccttacctgccttacaaagtttgagctcctatttattcttgtgctctcatcttctaccactgtcccctagctctgtctcctagcatcgtctaccattgtgccctacatacctagctcactcctgccttagggtacttgtacttattgtttccccagctttgaaagtcttttccctcatgtttttggctagctcctatttgtcattaagatcttaccttaaatatcacctcctcagaaaggcctaacttgattatttaatctaaagttgccaccaggcattcatcactatatcactctgcttcattttctgcatagcatttattaccatatgatattttgtgtagttgtttattttctgtccaacagacagaaaatatatttgtatatttgtttatcttctgcccacctttcttagagtaggagccttgtctgtctggttgaccattttatcattaatgcctaggacagtgctgagctcctaacaggcactaagcaaagagttgaataaaaaatgaattattcaatgaaggaatgagtgaatgaataatagttcttcctagttaagattgggttggtcagtaataaaatatatgcaattttgctgcccaaatttgaattctgatagctctagcttgaagaacttcttaaatttatacctataattattggaattatttagtactgccaaaggttgtgagcaattctctatgcaacagataatgctagattgcctggaggtgctaattttctagggtagatgattagtgatgctgttttctgacctttcctgagctacaataatcagctattactgtttatgtaatttcacagtacttatactcctcatctcttcctagggtaaatcatatttcatgaaataaattcaaattaatttgtgatgaaaaactcatgacacattttgagattattggtgacattttatgatttcataaaaccagagccggaactccctgacttaatggttgaactggtatttgcaaatggtatgcttaatctattacacttgttctcatttgtggaggcaaaactcagagcctgaggatggtggcataaaggattaagggcaacaagaagggcccctttgctcacaaatatattcttgctttccagaaacctggtttcatttgaattcatcaatttttccttttgaaacacaaagaaacccactggtgtcagtcattcatatttgatttataactttatgtagactgtatgacttcagtttgaagcatggtagactaggtgagtctatgagggacacttacatgaaggaacatattaaaggaggccataggcatgagggaagcagaagagagaagcttctccagaagagaaaggagatcagacagaaagccaaacatgaaatcacacatcttcctaggacacctgtgacaacagctgcaggaggctctggtaataacttctgtctatctagcgctcactatttacaaaacacttcaacaatatcttctgtttcattgttaaaatcaagacctacgccacgcgattattgctacattttcaagtgaaaaaaacctgaggatttgataagttaagcaacttactcaaattcacacagcagataacagaaacaaaaattagtctaatggcttctggtcttgttcacttcccacttataactcctatctatgctattgtcactagtccttctgttgcagttgtctggcaaaaccccaaccctgactgaacccaaccctccaccttcttcactgccccttccagaagttagtggagaaaatcctcaaatgatggaagtcactatgatctccaaatgtaacaccacacttcgccctgctcagcttgctgtccctctttctaaaaagataaactccaatgttctcctttcctgcatcacttccagaaaatatgtttgctaataattccaagagaaaaacaaagccatgtgatgtgaagtctctcaaattattatgccagatttctatactttactgcatgcaaacccaccgtctcctttctattcctattacagtggagcaagtgttccctctgataccaaaagtccatcaattcatgtctttttaaagatctcaccagatcatttaatctctctatattctgcatcttcaaacccagcctctacttaagtcatctctgaatattcaaacatgttctagtatctcttagtttttaaaatgttgtcttgacctggcatctccccttggctactgtcctatctccttcctctttaccagtcaagcttatcagaagatctgtttatacacactctctctattttctacttcttccttcccaaactctctttatctcattctagtctgagtttcctcacaaagcccctaccaagaaaaagagaaatggtcctactaaattcaccagtaatcttgattttgccaaatctaatgagatctcgttagttctcattttggtccatctcacaacagtgggaagcccagtggctcattccttccttgaaacactcttctgcattctgtgcctctcctgcttttcttctgaccatgctggccattccttttgtacatctctattttaattcttcctcaacctattaatcttcatacttaaaaaacaaaaacaaggaaaacaaaaacaactatgtgctatttttgcatgttttaggctgacaattgttataaatttaaatagtagcaaaggatatcatttctgacctactgtgaattgtaaaattttatttttttcacaattacatcactatttcaaatgtatcccatgggatataagtacatactgatttgaagtccacgctcacaatttaaaatattaataaacaatatcttcttgagcagttaaaaaatcacacttttctttctccttgaacttatgtttccattctacttttaccatgggaagttttacttcaatatatcactatgttagaacattttctattgatcaccctagcatacttatataaaacaaaaacacatgtacaaatataaatctgatgatttttccctcaaattttctgtgaccataagattccaaacaataaaaataattttctagactgggttttatgattattagtgttatgcaatttatcaaaatcactaaaatatattatgaaattcaacatataaacctaaaacaataaagatgaaattgtattggggattcttttcttagtagattgagtagtgtttttcaaaatcagtccatgtttccatagattaatatgaattaaagttaagagtaagacaagattcagaattccttttttcatttctgtatatgtaagtgatcagaaatcttgttcatataaacaggtagatgggaatgggaagaaaactgaattccttccaagttatatgctctgaatcctgtgacctataattaaaattactttaataatctatcagttgactgttgcttttcaattttattaaaagcaaagaattggaaaccacatgatttaacaaaatgattagttacctaatcattagagtcaccgactttctcatgccaggcaacagtatttcagattgtttctttatatctaggacaatgaatcatagcagaatttaggacggttaagacatatactttatttttttaaatgtgaaaataccaattaaatggaaaagtgaaaaagaagaaccatcataaagctgcaggcttcttcttgggcaggtcaattgaagatctggatattaagtgacataaatccacctatgtactcctagaggtacaccttactcaatttagaaagctctgctctaacctacattaaaagtctgaaatatctcaggactaagtcctagcttctcttttctttttattccatactttttcaaggcaatctcttaattcacttggttttaaaggttcccaatgacattcccagtcagatctctcagagttccatatccacgttcaactgcctatttgatatctccatttgcttttgttgtaggcatcttaaattaacattgtccaaaatggaactattcaacatattttccaactttacctctccaccattcctttccaattgtcatcctcaaagtcattctttaataattctattagatggtgaactctttgaaaacaagggtattatatactcagcacctgatatggggcccaggacaaagaggacacagatgatttatttgaaggaataccacttccctttgcatcccattccaattaatcattaagatttataaagtttatccccagtatatttcaaaatatgtctatttctctcaatctttttgccaacaccttagttcaagttacaatctttcattagctgaattactataatagcttctatttttggtttgtttttttttttgtttttctttttgagatggagtcttgctctgtcacccaggctggagtgcagtggcacaatcttggctcactgcaacctctgcctcctgggttccagcaattctcatgcttcagcctcccaagtagctgggattataggcacctgctgccatgcccagctaatttttgtatttttagtagatgggggtttctccattttggctaggctggtcttgaacttctgacctcaggtgatccacccacctcagcctcccaaagtgttgggattacaggcatgagccaccgtgtccagccctacaacagcttcttagactgctataactgcaggcactcttatcagctaagccagacttccatggcagagtgatttttatagataacaatttagttttgtcatttcccacattgaaacattccaggtctcatgttctttcaaaaggataaagaataaattacttactatagcacccaaggctctctctccctgatttctcatggccacctctccaccttcaccttgtgccagtctgcactctcccaccacctccagtcaccttccctattcctcctcaggcctttgggcatgcattctctgcctgaagactcctccagctccattcacttgggtaacagttaccctttatgtctcagcttaaatattaactctctacaaggcttcccctgagtatcttaggctagattaggtcatgccattacagcctttcacagcactacgtcctttacattcatagaactccttttaactctcaacttaggttgattaccgtgttgggttgagaggtccatggtggcaaagatcctgattttcttgttcccttctctattcccagctccagatgtctgaagcacaacagaatactcaagaaatatttatagggccaataaataacaacagtttgggagtaaaataaaatattctgtgtcagtttaataaacacttgttttatcccttatgcttattatatcacttaatttcccaatgacagtgaatcagcttactcaagatctatctcaccacaatgaaaaccctgaaactaccttccctcactccccacatacaaaacagtgacatagctcatattcttttctaagtcaggtttgcaagtttgatgctgcactctgaatgctagagaagtgagaatgcagaggtgatgagtttatggcacataaagcatactctcacataaggcacaatcaatcattatgggatgcttttgaacaaaggtctaaaatacatgttacattattattatgatgatgtatattattatgtatacctggactaatgactatcaaatagattgtgttttaataattttattcaacatgcagataaacaggggaaacagctaataattcatttttcaattcattgttttctgaaagaaagcattgctttgggctgggcacagtggcttacacataaaatcccagacctttgggaagctgaggtgggtggatcacctgaggtctggagttccagaccagcctggccaacaaggtgaaaccccatctctactaaaaacacaaaaattagctgggcgtggtggcggacacctgtaatcccagcttctcaggaggctgaggcaggagactcacttgaacccacgaggcagaggttgcagtgagccgagatcgcaccattgcactccaacctgcacgacaagagcaaaactctgtctcaaaaaaaaaaaaaaaggcatttttgcttcttttttttcaaatggtctacattcctctgttaatttacaactaaatcagactataatatttaaaggagttaacaaacgataggagaagacagaaaattataccaacactttaattattagcagtatattgtggattatatcttgtggctctgatgtctgtgttgtaaataacaggcacatttgcataatcaaaaatgatttgggccaaattcaggtaacatgagtcttcacaggccaattctaggtcactgtgcgaaggatgatttatacattgtcttagctcaaaatgttagaataatactgatattgagtgttacaacctctccagaagctggttttaattaataaacactattattattaattcaatcagacaaatgttaaaaaatacttcaggtctataatttacaaagaaaaaagaaaaaaaaaagtaacaaggaatactggagccagttaatttcaaacccagaaatatgtaagtaacaacaaatccccacactgtgtccaagtgttctcattgttaaattccctcctatgagtgagaacatatggtgtttggttttgtgtccttgtgatagtttgctcagaaagatggtttcatccatgtccctacaaaggacatgaactcatccttttatgtagctgcatagtattccatggtgtgtatttgccacattttcttaatccagtctatcactgatggacatttgggttgcttccaagtctttgctattgtgaatagtgccgcaataaacatacgtgtgcatgtgtctttatagtagcatgatttataatcctttgggtatatacccagtaatgggatcgctgggtcaaatggtatttctagttctagttccctgaggaatcaccacattgtcttccacaatggttgaactagtttacactgccaccaacagtgtatgtaaaagctttcctatttctccatatgctctccagcacctgttgtttcctgactttttaatgatctcctttctaactggtgtgagatggtatctcactgtggttttgatttgcatttctctgatgaccagtgatgatgagcattttttcatgtgtctgttggctgcataaatgtcttgaactttcatcctgcctttttcatttaataccataacacagtcattttattttaaaatactttgtaaattctggcagaaactctacaagccaaaatttacaaaatatttttaaagtacaatgcctgtgttatggtattaaatgaaaaaggcaggataaaagttcaactgtttgaaaatatgcactgaatatgaaggagtataataaatagaggcttttagtgataaggttgtgaatgattctaatttactttgaaatgtccgtatttttcaaattttctatgaggtacatccattactttataatcagagaaatacattatcttcaaaaacaagattacttaatctttttcactatctttttagatgggtttgtgaagtgactaaaacaccaatccacactgatcagtcatttcctgaagagctaaaagaatatgggtgtcactttgatgtatttgtgcttttaatttttaatactatgacatgagatgttggcagggctttgtgttcatagattcttaaatatatgttcagttatttatctgcagataattgcaattgcagccatgtgctgtagtgagaagaatatggattttggagtcaaacagactgagtatgaattttgtctcagacacctgtaaataactgaacctctttacacctccataggcttctggaaaaaaatttaatgaatggtagctatcattagttctaagtgtctgctgtgggtgagagacatgctagatgttatagaaaatagaatagtaaatgaataacatgggatagaagacatatagaatggtggtatattaaggagacttagagattgccatgtttcttctcttcagatttagctatcaagaaaataactaagtcagttgctgggtatggtggctcacacctgtaatcccagcacttttggaggccaaggcgggtagatcacctgaggtcaggagttcaagaccagcctggctaacatggtaaaaccccatctctattgaaaatacaaaaattagctgggcatggtggcaggcacctgtaatcccagctactcgggaggctgaggcaggagaatcgcttgaacccaggaggtggagattccagtgagctgagatcatgccactgcactccagcctgggcaacagagcaagactccatcttggaaaataaaaaagaaagaaaataacagtcatctaatgtaaataaatgtggtatcattaagacaaaggaaagattgctctattaatctgggatgaaagccacaactaccaccacaaaacctaatatgagaaactaaaagccaagaactctaccagtcacagtcttattgtttgaatgtgtcccccaaaagttcatgtgttggaaatttaattcccaatgcaacagtgttgggaggtcaggcctaataacaggtgattgggtcattcgggcagagtcctcataaatggattaatattatcatgacagtggttagttatttagagagaaggtggttataaagcaagtctggcctatagtatctctctctgtattgtgtacttgatcctgcttctgccctgccctttcaccaagggatggcctttgtcagatgctggtaccatgctcttggacttgccagcctccagaaccatgagcctaagaaacttcttttctttataaattacccagtctgtagtatcctgttacagtaaccaaaaatgaatatctatttattttatttatttctgttatatagtaacagaaagagaatacctatttattttatttttactgtgccttaaaactaaataaatatagttagcatttaagtgatcacttcatggaaagtctacaagatcccagagaggctttactctcattcaccccaacagacataatcaggaattccttgaccagagggccgcagttcactccagtagatatgtgaacctttctccacagttcatacctctaagggttgacagtgccagctttatgaataaccctaggctcaaaagtgaccaaagggcaactatttgaagaaaaagtaggtggagtttaggtgtacaagttgtagtattgtaggcatgcactcagggctctcatgaggtaagaaggagctggggctagaaaacgaaatgcataaactgggggctggggactgctgtcgctgtgctggaatttcctggtgtagaaatttgagaattctaaaaagtttatattctaacttggttttccagcgttagcttcctctgagaaaccaaaatgtaatgtgttcctttggaatggaagtagggatagtggtgggggagagggaagggtattttgtgaataaaggttgcctggctcagaatgggtggtatgggagaaaccgctctcagaagatatgcaagattttgttctactgttgccacagtttctgaaaatgtctgggtgggcctggtgcttaccattttataagctcaatgaatattaagtagtgacaaagattctctccttgaccaaactttagtcaggctcctctaagctctcttctcaactgggctttgaccttgggtttcagtgtctgtccttctcaggcctgtacttctcagttttagtaggaattctgttaacttaccttttttgttaatttattctattgatacataatgattgtacattttctgggatatagtttaaagagaatccctcaccattgatatctgatcactctggcccactttcagtaagttcaattgatcaagaatgcccccttactcttgatgtttcctcctagtaattttctgtccactgatctccaccctgctccttggctgtaaatccccatttgttcatattgtatctgaaattgagcttatttttatagtgaggtctcttttcctctactgcaacagtccctgaataaaatctgtttctaccaatttaactactgcccagctttgattttctgtgacagtagctctaacatctttatgatttggtcatttaattgttaagctaatttgaagtggcttgatgcttgtgcaaagcttaccacattattagacctttctaaataatgacacaatttataaactgctcagaaaaaccaattcttgaaaatatttaagattaccattgaattcaatttcagcaaataatttaaatatatttttctacctccctcaaaccattttcttttgtctagagcccaaagagctatttgctaaaatcaatataaaatttggtttcagaatgttagaatgacaacatgtgtctggagagactattagaaataaataaaaacaaatgccttatcaccacttaaagctgcaatcagctctttggtatatgaatctaatgagcagtggatcttctcagagctctgagtttaactgaaacaaagcattgatttcctggccatgataatagcattctgaacttctcaggctgtcaacaaatgtcagataattagaatatgattttaaaatggaaaattccccaagatcctgtataggactcatagctagttagtggcagagattcctatgtctcctgccttcactagagcagtacatcttgttaacttttagtctgggctggaagtttagatataaacctacaaataattccagaaattgcaccctatacacaaagcagtggcgatgcttaaatcagaatatttagaatcccataaagccaatcttaagggatatgaatcatcacatctatgtctcagcaatcctgttgttcctctgtgaggaatcaatatatcattctttcttttcttgattatatttggaaaattggaccttataaaacacaacctgaattaatcccctaaattgtaaagcatatcaataatttggttttgacttttgaaaacagaaatgctatttatcagataatttttatacaatgttgatgttttagcagctggaatacagggtcaaatacctgtttagaaaatgtgagcaccttgtgatatttgcttgtttaaagattacttacaccatacagacatggagccccaaacaaatggtactctctacttggttagatttaagaacaaatcaaagatcttctttaacagattcaagaacttggtgaatgaattcaaaaactttaaataaattgtatctttaaatgaacaacaatatgaagaagttgtgagctttctgaaactaggaaaaaaatttcttagatttgtaaatggggatatttatgcccaaaaagaatgacagggcacttttaaagtaatatctttattgagatataattcacatactttaaaatttgcccttttaaagtgcataattcagtgtttttttagtacagtcacagagttgtccaattgccctatgtaattttaaacattttctttctttctgttttttctttttctttctttcttttttttttttttttgagacaaggtgttgctctgccaccctgactggagtgtagtagtgcaatcatggctcactgcagccttaacctcctgggctcaagcgatcctcccaccttagcctcccaagtagctgaggctacaggcatgcaccaccacacctggctaatttttgtattttttgcagagatgaggtttcaccatgttgtagaggctggcctccaactcctgtgctcaagcaatctgcccgccttagcctcccaaggtgctgggactgcagacataagtcatggtgcccagcctagaacattttcatcacccccaaaagaaatcttatatctattactagcccctggcaaccactaatctaccttctatttgcatggatttccctattctagaaatttcgtgtaaataaaattgtataatatgtggccttttttgtctggcttctttcacttagcatgttttcaagtttcattaatgttgtgccatctgtcagtactttattcctttttcagctaatagtatcccatttttgaatataacacaatttatccattcacccatcaatggacatttgggttgtttccagtttttggctgttatgcataatggtgctatgaaccttagtgtacaagtttttgtgtagacatatgttttcagttctcttgggtatatgctaggagtagaatgactggtcgtgtggcaattctatttttagctgttagatggactgccagactgttttctaaagtagctgcaccattttacaatcccaccaggcatgctgagggttctgattctctacatccttgccaacacttatactgtccatcttttttattatagccattcttgtgggtataaagtggtatctccctgtacttttgatttgctgttcaccaatgaataatgatgctggacatctttttatgtgctcattggccatttgcatatcttatttgaataaatatatattcaaatttgtggtaggctgaataatgcccctcacctcaagaaatttatgtcccaatgcctggaacctgtgaatatgttactttatatggcacaaaagacctttcagatgtaattcagttaaggatcttgagatgaggtgactttcttggattatcctggggtgtccaatataatcacaggagtccttataaagaagagttagtagagtcatagtcaatgaagagataggatgatggaagtaaaggttggatggagaaaagggttatgagccaagtgattcagatggccttttgaagttgggaaaaggaaaagaaacaaattatcccatatagtctctggggttcccctgtcaacattccaagtttatctcagtgagtctgattttggacttctgacgtccagaactataggataataaattcgcattattttaagtcactaagtttgtagtaatgtgttacagcagcaatagaaaataatacgaaatgattgatcatttttaaattgggttatcttcttattgttgagttgtaggagttttattacacattccggatacaagtcgtttatcaggtatattatttgcaagtattttctctcattatgtgggttatcttttaacttcttgatagtgtcctttgaaagcacaaagtttttaattgacgaactccaagttatctattttttctttgttgctcatgctttttgtgtcatataaagaaaccacttcctaaaccaagatcataaagatttactcctacattttcttctaagacttttatagttctagttcttacatgtaggtctatgatcccatttaattaatatttgtctacagtgtgagatgggagccaattacattcttatgcaggtatatatccagaagtcttgatagaatttgctagagaaaaaaaaaaaaacaaaaatccaacgagtcatgtttgccacaaagttattaatatttcggtcaactcataggtggatttcctttattggaatatatggcagttgacagaaataggaaaactccagctgcgaaagactacttgtgggtgcctgatgttctaccagatgtgcagctgaaattattcttcttgtatagaaattttcttgtgtaacataatactaaattgttggggacttgtcgattgccagtcaccacagaaccacttgctaggtgattttcttcttgtccaagtactctataaatacaattagggctgatattatggacagagaaaatcaaaagagagggttgttacccttcaatacttttcacttttgttgggagagatggaaaaaataatccttaagaatgagtccattgagatttgcatcatacatctttctaaagagagcgctggtatcatttatactaggtaataaagtctcccttctcatgaaggtcttcctgttcagagcaacagctgggcttgtatcctgctttgacccccaaaacaatgatgaaataaatgtttacttggatttggaagcactagaagtctctgcctttgaataaaacatttaccatgatcatagtcatttagtgcaacaatcagttggggtacagtggaaattgacaggttggatgttgtgacttgtggggtttttttatttgcaatcacccaaactcatgacagttcagtatggagaggtactctaagaatttagcaatctcttatgctatttccacttcctagaaatctttcattttcttaaacaattggtaagtgggtcttgggaataagtgtcagactgtgatgcctggaagttactccctttcctctgtttggtgcttctcatttgcacagaaaacaaaaaacaaacaaaaaaaccaagctgagctttatcttttccatttctaagccttcatctcgtgatgattaccaatcatttttcttccttcttttcctcccctctctgtgtttccttttcctcccctccccttctgtctttctcatcgtgttcttattttaaaatcatcactgagttagtggatatacattaatgaaaaagcaaaaaaatgaattgacaaaggacagccaaaggacaacgttgttgtttatacacaagaactgcattcttgaaacattcgtccttgacctctcaactttgtcagtacagtcaaacctcagtataatcattattcttgtttgaaataaacatgtatgttgtcttggtttttatgaggacaaagacaaccttacctgtaaacagacacagaagtaataaatgaagcaatggatttaaagaaaagaaaacttctttttttttatatcttgtctgggagtagaaatgattatgctgaaggctaagagattaaattgtgtcacttgtcaggaaattggcaagcagccatcttttctgcctgtttctacatggtgcttttgtgctgtggatgcctttaataaacgcactcttgtgtaaaatgtcattgctgcattgccaagtggaggctgtcatgtgatagctcttccccatgatgacatatcaatattggtccctggcaattctaggacttcaaactacacagagggcatttttataattcaaatacaagtgaagaaataaaaatcattcttcatatcatggatgtatatctattttgctctgaaagaaaacctaatgttcttttcaaatactgcttaaagataggtaacgctggccaggcgcggtggctcacgcctgtaatcctagcactttgggaggccgaggcaggtagattgcctgaggtcaggagttcaagaccagcctggccaacatggtgaaaccccgtctctactaaaaatgcaaaaattagctgggcgtggtagcaggcgcctgtaatcccagctactcacgaggctgaggcaggagaatcgcttgaacccaggaggcggaggttgcagtgagccaagatcgcaccattgcactccagcctgggtgacaagagtgagatttcatctcaaaaaaaaaaaaaaaaaaaaaagatagataatgctatcaaattttaatgactactctagaagacaaaacacaaatgacgagtaacattttttaaaagtttcatcttactcttaatcaagtaaatgcaaagcaaagcagggaaatataccattgtttgccttggacatacgtgtatgccaaaattacatatgtgaaaccacatgcaacactgacaacatattgcaaagtaggacctctccaacattgttggtaaaagtaaaatttggtagaatatttctggaaagaaatttggtaacatgcatcaaaaggttttaaaatgttcattctatcaggttcagaaattctatagtagaaatatatactaaggaaataatgaggtacaaggttaataatgttttccaaaagatgtccatatatttaaaatgctcataaactgaaaataaattccaaacaatgtgaatggctaaatatgctactttatagcaattaaattatttgcaaaggcttttttactgatacagggaaaggtctctgaactaaggttaagcgaagttaaacaaaaattaaatatcatatagagtatgatctaaactaagtttaaaaggcaaaaaatatcagaaagacatgtacaaaaatgttactagtgattagctttgtgtagtgcaaaaatgaaagtgctgtgttttgcttagtctttgtctactcttctttattttatatttattacacaaaggacaaatatcacggccataaacacacatacccgaaaagttctatttaaaaagaagttctatcagaaaatggtcactgttcagagaaattcatctaaaccgccatgtgctcttcttgccttgcctcttgacttagccctcatctcacattttccctgcagtttctggctgtctccctcactccagctcagattcacatctccagccagtagagggaaaacaggtctcagtctccatctctgctgtccctccacccgagggactagattcctcccttttactggcgtgggtccacctcttgcttttgattgattgtgctttggcctcttgcctttaggtattagaaagtcccaagtccaatcatgaggcctgatcagtgtttctgaagttttgggtgtgacagtattaccggagacctgcaacagcaagctactctgcagcccagtttaagggaattttagggtccagaatttatatgtctatattagtttcttgttgttacatgacaatttaccacaaattaatcagtttaagacaacatatacttattatctcagaatttcagcaggtcaggaatctagacgtgactcagaggagtcctctactttggtatcacgaggctgcatgcactgatgtgtcagctggactgtattcattttgggaacttggggttctcttataagctcatgtagcaatctgcagaaatcaattccttgtgactgtatgtctgatgtcttctatcttgctagctgtagcctggggacttacttagtacgtaaaggatgccttcaggtccttactacacagccccccataggttctttaacaacatggaagtttgcttcatccatgccagtaagagaatctctctgtttttaaaagtctcattacatgggtcagtctgaatcaggataatctccattttgattaaatcaaagtcaaatgattaggggacttaattacatctgtgaagtcccttttgccatataaagtagcataatcatggaattgaatctgatcatattcacaggtcctgtccacattcgaaggaaagggatgtaggttattagggggcatcttagaattttgcctaccacactgtccatccctggctgccacagacttgtggctgaggttcagcattctgctaaatagctggctctatagataacagagttgtattgcaggccttgccttttacataactcctttacaaacactatttcatgtaatcttactatatcttcttgagatatatgttcctatctccaatgtaccagtgaggaaactgaagaacatagagcttaaaaaggggcccaaagtcacatagctaggaagtagtacctgaaaccttggtctttgactccaaatattgtgttctttctcctatatctcttttatgagaagttgttctttcaggagaaagaacaactaagactggagcttgatttgaagtctggtctacttagggaggaagtcacttctcactttatctgtgcctttagtctgcactgtcactttatattggctatgatttcgcacacacaggaaggtttttcataatgattccagggttcctagaattgtttcctagaaaattaccacaaaccggctgggtacggtggctcacacctgtaatcccagcactttgggaggctgaggtgggcggatcacaaggtcaggagttcgagacaagcctggccaacatggtgaaaccctgattctactaaaaatacaaaaattagctgggtgtggtggcgggcacctgcagtcccagctactcaagaggctgaggcagaagaatcgcttgaacccagaaggcggaggtggcagtgagccgagattgcgccactgcactccagcctgggcgacagagtgagtctccgtcaaaaaaaaaaaaaaaaagaaagaaagaaagaaagaaaattaccacacacttacacacttaccaacttgaaactatttctatttattagctcactattggtgtatgtcataagtctagcacagcgaggccagaatctctgcttaagttctcacaaggctgtatcaagatgtcagctgagctgcattctcatctcaaggttcagggtcttcttccgagctcatgtggttgtgtcagaattcagttccttgagtttgtgggactgaggtccctgcttcattgttggctgtcagcctgggggcctctgtctgctcctagagaccattctcattctttctcacatggcctccttcattttcaatccagcaacaacgtgtcaagtacatcacacatctttaacttctgccaccagcctgagaaaagtctccacttttaagggctcatgtaattagaccaggttcacatgtatattctccctattttaaggtaaattataccatataaaaatcataggagtgacatctcatcatagtcacaggttctatggattatggtatagaatcttggggagtggcatttttatttttatttttatttattttgagatggggtctcgctctgttgcccaggctggagtgcagtggtacgatctcagcttactgcaacctctgcctccctggttcaagccattctcctgcctcagcctcctgagtagctgggattacaggcgcccaccacaacaccccgctaatttttgtatttttagtagagatggggttttaccatgttggccaggctggttttgaactcttgatctcaagttatccacctgcctcagcctcccaaagtgctgggattacaggcatgagccatcgcgcctattcgtgagtggcatttagaatgatgcttaccacagtgggtctttttttttttattttttattttttatttttattatactttaagttttagggtacatgtgcacattgtgcaggttagttacatatgtatacatgtgccatgctggtaacagtgggtcttttaagcgtcgttgttgtttttctgcattatagcttagaagataaaaacatggacactggagtcaaactgcttacattcaaattctggctccaatatttactagcagtacaaacttagggaagttgcttaacctaccagttcctcaattttcttatctgaaaaatggataataaataatagtgtgaattttattgagtcatttaacactttaaatgagctaatgtgccagaaaatgacttggcacattgtaagcactgtgttggtctttattattaggattattattattgatctgattattacataaccactaatttagagttcagatttactactctccttggagcaaacccatcaccttatttctgtggaccttagtttctctgtaaatgttagtgttatttaactgtcaaaaatataatttatgtcttagtctgttgggctattataaaataaaatatcataaactaaatggcctataaaccaaggcactggcagatttgatgtctagtgatggccctcttcctggttcatagataatgcctttagatatgtcctcacataaaggaaggggcaaggaagcttttatgagggcactaatataagccagggcttcttttacagagacatgcaggagtactccaccttcaaaacctaatcatctctcaaaggccccacctcctgatatcattacattggggattagctttcaacagatgaattttgggaggatacaaatattaaggccatagcaatttataatgtaaaggtacattttaaagaaatttaagtgtctctaactcaaaggaaacaccaaggatttgtttacataaaagaaaactgtgtttaatttataggggttttttttaagcaaaggaaacatagcagattcagtggcttacattataaacttgagaatagaagtacagaaccgttttttgcaccatacctattttttaaaaatggtctttaattccatgttatgaccaagagaaaaaaaagtatgtgaaaaatagggacaggaaacttagggaagaacacacagggtgaaaggagactgcagaaggaaatgtagaaggtataataggaaaggggatagagaagaaaaggaacagaggcaagaggagaggaaaaactgcttagagacagagagggaaggtaaggagaaaggggaaaacggtggtaaaatttattgagcaccaattatgtgcctgccatagctaaggagttcggttatctcacctcagaacatctcagtgaagtaggtattattgtcaccactttacaaatgagaaaatagctattaagtgagtttaacttgtgtccaaggtcaactgtgttacatacagaagttagaacccacatctttccagagctaattacaatgtccttctcccatgtccttaaggactaatggtgagataaaacatactcctcatggcttgttggtccaacctcagtgttcctgtcacactgagaaaagacttagtctgacttagttgaggcgatggtgttactgtctcttagcactacctaataatcttaattatttgagtcaggacatttggattttagttaaataggatccccaaatgatttatgcctcaggataagtcactcctctgagctgcagaatcccactctataaaatgtatgtcttggactagaccacctgccaaatactgaaaattattagctgtcttcacataggcaaaggctgtaatgtggattggggagaaggtgaattttgctgctctagttagaagcactgtacaaagttttgcaggttgtttattgtacaaccttagtaggcaatattcatatacacagtcataggccatggccctggctccaggaagccaaaataaagaccaatgggtagaggccaaaaaaagggaaattgtggctcaatagaaaaacagcaaactctgttatgttcagaattacctcttaacattgtgaaagctttacctttgggggtttttaggcagagaccacatgatgtagggattctaccaacacatgagattttagagaatacctaagcgacattcagaactggatttttaatgtggtcaaagctagctgggtgatcttaaaatcattaagccttaattttctgaatccttattattatggccacaataatagtacctacttatatggctactgaagtagaagattgtgtgtgtgtgtgtgtgtgtctacatctgacatctctgtatcttagcacaatgtcctgcacatgataaaatgtcaagaaatgttagctttcattatcaatattatcttttcaactacgaatgaatgaagtttctagcacagcagaactttgctttacctctgtaggcatggggctgccaccatgtttgcaggcaaagaatgctggcattctcagagatatcacttttcattcttaattgtagagcaaacatatataaacatataacataaaatctatttcaagcttagagccagaatttggttaaagggtggaggttctccccatcttgtagctaaacagagtggtgaaaaattatgattatggcccgccataatgataatttagagataatttctaaattatcctctaacaaatctatttctaaactttaaaaatagagcttctttagggtccagtgttagcaaacagaatccccacgatgactcatagaattacacagcatctttttcaaacctttcactctagtggggatatgtcctcattcagaaattaatttagttaattcagcttaaaaattctgttgtcaaaaagcttatttcatgtgggagtatcttttttgttgaaaaaagatgcacatttacctgaaaaaaaaaaaaatgtgattctcttcatcaagctgtaaacatgcagctgtcaaaagtaatcactacatcagaaaaactggataaggaataaaagtatctttggttgattcataagaaaaacagcaaagtagcttatatgcttaatgaaaaaacagactgaggaagtgctatgaagcttacatttcgctccttaagtcacagtcctcaatgtggctccatgcacgctaaagtcattcttacctacaggacttcacttgctttatttaataagactccgtccttgattaaatttgaatcaggcttctctgggtcctattctcaattaggctttgaccttaggctttttatttggcctcgttagcccagttttaccaagaatcctgctgagtcagtttatgaaaaatttctctcccttggtatccgatcaaattccttatcccatacccttgataatttatcagcttggcctgccttcaacaagaatcctgccaagtcccttcagccagaattccccttacccttgacgttttctctcagtaattttccatgcactaactgccaccccccactccacagctctttggctatacatcttcacttatgctttctgtattcagagttaagaccaataactctcctccactgcaaaatctccattgcagtgaaccctcttgaataaactcttccttacagtcattaacaagtgtcataaatattttgtatttcacatatccttcctatcttacctcccacaataattttcacttctccctcttctccactttatttatttacttactcaaaaattcatttcttcagcaagagtttattgagccagttatacatatgtaactgcttggcctgaggggatttacaacctagcaggggtgctaaaagtgacattagggcatgttattcttcctgaaaaatctctcctaatttttccaacctatagtgccttttagctaaggttttgatcccatagcattttatgttatttaccccatgagggtaactcttatttcccacaattaagttccttaaagaaagtagcccagctcaagcagctactactctctatcactgagaagtacctggctgcactccctccaccaacctaaactcaccatgtgcctttttttttttttttttcttttttgctttttgagacatggactcactctgtcacccaggcgggagtgcagtggcatgatctcagttcactgggatcaagttcaagccattctcctgcctcagcctccagagtagctgggattacaggtacccaccaccatgcccagctactttttgtatttttaatagagatggggtttggctatgctggccaggctggtctcaaactcctgacctcaagtgatccatctgccttggcctctcaaagtgctgggattataggcgtgagccactgagccaggccatcctgtgctcttcatccagatgaagctgctttccctttttttctgagggacaacttgttcttttctctgtgttcccacttagatttgtagggttagtggactcagaggaaaccttcccagggaatggtttttttagactctttttccctctctaaacgcctagagaaagccctataaatggttgccgaatatgagaatacatacaatatctacaacgttgctttacttgctaatgctacttatagtgtatccttttgataattatattatttgcccgttagttcatatttatgttctttccaactagactgaaggcctcatccaaacaaaagatttatcttcatcccctcctcacagtgcctggcccaatgttcaatgtggtacctaccaacgaacacaaatcaaacactactgaaattcaatcagtagcaaaagatctgcaaagtcatttcaggaagcttgccttaaaaatctctttcaagtacagaacttttgtagaattattattcttcaaaggtacaaatgtgtctcattgatgcagcagatttactttcaaaatcattctaatgtttcagatctttacctgagtctgccatcctctgctgcagcacctcctggtataatcttcgtaataaatatgccagggtcatctccaatgtggggattatctgtccccccagcaatactgaatcccaggccagaattcccctatagaaacaaaaagcagatattaaatgatgtgtctgtcacctaaaacctagttcctcttgcactctgcattatcatgttactactcaaatggaaatcaggtgacaacagtcttgtatgctaaatcataaagtgcacagttagcagacaaaggaaggtcaggaaaaacactgaggtttattcctgcactgtaagaatgcaagagcattatatttttcttttaaaaattgcttcctttatgcagcaattaaaatcacatttatgaagcaggaaataaaaacttacaaattgtgtaatatgaaaaaatataaagaatcattagagtgtcaactgtaaaaattatacatttatatgaaagaggaagaaaaaagttacatgaaagaatttgatttaatagaagagtgaacttgggtgtttcattttcttatttctggtattgttgttctaatatcacttatctgtcaaataatgtgtttctaagtaaagaaaacttccacttcagaagacaaggcccccttctagaatcataatacatgagagatacttttgaacaataaacaggctttaatttgcaatagcaatagaaaaggcatgcaatagtgcagcagcatggaaatctgagtagcttctattctaataaagcctttacacttactcctgtagattatagtaactgatatcctgtgggtgtgtatatatatatacatatatacatatatatacatacatcgctttctaaagatatatatataaggatatatatatctaaagagatatatatatctaaagcgatatatatatatctaaagagatatatatatctaaagcgatatatatatatctaaagagatatatatatctaaagcgatatatatatatctaaagagatatatatatctaaagcgatatatatatatctaaagagatatatatatctaaagcgatatatatatatctaaagagatatatatatctaaagcgatatatatatatctaaagagatatatatatctaaagcgatatatatatatctaaagagatatatatatctaaagcgatatatatatatctaaagagatatatatatctaaagcgatatatatatatctaaagagatatatatatctaaagcgatatatatatatctaaagagatatatatatctaaagagatatatatatatctaaagagatatatatatctaaagcgatatatatatatataaaggatatatatatctaaagagatatatatataaaggatatatatatctctctctctaaaggatatatatatctttctaaaatttgtatgtaaggcataattaaaagtccccccaaatccacaaaccatattgtttatttcttatttctatagtctcctttactccccatctcccatctccacagctacatatgttttcatggttgtgttgtaattttttccaaatcacattatattttatgccctttctgtatagctaggcagtctttataaatattcgtcttaaatggctagtcatgtttcatcaaggtcacatattacttatttaaccagtcccttgtcactggatattaaatttctctacatattcttacaaaaaatatagcttactaaatttatgatcatttgattaatttccactcttgggtaaaaagagatgaggactatgaattcagtagttatttcagaaaaagtaattagggtgcttgattagtcagaaaggttcaatgtcaagataagatcagctataacttgacacctataccactgcaaatgtcaaggtaatgtttagcaattcttattgactaaatttataaaactgatttccagagggttgtttttacaattgtatatttattacatatgttgaaagggtgaaatgaataattcagctatggcaactaaaatctcatgtgtttatacttctgatgttttctctaattctgtttgctctttgaaaaagtccagtgttcactgaacagagttattacttattagcactcatataatcatgaatttatttaatatttattaaacaccacctctgtacctggcactagactaagccctggagctacaggagtaagtatgtcagtttataaggcacatgaaggggaaatgcagagtgtaggagtgggtaggagaaccaaacacagtgacctggtgacatagagaagaacattttgacatagagggaagaacttgtgtaaaagcccttaggtgagaaagggtatgccacacccaaggaacagacaataaagttggaacaaagaaagcaagaagaattggatagatgtaccttaatcatgaaattgacaagagcagagtgtacgagaaaccattttggattttaaatacttactgacaccaaatgactgtgttagtattggttgagcatttcgtatgcaactgactctaaactaagactgcagaggttaaggccagatggtttctgccttcatggatattcaaagcatagcaaaaaaaagcaataatactctggcatctagtgatcagtatatttcacgtactgtataacctcaactgcattgtcaagtatgtagccatggagatagtgtttaggggacttaatgaggcagttctctaagatccagaggtttgggaagaaaaaatgggaggatgagtattttcaatgtaatttgggtcaagctctaagtacatcaactagagtatattggtctcactgtagttagcatctcagggataataatgtcttgattaatgagagtagggaaggaggcaagcagagattgggagatacccaaatgctttctcctgatactgtcaacatgtttggagagggtactcaaaactttgtcctgtgagaaagatattcgtgatctaactcttaaccttgtcaactttatttccagcttcacactttaccccccaggaacaatgaagtgaactgcaggctctttactgcacagacctcactataattcatctattggtgtttatttatgctgttttctctaccagaaacttcacatcgccttcttgactatttcaattcttcgcatttttgaagatgtggctcagacggtgtctgctcaaattaatactaaattatcacccaacccttctctagatagatcacatttctgtgtttttgcaggtttttatgcttacttacattatgcattgtgttattttgtagttgtctgtttctgagtctgtctttcctttaaactgggcttgtagaaggcaggaactgtgtagtattcatctttgtttttttggagccttgtctagcacatagtattgacaataaatacttgatgaatgaagtaacagaaaaacaagcctactgagaatgtttgtgccctaacaggaagactcaaaaaggccacaatagaaatccacaatgtgttaaggaatacaatatggaagtagaagccattttgctctgtgtcattacaagaataaaaaagtagaaagctcaggcattcaaactgtggtgcagctaaaggctgactaataagacacaactgttcagattggagatgcactactctgtaagggatagaggatccttcactcaggaggtatttggctagtcactgggcgtgaaggacccaggcatttattgaaaggttaaactggatgattttaaaggattcttttgggactctggctagatataggaagtctgctcttgccaacagagaaaaggggatgttttagggacatttagtgggggaagtagatcactgtcaaattcttggaacttagtctgtgaatcaatatgtctttgaaataatagctttgataacaacctagaaacatttaaccactgtttttcttttgaattgactacaatatggagaaaactgtggctctggcattttctaatatacattcccctgtccccagacccactctgaggaaaagaatgaatatatttaggaaatttacagtggaaactaggtaggtagagacagaatgtaacttgccctgtgtttctggtcccaaagcatccctgaaagcttttgtgtttcaattaaaactagtctaccagctgggtctggccagtcatcatggttctttacaagagattcatctgaattcagctaaggaaatgatttaaagagctttcacctccctttattgttctcttccagccttcccttttaagtctttgctaccagccagcagcatttagcagagagagggacagatgcaaaagtgtcattgaaattgctgcctgctgctctctatggctgaatcacttcaatcccctgacaattgtcccagagcctgccagctgcagggacagatctcagctcctctcttctctgagcagcaatctctccatgtgaacaggcagacccctggttgacactcttagatcctgaaaattgtgactaattaaccgagtgttgatccctgatgcagtcaatggaaacttcaaggtgccatgctggtaagggcagaccctgtaaaggattctgggtgggctgctgtgtccttgcagttgggaagattccatgacagatgaatgtcactgacatggaccattctttctcttaattgttcatatttgctgactcttccccacgagcacaaacccattttctagccaaatgacacttcttgtttcatgtactgcacaccatctcctctcagagagagaatccaccaaaaggaaagacatttcacaaatataaatataatgtctctgggaaagccccacttttattaaaagtttatttcccaaatgaaaatttctctcaaaatggggttatatataataaaaaagaggaaaataagtagtaatattataatcacattcatttatatataatgttgtaccgacaatgatttttttttgatttttagaatttttctactttaaaatactgtttgacctgatcattcgattctaggattttatcctaaagaaataatcagagaaacatgaaaagatttgtgttcaaggtttgttgcattatttttctagtgttaaaaaaacacaactgaaaactgacatccatatcatggagaaatggttaaaatattgtggtacatttatctgaatgtggggatagtttggagtcattaaaattgtagtgcttttcaataataaagacatggaattaacccaggtgaccatcaatggtggactgaaagaaaatgtggtacatatataccatggaatactacacagccataaaaaaagaataaaatcatatcctttgcagcaatatggatgcagctggaggccattaaactaagtaatgcagaaacagaaaaccaaacactgcatattctcacttataaatgggagctaaacatcgggtacacatgaacataaagatggggacaatagatactgggaaatataagagggaagaaggaaggaaagggaaaaaggttaaaaaactacctatctggtactatgctcacttgttaggtgataggttcaattgtattccaaacctcagcaccacatgatataactttttaataaatgtgcacatgaacccccagaatctaaaagttataaattaaaaataaaattttagtgctgttaataaaaacggaaaatgttgattatataaatatgagaaaaaagtgacattttaattacagtatgattgccactgaagacatttaaaatgacttaattttaacaagaaaattactaactttaattaataatagtaaaattgcttaaataatttaaactacataagaaggagattttaaaaaattataaagcccctagtaaaatactaaaagcattattaagggaactaacatttattgcatgcttattctatgctaaacactaatctatgtttcttacaatttcctatgtggtagattgtattattctctttttatatattagaatgaaaaacaaacaacaagcaaacaaacaaaaactgaggctgagaggagtgaagtaacttacttaaagacgtgaagcaagtaaatagtgaattcagatttaaaagtaattctcagacttcaattactattttctttccattatatcacattgtctcttctgaattcaaaaactaatgcaatggtagggaagtaatacaaattttagttataaggaaccgcttcattggatttttggaaaagatttaaacttctatcagtatcatgaaaatatttcaaaacatttctaataaagtgatacggtttagtggaaaaacatagatctgggtcgttttaacctgggtttgcacactggctctgccattgacatctgcatggtattggatacattttgaaactagactttgagtctagtttcatcatctgtcaaatggagataatgagatgaattcaaatgacacaggcaccagcaagtgctaagcacagcacatgggtgatgatcaagcaatgttagttcaattcctttggtttgatgcatagcactgtttaaagggtccttacgagtttgaggacagtaagggagaacagatgtcaaacaatgtattctttaattcatgccttatttattgatccaacaagtatggattaatgcattttaacctacactgataatatatgttacttttctttgttaaaacaaaacttagctagaagtactaaatttggggtaaagattaggttatagtattgaaaccttagataaaaaacagctagataaaaaaagactcaaataatgttcttttaacattttaatacccatgttctatttgataaatattgaaatggtatattcctctcactaaccccaagattcctatatgcttcccttaacccaggaacacctatctgttccttttgctacttgccaaccatcatcgatattcaagtttaccttctgtatatttgttccagcaaagccatttgtttattttaatttaatatagtttatactacaaaactatatgttgttttcaaatataacatacctcagcccctaatctgtaaatttctcatatgcaccctgatcgaaaattactaggctaccacttgaacattggccatgaagataataggacagcgaacaatataagtaggtagaataaagatatcaaaaaagattaaaacaggtaataagaagttaaaataaagaaccatttaggctacatgccagaagaagaaatgtcccttgatagaaaggtctgttggttggcaaataatcttccaaattgtcctggaagtcattttactttgaaaagtaaatctggagtggcacagggaataaaaaggtgtcttttcatacacattacttgttaaaattatttaaagtctttctcacatccactttctgtctcatgttacgatatctaaagatgaacagccccaggtctattactaggatgtgaaggtgagaaaataatgcagacatttctaactaccattgctaaatagagatttttttcctcaaattttttatttagtttttaaatgctatctaataatgtatgtgtcctggaacaaagtgcttagtccaggaataagaaatgcccttttcacaattatacaatctacaggaattgcatttaggatgccccatagtttgttctattaaattgtatttttctggaagctgctgggtagaaaagccatcaggagaatacttcatttggggattggtaaatgtttacataaaaatgctttaacaagatgggggatggtagagaggaagcagtttaataaataggccaagagagaatgccagattattgtagaccaaagaactcctgagaagcaaagaaaagtaaacacagtgaaagtagattattatctgtgtgtgtgtgtgtgtgtgtgtgtgtgtttgagtgagtgtgtgtgtgtatgtgtgagagagagagagagagagttttagctttagggggtgtgtgtgtgagagaagtgtgtgtgtgtgagtgtgtgtgtgagagagagaaagagagagagagttttagccttagggtgtgtgtgtgtgtgtgtgtgtgtgtgtgtgtgtgagagagttttagccttaggggagatatgtggcagtatcgaaagagaaggagaaaaagcagaggaaagattttggaggatggcagggaggggactcaagcatctctttagtctaaaggaaagaagcccctgggaaagggagattgaaggtacaggagagaagagagcacacaaaaaaacataatcttgaaggaggagtgagaatggggcccagagttcagactctttgagtcccaccataggtactacttaatttcatgtagtatagccacaatacaacagtattgtataagtttatgtgctgacatgaaaagatctttacaaaatagttgtagataaagtaggagacaatttaggatttaaactttgacctcactttacaatatgcatgcattataaaagtttgtaattatgctgattaatttattaatagtgctttgtagatctttttcttttgtcattttgagcactccatctttaattttccttataaatatatcttgcaatgagcgcatatgcatgtatacacatgcacatacacacacattatacttgtacaacatgtgtaacattagaaaaaataagttcgcttttgacacagcataactcagccatgggtagggggaggaatacttcgccctctgagataagagtaactgagttcctacggtaagttatagtattattttaaggtggaagaaattaaaggtcattttaaggtagaggagaaggaggctgaaggaagtcttaactgattagatgtctttactccatatatttagaagtcaggacatcagagggaaaggtctagaatgaagttgaaaacttaagtaaagctgtaagtgattggaactgcagctttgaggcaagagagagacacttagggatcagctggagcctgctaagcagcaccatggtgggatgccatcaacgtgttatgggattttctcccacagagcttagtaatcttgaacagtgaaagggatgatttggttgctttaggggtgaggcttggggaaaaagatatggtttactttgtaagtgatgagtaacatgttagaaaagataggaaaatatgagacgtaagggaagatactcagactggaagaacagaagagggtgaaaagatggagatacgataaggtgaaaacatagatttatggggagcaggggaaggaagagggagcaacaggctgtggatattggcagatttcagggttcaatattttggagataaagcagcactcagtgttagtcatgtgagtatagtaaaggtcaagttataagagtgtattgaggtgatgatcaagtcagggtactttgtagctgacactgaagtttcccagtaagacagaaggagatttaaaaaacaaaaagatggtaaagacagaaaaaatggctaacatttttcattgaaactgaagaaagacctagggtagaaggagagaacagtgaaaagatgagaagaggagtatgatgtgaggtagtgtggcagttaagtattcttggcagaggaacaagatgtgctaaggcctaaggaaaagagagagcttgacttgttcaagaaactaaattgagaccagaatagctatgcagtggtaagaaagggaaggaagagctgaggcaagagaaggtagcagggggtcagacactggggacagtaagtttttgggtcataaaaggcttaaaacaggggaattacattatctgatctagtttaagattatactttttattgtgtacaaacttattggagagtgctgaaggggagaacagagaggcaagttgctgtagtccaggtcagaaattgatggcatctgaactaggctgatagcaatggggatggcaatatttgaggcataatttgaaggtagaaatgactggacttactgatggctggaacgtgaaaggtggaaaagagaagaatcaaagatgacgtgacacatagctggacagggatgctgtgtatgagataagaagactgtggtgaggatgaggaaagcagtttgggagatgtaaatcaagacttaggcttgggcctttttcagtttgagaaatatgttggtgttaatggagagaaagaaaaaaaatacttacatcgtcaaaaaaaaaataataggtaacactcatttagtgcttgctatatatcagatactgtgttagaccttacaattgcctacttaaggaagtcaagatgctggccagaaaatagggtgggttattgcaggaatatcaggaaaaagttctaagcaaagttatctactttggtccccacaactgtaagggtatatgagaaagttttctgagtgacagacctaggattatgggctttcctggagaaactaggttatctgagtaaggagcgatatgacaaatgtgatgctttaccatgattaattcaagggcattgtgtgtttagaatgctgaatttagaataggctgggtggattgagtcagaaagcaaggagagcaatatgggatcaaatataatatttaagctgttaattcttaagatctgatttaagatgttgtcagtgatactccaactacaaaatttctaagtaacatcagtcttctgtcctgtaacagtatgtatccaaaatgctactggcagcaaatatgtacttctcattagctcccaacatagtttcttaatttgttgatcatttttccagtgtaagctggtaataatggagtgagttcctcttttgtagtcccatcaaatcttctactcctaatgacatctctgcttgtgttctgaaaaggattaaagcagagatgtctatttagactggtttgtgtattgaaaataaggaagaaacaagaatgctcaacaattcttattaccatagcaagaaatctgatagtcatccttgactcctgcctccccatcggtccctacattttattaaaactcaaatcttgttgattctacccctgaaatacccctcaaatccatccagctcctctcgacttctgccatcactctctagtttagaacatctttagttctcctcattggttttctggcttccacacctgactcacttctctccttccttctcatgcaaggatgtgctcaaaaacaacaaatctcaaactccaatgcctatgaaggcagaaaacacatataggagggtgaagtaatcccaggagaggtaaaacaacagagcaagaatgtgagttaatgacaactgatcttcgtattggaaacaaaacagaagtgcgggttgagaacgtatctcatctaaagcgataacctgccattcagcttttatgggttattgcctctctgaaatggggtcctcttactggatgattgtcttaccctccccacaccccagagaagccaggaatcaaatttccttaagtaaaatatcaatttttaaatgttagaaaattattgaatttatatctgtaaatatatattaggctgtactagtccaagtcctctgagaagcagatgtcaagacaggattaaatctaagaattttgttaggggaaatgcttgtgaaggaaaatggggaagcatccagaaaaggctagaagagctattagatcaccatgcaagtccgatcccaaagaggagaacagaaagaaggaagataggttggaagtatccttcattgcttttctctgagtccatcagagaaaaggccccacctgagtagccatgcagcactaggtcactggctcagaggagccattggggcaaactcaagaatagatttcagattttagagcttagcagctgggttccaggtgaattatgctccctgtagttggcagtctgtgaagcacatcctcatgactgccccacaggccaacaatgtgaagagcaaacacatctgcaagccagagatatagtctgagggtcgccattttgtaaactgctcaccattcagtgaactagcttgtactttcttctgtgtagatttatatatcccgaggaacacataaagaaaagtgcttgactcagagtaactcctcactttccccttcattttcctcctctatataattctctaagtgattcacaattcattactgcacacagcacattgttttgtacttgtttatatgtttattttccctattctattgtgagaatcaatgcaaaatatcgaaacttagttattcattttccatgccaggattgcatagtacctgtacatgaacagaactgaataaatccttgtataaactgaattgaactgaactatttcctattctgcaattcttcttttctttgctgttgaatttctattcaaatatcaaactccacctcaactgctctctcatgttttctccaactgcttcaggcagatgcgaaggcccttccttctgggcttccgtaaaacttcattcataacgtgagagagacactattcacactgtgtctctctttctctagatcctcagcatctggaaggcaggggccccactgtatttgcaattgtatttctctctctcaatctaatgcccattgacagcaaatgctcagtaaatgtttgatgagttaaactaaactgaagaataatccaaaatatttgcatgattgagctaataaggaagggtcaggtgaaggggtttacctgaaattttaatgtaggagggctaaactttgaatcacctaattaattctgcatttgtttctttgagaacctgctatctgttcaacattgtgtcaaattctgcaaaccaaataaaagacgtacagttcttgttctcaaggagcttacagtctagttggggagatgtgccatatacatggggaacagcatgagtacggcacaatatttcccattttccattggctcctctctccctgggtcctctcatccatcatttaccaagttttattgattctatcacttgagtaactcttgttttcatccttttatttctatttccactgcctctatttcctcattttctattgaccaggatatcataaattctaagcatctgagaatgactttttttttaaccacttttttttccctttttccctttttgagacagagtctcactctgttgcccagactggagtacagtggcgcgatcttggctcactgcaagctccgcctcccgggttcatgccattctcctgtctcagcctcccctcaggcgcctgccgccacacccagctaatttttgtatttttagtagaaacggggtttcgccgtgttagccaggatggtctcgatctccttaccccgtgatccacccgcctcggcctccccaagtactgggattacaggcatgagccaccgcatccggcctttttttttttctttttacttttcctttttttttttttttttttttttttaccacttttatgactaccacttttcattccagaagtataattttctcactttctctcaaatcagtttagatgttcctgctgttttttttctattccaaatctttaaaaacttctaaatgttgaataaaacaatatctttttactctttactctgtttttactctttactgaaccatgagaatttttttttttaggcagataactagagatttttttctggcggtgtgcacttattatttcttctagtatttcttggcaatactgtaggttctcatttgctacagccataaatttgtatttctttaaaataacttccctttaaaatggtaacatgcgattaaccaactgtacttctgacttaacaagactttaacaccctttcctttaccaaccttgactaggcaagagggatgggaatggacacttgctgtcatctattaggtgctactcccttggaacggataaagaaaataagctctgtaatcatttctgctgtgttcagattctagctttactatctcttgacttgtgaccctgaacaattctcttaagttttctgaactataacttcttcaccagaacaaacggaacaataataccttttggattggttataaactagtagtactcaaaatatcttcaagatcaaataataatatgttatttgtctttttcactgtgttcacctgtgtgctgatggtacaaaagcaatggagataactgttggtgtcttagtacaaatcaaggtagtggtgccgaagtatgctagtaagcatagagttcttcactcccatacactcacacaaaaaattaattttacttaagaatatctttgatgaggcattaaaaattattaattttcttaaatattgacctttgagtccataactttataatattctatgtgatgcagtgagatatatgcataaaacacttccattgtatagtgcacatggttttctatagaaaaataaaaatactgtgcaattatttcagttgcaagctaaactaaccacatatttactgaacatcagttttacttaaaagaatgactgacatacaaactggttattcagtttcgggtatttcacaaaaacattcctgaaaactaataaagtgagattgttgttttaaggaaaataattgccaatatttgtggtcaatagcaaaatttgaattttcaagcacacattagaatttggaaactttgtattcaccaccaatgagctgacaagctttctgacttaaacttttttttctgataggatgggtgataataatgacaaatactattttttgatattatatagggaagtatgtcaacatttggagaatctgcatagctcagtgaatcaataaatcagtaattttcaatcaaccaatacatattatacaaaaatacatgagtaaaaggttcatttaaagtgcaagatagatgaacgaattttaatgtaatggtaataaaagttcaatgatagagtctcagattccaccttgcagctaaactttaaagaatgaccatttgtcaagttttaatgtggtatcaaagaatatccacagttatctgaaaagcctatgaaaacattctgcctttctccattcacagaagagtaaaaaaaatgtcctataaagatatgagaatccaactatattaaattaagccagacattaaaaagatttcgaaaatgtaaaacaatgcccttctacttactactctttttggcttaaaaaaaataaaactagttttaatttttttaagttacattaatatttaatgggtttattattatttataaataaattattacttataaaaaatttcagttttaatttcgaatacggtaaatactgtagacagaatacacataaactataggagctcttcatgaattttaagtgtaaaaaggatcctgagaccaaaatgttttagaactgtttttgtaaatattttgttacataattctgacaaagcatttaacttgatacattggaagggctcagtaaatattagtaagcttatttacaccaagggctctaggtagtattagccagcattataatttcttgaaatcacccttgactatcatccatttttcttaatttgaaagcgaactcaaggagctgaggcagcagagtgcttgaggaggggaggatggagatggatctatcatagttgaatgcttatcaaattaataatactattcaccacctcagaacatgctataaggaatcaactcctaaagagaaaagatttttcaatatgatgtgtttttctgcggctgcacggagattttaaaagcatgcacccaggtttcctactgcctcacgcctagtatgacttcacattctttttctttttttctttttgtttctttgagacaggctggagtgcagtggcacgatctctgctcactacaacttctttcacgtcagcttcccaagtagctgggaatacaggcacaaaccatgaagcctggctatttttttttttttttcattttttatagagacagggttttgccatgttgcccagccttgtctcgaactcctgagctcaagccattcagccacctcagcttcctaaaatactggaattacaggagtgagccacctcacctgggctgacttcacattcttgtaccaagtagctattagttacaggcttcttaaagctatgcttagtctgtagttttatattctatttgttaaatgcaaggcccattggcagtggtaaggatttcaaagacctaactttctgttttacacaactttatttgtagagtctatttccttactaaaagatgtcatgtgtaaatgtcaacgctaggttaagattagaacttatttgacccaataatccaaactcccctcagcccaccattctcactgggctcaaaatctattcattggtattcaaacaattctaacttcagagtgctgcccataaaacctctacccaggaaaaagaaatattttctggaagcaagtgagttcaatgttccatcacaggtatatgttgggagacgggaggtggaggtaggcaaaggctggattgtgtgcactccattccccttaggagtatatttgctttctttgcaaccctgagcattttggttaatatctaaatcctttagttttgcaggggacaaaaaaaatttaagtcacggacacctgtctcctctttgacttcttgtatccttcttctcccttactagactgcaattatcatgtccccttttatggtcctccaacatttcaagtttatttctatcttggagactttgtatttgctcttatatctacctctagcatttttacgtccttattcttcagatcccagctcaagcgttaccacctcaaaggagcctgccctgatagcaacaaactactcttctcattaccacctttggtcacttcctatcttatcaccctattattttcttcatgtcctttatcaccatctacccttattttgttaactgcatatatattgtatgagtacctcactagagtataagctccaggaggcaggaacctttctgtcattttcaccactaactgtattctcgtttctagaacagcaccagacacataataaacattcaataaatatgtgtttaagaaatgagtgtctcaatcagtaagaagcggtaatagagtgaaaagtgtataagttttagagttcacagactggaatttcattcctgctatgagctcaatatgtccaccaaattcgtgtgttggaaacttaatccgcagtgcaagagcactggcaagtggggccttttgggaggtaagatgatcctggactttatttattaagtgtgtgaccttgggctagcttcttaacttctcttaaattcctcattttaaaacagtgattgttaaactcttgtgaagaatgatgttttcaaatgtaaaagcattcgatactgtttagcacataaaaggtactcaataaaaaggatatccctgtcctgctcaatcgaaatactttccatgttttgttagtccattctcaagtggctaataaagacatatctgagactgggtaatttatgaaggaaagagatttaatggactcacagttccctatggctggggaggtctcacgatcatggtggaaggtgaaggtcttacatggtggcaggcacgagagcctgtgcaggggaactgcccttttataaaaccatcagttcttgtgagacttattcactatcaggagaacgacatgggagaaacctgcccccatgattcaattacctcccactaggtccctcccatgacatgtggggattatggtatctacagttcaagatgagatttgggtgtggacacagccaaaccatatcacatgtgtatgacaagtaaagctaaagtcctaacaccacagaatttaccattttgtgaagaagcaggatatataaacataaaatgacattaaatgtcagtatattttaagtgtcaaatgaatgttagagggacaagtgaaacgtgcattggctccctactgcttagggaataaagtctaaatttattaggcataacatttatggcactttgttattatgttgcactttgctttccaacgcctatttctcactgtggttttccacttaagcgtcacctaatcaaaccccagtattcactttactttgtaaatatatggtcctgataagccttgcaactttgctctcagactttccctcacctcttattctattcttcctttagggcttgaattaattgtcatttgctccaagaagtctcacttgatctcacgcaccctaatccttacaaatgaaagcaactgctcccacttctaaggtcctagagcacattgggttatacctttcctaaagcaatttatctttggctttatgttcggagtatatgtgtatttgccttattttctagcctgctttagtttttagcctaaccctctggttgtctctgatctatcctagtcattccgaaaattctgcacatatcatatgtgctccctcattatagttagatgaataaatcaactaatttaaaatgaatgaaaaggaactaagtgggagacttggttttctacttgggtctttcagcttaagtctgggcttttctcatctcccttcattcctcctcccaactcctacttatagattcctaaagacactcattccatttccatttctaagccttctttcctcatgtatctaaacgtggtttaagcatcatctgctctgtgaggcttgtgtgactcaccagttgggttcagataaccagttgggttcagttacacccagagtacattgaacttacttctgctgccacatgtatcagttatattataagaattgtattcattgagaaaaaaactatgttaatgtaatttatgggcacctctaaccatggctggcatataataaatatgcaataagtatttgttgaataaataaattaatgcaaactttatttttattgatattattatcgtaagcattttataggctttatttatttatttatttatttttgagacagagtctcgctcttgttgcccaggctggagtgcaacggtgcgatctcggctcactgtggcctctgtctcccaggttcaagcgattctcctgcctcagcttccggagtagctgagactacaggcacgtgccaccaccctcagctaattttttgtatttttagtagagacggggtttcaccatgttggccaggctggtcttgaactcctgaccgcaggtgatccacctgcgtcggcctcccaaagtgctgggattacaagcatgagccaccaccacccagctggctttatcttagtaattcctctaattagtatatttaaatccatgtttatttatgtttactcatgcttctatcaactacaaaagatcaagcagttcaccatttgaagaagaaaaaatttgttcagcctcctgctgcatcaaatgtgtactagagtaacagtttgcccgatggaagcctgagaaactaatttgcctccatggtttctccttaattccctaatcacaggcaaaatccgatcagactttaagagaaaataaactttgaaatctaattcatatttctcttagagtcttctcccatctactagagtgaagtatagcctaaatcatttttctctaacgagttcatatttgacaaaagatttaagaacacaatataaaacttttcaattctcaacatcaattctaatgtatttctacacctgaaggtaaagtaaataaactgaattaaagtgcagcacagaggtatatatttcttttagaaggtacttaacccgagtataaacaatttcttttgttctttactcatcctttcagcagcagaagcaggaagatggggtacttactttcttctaatttgcggtagaaataaaattcatttttatgattctgccaccaaaaagatattttccagtcacttctttgattccctaaagtatcttcctacactgaagtccaagggtaagcagaactcacaaaaaatgttgttctatcttgtactttaggcaggttaataattctcactgaggcataaatatgacttgccacattctgccactttcaatcctttgtgaatacacttcaaaagcaaaacgtgtttataagccctctaatatctgccacattacaataaatgatagaccaacctccagagtattggcttcgacctcaagcaaattatacaataatgtttccctcaaagtttttgtgcatgcagctccttctctcccagaagaaacatctaccatatggcaaaagtgacaacctcagaaaaaaaaaaaattaaagctgagttgaaaacgacagcttcttcagaaggtcagggcacaaatctctggtagcaaagcacaacacagcattttagagataaaaccttattacccaaataccgctatttcacagcacttaatattggatggtagtaaatctgcctgaggacatattgctctcatcctaggatgagtccaaaagattttaaccaccacggcaaagtaggggtggatgagaccatatgcagatgagcgttttagttcattacaactggattcatatatatatgaatttcatatatgttatatatataaatatatatcatatattcatacaggtaatatattcatacacacacatacgaatcacatttaaaaagactgaacttgtacagtaaataagggttgtgtttgcttaatagtcatggtgagaattaaagcaggaaatcttaaagaagttatacagaaaaaagcatctttattttttgatgtgccccatttttacctactttttacctcgctcaaacaagcacatgtatcaagcttcacagaacagaacaaacctctaagaatttcacttcttaaatagatatttagaaagagtatacgaatctttttatatttggcttaaaacatcttattagttacctataataaggcccaacttagaagctaagaaaccctttcttgaaaagcatgagtgtgtttctaaacaaatacaaatgcaatgaaatgaaagaaaaattcctctgatatgaaatgcctcctactgactttgtactggaacatttattttctttgtgtggaagatgtaggcagcatactttgcattaactgattatttggaggtatggctggaaggaggggactaggaagagaattggcttgatgcctgaactaatttcaacttcatttcatccaaaggcaaagggaagaattggccagtctttcagtgaggtggatattctttttcactcctcaaaaaagtagataattctcaagtgtgcctaatgtctgtaaggctcatttgacattccatcccccatttatcaactataaaaccttgtcccttgtctcggtatttcaccatgttaaaaggtatttacataccagtatgcaacctgaaaatagataaactaagtagacccaaatggaaaaaagggtaggcattgaatcactcaagaaagctgctatcttgtctaccccatttatttcttttagccccagggcaaaaatttttaaaagacagtggttgaattatattaaaggggatacaccggtagtaatttagcattcattcttttaaagttgttcttcacaatgactctgagaaaggttgtagcagtatcactgcatcaaaaataaagcggggaaaaagcccagataaattaaatagtggtctagacagactcacatgacagttctgccacagagtgggtaaagagactggatgacagacactgagcctgaaatcatttgggttataaagataaaataggtttccttcattaaaaattaatcaaataatctagactgggtggcttagagtaacttagtagtttgcaccactcagcaaatttgtattatggcaaccaacaaaatagaactacaggcatgtaagaaagaggctaacatagtcatgctacacaggtgacaatgtttaatttttgagctgagtttaaaagcacagtgtgtaaacttatattatgtatgtattctttcgaataactatatccttacattcagtcactaattatgtggttttagtggtcagttggagaatatgtatataaacatgcacataaaatcagtggattgtaagctacaacactactctaatttcttttgtctttactcttgctcattcattcaattcattaatttattcattcatttattcactcatttatgtatttaaaaatatttattgaacaccttctctttacctggcaataggtgacatgctggatatatacggtgaacaaaacaggcacagtcctcactttactgggttctcattaaccaaagaagttttatagatggaaaggattcacagctataatgttatataagttatttaaccgctttgagtctcagttgtctcttctataaaatggggttagtaatattttccttccagaattattatgttcccatcttgttcataatacgtatccctggttatctggtatatagcaggtactctatgtttattacagaactaatgaatgcatcaaaaatgaatatataggtcacttaagcaatgggtccacattatacagtagccagtattatggaaaatattttctcctcctttttaaaagtcactgtcacagataacaacaataaatgtgacaactcatatatgtttactctcacttatattccttgctaattttttttttttttttttttttttttttttttttttttgagacggagtctcgctctgtggcccaggctggagtgcagtggcacgatctcggctcactgcaagttccgcctcccgggttcacgccattctcctgcctcagcctcctgagtagctgggactacaggtgcccaccaccacgcctggctaattttttgtatttttagtagagacggggtttcaccgtattagccaggatggtctctatctcctgaccttgtgatctgcccgcctcagcctcccaaagtgctgggattacaggcttgagccaccgcgcccagcctttccttgctaacttttaaagataatatgtataatttttcaaattttatatttgaataatgctgagagatagagatagagtaggacttatcagccccattttccaagttaagctatagaaactcagtggtcacttggctttctcaaattaaaacaatcagtggtgaaaaataattctgggctgggtgcggtggctcatgcctgtaattccagcactttgggaggctaaggcaggcagatcacctgaggttgggagtttgagaccagcctggccaacatagtgaaaccccatctctactgaaaatacaaatttagttgggtgtgatggtgcacacctgtaatcccagctactcaggaggctggggcaggaaaatttcttgaatccaggaggcagaggttacaatgagccaagatcgcgtcactgcactccagcctgggtgacagagctagacttcatctcaaaataaaataaaataataattcctgaacccagattttctcattaagctctcagtgctttcagagaacacctggggagaggacatgtcaatgtcccattaagttggagactgattagtcaactgatgaccagtgatgcctgtcttcaccaagatttttgctcctaaattttgcatgaggtcaagcagcctatgagttcacaactctcaatctactgcacaccagacacttacttttgaacttccatgctcctagggcaaacaaacaaaaaaaaaagttgtcgggctgtgtttcgggagatgttgactcattttcagcacatattagaggcttaaaaagtgtttataagctgaataaactaatgttcttttcactaaagcagtgcttgaatgtattgcttaaaatgaggcagaaaattacattcaatttgaggtagcaaattaaattgcccttgaaggttttttataatctcgtggtattcatggaagagacagaccaaacatataacacacacacatagacacacacacgcaccccacacattagtgaagaggagaaaacaatttattctacctaagaagaggggaaggattatgattctaaagttctaaagtctatgctcttttataaaaggcaatttgttacaaaaaagagaagagtggaaggagagcaaagaagaaagaaggaaaatattggaaaaaaaacccctaatatttgcagagagacatgactatgggtcatggactatgctaggtactttctttatgaaaaaaagtgagtttaaaagtcagtcctcaatagtagcatcctctgctacttattatatgtttcattggtaagatactattttctgagtctgtttcaacatttgcaaaagggcataataatacttcatagagttgttgtgaggcttaaaattggttaaaatgtataaagcatctgtaatgcactttgcaataggcatgcaataaactactcctctttcatattgataatttcatactgccttgggttatcagatcttggtataaggtcacatattctctttataatgcaaaagccaagtcaaagccaagtctatgctgtgcttggagtcataagacaatattacttttaatcctccattaaccctggatcctctacagctgaaccctagaatcaaggtataaggcctcattggcagatgaagacactttaaatgtagtcctttcactgagttttgtatctaagctcctctgctccgggtactgtatgaatcctgcttacattcaatccaactctgtagtaaattgttattcagagtctccagtgtgatgctggcctcctacttcagaagaagtgctccaaaaagttaagcctcaaagatatattatttaaccaatcccttaaccatttcttttgcatgaaatagcggcccaaaaggcaactaagtacatagagatgattttttatatcttaatatatttttcctggcaaccactgtaaatgctccataagcaggtctacttaccacatcagaaatataggagaaattttctgaagttgaggcatgtgctttcattagtataaaaatgtgtttcacaaaattatttttagaatgtattctactcacaaagaactaagcaagaaattgtcaacattctattttgtgattcatgcatgtaaaaataaagtcggttgagagctattttgcaatattgaatctagcaaactgtcattcaaaagagctctcctttcaagaaaacaaaaacaaaaaacttcagtgaaggatactttactatgaacctcaggtgatagatggtattgttggggccacaaagcctattcaggtggcgtgttcaggtattcacctttgaaatgtactgaccactaccagcacatgtttttttcctatgttataggtttaaccagaaaagctacatcatccaagaaagctctggagaggtgacataaaatgtgatctccgtgtcctctgataaaacaaacctctccatgagttgttatttctacctgacaatggaaaagagcagactccccttacctcacaggttgtaagatccagaaattccactgtgattctaaagaacctcattctcacgcttctatcatatcagttgctacataaagaaacacaatatttgttgaatatttacctcactaatctctctagcagggtggaaaataatttgtattcatctctggatctttattgtggaataaaggtttctgtcatgatagacgcttaacaaatgtttagtgaaggatctctctccttcccattttctctctttctttaccataaacttgacaatagcagtcccacacggtacatgtcaaagaggtcctagacttccataatcagggacctctttgattatttgatctctcatggatatcttattttgaaatattgaatctgccaaacaaactagatttattgtctttagacatggcacttaaatagtgccaacatttttttgcgtaaatgtgataagaaatcatatttgttgagaaataacttgttttcacttttttttttttttttttttgagagggtgtttcgctcttgttgcccaggctggagtgcaatggcgtgatcttggcttaccgcaacatttgcctccagggttcaagcgattctcctgcctcagccacctgagtagctgagattacaggcatgtgccaccatgcccggctaattttgtattttcagtagagacggagtttctctatgttagtcaggctgatcttgaactcacgacctcaggtgatatgcccgtctcggcctcccaaagtgctgggattacaggtgtgagccaccgtgcctggcctgttttcactttttattagtcaaatacatatattactgccagacaaggctcacgtgctaaattccagtatagtacagttagaggtggttgtatgcaaaccaagggggattaaagctgagacagcacttataatactacaaatccaacctcacacacacaagtttttggttacccatagcttttatgtagcatggaccataacagaagttgccatgtacttccgatggtgcttcaaaggcaagcaggtgagaatcagtgggccttctgtgagattattatgctgaataaagtgaccctccaaacagaggcttctagataaacaacctaagccactataatttagaagatgtagttatgatgctgaggatctttagggtcagcaaattttgagatgggggcaagtcagctgtaggggggtactaggatctcacaaggctgaaagcctagatcacaagttctaccactgtaggcttcaggcacagctgtcaataagaaacccagtggtcaggaaagacaaagaaatagccatgcaggcagcaaggactcagaggacaacacaagctacaggttcctatcaccatagaggacacataagatttcttatccttccaagttgtttggtcaaggcaatgtgaagatttgttgacatttaaaaatagccctgataagaaatttgaacagtgaaattaattgtttttctagtgtgattgttaaatagtaaaccagtgtgattatggagtaatataatgaatttatctgaaaaagactgctttaaattggaagaaatcaagatacctttgattctaaaatcaagttttttcctccctttctttttttaataaagaggataaaatcagctattgaaagtttttaaaaattgcatttttactttgccatctctgaatatgtcaaatcccgtttgattaaacaacatggaggtcattggaaaccttagtaagaactggagtgtaactcatggggcacagtaaccattgcagggtggtttgtggagtgagacgatgatgaagaaatggaggcagcaagagaaatgcagccacgaagggtcaggagaattagtatagttacctggagggatggaaaaaaggactcttttatgttagcgaagaactgaataaacttaaataaatattgatggcagaggtcaagaaacaaaaagaaaatttatgaagactgtagatggaaaatacagtagaaaaaaatgcagagacatgtctaacttatctcaaggagaggctggccttttaaagcataataccaaagaaagaaaactctaaaggaaatactaacagagttaactacttgtatgcattggaaatcatctgatacaaaatataaaagacaaaatattgatgggttgtatataaagattttaaaactcaataagaaaaaatgtaaacatgccaactaaaaaacagaggtgtatatatatcgatttcagaaaagaaaaaatatttcaatccaatttgtaaacgtatgaaactatattcaacctcattagtaataaaatgcaaatttaaacaataaaaaacaattttgcctatcaaactggcaaagataaaaattagactatgttttttcctttgtagtacttaatttacaattattttataaactgatctgctcagttattttagtctcttacccactaaactacacatttttggggtaatagaatgtctgtctagttaacttttgtatttacaattccttgtacaatgttgggcacatgatgggacttccataaacatatattaatgaataagtgaatgtcagtgagggaacaaggtatttgcatactctgtgggagcagcaagtggtacaaaccaatctagagagcagcttgaaaatatctagccagtgccaatgccatattcgtcaagctagccattatagttttaggaatttatccaaagtaaacaatttttgtataatctaggacaaggatgtttatcaaagggctatctatattgtgattataagttatacattgtgatacacgttagaaggtaagtctgcatgacttcagagagtgcgccaaaccactacactgatggctttcagaggaaacccaaatggtgaaatttgttgtttaggactaggattgaactctcagcatacccagttctgacatacattccaatactccccagtgatcaaaaggttttcctttacatttagctccgaattaacctttctaatccttcttctgctaaagctctatgtaatcttttagtgctctaaataataattttactgtctcacagtactggaggctagaagtctgaaatcaaggtagtggcaaggttgattccttgtgagggctatgagaaatgatctgttccatgtctatctcctaacttctggtgatttgtcggtaatctttggtattccttggcttggcagatgcatcactctgatcttggtatttatcttttccttttttctgtacagacaaggtctcactatgcggcccaggctgcctccaactcctgggctcaaactatcttcctgcctccaccttcaaaagccctgggattacaggtgtgagctactatgctcagccttctgtctttgccttcacatggtgttcttcttatgtgcgtatctgtctctgtgtctaaatttcccttttctgtaagaaacagtccttattggattagggcccaccctaatgacctcatcttaacttcatcatctacaaagaccctcttttcaaataagatcatgtttacaagtactggagattaagacttcaacatcttttgggagggacataattcaaacaataccaacgcttaacatcttctaacatattctaaaagctttatttgcttatttatattatagatgttcccccttttcaatgtttgctcaaaggaggcaggaacattttacttattcattgttatatcccagggcataaaatcgtagcagccaacaatagatgtttaataaataagtgtggaatgaatggactataagccatttaataggggtagagagttggataagtaggaagaaggtgtgagatgttagaccagtagctgggactcagattaaaggccttttgtaaccaatacacttagaaatttgtctagctagttgtatccaatatctgcttatatgaaaacatactgatttactgtgctaaatactgtcaatgtatactttgttggagtattttgttaatttgctgcattttagtgatttaaaagtgataaggtatttttatattattgatctctcatacaatcctatattttattcactctctacatatttagtattacctacagatttaccaaaacagctctttaccacttaggagcctacttgtcccaaaaacaattcttccttctagaaatgtgaataatatatgtatgactgggtaaatctaactgttctaatttgctttttctctatcaggtttcttttaaattttttcggtctgcattgggattgactttaatatattcaagattcccccaaccccccttagttacatcatggtataaaaagttttagtcttcagctaattggatcaatcaggcatttagggggcaatatacacttcattgatataatcaagcgaggctgtgcagctgggtaaaccaaaaaatcacaagggggaaaaaaaacacaagcagtagccatttaagttgaaaaaacgtgtatggttttaaaagtacttcctccaacttcagagttcaacatacaatttataaaatagatcaccttttttggcatgttctgctagaaacttctaagttgtcaactcgttttcttaaaagcagtctttttatttcagcctaatgatgctgagcccagagaaagtcattcaatctgctggcagatgaaaatgaagtgaaacagtacactaaatgggtcagaggaaaagttgtttcagggacctaaacaggctttcttttacagtttttttcaggatgactgaagagatagtattatagttagatgtaatacaacagaacgtccttcaggcccaaaagaaaactttgaaatctaggaaggactaagaagtcatctactgaaccatgacacatttacagactagatggcatatgtccaaagggtgaagtccctgcagtccttctgggggagctttaagaggatggcagcaggaagaagtttgggtattcaggaaggcatctgtgagagaccttagcctgttacttgaattttccagggtgatctcaaggtcaattatacagtctcattatctatataaactgtccaaatgtcccccaaatttcaatgcccaggctacatgtctcagtactactcaaacctgaatgttgtacataatttcattttcaaatgatatattccaaagacagggtacatgatgtgagatggcctgtcatcttgcctcaaaacagccacgtcaggcagaagagtgtatggtaagaaaagaagtatatagttgctttttttgagaacgtaaattatgcaccactaaattcatttaccctgaaaatatttatagtatttttacattgtattagagacaaactgaagagataatagtaaccttaacctaaggtttacagggaataagatctacattttgccgattatggggtcttaaatatgagtacactttccctgcactcctccttgcccccaaaagcacttatgaaagtgagtgaactatgaattatatctcaataaaggactaaatttctagaaacctggtctttctacaatctcgaacttagaattttcataagacaattaccatatagtaatatataaatcctatattaaatagttaatattttcaagtactaaagaaagtacaaacacaatatttagtactataccaagtatttagaaatttctcaaaagttcttgctcataaagctattccctaactttatcaattaaaaaggtattcttgagatagcacatagtgaatttatgccaggacacacaaacaacaggcccagataggcctaccataattacaatctcaagaagggggagtatgagtctgaaactatgttctacacacaagtttccaaaaattaataaaatgtttcaaagtaagtcaacctatgacgttcttaaaaaaatcattgcaacatttttattctacatagaaacacaagttaaacatttgcttatccccttggaaacaagagaagaaatcacaccttcaccaacacctacagtaggcaaagatttattttaggcattgtcaaggatacaaagaaatacagagcacagtggctacacagggtgatctgtcagctctgcaactgtaagaaattatcaaacatcaaacatgtacaagtggaaaagtatatatatatatacacacacacacacacacatatatgtgtgtgtgtatatatatataaagtatatataagtatacgcacacatagacacacacacacacacacacatataaaaatctgtatatgatcgttcttaagcagctactaaggtaaaataatcatgtattactgcttctttagtactctatttgtgtccaacttgtgacctaaatggtcgtaacagcagaaataaaccactgctctccaaaacagacaaaaccaaactacagggtaaagatgcatgaaatttacacttgtaaacttagaagcaaatggccccagttgcttctcttcttcagtttgcttttagagaagtatctcattgaaagtggaactacctgttctgagaaacaaactcatacagagaaaaaaaaaaagtaagaagaggtcattattaaaaaggcaaacatattacaaaacatagggttaagatgatgcaattaagatatttaaatcagaaaaaccaacacatacatgtacttcataaatagaccagtatatgtgtagcacaccaacacacattcccaatagtgatagccagggtgtgtggtgtcttctttgacaacatctagaaagggattagagaaaacataagtggtaaagctggttttaaaagaagaaaaagatgaagttcacatacaggcagaaggaggcagcttaggaaacatgagcatgttgaagaatggagaaacagctgtccagagaaacagggaagacaggtcagtgaagtggcaaatgagtcagcttagattattgacgcctaagataaagttccaatgttctaatggtaaatatgccatagcatcttctaaagtaggtctgagccctttgagtggatttgtatgttgcgtacttgtatgaatgtttatatatacatacatatacatgtatacacacacatacataaataaatggtatctattttttcgtgttcctaccatgagcaggaagttttggtgtttctttcaccctatagaatttcattcattcattcattcatatttgtctagtgtttactctcagtcaagtattagggcactaggatcataatgatgaaccacatctgagtgtattgcagcaggtatgaggtgggggtcatgggagatgcagatggaaaggtgactcagttgtaatcacaatgggccttatatgcaaaggtaggggaaaatatttgggttgaagagcaagaaatcaggaaacaaaaggaccaacaaaaaacccaaacagtgatgttttttctaaacttaaagtcaccagtcactattgattttcctgtacagaatggttttcttttgtgatttttcaaaattacttatttatcttttaaattgacatataaaactggatgcattatcatgtatgacattatgtttctggccatatatgtatgtgaatatgacccttcttctacttattgttttttttttgtcataaactacaaaacgtttgaacacgtacacacacaaataaacaaaagcacaagagaaagatatttattctgatttgtgtatcaggattacctctttattttaattttgatgtctcacatgaagctttccaaccctttctacattctagatgcttacatatatcaaaagcagggcatgacctgttttttgttctggctttagctttagtccaaacggttaaacagctggaggtaattatcaaagaatttagtatatgcccagcctattctaagtgattaaaaaaatgttcagtttcacattggattaccactggggcaaagcagattcatcagggtgttggcaagatacctgatatctataagctttaagcttgtagttggagaattccaccatgcgttggggtggtaatgtgcagatgcttagaaacatacaagaagcatgataaaataatttgactccctattatagtctcctcaccttctcagttggcaatgattcctgaacacacacatcacttaaagaaatgagcacaaagataacgatacataagaaaaactgaaaaaactctgtcactgaatactaacaatttttcttttaatatagcccttaatttattgagaacctactatgtgcaaaacactgtgctagtaaacagtatattcactggtaaacaaaacaaggatgattacctgatttcagagtttagtatctaatgacagaagcagatattaaaacaagaaataagcaaataggaataaaatagccagtactaagtgagagaacaataacaggggatagctaatttgaattggaaggtctaacacagtttctttgagggagtaatggttaaactaagacctgaaggatcactaaaaatgaagtggatgaaacagcacttcaacagaattagcattattttaaatcttggatttttacggcatgaaaatatccatgtgtcttaaacaggaaatggagaaaagtaatcagattattagaagtaagcaaacaaccagaatatctttaaagaaaagctatatttacagaagtaggtctgaacatcattgcctttgaccaaaagtcattgtaaatgtattgaatagttgtaaaaaataaatgaaagtttaaacagttaagtcgaggttggcatgctgtagcataggcaaccagacaggaactttgaaggaatacttttccctcaaatgtttttcttctgagatagcaataatatgaggccacaagaatcagaatatatttaaaatgtaaaaagcaaatccaaagtctaatatcttcaacaaaacaaaattccagtgaatcccagggcaaccagaggaggaaatatattctattcttattattgatgtttttagttttagaggtgtaactgaggtcacatgacttcttaggatagtgacaaacaaagaaactggtagaagtatcatctcaaaatggccagtgtgggctataggaggtttgtacctgctaaatatttataggattattttatttaaagcattctgttttaggttagagttggttccaaaccacatacaaaaaattgtgtaaaaagttggtagctaaactggaagcagttcatttccatttaaaactacttcactataaaattaatcatttttgttttggatctcttgagagagaataattttttccttcttcttcttcttctacttcttcttcttctaaatagagacagtgttttgctatgttgcccaggctagtcttgaactcctgggctcaagcaaccctctcacctcagcctgtttaatagctgggactatagatgtacacccctatgcccaggtaaaagaagacatattttgttcaaatatttcatatatttcataaccagacaaggaacaatataggatatctggcttttaaactaatgaggtagctgtgttgagcctgggtaagtccttgtaactctgtgacattccatttcttcatttgccaaaatccgtaaaaatgatagtgttgaattagctgtcaaccttatctagctctaatattttctgattcatgatatggatttcttactttggtagatacccattttcctttcttccttcaggtatttcttactatgtgcctgtactcggttagatgctgggaattcagctacaaaagatactaccctcaaggagctctagttgagcacagggaaggaatggggtgactgcctaggaaacaggctatcatgacatagcgtgaaatgaccttgggtgctacagtaacatctagggagagcttctgatccaatcagaaacttaggtagaaacagtcttcctgaggaggaaggaataaacagattcattttgcaattatcatgtcacagcaacaatacagtttacttccttggactattttcttaggctcacacaaaagaatacaggtaatttcaatttgggttaagaagtgctatttattaaagcctaggtatctactggaactcagtggatgggtatagtcagcatgttatttcagggcttgacaatgctcaaaagcacattcatatttaaagcttagcttcttatcttctgaacacccaactaggcacacacacagtgtcttctaacctggttaattccaagtcacccagtcagcagggaactaggtacagttcccaccaccaaagatttgaaggtctctccttcccagataaaaatagaattacatcacatgtagtcttgtctcaagagacctcttttgttatctgtgtgtgtgtgtgtgtgtgtgtgtctgtgtctatgtgtgtacctcaactaatttgaaatggagactgtttttatgtttgtacaactgatatatttgtggagtgtcctgatacttctacaacggaaacacctgctaattccaccctctcccttttctgatggtgcctgaagtccagccaatatagggtagtcattacagcacccacccagactagccaaggggtgaagggcaatgatcattttgaatggcaattgccatcttaggaggaaacataaagtggctttcttctgtttgggtgactaaagtcaaaataaatctgctctattccatttcatttattactatctaatatattacttatctattaggttagtttacttaatgtttaccccactaaaatataagctttctgagagtaagaatttttgtttactgctatatgtactaagcctagaacagaacagaacagaacacatgataggtgatcagtaaatacttattgactgacagactgagtgaataaatgttgctcaaccagcagagactcaacatttaattccctgactaggtagaatctagatggaaaattttcacccataaatggctacaaaattgtggcagggaagataactaggatgctattttcttttctatttaatcaaatatacgttttttaaaggacaagaaaaatggggctgttattattttgagcagttaccaaaggaaatcaacaagtactggacaggggtcagtaaatcttgacgaagacttttaaataacaacagaggggaaagaagtccaagagttaaggattatgtcagggaaggatcctagaaggacataatatcaagttcacatatgaagtttgagcaggcagtagtcaggcaaagagagtagggcatggagaagggcatttgcagaaaagaagagtgagaaatgcaggagcccatgagtttgaaaaattccacgtcatgccgtgtggttggagtacacatgcaagaagggagtggtaagaaatgagctggaagcttcagtgagaggtcgaacatgtaaggcttggttgccttattccaagaaggtcggaatttatctaaaagtcagtgggagcataatgagtattatggtttatttgaacaaagatcacactgggcgcagtgtgagtaatacattgtggggacttaagcctgggacataaagactagttaggtggctgctctaattctgatgagacataatggtggcttgaagtgggtagttgtgtctgggaaaatacaggtggaatttaagagtaatttgagaggtggaatttataggacctagtggctgactagacgcaaacagtgagggttgttttctggctaatcagatggcgatcccaaggtgagaatataaaaggagaaagaatgttctagatatccacagttgcatgatttttctctatccctggctttttcatacaaaccctaaatattgagtaacttacttaacttactaagccttagtttcttcatctgtataatggtttaaataacatctaccacataggttcacagcaagaaaaatgactttcatagaagttatcaaaatagtagggatgaattctgaccctaccatttaataaaaatgtgattataaatttgagttactttactaaaatcttttgttttcctattttgaaaatgaagataacaaaaggtaaatgcttgttttttgtggaatttaaataacataatggaggcttcagtagtacatctcactatttaggagctgttattacatcatcatcacatctgtgctataagaaaatgagatatgagaatctattctatctagtgaataatctaacgaagtgaaggatatggtttcatagactcgagaaggacaatatgtaacatgttaatagtaagtacatgagacaaaaagatgaacaggacgtgactggctagaactgagatttttaaacaaaatatgaccgtaaacagtgggtcagaaactttgcagttggctaaaagttaattgtgcttatggtcaaggcaaagtctctggagagctctacgtggcatgggaagtagataatagtactttgttaaaacatagtgtactctcattcatgctcaataaaacaggagattcatttgctgggagctgaaagatctattgcacttactctactcatacaaagtaggaggtaaaaatgtctcactgcatttttcttttggaatttctaccagggattctggcctattcaagggaacctcatgccaaatgcagaactgaagggaggaggcacagcagaaaaaaaacactacaaactattccacaggctcattctaaccagattgtggtcccagggcaggaaagggggagcttttgatgagaatcacagattttctggtatgcagtatgtctttggctacaactgtgtaggttgtggcaacttaccagacagccagaaaattctgtggtggcttggggcctggcaattcagtggtggcttctaaatctttagaaggctcaactttctcttgaggttttgaaactatgcagctttgacatgcctcatatgaaactgtctaagcatggttatttaatctccttttctggactttttaaaactcacaaccatactctatcattaaagagaaaaaaatagccccatgtattcacaaagaagctgagttttctgtgaatgaggtttcggcaatgctggagggcataattttcaggtgacatgaccaaattttatgtgtgtgtgtgtgtatgtgtgtgcgtgcatgtttcaaatgctgtctgcacatcttgtgttcgttattacaggagatatttcatagctcaaacaaatttaggaagcaccaatttgttctcaaggttattatcaacagatgttttattattttgatcacacaagacaagtctctgaaaagacctgctctatatggggcactcaacataaactaatctgaaagtatgaaagaatgcttccaccatatggttcagtctgcatgtggctataaattgtgcattctagatgtgaactgggttaatattcaatttcctttctcaggattctaagaatgatacacagccttctaagactaattcattaattcaataaccttgagatttaaaagatagctgatttcacagtcagtgctgccttcatttaatgccattactctttcttccctactgatcacaaatgcagattctatgttcaaagtgagaaacatccccttagaaaccagaggcaagaatccccttgttagctgttcaaatgccaagctttccaaagtgaaaattataatactatgtgaaacaatacagtcagccctgataatcagtagaaatagaaacactgaaaccatagagcaagtggttctttgtgaaattttggatttgaacaagtctcagttcaaatctcagctctcccacatcctggctatgtatgcaatcttatactagttacttaatcactcaacaccacagtatgcaaaatagatatgacaataattacttcagagttgctgcaaggaggattaggtaaggtaatacaatggatggatttaacaacaaagatcagatttccagaacatttggggaaaaaattcccttcttattcagaacagccaagtctgagtgatgcataggttgtccaggcagagcagtatgctgcatttcaactgcatctgaaagtgttgccaaaggatttgatcagttcacctaggagcatcctcgaggttccaccaaacatgataggtcaaacgtgtgttgtaatgtcgatcaaaccaaacaggctgaagacagcccgtccctaaagtaatatgcttgaagagaaggggattaactaacactgacacaagtttaattttgaagcagtaataaatagttctcacaaaatattttgtcacctggatattttatcattgaattcaggaatagagaaacatactacaactaggaaacattcactttaggccaggcacggtggttcacgcccataatcccagaacttcgggagtctggggcgggcagatcactttatgtcaggagttcgagatgagcctggccaacatggtgaaactccatctctactaaaaatacaaaaattagcctagcgtggtggcacatgcctgtaatcccagttactggggaggctgaggcaggagaattgcttgaacccaagagggggaagttgcaatgagccgagatcatgccactgcatcccaaactgcatggcagagtaagactccatctcaaaaaaaaaaaaaaaaaaaaaattcactttaacaactggccaatggaaaaggctgggttttcattttaccacagcaaagtgaataagaaagattattttttccttttatcaggtttgtatcatggaatagttacatagaacaagaagagtcaagtctagttgacattttatgatagcttgccctgatcatcccattcacatgtctgtctccccttctacctttaatctctctgagggcagagactgtctcattcatttcctattcacagcatcttacacacccgccacagaggtgatcaatttacacttgttgaataaacaacccatgaattccaggcaccacagtaggcattcaatgcatatttataaaatatgataacattttaggagggagaataataatcaggagcattgccagagggaggaaaccatataggaaatagttaaagaaatgtggaggtagatgaatcttcagaagagaagacgaaagggaagagattgacgctggtttctcaaggcctataacatgaatagcaattggactagtagtaataataataattactattaacaaattattatataatacttattagggctaggcactattctaagcagtctattttctatttttggacttacttagtcgtcacaggaatccttggaggtaggtattattatcatccctgctgtacagatgagaatactgagccacagtggggctcacattcacaaagcaggtaagtgttaaagctacagtttgatttcaggctaaatgactacaaaggccacactcgaaacactttgctgtatttgtaaaaatacacagaatttagtagaagaaaattcaaaccagtttaagaaaacgctttcaaacagtaattgttccaaatttagagggctaaagagttctcactggaagtacaagataaaaacttggtatgtagaaatgtctttcatagtacttaatatttataattgttgcttttagaaaagtaaatttaaatactttggggtgatttaaaatccaattttttataagagaactatttcttttgatttcagcttagtttggatgagaaatcaatgaccatattttgacattttcagttagtttcacctgagtaggatgattaactgaaattgtatgatattaaaataaaacaaaaaaaccacagtcacaagagataatgggaaaggaatcaagctgtaagttaaagatgtgaatttcagactgccctttgctatgtattgagtgacccttgggaacccatgtaaacacctcctgagcgtttgttttcttatttgcaaaatgaggagcatcatgtttccttttcctatttcacagggcactttggagaataaaatgaatatctaagaaataatttgaaaatagtgacgtaatatgaaatatgagatgtatcataatatatacattatgtcaaacaagtaaaacaataatgctgcatgcatacaactaagcatctcattgattttaagtttcagaaaatatagatacgtttttatgagaaaaatgtctacaacacaattggaacactgatttaactgtattcctattcacgagttccaaaaatgctaaacatgcaggatgtgatgtcacttttgttattgtttttccctggagttagggcaatgttacggagctttgaataagttaggcagatgagcagggagaagtatggcttatttcccaaacattaaggaataatcacaaacaaaaataaatgtatctctatctacctactgttttcatctttctctctcagctgctttcaggctttcaatatttacctttgttatctggcttagttttccttttgataggtgggcttaagtcttgaaggcaatctgactatatcatgactagtgagagaatgaatatattactccaaaaagtcttccatattttccatgtttgctggtcacatcttagtgatttaagacagattaaccagctctgccatatacttgttatgtgacccgggacaaatgtgttaacttctttgaaccacagtttgcttatctataaaacagaggctcaaaacttatgtaacatgcttattgttaagatataaaagagccattgtagagtgattagaatataaggtccaaacttcaataaacaatagagagttatacttactgttacactgccactgctaccagcactagaaacagatgcactgagcattggtcccaacctccaaagaatattcttttttcttatttattttcctatctatctatctacctacctacctatccatccatttactatctagtgacatgcataactgcatacaattacatgaaagaaatatatgcatatatataatatagaatatagaatgtatataaatatatatgaaacaacatacttattaaaaagtatgtaaatgaaaatgtatagacatatgcatacatatatttgtacatatatgtttatacttgtatatacatatttgtatatctgttacatatatgcataaacaaacacacactctcaggaggaaaaactagtttttatcctttgtcttttgctggaaagctaaattgattattctagtgataaaatgccaaatgaaaaaaaataaactaaggaaaaatttagccctttagggccttaaacttttggactccagattttcctttggttcagctaaaatcaaagtgaacaggagccaagttagttaacattctattagtggctgcaggtgtctcctcaaaaaaattatttaactactagaggctcatcattgagtagtgataaatctgcttagttacattggttttattgagccatattttagttcataggtttgtatattaaaatatctacaggttttttttaatcaatagaatgtgaaataataatctctggaaactttagttttctaatcataattcagtgattctaagaaaagaacagtactgattccattgttttcaacctggaatttgtatatttaacttttttgttggttatttttgctgtaccccaaatatatctgactttccatctttctagctccaggtagaaaggagatttgctggccgggcatgatggctcacccctgtaatcccagcactttgggaggccgaggcaggtggatcatgaggtcaagagatcgagaccatcctggccaacacggtgaaaccacatctctactaaaaatacaaaaattagctgcacatggtggcacatgcctgtggtcccagctacttgggaggctgaggcaggagaatcgtttgaacacaggagaatcatttgaacccaggaggcggaggttgcagtgagccgagatcgctccactgcactctagcctggagacagagtgagaatccatctcaaaaaaaaaaaaaaaaaaagaaaaggtgactggctttcaggccagtaaaatgtgaataaagcattgtgtgtcattgccagagataaatttaaaatccaggttgtgattacaaaggtgaacacatcacgatgaagtcttggtcagtgtgatgattaattttatgtgtcaccttgactggcttaagggatacccaaatagctgataataacattgcctctggtgtgtctgtgacggcagctctggaatagattagcatttgaatcagtaggctgagtaaagaagttctccctcaccaatgcgggtgagagtcatccaatctgttgaggtcccagatagaacaaaaaggcagaggaaggacaaatttgctctcttctggaggtgggacatccattatctcttcctaccttggaacatcagagctccaggttttcagacctttggtctctagattttatatggatcctgccccttgttttcccctcttctcagatgtttggcatcagactgaattaattgtaccactgactttcttagttctctggattgcagatggcagattgtgtgacttcttgtcttccataattacataagccaattctcatactaaatcccctcatatatatatatatgtcctactgattctttttctctggagactctaatacagtgagtctctgtccttggaagactaaaataggagtaagatataaacttgcaatctggtaggtcattgagatttttcggtaacctatcctgactgatacagtgtctttgtagaatttcagtttcaacgttgagcatctaccttgtgccaggtgctgggaatataaggcgaataaaatatgatgctcattttttagtcagtatataaaaggtaggcacatgtgaacacatgatgagaagaaagccttgaagtaatgaagagaagggacaagctaactctggggatatttgacaaggcttttcaggggagataacatattagctgggttttgaatgataagaagaagttgatcagttaaaaatggtaatagagtgaagaataattttagaatcaataaatctgattggtaatattgagttaaatccaaggtgacatttttctaaatgactacatgtgcatttttaatttaagctaagtctatatagaccaaacatcttaaactttaaaaccacgtaattcaccaaacaggttttaatgcctattttcataatacatacattcttttccttcaaacaatagataatttgagagtttaaaatgcatcaggctcatcaacatcaaggtaaatggataaaatataagcttgtaaactctgaattctaacaattgctcaaatgcttgaaataatttcagtttttcctaatgtacatctctgtgtaactaggctctatttcgagctactagtgtttttattacttctctgtgcgtttttccttttcctttcttcccactgaagcaggtattcattgtaggaggaagcagggagaagcagggttgaactcagaagcagcctgtaaagatttccctgcttttgttttcaaaacctaataaacacgttagaaaattaaagggtttggggataaggtacaatggagaacaggaattctctacaaaagcacaaagtcttgatgaagaagagaacaagagtgaggtttccaaaattgggggtgggtagggtgaggaatgattatgttgactaagaaaggggagaaaatatctgtcagagatggacattttaaagcatgtctaagaagttggggccctatgcagtttcctaaaaatttcatgacctgctatgtaatagggttttgttgtttactttcatatgacaaaagcaccaatgcaaactggctaataaactgtattcatagctttctgtaataaaaattcagaaggaaagtttcaaagatggtttgatttacggtctgtagatgtcaccaagcctgttttcttaccttcatttatctattctgccatctaaaatgctggtttcattctaaagatggaaacccctacagtcacaaaacagcttcaagctactcttccagatacagggttccttacttcgtgctcatagagaagggtgggcttctgcctcaaagttctaagtaagaatcatggaatttgctctgattttactggattaggttgcatatccaccactaatggaggccagggtatcaattggcctaaatcagtaaaaacccacccttgcaattcagagtcatgtcagcttctagcaaagcacagggattatctgaaccaaaatctagggacaattaggaaggggtaggaagaataacatgaggagataaccaacaaaggtccactattgaaagaaacaactcagagaggggtaatgactatcacagcagttatttgtgaggataaaccaaacaatgtgtgggttgtcttgtcactgtgtaaggacatagaactgctggacaattctgcagatgactgaagtagttgggaaagcactaggaatgactgaagttatattttttgccagcctgagagttaagctacagaaatatagagccaaagctgttatgatttgttcagttgcaaatagcaaaatttccagctttaccatttctcaagacctgtaatctagtgacccaggtattattcagatgttagacctctttgtgtattccctggatctttgttatttccaatattctcagaatctggtaactccatcagatcctaaactcgtacccctgagttagatattttcttgccaaatctccttagccacccacaccttgtttttacaaattatggaaataaatctactttgattagaacattcaacttggggatacagctttgtcatttctatgcaagtctttccattgcagattttgtctaaaagctgttagttttaaaagtacccttatacagtcatgtgttgcttaatgacagggatatgttctgagaaatagattgttaggcaatttcatcattatgtgaacaccacagaatgtacttaagcaaacatagatggtatagcctaggctacatggtatagaccattgctcttaggatacaaaccagtacaatcaatatgttaatactgaatattatagacaattgcaacacaatagtgaatatttgtgtatccaaacatagaaaagttacaatacaaatagggtattataatcttatgggaccactgttgtataggcagtttgtcattgatcaaaatgttgttatgtggtacatgactgtcctagcattagatgtgctggtaaaaatcagggccatgtcaaagatggggtaatattgtaacaagtgattcgcagaagaaaatatattggtcagtttagatgatgtgagggcagtaagacttggactaatgaactggaagacagcacttgttaataatcaggtggcagagggtttgtgaggcgagagaaaggagataactcagctgagcacttacagagaaaaatggagaaggctggagtcagcagctgaatttcagctaaatgcattttgtgccgattcatctaactcagccctttgaggtatgtttactaggcacttctcattcctgacactttgatgcttacatctaaagaaaagttagattaatgcccctccgaatgtctgtaaactatatttctaacacacacatttttttccctgacatctgactcagatagttaacactgcaaaagcactttgcacacacaaaagccagctggtttccaaatcagaaaggtttctaggcagtggagacctaaatttgcagacctgtccctagtcattctttttacttgccactttaagaaaaattgctctttcattcttggaagttaggacacagtaatgagttaaaggagactatatgtataagctttggggtattaaggtttatggcaacctgccaatgttgttctactggagagctttgctttatcatcttactccatggtgaaagacatgattagaatttagaaaaggtctaaataataatttaattgtacattttaaaataacaaaaaagtataattggattgtttgtaacacaaaggataaatgcttgagggatggatactacattttacatgatatgtgatattacacactgcatgcctgtatcaaaacatctcatgtaccccataaatatatacacctactatgtaccaacagaaattaaaagtaaaaattagaaaagaatttagaaagaatttagaaaaagaaattagaaaaataattagaaaaataatttagaaatgttgcattgcatgaagaatctatgcaatgcaacatttattttgagaacaggctgtggcaatatgaccctaggacatgacctacctgacaacttcagaatagtgatagctaaagtacaacttcaagatacatttgtataaagccccacttgttggcaagttatacattcctgatttggggtacctagatataagaggaatttaagggaaggctcatgtagacataggaaagagggtggtggtttctgattgggtccttgggacagttataacatgggaattggaagttgccagttttctctttctccttctttccctctctctcatctccagtctctagctttctctgcaggaaggctcattatttcagatgacattacttcatatggcaaaaagaccacatagtggccacttttctgtattgtatgtcacactttactacacagtgggaatgctgccccctctctgctcccatactccactgtagaaaatcctgagaaacaatctgcttggcttgatttcgctcaggtgccagcttctaaactgcacatgtgaccaccaagatagttctaaaactaaagattttccatgctccagccccagaggttcggatccattgggtttagttgagattcatctggtctaattatcagtattatttcttactagctaacctggttattccaatgagcagctctagacaaatcaactgtgtgaccaggggtactatgactgcattctttcccagaatcacggggttggaaagaggagaagggcagttccctaaaaggaggaggatgctttttaaaaagaagaggtgcttttaatgcacgacaaaacactagctgtttagcattttatatgcagagattagaaatggggagtcattaaaataaaatattttaaaaaggtatcagagcaaaatatcatagtctcaaactattgaaaataaaacactgtaatttcttatctagcctggaactaagttctcatgagttaataaagaaaagaaaagagttgcagagtgctatgttattctagaaaaaattatggttgtaaatcaaggacagattccacttatatacttaacatacttaaatatatattaataattgggcatacacacatttcagagatcacttaaaaagcatactattaaccacaaatatagtcacatatgtgcacacatatacacacgcacacaaagtagaagcatatatttgccttttgatatagtcaaataatcatagcctaaagttatacaaacaatgtcatctttaaaaaggtgggggtagataaatgtttgtgtataaacattataatagctaataatactgataatctagtatctagttctaggaactcttttaggcattcatatgttatttttatttttattttttttaccacaatgctatgaagtagatagtagtaccccattcattacagagaaaactgaggctttaacgggttaagtaatgaacggtcattcaggaagtggctgattctagactctaacaaggtctgagttcaaagactgtgcttctttccaccatttttatttttatttactttttgttttataataaaaaaaatcttctaaatttgatatttctgatttttccttggaattttacaaattataattttttccagctattactgtagattccaggggacatgtgcaggtttgttataaaggcatattgtgtgacgctgaggtttggagtacaatcaaacctgtaacccaggaagtgagcatggtcctaagtaggatgtgtttcaggccttgcaaccttccctccttccctctcccctctgatgttccccagttatctattgttcccatgtttatgtccatgtgtatccaatgtttaattctcacttataagtgagaacacacagtatttggctttctgtttctgcgttagtttgctcaggatgatggcctccacctgcatccatgttgccacaaaggatatggtttttttatggctgtgtagtattccatgtaaatgtatgtatattttctttacccaatccaccactaatgggcacctgggttgattccatgtctttgctattgtgaatagtgctgtgataaatatataggagcatgtgtctttttggtaggatgatttattattctttgggtagatacctagtaatgggattgctgggtgaaaaggtagttcaactcttagctctttgagaaatctccaaactgctcttcacggtggctgaagtaatttacattcccatccacaatgtaaaagcattcccttttctccacgtccctaccaacatctattattttttgacctattatcaaaagccattctaactggtatgaggtggtatctcactgtggttttgatttgcatttctctgatgattagtgatgatgagaaatctttcatatgtttttcggctacttgtatgacttctcttgagaagtatctgttcatatactttgcccacattttagtggagttatttgtcttttggcctgtttatttgtttaaattccttgtagattctgaatattagacctttgtagatgtatagtttgcagatttttctcccattctgtaagttggttgtttattcccttgatagtttctctggtgtgcagaagctccttactttaattaggtcccgtttgtcaatttttgtttttgttgcgattccttttgaggattttgccataaattctttgccaatgccaatgttgagaagggtatttcttgggctttcttttaggatttttatagtttgaggtcttatatttaagtcttaatccatcttgagttaaattttgtatatgataaaaggtaagggtccagtttcattcttctacatatgaatagccagttatcccagcaccattaattgaatagggaaccctttccctactgcttatttttgtagactttgtcaatgatcagatggctttaggtgtgtggctttacttctgggttctctatgctgtttcattggtctatgtgtctgtttttgtgccagtaccatgctatttggtttctgtagccttgtaatgtagttgaaatcaggtaatgtgatgcctccagttgtgttcttttgcttaggattccttaggctactcagcctcttttttggttacataagaattttatttatttatttatttattcattcatttatttatttaagatggagtctcactctgtcacccaatgcaatgacattgcatctcgtgatgcaatgacatgatctcggctcactgcagcctccacctcccgggttcaagtgattcttctgcttcaccctcctgagtagctgggattacaggcacacgccacaatgcctggctaatttttgtatgtttagtagagatggggtttcactatattggtcaggctggtctcaaactcctaacctcgtgatccacccaccttagcctcccaaactgctggggttacaggtgtgagccactgcacccagccacatatggattttagattagtattttcttattctgtgaaaaacaatgttggtaatgtgataataatggtattgaatttgtaaaccactctggtcagtatggccatttcaacggtattgattcttccaatccatgaggatggaatggttttccatttgtttgtgtcatctctgatttctttcagcagtgtttcagttctcctggtagagatctttctcctttttggttagatggattcctaggtttttaaatctttttgtggctactactgtatcctgctgtaaataggattgcattgttatttggctctcagcttgaacattattgttgtatataagtgctactgacttttgtatgctgattttatatactgaaactttactgaagtgcttcatcagttctaggagctttttggtggagtatttagggttttgctagatagagaaacatagtattttatactctcatagaatatacagtatacatagttttctattctctcagtaaagagagacagtttgacttcttgtcctatttggatgccttttattcctttctcttgcttgattcttttggctaggacttcaagtaccatgttgtaagagtggtgagagtgggcatccttgtcttattccagttctcaatgggaatgcttccagctttgtccatgtcatatgttgactacaggaatttcatagatggctcttattattttgaggtatgtttctttgatgtctagttggttgagattttttatgatgaaggatgttgaattttatccaaagctttttctaaatctattgagatcatcatatgaattttgtttttagttctgtttatgcaattaattacatttattgatttgcatatatggagccaacctcacatcccagaaataaagcctacttccttgtagtgaattaccttttggatgtgctgctggattcagtttgctagtattttgttgagaatttttgtatctatgttcacatcagggatattggcttgaagttgtcttttttgctgtgtatctgccaaatttgggtatcaggatgacgttggctttgtagaatgggttagggaggggtccctaaccctagatttttttggaacagtttcagtgaaactggtttcagtaagattggcttttttttttttctgattcagtttcagaacttattattgggctacctagggtttcaaattcttcttggttcaatcttaggaggttgtatgtttccagaaatttctccattttctctagattttctagcttgtgtgtatagaggtgatcacaacagtctctgaggatcttttgtatttctgtgggatcagttgtgatgttatctttgtcattcctgattgtgcttatttgagtcttctctttatttctcttattctggctagtggtctataaatcttgtttatctttttaaagaaacaactactggttttgctgatcttttgtatatatttttgcatcttgattttattcacttctgctctgatttcagttcttttcttctgctagctttgaggttagtttgttcttgtttttctagatcctctaggcgtaatgttagattgttaatgtgagatctttctaacttcttgatgtaggcatttaatgctataaacttttctgttaacactgctttcactgaatcctagagattttagtatgtcacagctctgttttcattaatttcaaagaattttttatttctgccttaatgttattattcacccaaaagtcattcaggaataagttgtttaattcctatgtaattgtgtggttttgagagatcttcttggttttgatttctatttttattgcactgtagtttgagagtatgtttggtatgatttttatttctttgcatttattgagtcttgctttaccagtaaagcatgtagtagatcttggagtgtgttccatatacagacaagaagaatgtactttctatcaatgttggatagaatattatgtagatgtttattaggtccaattggtcaagtgtctagtttaagttcatgattcctttcttagtttgctgcattgatgatctatctaatactgtcagtagaatgttgaagtctcccactattattatgtggctaagtattttcatagatctagaagtacctgttttacaaactgggtgctccaatgtttggtatgtatatatttaggatagttaagtcctctttgaattgaactcttcattatcatataatgcccttctttgtcacttttgacttgttattttaaaatctgtttgtttgtttgttttttctgaaataagaatactgtcctctgctcttttttgttttctctttttttttttttcagacggagtcttgcactgttgcccaggctggagtgcagtggcgcaatctcggctcactgcaagctccacctcctgggttcacgccattctcctgcctcagcctcccgagtagctgggactacaggcgcccaccaccatgcccggctaattttttgtatttttagtagagatggggtttctccatgttagccaggatggtctcgatctcctgacctcgtgatctgcctgtctcggccccccaaagtgctgggattacaggcgtaagccaccgcgcccggcctcttttttgttttctatttgcatgataggtctttctccattcttttactttgagactgtggttgtcattatatgtaagacaggtctcttgaagacacttgggtcttgtttttttatctagcttgccactttgtgcattttaagtggggcatttaggccatttatattcaaggttactatagatatatgaagttttgatactgtcatcctgttgttagctgttttgtagacttgattatatagttgccctatagggtctgtgctatgcacttaagtgtgttgctgtggtaacaggtatcattctttgatttctgtttagaactccctcaaggacctcttgtatggctgatctggtggtaacaaattcccttacgcttgtctggaaaggattttatttctcctttgtgtatgaaacttagtttggctggatatgaaattcttggttggaatgtcttttctttgaggatactgaaaacagaccctcaatctcttctggcttgtaaggtttctgctgagaagtctgctgttagcttgatgaaatttcctttgtaagtgacctgaccctttttcctaggtgcctgtaagattttttctttcatgttaatcttggagaatctgatgactttgtttcttggggttggtcatcttgtatagtatcttgcagcggttttctgtatttcttgaatttgcctgtcaacctctctagtgaaactggggacatgttcatgaattatatcctcaaatacattttccaagttgtttactctttctccttctctcttgggaataccagcatgggttgtagtttagttctccttacataatcccatatttcttggaggttttgctcattaaaaaaaaatattttttctttatttttgtctgactgtgttgattcaaaagaccagtctttcagcttgagattctttcctcagcttggtctattacattgctaatgcttgcaactatactatgaaattcctgtagtgaatttttcagttccagaactttagtttggttctctcttaaaatggctctgtcatctttcaactcatggatagttttactggcttccttggatttctcctgaatcttgttgtgtttccttgtcatccaggctttgaattctgtgtctgtcatttcagccattacaatctcattaggaactattgttgggaagctgttgcaattatttggaggtaaggagacactctgaatttttgaattgccagagtttatgcactgattctttctcacctgagacggctgcattcctttatcttacattgctatcacttggacaggcttttgaagtttatttttatttttttgagacagagtcttgctctgtcacccaggctggagtgcagtggtgtgatgtcagctcactgcagcctctgcctcctgggtttaagcgattctcatgtctccgcctcccaagtagctgggactacaggcacacgccaacatgcccagctaatttttgtatttttaatacagatggggtttcaccatgttggccaggctggtctcaaaatactgacctcaagtgatccacccacctcagcctcccaaagtgctgggattacaggcgtgagccactgcacccagccattaatatttttaaatacaaaagtaatacatgcttattctaacaattgaaatcatataaagatacataaagtgaaagcaaatcatctcctttagcctcatcttcaaccccatccccttgagctgccaatactcacacctgctgtagactttccacattttccccttgttctttcaaacagatgcaaatgcacatttacatacagatagatacttttaatactttaagttctagggtacatgtgcataatgtgcaggtttgttacatatgtatacatgtgctgtgttggtgtgctgcaaccagtaactcgtcatttacattaggtatatctcctaatgctatccctccccccttcccccaccccacgacaggccctggtgtgtgatgttccccttcctgtgtccatgttttctcattgttcaattcccacctatgactgagaacatgcagtgtttggttttttgtccctgcgatagtttactgagaatgatggtttccagcttcacccatgcccctacaaaggacatgaactcatcctttttgatggctgcatagtattccatggtgtatatgtgccacattttcttaatccagtctaaaagccaaaattgacaaatggtatctaattaaactaaagagcttctgcacagcaaaagaaactaccatcagagtgcacaggcaacctacagaatgggagaaaatttttgcaacctactcatctgacaaagggctaatatccagaatctacaaagaactcatacaaatttacaagaaaaaaacaaacaaccccatcaaaaagtggacctatttttatattctttatttcttttagagttgaattgtggtatatattgagtatagttgattggcttcatttctggatgcttttagagggttgaggctcttcatttgtgactagatttctgcactgggtttcaccagcaatgtatgcccttctttaggtcctatttagggccaggaactggccctggagcttgtcaactctgtgcagggttcccagtttcccccctcttctactttggtttctatgtcacctctctataaactttcaacgttttatttcaaaagatctattcgaagtgtgatgatttactcgatattttggtttccttcagtgcaagaggtgctcccagctatatctagtcagccgtctagtcccctatgttacttcaggctgaccctaccagtgctggctgcaaattccaaagcctggtgatctaaagggtctgcccctggaaatacacacccaatgccaggtgcagattagtgggcagatgtcttgggtatggggccactggtagtcaagtaccagcccccactgtttttataagcttatttttcttctcaaattattccaacacctttaaccaaaaccaataaaccactgattaaaattcacacatattatataaatgtatttctgtaactgcaagtagttcagaatgactgcacttcaagatatgaactagggctccaagggagaaatgaggctggcaagatgaagaggacatccatggatgccttaaataatataccaaggagtttaaaccttatcctaaagacaataaagagcctctggagaaattttaggataaaaatgacataatcatttttatgttttaaatacatcactttggctgcaatattgcacatacatagtatttgggaaaggatgaaggtatgccatttaagacaaataattaatggctaaattctgccaagttgatggaggaggaaataattcaaaaatatactaggaacgatagaagaatatatgtggtgttttgcaggacaggaaaatacaaaagagaagggaaaattcaaagatgcctagagtataattccacaaattccttttactatcacaatctgagccgctcagccatagacaactttgatatctcaagctttcctgactccctggattcttatgacattagcaaatgcagctaagtcaagtccatgtctttgcgtactctgagtaatttatacattttccatgtatgaaattaatagcttatataaccccaacatgatttgtatcaagagtagttagttgaccgagcatggataatagatttatgatgcttttataaccctgaccagcacgcatgattacagttttgcaaagatgctaaaatgactatcagctaccttatttgactctcatattcctcccatcctcactgaagaaaaaaacatttggagtgctctcccaacagctgcagaatgtatggccatgtgatactatttgaacgttttgtctgacaagttagggattctttttgcaactaataaaataatttaaaaatctgaaccatttcctgaaatgtaaattactgacttttgttagtcattatttcacctctgccaaaacaaaatgacttatagagaaaagaaaaatgactgatttattgcatcatgcaaattcctacagaagaaacaagtttaggatataaggtatgtaacatgggaattttaaaaacagtattagtgaattgccaggtaagaagagacccattaaagttgtctaatagtggcctccccagctctccagatatcaaaataactagaaaatcattagatatctgatttatttagaccaaattcttttatctcacattgttgatctttttgaaaattcctaatttctaatagaattaaggatctgttacttcaaataatataaagcttttgaatttctaaattcctcattttttctaggtctctttagctatttttaataatagtgacaggaataaaaaaacaggcacggtttgagtagatatttgatagaatttcagtttttatatagtcaactgtattaaaatcttatagtttaattaaataattttggtaatagatacatttcttaactgaactccaaagtttatgtatgtgcaatcatcactgtatattttgcatatttgaaatatatgcaaatgtaaatattaaatacaaaggtaccacccaagcatgtgtgtatttatacataaatgaatatatttgtataatacttgtgaatttttatttagcatgttacttttccatgggcccattaacatttgcacctgctactccctatctgagaggccgtcatccactactttttaaaaaaattttattttttaaagatggggtctcattctattgcccagactggaatgcagtggcacaatcatagttctctgcagcttcagactactgggttcaaatgatcctgctgcctcagcctcctgagtagctgggacctcaagcatgagctgctatgtctggctttcactctcttttacatggcttgttccctctcacctctcataagccagctcagttatgatgcctcaggaaattacttcatgcggaccacatattgagagcaatctacttatcgtcatagtttttgtgcatttacttctgtgtcctccacaaggctgcaaaattctttgaaacaaggtctgtgccctgtacctatgtttaacaagtgcttgacaattaaatgtacaaaagatattcatgaagttcactctgtgtggcaagtggttaatgctttaaacaatgctactgtagaggaggagtcgtcaacttgtttacaaattgcccaagggctttttcttttcttttaatgtcaccatgataacataaagaacattatgagaaaattcctttcatcatagaattcataggccagtggaagaaatagattttatttatcatctagtgtgataaattctctatttgtgttttgtttttttggttttttttttgagatggagtctcactctgttgcccaggctggagtgcagtggcaccatcttggctcactgcaagctctgcctcccaggttcatgccattctcctgcctcagcctcctgagtagctgggactacaggtgcctgccacgacgtccagctaaatttttgtatttttagtagagatggggtttcaccgtgttagccaggatggtctcgatctcctgacctcgtgatccgcccagcttggcctcccaaagggctgggattacaggcatgagccaccgcccctggcctattgttgttgttttcaaagaggcatattgcccaagagtgaaagtcaagaaaatctgtttggaggaaatgatatttaagcttaattttgacagcagtctaattcagtggtaataagctcagattctaatatctgttggacatagggctgaatcctaactctatctcttataaagctatgatttttggcaagtgatttaatctttgagcctcagtatcctaatatgtaaaatggagttagcaacatctacctcataggagtgttactaaatgtgattattacttaaattaaacgttacagaggttaaacatagcaaaagtataagctgtaaatgcacgtggcaaataccataacttatttgtcattgggtatttgacatctaataaagaaaagaaaagcagaaacaaaagaagttcttgttagattaagttgtttgttgagagtggaatgctatgtctttaataacttcctcaattatatttataaataattcttgtgagaactaccatgttaaccaaagaaaatattaagaataattatatatgctgctctaaacctttacgttaactcatgtattcatcacaacggccttatggggtaattataaacagtttagcctcattttcagatgtggcaactgaggtacagagaggttaagtatgtagttcaaggtcacttgaccagaaagtgctagagccagaattcaaacctggattcaaaccaggccatgtgcgtctatgttactgtccttccagtaatacaaccaggccaacttcatttagatgccaaccactccctgagtatacactaaatttcagatgttgttctagaaaaattgtatataaatcactttatatttatatactgcatatatttacaggaaggaatagatgttaacaaaataaactataaataaataatatacatttcagatactggtgagtgcaattaagtaataataaaatgggaaaaaagaatgatggaaatgctactaatttaattacagtgaacagggaagatttttctaaggtgatgatatttgagcagatatttaaataataaaaagaataaaccatgtaaagatataacggacaatttttccaggcagctagaataacatacatatagggcttgagttaggaaaagcttggcttgtttgagaaacgtcaaggtcaccgtggctagagtgaaatttatgaagagttggtggtgagcacataatgttggagagaggagcaggtgtcacattacagaaggccttgtatgtaatgataatgaagttaattatcacctttggaaggtcttaagaatataagtggtatgatctggcttatattaacattttgaaaaaagataacgggttacttggaggagaacagcagggtaaaagtggaagctattatggttgttgaggcatgggatgaaattggtttggattaggattcagcagagcaggtggtaagatctgactgattttgtaatatattttcatggtagcacaagcaggacttactcatgaatgctgaggataaagaataattgagcaagacttttagattttagattatttttctggcataaataatatgggaaatgatagaaccaattagtcaatatgaagaatattagggcagcagttactttggccctgagaagagggactgcagggaaggggctttcttaataatcaagcagcagagatgccaactgcacagttagacatatacatttgaagttctcattcagggagatgtcatggcttcagaattgggagtcatcagttgacagttggtatctaagggcatgagtctggatgaggccatctagggaatgaagaaaagatggagaagaggtctgtacactgggtatctggagtgctgaaacctttagaggaggagccagcaaggaggctgagaaagggcagccattgaggtggtaaaagaacaggagagtgttttgtcctggaagttaaaatgttgacatctttgaggaaggaggaagcatcaaatcctgctaagaagtcagttaggtctgagaactgatgcttcaatttagcaagatggaaccagtaatgactttgatataaatggatttatgactattgtggggatgagaacatgaaacaggttaaaatttaaaaaatgaggtaataagggggagctaatgaaaatagacaattttcttagatttttggtaaagcaaaatagaataatgaggtaatagtggaaggaaaacatagggtcaggggacggttacttattttttctaagatgaaagatatactgtgcctgagttaaagttattcagtaaaaagcaagatagggcttgatattgcagaagagagaggagataactgcagaaggaaaatcattcaatggataactggtaatggagtctaggtaacaagtaaaaagttggtcttagaatggaataggaactttccttcattgccatgggagaatatactagtagacctggtagtaggaaaatgtggttttcatttgattgcttggattttctcaaaaacatattaaggcaggtcaacagctgaaagagaagatgagagaagagagtgcttgagatttgaggagatatgataaggtatgaaattgttgtcccagagtatgagaaagtgattttttctaaagaagtgtataagaattgctagaaagtcttgagagttcacttaaaatcaatggttaaatatttaaagtgagatgagtgagtgtttctctagccatatccagttgctgaggcagtggcatggagtgaagaggaaagtgttggcttaaccagcgtaagctaacttggactggggttttgctggatgagcacaaaaagctagagaagagaaaaaaaagtgcatgagagggagaattagagtgagggaccaggtaatacatgctaggtggggagggaagagagggcataaagaaaggtgaaagctgggtagaaatggtgaaatcaatgatctgaggttccaatggggctaaagaagtttcaatgagaaggtactagaataaatgatatgaacagaagggaggaagtgttcacaaagatattgcttgacatagaggctttggagagggggcagttaatggcagtaacaaagttcagagtatggtcatgaaccccaaggcaggaagttagcaaggtaaactgacatgctgaagatcaggaaacaagtaagatcagaatccagactagaacccacagttgtctgactcctattgagtgttctctctcataccaatgttagcttttattttttgacctccaataccagggcaactaaatagtgttctattcaagatggtgatgtacattggataaggaaaaaggagaaggctcagcttcacgggcatgagacctgttcagttgcattgagtcctgtgtttagaaaggccccacgttttcatgttgtactgcactccataaatcatatagcttgtcttggagagaaacttaatgattcaggagaaatgtgtttttttgtctcatttgagctcattttccataagcctcacttttctccagttagcataccattaaaattttatcaagtccataatggaagttttaaagaacccatctgtcaaacacttaagtttcaacgtatattttggtttaaaagcactcacacttgataaaaatcagcctgaagatgagaaatgctctgactcaggaaagtgaataattagtaaactaaaaacgagatataaattaaagtgcaggtctacaatcttcatttatacttgaatgatagcttagtgaaaatatttacatttttatttcttatactaaatgtggtatgcgtttatcatagaaggtttatgaaataaatataagcaagaaggataaactaaacattaccccaaaatccttaacaggagttagccaccaacatgtgtaacatttggtgtacatctttccaggctttatgagtgtatttatgtatatatattatattatatagctttgtgtctactgaattatattttaaataccattttaaaacttaatttttaatttaataatataatctaggtagaccttctatccttgcaattacatatttttctaaagtattatttcagtatattttaatataatttatattacatgaatacataataaacacattatccttttttgtttattattaaacacctatgtttttcaatcttcactattataaaccatatcaatacacacattcatcgtgtatttgtccgctactgtaagtacaatttctgggtcaaagagtgtattcattttaaaggcttttaatctatgtttccaaattgctcttgtagggttgtactaattttcagaacctctcactggcattgaatattcacattccttttaagtttctgtcaattggacaggcaaaacttgtttgctctcattgtcttcctttgttcttaatgaggttgaacaggttttcatttgtttattggctttttcttttttaatgaatgtcctgttaatgctttttggtcacttttttctacacggtctttggcctttctcttattgttctgtaaaatatctacatatattagggttgtgttgcacagtttccttaatttgtcaaagcactttgccaggaccctaccagcatatttgcagagctctatggggttgctgtgttttttcctatgggagtagttttaaaatgcaccacttgttttttaaactaagtaagaaacacatggtaactataattatgatgatagtatcgatatcacacaaatgaaaacatcttgtaacatatctaaataatgtatagccaaaacactaataataaaaccattaagaacaaagtgctgtacaagctcatcaaacatttctcttttccattcatttctccaaatcctggcaatgaaatttacatactaaacattcagttatttggtctgctgtctcaatgctttctactgtgagcatttcattaatattctcattgtgagtcctgtgggaaacttccaggttataaaacacaattgtataatttcacaagacaactcattaagattagaatagaatgtgaaatgcaagattggggctttggatttttcaaaattttttcttaccctctccagtgtaatttcttcaaattcatattcaatttctgtcccattgacctgtaaatagggaaaaaataagaagagaactattaaatacatgttgaggaggagacagctgcattttaaataatgcttgggggtgaaattttcattctagctataaataaccacattttcttgatatttctgattgtgcattttcattcaagtgaaacataatctatgctattctaaaatatatgactgagatgctacaaaaaatactcaaagattattgcttcccttagtaattctgtgatttttttgtagtgaggtataataacacaaaatacatattgtgagcttacaaagaacaaatcatctaggggcaatgatacaattatgaggaaaataattttcttgttttttaaaaaatgttatgtttgaacactaaaatatgaccttaaaaatcagtgataatggcagaacaacattgttccatttttgaatagaaaaatagcatgaaaatgactgcatcatctgagaaataccttttctttagtggctcaagctcaggtaaatcatccccatcatccttttattatctttattggaaagccctggaccatataaccatacctatgtacctcagtagcagtaagaaatgagcaaagtaagacacattttgaaatgcttagtgacgaattgtttcaaccatccaaccaatccttgtattgatttgaatttacagagagaaatacattttaaatacagccaggcaccttagatttccacaaatgtgcacagaggccatatgaaaagttggtttaaaataatctaacaaatattcctttctcattttcatctatctcagaattcttctcaaccaggcaaaacctctaagcaagaaaattctcaaatcggttgtttcttatttctgatacgtgtcttggcaacatcattggaatttaggaatcagccagaaggactacattttaactataaagccatactttttataggattctaacttacatttacttttctatcttagaagaatttatacccagtaccagggattgagagttctatgcaggcaaggcccagacagccagccctgttgcctaacacagagcctggcaagaaaataatgagggaaaagatagtgaatgaatgagtgactgaactaagtaattaatttacttgtgtaatttataaacatagatatttgtggattctcttttgtaacaaaaaattgaatgtagtatcatcacctaaaggtgtaattatagttataatcagtgaacatatagaatgacaatgacaatggactttacttaggtgtgtccaccacccactcacagcatgtttttgattttctaattacgtgagctaattggtgaatcacaatttactgttttactacattatcaaacagccctaaactaaatttgattttctaggcttcagcaacttaatgactcacagaaaaggacttgatgatgtcagaaagctttagcagctttctagagggttttgttttgtatatgcaaaagtaaaacacacagacacacacacacacaaacacacttcaaactccttgtatgtttccatatgaatgatttttaaaataattttctttgatggataggaagaggacaataggggaaggctgaattaacgagatacattttcattccctcagtatggctccatgaggcttttctttgcttcagtgcttctccaaactgaatcacttcacattattaaagtgctgcaaactggggagaaaaaaacaacttccaagagagaaaaacacgcctctaataataaatgtctaaaggctcaaagaaattcttttaggaagtgcttaaaagacaagaatattttagtggcatacactgcatagttgtggcctatcaaaacctacgcttaacatttctaggatcctaaatgctgactcttagatttttagaagtattatatatgcatatcctaattggtattccaaagttccttagtcagctacataaactattgcaggcttatatttacctcatgggtctttcattttcaactcaagaaaataatatcatttgtctaattcaacagtatccaggttcttttcatcaggagagatgatgccatcaaggttgcaatgtaactttgcttttaaaacaaagcatcccggctgggtggttcacacctgtaatctcagcactttgggaggctgatgcaggcagatcacaaaatcaggagttcgagaccagcctggccaatatggtgaaaccccgtctctactaaaaatacaaaaattagctgggcatagtgacaggtgcctgtagtcccagctacttcagaggctgaggcagaagaattgcttgaacaggggagatggaggttacagtgagccgagatcgcaccactacactccagcctgggtgaaagagtgagatcccgtctcaaaaacaaaactaaacaaacaacaacaacaacaacaaagcatcccatgtctacaacaagctttcgtgaactcgtagaagcatgaaggatttttagcataggtgaggcatcatttcaaccttttacatgaggagcatttagagcacggaatcacaggagccagtgagagagttcagaaaagacattggaaaggccctaatctctattctctcattacagggagagtgtggtctatgttctgccaaaggactcctaagacaagaaatggcaaatatcttgagggaaagaatgagacagaacaaaagaactaagaatacccccccagggctgggcgcagtggctcatgcctgtaattccagtactttgggaggcaggagcaggcggatcaagaggtcaggagatcgataacatcctggccaacatggtgaaaccctgtctctactaaaatacaaaaaattatctgggcagggtggcgtgcacctgtagtcccagctactcaggaggctgaggcaggggaatggcctgaacctgggaggcagaggttgcagtgagcctagatagtgccactgtgctccagcctggtgacagagtaagactctgcttcaaaaaaaaaaaaaaaaaaaagaaaagaaagaaagaaagaaagaaaaaaacaatacctcgatcttaatttgtgaaaatttggtgccttttcaaacgaatataccagtacagtattaaataaggatttaaatacttatttcgactttatttctaaataaactctctacagtggttgcttactgagtgatgaaacactgagaggtatctacagtaattcacccctaaccataatcttgtgtatcctcactcagcaaaaccaaaactgttataaatggctcccatcatcttttgggtggtttgcaaacaatccattgttgtttgaacttgccttggtgtctcatataatattcccaatcaggttatcgacatatgattttcaattccttttcctcaaaagagttcggccgaatacattttttttcttgtacagtaacacttacggtaatatttaagtaccttggtcatattttatgctactgatagtttggggcccggagagcttcacagttggggtttctgttattccagttctggccctaactgtcacagcctcctctctactttgagaactagaaaaatcagaggattgacattttcatagacttggagagtcagtcaaatagattaaacttttcagtgtttgaaaaatgtgtgtgcatgtttaagatacttgatttttctgaactttatggttctgtggtgacagctggtagatttctctggtggccagaaaatcaaactgatgtcacacattgtcctgtgctgttctgagcatgtagccttcctagaatcatatggcagttaagcaaagagagtgacccacagccaactcaaatttaaacttggtatttaatttaaagctctaatttaatgaatgttgaatgcattaaatatttgtttttctccaacagcttttagttaattttatggccttttttctacttcaatgatatagtaatcacctgcctggatgatgatataatttgattttgagatatatttttatctcctgaaaagaggttctccatacataacaaatgtgaactatccatattttaatgttgtttcattggaatcttaaataataatttctctgaaatgttttgcttgttctttgccacctttgtagcttcattaaggctaaggatatactaaactccaaaatgaataattttttttttttcgagacggagtttcagtcttgtcaaccaggctggggtacagtggtgcgatcttggctcactgcaacctctgcataccaggtttaagtgattcttctgcctcagcctcccaagtagctgagattacaggcatgcaccaccatgccaagctaattttgtatatttagtaaggactaggtttcaccatgttgacaaggctggtctcaaactcctgacctcaggagatccacccaccttggcctcccaaagtgctgggattacaggcgtgagccaccacgcctggcccaagatgaataaatttttatatatctctgtgtcacatattataaaagtgctgaaacaaggatatcaaagcattcacttttttagactaaacacaattctacccaaagagcaattattaagcatgcataaagtgtcaagaacagtgacagatactgagaaaatattttaagatacagccatattctagagaaacacacaacctttaaagaggcaccgaaacacaaatatattaaggcctcatacaagagtgatatctaatatttaaaatatagaggtagactaaagctgcagcgccactattgccacatgcaaggtatgtgcagatctatttactctttgtcgtttacatagattaagtcagtagtagagaatatgacagacgatgttctaatccttctccttattataagtaattatgatatagttaacaaggtatacctctgattattattgttttagcatctagcactacaattggactttgggaggaatgtgatcatcatgcaaattgggacctccagttcttgtggtctcttgtcacttccagagtaaggtggggcaatgccactttgcttcatccacagatgcagcatatattacagtggctagcaatgatgactatgtgagtgagtaagtagataaatcagtgaatcaacaaatgaagtttttggatgggttaaacctgatgcactcaaagaagaccttggttgctaatggggatgccatgcctactgggcccatgccttttgccattccttgtttatttatcctcatctctgagcttggctcctctcagaagccctgaattacagggtcacaccaccatcaaatgccacagcaaatcaacacacacacacacatacacacacacacacacacacacacaaacacacacactcatttgcattcctcttttttagtaccttgccaatattcatccttcccttcttttggagtatctcttatagtaaatatgtcatgatgcattactgctctttacacttgaccttacatacagtgtgatactcggtaggcaaaaacatggcttccagagtaagaaaagacagatttgaatcttctttccaacatttttgatgagtgcgagtttgggtaagttccttaatctcttaaaacctcaatttctttatgtgaagaatagtactaaaaatagttcttcctcgtatggttattgcaatgattacattaggtaatttatatgaattatcacacatcttaagtgattaaagaaattttagctaaaatcccaaacagttttcttctcagtttctacttcataaaattcttggtaggaataaataatattacacatgttaactgtctggcacaaagcagatcttcaataatgatagctattattattagttctggatacaaatctataagggtcacaaaatttgtctgatcaaatactgaatgtttgctaatttctccagtaatacataacttaagcaaacaaacttgtctttttctatatatccactaaaaggctttcctaactcaaacatctttttcttgaaccaatctaagatgcactgccttgtgtataggaattaccttagcttttgttctcaaacaagtgtggccttcactcaaaatattattttggccatgcgtggtggctcacccctataatctcagcactttgggaggctgaggcaggtggatcactcgaagtcaggagttcatgatcagtatagccaacatgataaaaccccatctctactaaaaatacaaaaactagctgggcatcatggctcacgcctgtagtcccagctactctggaggctgaggcatgagaatcgcttgaagcagggaggcagaggttacagtgagccgagttcacatcgctgcacttcagcctgggcaacagagtgagacttggtctcaaaaaaaaaaaaaaaatctcaactaaactttctcccaatcttgtgtatactcacttttcatttaaaaaaaatattcccttgcccagtattgatcattatgttgctctgctattggcactcactttcttaaggctattctcaaggcatttcctatatcctcatgttcatgagagcacaggttgtatattaaccttttttttacccttgtaccttctgacaccatgccttgatcaaagcaggtctccagaaaaatctttagacccaagtcacctatgaactccaaaaattgagttgtgtttaaactgtatctttgcctaagtatgggcagcccctaacaacagctgccctttcctgtgaaatatggcttgaatttatcctcccatctcaggaaatttttgcaaattttaaaaataatttccaacttaaatactgaataaattaaaacatcaattaaatacattaatacttagtacctatcatgtacttggtataatgataagcactggagatacaaagttgggtgaaatatggttcctgccctcaaataactcagtctaacagatagagacaagtgaatggaaacatgtaacaaagcgataggagtgctatggtagatgtctatagactgcagcagctgcagaggtgacataaaggaggcaataggaataggtgattccaccggcagtgagtcagaaaacttttcatagaggagatgggatgagctgagtgtgttcatggcaggtgttcatgagaatgtgtaggcctatcaaaacagagacagcaatattaaccacatcttcagaatgttctactggagacagcactgaccttaagagtctgatgcttgcattgtactcctgagtctgtgatttaacatgctaggtaaccttgggcttgtcatgatgctttaattttctcatgcagatagataacctctgaggtccctcccagctctgacctagcaacagggcttttcttcccatctagtgcacctgaccaattgttactgtgatttttctattactctttattctaaagatcctaactggcaacccataattttgccaggtgatatctctctgacctctgaatatctctgtcttatctcttctctttaacctataaaaggcctcaacagggaggaaactaaatagtggtatcactttccgtcttggctccactcgaggacattaccataagcattttttccatttctactcctcaaagatctcaggtttctggagggaaagagtaagtagctgtttctctctaaaaaggaaaaaacgtaagaaagttttgctctacttcaaaccaaaagaaaaaacttgaggaggctgatgttctttactcccatctttttatcatatttcgctatatttttaaaatttgtatgaatttaaggggtacaggtgcagttttgttacatggatatattgcttagtggtgaagtctgggcttttagtgtaaggatcacctaaggtacactgtatctattgggtaatttcttatccctcattccattcccaccttctcatccttccaaagtctccaatgtttattattccatacattacatagctcctacttataagtgagaatatgtggtattttgactctgtttctgagttattttacttaagataatggcctccagttttatccttactgctgcaaaagacttcattcttttttatggctgaatagtattccattgtatacatataccaaattttctttatccaatcacccactgatggacactgaggttaattccacatctttgctattgtgaatagagctgcaataaatatatgagtgcaggtatctttttgatacgatgatttattttcctttgggtagatgtccagtattgggattgctgggtcaaattttctctgctgaatatatgaaaatcagttgagtgctgaaaaagtgagtcattccaccagaatgtaagctctaaataggacaaaacacattacaaaagcctgaggcttgcattaatacaactagattgtccatcaccacctttaactaatgtcccttctcctagactatcttcactaaagatagtgaccaaaaacaggcccttttttcaagttacagcgcattatcacacagaaattaaaagtttagattgtggaatctaaaagacctggattccataacagttctgtacttacaagctgttagaattcatctttgttatgcattacacacatttgtgtaagtgtcaaaattacttatttaaacacttagtagtaagcaaaagattttctgcttaagctttgtttagaacctgttttaatgtaaggtatacatctggttattttatgaatactatgaagttataataagactggtttaaaatatgcagttttattaaaaactcatcatagttcattattcctttctttaaataaacgctcacaagctataaaaacaatcactgatattcttagttaagattctgagtttggtaagatcactattcctattattcacctgaatttgttctaccagtaaactctaatttcaagttaaaatttctaatcttaattacaaaaacttccgagctcagcgaatgctaaatcatagcttctaccacataaagaaaaaatcagtatactataattttttccattcttatttatttatttatttatttatttatttatttatttatttgaggtggagtcttgctctgttgcccaggctggagtgcagtggtgcaatctcggctcactgcaacctccacctcccgagttcaaccaattctcctgcctcagcctcccaagtagctgtgattacaggcacccgccaccatgcgcagctaatttttgtatttttagtagagatgaggttttgccatgttggccaggctggtcttgaactcctacctcaggtgatccaaccgccttggcctcccaaagtgctgggattacaggtgtgagccactgtgcaaggcccttaaataactttttttttaaaaaattatctgcctttgttatgaagtatttataacacacgcaactttgggtctagaaaaataatcacagacttaataactactatgtttttaaaattttaattagaaagcacacgtttttttgtaattagcggctttttagctataaaattataataatttttatcagtatttccatcagaagaaattaagaaaaatagcttagggttcttatatgcataaaataatcattttctatatacaaaattgtcttgattaaaggcttttgtaacaaaggaacaaatatagttacttagtatgttcaaaactggatttgcctgatttggaaggagtccattttctctcagctttgctcccttgttttgcaccatgtgcaggatggagaataacaggtggttttaatgcattcacttggctccagcctgatgcaggctgttttgttctttgggtttaaatatttcatgagtttgtacatgctctttgagaacagtaaatggtgttaagaacacaattgatcaatggttgtaaggcatcatgatacacaaggtttttgtcccaacaaatctcctccctcacctcaccacccatctatgcaaatcatgtggtcatttgcaagcaagtgtccaaaagtatcaagaactcaaagcacatagccaaaatatttagggaaataaaaactgggtgctaagccaaaagatgagactttacgaatatgatgatctaaccagatagtcaagaatattttcttttacttgagtataatatgactgtagcatgagggaaaatatcaatgttctctacttcatcccctctctctcctcaatcctctgcagcttttgtttgtgttccactattatacaaaagttgaacccaaaataatcaacaaaagctttttcacatttaaatacaatgatctttcccagtcttcatttgccctggctttcatacagtatttggcactagagtgaccacccaccactcgcaacttccctttccttccatcacagggtctatccttgctagtctcctccctactgctctgtccacggcagtgatgaccatttattttactcctgccagatatgaacatttgccaagctctgtcctttgttgcttttataatctacctgagttttgacttcaccccccggccttttttttttttttttttttttctgagtaaacacttaagtactgccctggtctcaatacatctaaaacagaacagatgctcttgcctaattgtaaccataatttcctgcagtctaccactctatatctctgttaaggagattttttttttgtcatatacatcctttacatttgttatcaattcccgccatcctatttcatgttcaaattatcactttcttaagaacattggtataacttcctaaaaatacttcttcccctattgattttcaacatcaatctattcttcatatcctttgaggtttattttcctaaaatgtttcatcaaggaattttactgctcaagtagcttcaataattttttaatccccagagaacatttcataccatccaccagctgtccccaacctacctttctagctaaataccctgtttctcatcttcaaaaacgttttctagccaagtaattgagctgaacacctcctccttttggtatctttactaatgccacatacgctgccttaaatgccttaatgcaatttatgtttattaaaattctaattaatgtagaaaaatattttgaatgcctaaaatttcccatgtattaggttaggtcctagggctatagtggtaaacaaaaaaaggcctctgcctttatggagctgcattctattggtggtgtgggaatctcccatttttaccaactaaagactgtcttgtccatcgaatcaaaaatatttttcttatcgataccctggaaatcataaccctgttatctccagaaaaaatgctaataacaataaaaatgattactactactgcagctactattgctactactggattttgttaaatatgtagtacatgccagacactatcttaagttcatctaataattgtaacaattttgagagcttagcattttaatgttgattttactatcaaagaagctagtttctaagttaaacaattttttcaaggttatgctttcataagcaatgtgaaaccaggagaatcttgttcatcctcatccttacttactgatggaaagtatgtgctcaatataaatttgttgaacaaaattagcaaatgagtgcctatagggatggagaaagaaatggaaatatctagtgtttgaatccagtatctgacattaaaacaataatttttctttctggtcatacatagcagagcacctctcttactatacttgtggtcttcctcttgccagctcctcacattgtgatttctcttccctgacatactgtcctcttgctcggatggggaactatcttttaaatttgtgtttcttttatggcacctattataactgaacttatgtttgcccctagtagccgcattataaattgttattaaagaaataaatggattgactcttatgctaaaggctttttatttgctgtatatctttaaaatcccttttattcaaaaatcttaccactgtcagtttccaaaggcgtgaactgccttaatttctctctaatcattttacttcaaatcttgctaacaatgagctgcatcccttttcatctaaatataggtcaccctttcagcagttttcaagatcaattcatcaatcaacaaatatttattgagtgactacccccaccttcttcgctatctcatataatctcttttcatcccatttaaaaagcacatcactatcttcacaaccttgggaaaagagctatagagccacatcaccctgctccttcatctgaagttctgtgattttggaaaaatgcttcgggctgcttgttacaataaaggtcataccagtatttccagatcagatactaagggaaagcattctgctgctttattttatttcacctttttcaaagtactttaggaccatgacaaggactgcttattaataggttttgtcccctaccgaatgtctggcccaggtgataacatagaaattgtaaggtttaaagttgtttatatctaacatttttagattatggtaacaacagtattattaattttcatactattttcacatacattattgcattggattcttataacaatcgtatatatagtgatgttttaaaaaatttcctgcaagcaataaccatcagtttcctgatggttacctgatggttcacttaccatccccctccccctagcagacatgtacatacatgccacactggtctcttttaagaaaggtgaagaggtagaaattaaataagccaatagcagacctggaaaaaaccttttaaataattgtagttaatattgctgaagatttactatatgctaagcagtaaagcttatatatatatatatatatttgcatatatataattacatataattatatataagcatatttcatatataacatataagctttactgcttggtgtatatatatgtatatatacatatattcacatacgtatatgcacggggcagttgtgttcaatattcatacagaagacctgacttaccctgttttttctctgttagattcaattaacttagaagtctaaagtgacaaaaaagtataagcaatatatttttcaaagaaaaatgtagaagtttctacatatctattagtgtttctcagacttgatccaggagtttgaaaggggtcatgcatactcaagttgtgatagctagtcggattaaggcgttctggactctgaattttatgcaccaattctatctctagaagtctcagagacagaatttctctctctctggacacttttctttgttgacctttaagtattctgtcacagggtcaactgggacgctgataggataagtttctaacagttcatgctcaagcatagctcactgctgcttgcttgcttgctctctctcttttcttttcttttctttcctttcctttccattcccttcctttccttttcttttcttttcttttattttctttcttttcatatcttcttggaataggaagactcaaaagggtaccagaaaaattttcacttgcattctattaattaaactacagatactcctttaatatagtaaacaaatgttaatcagacaacaaacttacagcaaaaagcaccaaggattgaaagcagttggtagggcagggagaagagatggaagaaaattcaaatcatgttttcattatactctttgttttcttaatcatcctctgcttaggatggtcttgcttgccaagttttccctgtataactcctacttagcctttaaaaacatcttccatgattctcctctccttccatctaatatcatcacaaaccctgcctttctttctctagccctcctacgcactctaatacacacatatgcatgcacatatatacacaggccaggctctgctaatgctgtttctctgtgtttacagactacttctgtagattctttttgctctgattatattatcaggctgtgttaagtatcagctcaggctttggattcagtcagacatgtaggctaatcctaaattggcctcttaataatttttgtgactttagaaaagttaaatagcctgagttcctcctcaataaattacgatactacttatacttacttcaataaggttgttagggattataaatgaagtaggaagtaaagtacagttctcaactgctcataatctagagacatttcctaagtttgactctgccagttaatagctgtcagatatctgcctcagttttctgatctgtaagtggggtcaaaatgaatatcataggattgtgaaggataaatgaactagtaaattagtgtaaattaatttaaataaattagtaaaatacttggaacagtagtctggcacatgataaatgttattattatactgttcattattattacagactggtggaatagggagctcagcaaatcctgtccccaaagaacaactttaaaactgggcagaaattgccaacaatagccatttctggactttgaaaactgactaaagacatatagcaagttaaaaatgattgattaaaaaaaaaaactgctgaatgttagttaacaactgtgagagcctgtgttattccagtctggggctgcacattgccccatctcttcccaccccacaaaattctgtgggtacagtagttctaccagcagaaaatgctatgaaaaccagcagctttactgccagagggggccaacttcatttggagcagaatgtgggaaaatcccatgcatagtttttgaaaacaatagtgatttcagtggcaaacttcagggaaagcaaaaatggaagtagtctaaggttgcaatactggctggtgcagtcaacatgctgtctacagtagccagaaatttaacagaacaatttgggtacttagagagttatgtcaggctttgagagctcctatatttccatggaagactggaagtttgagtgcatatgaaaggtcgtgagtatcctcaagagactacagaaggtcctagcaatcaacatatccctgcctgaatgtgagaccttgcacacatgcacaggagataggaaaaggaaggcctattcgaaaataaaatctcaggccaagttgtaggctgcttgaatgtaaacacattccctggcccactcacaaatccattggtgaaggatggaaggcttactggctcaaggtgtttcagcataacctctcaccaatcactggctcaccatctggctacgttgatctaaaggcactgctatgatgccaggcttcaaaaacaacaacaacaaaaaagaaaaaaaaaacaagacagactcatcagagacatcagtagctatatactgcaggggaaacagactacagatctagcatgtgactaaatgttagtttttaaaccaacatttaaaaaccctcaaaatctggagctggtaagagagaagagggcaaatcagaatctctaattgcttttatcttatatgtagagttttcaaaaaaatataggagacacgcaaaaaaggaaagtatgatgatccatacataagaaagtaagcaataaatagaagctatttctcaggcattccagatgttggaattagctaacaaaaacatcaaagcagccataaatatgtgcaaagaactaaaagagccatttaaaaaaattaaagtatgacaacaatgacacatcaaattgaaaatattaacagagaaatagaaattataaatcaaaatctcatgaaaattttggagtcaaaaactgaaataataaatttgctagagtttggggctgatggcctactacataaatagcttagaagttgccattctgttctaacaacaaataaaaagctaaacaaactgaaaaatcaacaactattgttagatccatcagagaagttaagttacaaggcaaatcactgtccccaaaatcagtcagataggtagacacaaagaatcaccaattatcagagcaaaaaccaatgggcagatacctctttgggaaccagtgccagggtagaaaaacctgaactataactgatgaattgttagatgctcaatgtgaaaaactctgacagtcatgaactccagagggaacagtcacagggccgccacgcttttgtgagttttactgcctaaagctctacgaggccttcgtattgaatattagaagaaaatctactagtgctctggcagggaagaggaaaaggaatcattctgaagtaggttagagcattcagtgcttcttaataagggcttctctcaggagaaattattttaccagagcctaacctgtcggggttttaccagggcctaacataactggggaaagggaaatacccaagtccagaccctctagccatcctgtctcacctaaaattggggataagggggacaacagagaagcactggtgaaatttagaatccagatagacaaactcaccaaaatactgaaacctaatcacaggaataaagcatgctttcctccccaataccttgccactacattaccaaagatctattcaaaacagctccttttattcagttcattatgtcattttaaataaaaaatgaccaggcatactaaaaattaaaagaatacagtatgaggagactcaacaagcatcagaaccagagtcaaatacggcagaaatgtttgaattatgattagtatactaaaggctttaatgaaaaaactagacaactaggcaaggacagacgaataatgtaagtagagagatacattctaggaaggaataaaaatggaatgctggaggtaatatagtaaagaaatgaagaatacttttgattcttacgtggctgagaaaagaatcccttagtttgaggatacaataatagaaacttccaaattgaaaaacagagaaaaaaagacaagacacagaacaaaataaccaatagagaacatttaagaaatgtgagacatctacaaaggtgtaacataagcataacagaaattccagaaggagacaaaacagagaaagaaacagaagcaatatttgaggcaataatgactgaaaatttcacccaaattaatgtcagacaacaaatcacagatccaggaacctcagagaacaccaagcagaataaatgacaaagcaaacaaacacacaagcaaacaaaaaatcctcctactcccaataactggcatctaggcataccatattcaaacttcagaaaatcaaggatttttttaaagtcttgaaagaagctagtgggggcaggtgggagccatatctacggaggagcaaagataaaaattatatctgaacccccccagaaaccatgcaaactggaagagagtgaagtgaaatattgaaagtgtggggagaaaaagaccaaagtaaaaatttataaaattatccttcaagaatgaaaaagaaaagacttcctcagacaaacaaaaattaaggaaatgtttctgtcagtagacctatcttgagagaaatattgcagtaagtacttcggagagaagaaaaatcataaaggtcagaaacattgatctacataaagaaagaaagagctctggagaaagaatatatgaaaataaaacaaaataaaagttttatttttcttaatctaacagataacagtttgttcaaaataataataggaataatgcatatgattatatatgtgcttatatatacacacatatgtatgatcacttatatataatcatatatatgcatgtcacttataatcatgtatgattatatataagtgaaatgaataatacaagaaactatggcagaatggggaatattttgttataagacacttgtactatttgtgaagtggtggagtgttatttgaaagtgaacttggattggttgtaaatgtgtagtgcaaattctatggcaaccattgaaaaagtaaaagaagaagtataattgatatattaataaagaaaataaataatataaaatgccatttaaaacgaaaaaaggcagaaaaagtgtggaagacaaaaataggatgaaagaacaagaacagtaattagaacagtaattagaaaatggtaacagatatggcagatattaatccaagtagtaaatacatcaataatcactttaaatatcaatggtataaatacatcaattcaagagccaagattttcaaagtacattagattaaaaagcaagacatgactgtatgttgtctacaagaaaaacaccttaaatgtaaggagaactatacataaaaagtaaatgaatggagaaaaatatatcataataacactaatcaaaagaaagtgggagtagctatattaattccaggtggagcagatatcaacgcaagataaattatcagagataaatagaggcattacataataataaagtagtcaatactgggagaagatgtaacaacccttaatatgtatgggctgaacaacagagtgccaaaatacatgggggtaaaaacccatagaatagcaagaaataaatgaatccactattatagttggagacttgaacgcccctctatcaaaaatggatgggcctagcaggcacaaaatcagtaaggatatatttgaactccatggaaccatcacacaactgatatcaagcacatccatagactacttcattcaatgacagcagattacacattcttctcaaacttacatgaaacagtcatcaggatagaccaaattctaagccataaaacaaatcttaacaagttcaaaagaatagatacaatgtctgttcttaacaccacaatataattagactagaaatcaataatggaaagacagctggaaaattatgaagtacctggagattaaacacatgggtaaaagaagaaatctgaagagaaattggaaagtattttgaactaaatgaaattgaatacatgatgttttatccagcctgggcaacatagggagaccccaactcctaaaaaaaaaaaaaattaggcagtcatggtggcttgtgcctgtggtcccagctacttgaaaggctgacgcaggaggatcacgtgcccaggaggttgaggctacagtgagccctgatcatgctactgcactcaagcctgggcaacaaagtgagaccctgtctcaaaaaagaaaaaaaaagaaaaagaaaaagaatagcaaatagaatgtattaaaattaataagcttcagtaaaagcagtgtttagagggaaattcatagcatcgaatgaatgtatataaatgaagaaacatctaaaatcaataatctaagcttctactttagaaaactagaaaaggaagggcaaattaaatccaaagtaagcagaagaaaagaagtaaaagttagagaagatcaagaaaattgaaaacagaaaatcagtatagaaaatcaacaaaatattggctattttttgaaaagatcagtaaaattgataagcctctagctaggctaattaagaaaaaaaatgacaaaattgctaatattagaaaagaaacacaaaacatcaccacagattccatggtcattaaaaggataataagagaatatactgaataactttatgctggcaaattttataaccaaggtgaaatgaactgttttcttgaaagacaccatgtaccacaactcaaagaagataaaacagaccatgtgaataggcttatatctattgaagaaattgaatcaataattaataaccttcccaaacagaaagaaccaggcccagatgggttcaaaggtgaatcctaacaatcatttcatgaataaattacaccaattatctacaatcacttccagaaaagagaagcacaaaaaatactttctaactcataaatactttctaactcataaaatgttcaagaacaaaagtgaactatactgttaactatggactttgagtgataatgatgtgtcactgtaagttcatcagttgtaacaaatttaccactcagttgtggatgtcaatgcccgtgtgagcaaggcctgtgtgtgtgttaggtggggaggaggtgtatgggaaccctttgtactttccatttagttatgctatgaacctaaaactgctcttaaaaaagttattaattaaaaaaattcactagagcagctcaacagtagatttgagttgacaagaaaaaacataagtaaacttggaaatatatcaatagaaatgtttcttttttttaaattatactttaagttttagggtacatgtgcacaatgtgcaggttagttacatatgtatacatgtgccatgttggtgtgctgcacccagtaactcctcatttacatcaggtatatctcctaatgctatccctccccactcccctcaccccacaacaggccccggtgtgtgatgttccccttcctgtgtccatgtgttctcattgttcaattcccacctatgaatgagaacatgtggtgcttggttttttgtccttgtgatagtttgctgagaatgacggtttccagcttcatccatgtccctacacaggacatgaactcatccttttttatggctgcatagtattccatggtgtatatgtgccacattttcttaatccagtctatcattgttggacatttgggttggttccaagtctttgctattgtgaataatgccgcaataaacatacgtgtgcacgtgtctttatagcagcatgttttataatcctttgggtatatacccagtaatgggatggctgggtcaaatggtatttttagttctagatccctgaggaatcgccacactgacttccacaagggttgaactagtttacagtcccaccaacagtgtaaaagtgctcctatttctccacgtcctctccagcacctgttgtttcctgactttttaatgattgccattctaactggtgtgagatggtatctcattgtggttttgatttgcatttctctgatggccagtgatgatgagcattttttcatgtgtcttttggctgcataaatgtcttcttttgagaagtgtctgttcatatccttcgcccactttttgatgagtttttttttcttgtaaatttgtttgagttcattgtagattctggatattagccctttgtcagatgagtagattgcaaaaattttctcccattctgtaggttgcctgttcactctgatggtagtttcttttgctgtgcagaagctctttagtttaattagatcccatttgtcaattctggcttttgttgccattgcttttggtgttttagacaggaagtccttgcccatgcctatgtcctgaatggtattgcctaggttttcttctagggtttttatggttttaggtctaacgtttaagtctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatggttgtagatatgcgacattatttctgagggctctgttctgttccattcgtctatatctctgttttggtaccagtaccatgctgttttggttactgtagccttgtagtgtagtttgaaatcaggtagcgtgatgcctctggctttgttcttttggtttaggattgacttggcaatgcaggctcttttttggttccatatgaactttaaagcagttttttccaattctgtgaagaaagtcattggtagcttgatggggatggcattgaatctataaattaccctgggcagtatggccattttcatgatattgattcctcctatccacgagcatggaatgtccttctatttgtttgtatcctcttttatttcattgagcagtgatatgtagttctccttgaagaggtccttcatgtcccttgtaagttggattcctaggtattttattctctttgaagcaattgtgaatgggagttcactcatgatttggctctctgtttgtctgttatttgtgtataagaatgcttgtgatttttgtacattgattttgtatcctgagactttgctgaagttgcttatcagcttaaggagattttgggctgagacgacggggttttctagatatacaatcgtgtcatctgcaaacagggacgatttgacttcctcttttcctaattgaataccctttatttccttctcctgcctgattgccctggccagaacttccaacactatgttgaataggagtggtgagagagggcatccctgtcttgtgccagttttcgaagggaatgcttccagtttttgcccattcagtatgatattggctgtgggtttgtcatagatatctcttattattttgaggtatgtcccatcaatacctaatttattgagagtttttagcatgaagggttgttgaattttgtcaaaggcctttcctgcatctatttagattatcaatggaaatgtttctaaggcaagactgctaaaaacaaattcagtcttttgtttatttgggattgtctttgtttcccttttaattttaaaggattgtttttctggatccaaaactcttcgttatcagttcttttcttttagcattttagatatgttattccaattgcctgtggccatgattgtttctaattagaagtcagatgttaaacttatgtagttaccttctatatgacaagttgacttcctcttgctatttctaagattttatctttgcctttcgcttttcagcatttgaatactacatttgtagctgtgggtcactttgtgtttatcctgcttaaaatttgttgagcttttcaaatgtgtaaatgaatgtttttcatcaggttttggaaatttgggtcctttatattttcaaataatttttctacccatttcctttgttatttctctgtacttccactatacatatattagtatgcataatgttgtcccacaggtttctgaaaatctattcatttttctttaaaaatgaatgcaaatataaacctaagagagctggagcggctatactgatattagacaacttagaatttaggacaaaaagagtcttcccaaagacaaagtacatttataataccaattcaacagagagagaaaataattattattaatagtaatactatataataggtattctataaatatttgttagattgaagtttgtcagacctagatctttcaggctgggcaaaatcctaggggcattatgaaccacctctaataccccacagagttctacgaatattagataagttagtatatgatccgtctctgaacactcctcctatctagattgccagttcgagttacaggctgcaaatataatcagaatgaatgagaatggattttttgaacagtatatttatataatcaatttgccaaaattatcagcttcaataaactactagtagtatgttaaacattgtattaaggctggaaaattatttttgaaccagaaataaataagcttaggtaagtgaatggtagctaaaaattacctgctggtagcaaagctgtaaatataattactaaaaatgtccttctgaaaatatgtatgcacccctcagttgtccatctcaactggcttttaatctcacaaccagaaagaagtatggtaagtgttaagggcgttaataaagtacacttcacactgatgtttaatgagtttgccaaaattcccaggcataatttttaagtataaaataaattaaatattatatctttatataaatatataagtaaagtattatatataaatagaaattaaaattgagatgtagacatttccagctgaaataaagtgagaaggtgatagcattatttcttactaaaaattggtaataacagagctggtatatctttattatattcattaatgtcatgatacttttccagatatctagacttacaaaagaaggtaaataaaatgtggtttctacttcaagagtatatatttagttgtaaaggctcttgaaggtggtttgtcaattttctttgaaatcaaagggcttataaagattcagaggtagtgtacttgtgtggattttctcccttgtcatcacaaagaataaaagaagcatcccccttttctgagttagaaatcaaaccttaccaaggactgtttcacccaattgctgttttgaaatttggtcatcttaaaaccaagagagaaaattcattttacacacaagaacccatttcttcttatgtctacctccaagaaaaattttatctcaatgttgctaagtattcctggtattgtcatcagcaaaatctgctcatatgaacaggattttaggataaaaaaaataaagactgctttacacctcttgtctgttaaaggtaatgatgggtatctggatgagagttagtggtaaagaccttcaggctatgtaaaaccattaatcaatagaacaggaatattccctggctaatttatctgactgctttaaacataggactaaaaaataggaagtgctcagcataagggaaattaccttggcaacgtggcatatattcttttggagagagctgtagaaagactctaaaatgtaaccactactgcctgaaatctttgcagaatgcccacagccttcagcttttcccaaaatcaaataggatacaattattgctgctggtttccagtcaacattcaaatccatttaaaagcagattcctataaagttgcctctatccaaatatgcaaagtggtcttatgaaaaataacatttatgacccaagatccagttactagttttagcaaccttgagggagccacttagacttcaaaatatagttatacgctttaggtgtatatgtttatatagggatatatgcaaagaaaagcatttgaatactcaatatgcttgtccatctaaaaatctgaattttaggaaactaacaatttggaatttatttttaacctctcaattacagtcacatttttaagtaataaccattagttttcatgattgcatctccagatgctctcacatatattatcttactatgaagtaagaatgattttatctccactttaaatatgaagaaactgaggcttagagaggttaagcacattgaccaagttcagctaataaatgtatggagttgagcaagcattcttgttttttaactcctggttccagactctttcagaatctttgggaacttcagtgaattttcccaagattgcaagaaaatttcttcccactgagctaatattggagtgaaaaataaagacttattccttacaaaaactggcttcaaaattgcaaacccaaagccacagctctccctaaatattctcttttgctcctcccacttcttcaacgggaatgctttggcaaagacatgcttattcttttgccagattatccttaaagaagcagccactaagcaaaaagcctggactcagtgattatttatttaaaaaaaaagggaggacagtctgtagcaaggcttgcctgagtataccctcaataatcacccagagccttctttttgaaagccctttgaagtgtcactgatttctctatttcactagcagaaaagtttcaccaaagagtagtaagctatgcaatgaagcccattaactaataaaatttccttatttgtttatttattcatctattcaaatatgttttggtctaccaggttctggaaatattgaatactgcaggtgcaaagatggtcagttctaattttaggacaatggatggatggttgatgctaacgtcttactgcttaagcagctttcaagaatcttgggtaaataacgaaattaagtcagaagtcaacaagacatacatgcagccaacaaacatatgaataaaaagctcaacatcactgatcattagagaaatccaagtcaaaaccacaatgaaataccatctcacacctgtcagaatgactattattaaaaagtgaaaacacaacagatgctggcaatgttgtggagaaaaaggtacgcttttacactattggtgggagtgtaaattagtttaatcactgtgaatgtgtgatgagccctcaaagacctagaggcagaaataccatttggtccagcaatccaattactgggtatatacccaaggaatataaatcattctattataaagatacatgcaagtgtgtgttcactacaacactatttacaatagcaaagacaaggaaccagcctaaattcccaccagtgatagactggataaagaaaatgtggcacatatacaccatggaatactatggagccataaaaaggaaagagatcatgttctttgcaggaacatggatgaagttggaagtcattattctcaacaaactaatgcaggaacagaaaaccaaatactacatgttctcatttgtaagtgggagctgaatgataagaacacatggatacatcatggtgaaacaacacacactgggtcttatcagagaggcctatggggggaaggagggcatcaggaaggatagctaatggacactgggcttaatacctaggtgatgggatgatctgtgcaacaaaccaccatggcacacgtttccctatgtaacaactctgcacatcccgcacatgtaacccagaacttaaaaattaaaggagaaaaaaaaaaaagcttggagactagtgtgaaggacaaaccgcacagtaaggtaagtgtcaagatagaaagatggtagtatgggagtccatagaagacacatatagccctgtttgacttaaaggaagtagccagataaaggtcttgcacaagtgataatgcttagtctagaaagttaagtagtcaaaaaaaaaaaagtgaattggagagagagtaagtatactctagaagtttatttagaattccagataagtggctcagcatacataaagacagaaagaaaaagatataagcatcaaatgcactccttgtactacaaggactttactatgactagaaaaggttacaaagtttaaattttgtattttccaaattgcatccgatttaatgaacctcaaggttacaaagttggatttggaaccagaaagcaagtgaaaacacgcattactgggtctttttccccctctagaattgttagtgatgatgccatgtgttgaaaagtcaaatcaaagaagaataattcttggaacttattatgtaagtcatgttgcatacataagtttgctgaagttattcagagttgtacaattttcagacattttaatgttttgagaacatgaaaattcctttttcagaaaattggctaatatatacattcaatggaaatagcaactgcctgggctgcttctggaggcccacaggcatttcctattaggagatgcacaatctgcaatgttctggagctaaaaggaaagggtagttaagtgaccttttggccaacatttccttccaatcaaaattacttccttcctcttccctcactcccttgtcaattggtaagtttctctcaagatttcagaaaaataggaacagctatcgtaataatctagttggatatactagtttattgataaagagaaaaaatgaatgctggtcaattagtattgcacacatcaaaataaacacgttcattaagtatgtactgaccaaactttgatattactttaagggaagaataaagaacatcagttcaaaaaaatgggtaagaagttaaaactttgttcatttaaattgcagtttggtttgtggtgtaggaatctgaagacctggatcctagccctgactctactgcctaccaaatgtgcaatctggagaaagtcagatttttttatgtggatttcagtttctcaatttctatattcaggtaactgagttttgatctccacttttttttaatgtataaaacatttatatcagaaattttaattttaagaccaaaggaaaattattgttcatgtgactttgcaagatatgactacacatagaattattcaaatggacttagtctttccttcctgagtctactgtatatgactttaactggcaatcagaaagaaaaataatttgtatatagctgccttttaaaaggaaagaatgccagatttgtggacaagatgacttttattactctttcaaaaactacattagaaactgcagtagaacattatttcatttgttaaacaaacctcgcccaaacttcctcaaagttaaaagaacacatatgtgggaactagaaaagcctggtttgcaaatgaactaatacaaatatccaaagttagaactttctgaaataccttatcaaaccgtttatgacactttcttaaagaaaagtcttagctggaaaaagcagcttacattaaataattgtttcagggatcctgaaatagatggcaattaacagttaataaataatcattgacaactgcatacagtctgttacgcaaagccacaaagtgggtagagaaagtggagtggtagggagaactgtggacatttagttaagcttaacattctgtcaaacaactgaagaacaaactgtaatttgtgtatagaatcttctgttaaatctgctgctgaaacttaaaaaaaaaaaatgctgagcacggagtaacattttggaatttcccctggctattcttatcaactagccccatttgttataaaagtgggtcattctaatagcactatacagatttgctagaacataaatgaaaattttaaaggacacattaatccaaagaattccattaagatactactgctgcacatgggacaagtaagaaaactaatgtgatacagaagataaggaaaagaggacaaatattctccaccccaaggtaaaaaataaggtagattataaggagaaaatacttttagtaaacagggggtgggtgagtatatgacagtttccttctagataacttttgacagttggcctccacataatggtaagataatttggggtttgctaagtaacagcgacatctaaaacatgttctgagtaaagttaacagcatctaatatctgttcttttagaaaactacatgcacgtaaagaatatatgggcctttttataatgagatattttattttatgatcagaagagattggcaaagaaaggctgggcacggtggctcacgcctctaatcccaacattttgggaggctgaggcaggtggatcatgaggtcaagagatcgagataatcctggctaacatggtgaaatcctgtctctaataaaaatacaaaaaattagctgggcgtggtggcaggcgcctgtagtcccagctactcgggaggctgaggcagaagaatctcttgaacccaggaggtggaggttgcagtgagccaagatcgcaccactgcactccagcctgggcgacagggcgagactccatctcaaaaaataaaaaaataaaaaaataaaagaaattgggaagtaaggaaatttaaatcaaatgtttcttatgaattaaactatattgacatctcagaggactgcaaatgtaaacactcctaatcatgatgaatacaatacatattcctctttaggtaatgtcaactctttagaaattggggagagaaagaactattcccacatgaaatcataataaactctatattagaaactactctattgaaatgcctgctttaaaattaaaaaaaattagtgaattttatattcatggaatagtgatttttatatctgctgaagtggctaacaatgcatgtagttgataggtcagttaatcaattagaatttattgagcacctaaggtcttggacagtggtactgggatatctatttgacattattaatggaatcctagacagtcattgttgaataataataaatgaggactacatccctggccccgaactctggcaggagcttaggaagggaacattcactacaatcatggatctagatagtgattcagggaggccaattttaagggaaaacaacccagccacatcacctggtgttagactggacctgagattcgaagatattaaactaacacataagcaggacagagagaagatgcctggatgggaagtgtatggtgataattaaaacaggaactctggacccgacagtaagggttaaatgagtcaagatgtgaaaacagtgcttagaagaatggctggcatataataaataatggagaagtgttcattgttattatacagtgaatcatccaccctaagagcaaagctaatgcaactaattctgtcttctatggaatacttcaaaattattttccacttttgattaaacctcatatttgattttattagaattttacctaagaaacatcacagtttgttctgggtcctatgctgtacagggaatagcctacagtctggtacaggtcaaattaaactatcctaaccagttcagctgaaattatggtcaaaacaacaataatgtagatgtttcataagaaatatcatcctttgttacactgtgtccctactgaagcttgtacaacttttggattttttatgaaggcactgatccaattactctacctttgggcaaggggtgttgttgtttcacttcctcaaaataagaatcctacattaccacagaatcatcaacacatagaggactgctggcgtatggaacatgctcaggaaatatttgctgagtggattaatggccaaaggaccacagactcaaagatggaagaaccagagacaatataattcttcatcctatttcacctgcaaggaaacgaaaaactaatacagggttgaagccaacttaatctggatggggaatcaatctttcgatgatcataattagggtaatgcttctcttcctcctatactctatcctttctcttttcccttctctcactctctatgtccttttgtgtccagaattggtgggttcttggtctcgctgactttcaagaatgaagccgtggacccttgcggtcagtgttacagttcctaaagatggtgcctctggagtttgttccttcaggtgttcagatgtgcccggagtttctttcttctggtgggttcatggttttgctggcctcaggagtgaggctgcagaccttcatggtgagtgttacagatcataaaggtggcacagacccaaagagtgagcagcaggaagacttattgcaaacagtgaaagaacaaagacccgagtggcttgcgctgttggcttgggcagtctgcttttattcccttatctggcccacccacatcctgctgattggtccattttacagagagctgattggtccattttgacagggtactgattggtgcatttacaatccctgagctagacacagagtgctgattggtgtatttacaaacctttagctagacataaaagttctccaagtctcaacctgactcaggaccccagctggctttgcctagtgtatctggtgcctactgggacccacgctggggccgcaggcagagctgcctgccagtcccacaccctgcgcccacactcctcagcccttgggcagttgatggcactaggcctctcactgcctggggccggcggcgctggccagctgctccaagcgcggggcctattgagcctgcgcccacccggaactcgtcctggccgcgtgcagcctcggttctcactcgcacctctccctccacacctccctgcaagcagggggagatggctcctgcctcggccagcccagagaggggctcccacagtgcagtggcgggctgaagggctcctcaagcgtggccagaatggatgctgtggcctgaggtgcccagagcaagcgagggctgctagcacactgtcacctctcactttccctctactcttcatttttttatttatttatatttttttgagatggagtcccactctgttgccgggctggagtgcagtggtgcggtctcagctcactgcaattgccgcctcccaggttcaagcaattcccctgcctcggcctcctgagtagctgggactacaggcacacgccaccacgtccaggtaatttttttttattctagtagagacggggtttcacccatgttggccaggatggtctcaatctcttgacctcgtgatccacctgcctcagcctcccaaagtggtgggattacaggcataagctaccgtgcccagccttgcctctactcttctccgcctacccaatatttctctgcctctcctttggaattgagtctttctgaaagggaggtactgtgcacaaagaggtcccatagttacacaatgctaggctcaaactctaaccttgccacttatattagttcctcaacaattctaaacctcagtgccctcatctagaaaattgggataaaaatccatactgtgtaattacgacaattcttgataaatacatgtttgcgcatatgtcacttccacacgaaacttctgcagcaacctccccagtgtaagccaggttcttctgttatatgctcttatgatgccctccacttttccttgcagcttttaacataattataataaattatgtgtgtgtttgtttatttaatgttggtttcttccattagattattaagctctgtaagtgcaaggatcatgcctgctatatttgcatttataattctaggacatagaactcctgacacaactggaccaacaatgtatacatgttggatgaggaaataaagaaaacaagtgcttaacataaaaccaacaccaaaataaaattatttgtatgtagatcattattaaatcaatgaaatcagggaaaagttatagaagccatcaaatatttatttccagtaatttttaaaaaatttaaccccaatttcaagaaagacttcattcttttgagtgctttttataatttttaacccagcattaaataagtgtcgagttacttttatatctcatctggaagataactgtcataaaacatggtcccctttgctatctgactcaagagacaagaaacaacttacaatcaatgtcacaggaactcaacagacagaaaagattgaactggactaccacagatgggtataggggtaagagaaaaagaaatcaggacattctaggcaaggagaactgtgtgagaaagtgttgagcggccaaaacaactctcaaagagaatgaaagacaattaaaaagccagtttgtactgtaaaaagaagaaatactactgaggaataatggagtatactccagggaatgagatgcagggtattatttcctagtcagttttcagaaataaaattttctcctgctgctaacaggaaacttgaagaattttaaataatttaactaactggtattttaggaagattgactttcagtatatgtgccagtataatttaccttaaattaaaagaaagtagttatttctataatttacatttatttatgtttatagagtgtttcctaaagaaacaaggttagaaattaaaataatgatggccgagtgcagtggctcacacctgcaatcccagcactttgggaggccgagacgggtggatcatttgaagtcaggagtttagatcagcctagtcaacaaggcgaaacaactctactaaaaatacaaaaattagcagggcatggtggcccacgcctgtaatcccagctacaagggaggctgaggcaagagaagcgcttgaacccaggaggcagaggttgcagtgagctgagatcaccccactgcacttcagcctgggcaacagagtgcgactctttctcaaaaaaaaaaaaaaaaaaaagaaagaaaagaaaaaaaaaacgaaagaaagaaattgaaataatgatcattccaatatcttttttaaatagaaggctttgaaccatatgttgagtatttttatactaagctatgacccaaggtatattaaatatacaggagaagtgaaggttgatttccaaattatctctaggtccacatacctaatatattcatttcctttgaatgggtccctaatgactcttacattatgccatttttgaaaaggaaggctctatgatgtgtgaggtgatctatatatataatcaaaatataaaacacaaatcattcatgcacaaaatgatgatagcatagttaaaactcaatgaatttgtatagccatttttaaaatttgttctccagaagttaaggatcttctgttattcaatccaggaccaggacaatggaaagaatgacatcatgattcccatgccacccagggaaacaaatcaaatacaaatcactaaaaaagcctccaaagagtcaagacacaattaaaatttttacaaaggaaggtgcctaagcagaaggtatttgaatgctattggacttaaaaatgatgtttgggaattttaataaaatgtttcatatgaaagggaaaacaatctaaatgttgacaacaaagcgtggcacattactgactaaaaaaaattctaaagctaaattatgtcccaggtattcactcaattaagtaactagataaacagctaatcctaacacatactgtgagccaaataattctggtcacgttttataggtcagcctagagtttctcagatattttcactaaaatacttctcaggggctacagaataattacatatggggatataggatttagagggatggcttcagcggccccacaccaaatttattatcatttcatacttcatctttaaaaagtatttttttaaatatgtaatattaagatacttttccctcaaaactccacataatgatctaggaaagtcagccatactttttctgggtttgtgtaccttcttggacaacttctgtataaatacaggtatagatattttgccttgaaaactaatttaagcttcacagccactctatgaagtaaataccattacccccattttatagatgagaatatgaccagcccaaggtcacaaagctattaatactaagaggtagagagtgtatattaatccctgtttttcggaaaccaaagcccttgatgctttttctataataccataatactttcaccacaaaatataggagtaacaaagttagagcttatacttattggaattttgtttcttatagtaattctcaaaagaagcaatagctttagggaaatatattttataaaaggaaaatcaatttttcttaattttattttaaaaaattgaagcatactaaatggcctctagctaaaagtttatttttgttgtggggaagcacaaggaaataaatactattacaatgttatatttaccaggtaatgtaatgtcaaaataccaaaataaaatttatactttgtaagtaaattgcatgtattcttaagaaaaaatataaaaccatgacaattatctacaattagtcaaataaatggtatacctgaatatgagtaaaataaaaattataaagtggagtgctaaccctttatcactattggggagacaaggacttagagagggaagtcaaatagaaaaattctgcctgtgatttagaatgtaaagaaacatagatagttgactttgcactcatggtaacaccaagaaaatctagagagtataaaagacatacattttgtaggactactgatatgtggtgagttacagcagctttcaggggcaaatggtgcaggtgcagggaacagaaaaggagatctgccaatgatcaagaaacttaccttgttaaaaaatggtcaacagagctatggataacggtaggatcagccaggaaagatggatttgaaaaattctcaagtgcagtattatttgcacgtcataaaaagtcttcctaccttattctttcccaagtttactgagaaaagggaagtgaagataggcttgaaaagcaacaaagaatgtatgtattcttaagagagtatgtatttctaagagtgctagaaagctttgaatctaggctcacaaactagtcaaaaagacaatttcctaggcagctactacagtgagattgaagttgacataaacaaaattgaacataatctgcttaaagttgaggctcaatcacacactcacccgatattaataatttctgaattattactgcctcccttttgttaccaaatgtagggcagagctctcactctctgggaaaaacgttttcctataaaacatgtctagtataataaaatacaatacatgcaaaaaagcaagaaaataggatccaaaagaaatcaatccatagatcaccaaaatagtggaacaagtagacaaagatttttgaagtaactaatacaaatatgttcaaaatttacataataataaagaaaaaatggaagaacaaataggaatcttggcagtaaactgaaaataattttaaaaagaacaaaatcaaaattgtagatatgaaaaatacattaaattatcaatacactgaaagggttcaaaagaagaatgaatgaatcaccaaagaagggtttactcagtgggaatataggtcaatagaaattattcaggataaaatctgagagaaaaaatactgcaaaataaacctacagtgtcagttatctgtttgacaatatcaagtggtctaacattcatgcagctggagtctcagaaaagaaaaagtgggaaagacaaaaatatgtgagaaattatttttctaaaactttccaagtttgatgaaaaaaaccacagttctaagaagtccaatgaattacaaagaggataaatatatggaaaagtatgccaagaaatattctagtcaaaatattataaattttaaaaaagaaagaaaatcccaagactactaaggaataaaaagatatgtcacatacaaaggtactattataaaagtgactgaaaacttcttagaaaaaataatgcacaagacaaaccagtgatgtctttggagtactcgaagggaaggaaaaattagtcaaattagtattcaatatgagtaagaatattattaaaaaatgtagtcaataagtaattttacaatagatcatatcagagagcattaattgccagcatgtctgcaccaaataaaacactgaagaaacatttcaggggaaagaaaaataatagcagttggaatttcagatttacagaaaaattttaaaagtcacataaaaattagtcacccgactaatttttgtatttttagtagagactaggtttcactatgtaaatatccaagactttttagcagagactaagtttcactatgtaaatatccaagacttttgataatgcttcccaatttcattgaaagatgtttaattttataaattgctttgggcagtatggccattttcacgatattgattcttcctatccatgagcatggaatgttttttccatttgtttgtgtactctctgatttctttgagcagtggtttgtagttctccttgaagaggtccttcacttcccttgctagctgtattcctaggtattttattctttttgtagcaattctgaatgggagttcattcatgatttggctttctgcttgcctgttgtcggtttaaaggaatgctagtgaattttgcacattgattcggtatcctgagactttgctgaagttgcttatcagcttaagaagctttaagactgagacaatagggttttctaaatataggttcactttttttgcaaacaagatggtttgacttcctctctttctacttgaataccttttatttctttctcttgcctgatttccctggcagaacttctaataccatgttgaatagaagtgctgagagagggcatccttgtcttgtgcctgttttcaataggaatgcttccagcttttgctcattcagtatgatattggttgtgggtttgtcacatatggctcttattattttgaggtatgttccttcaatacccagtttattgagagtttttaacatgtagggatgttgaattttatcaaacacttttccacctctattgagataatcatgtggtttttgtcttttgttctgtttatgtgatgaatcacatttattggtttgtgtatgttgaaccaatcttttaccccagggatgaagcctatttgactgtaatggataagcttttggatgtgctgctggatttggtttgctagtactttattgaggtttttgcatcaatgttcatcaagcatcgtgccctgatattttcttttttgttgttgtatctctgccacattttggtatcaggatgatgctggcctcatagaatgagttagggaggagtccctccttttcagttttttggaacagtttcagtagaaatcgtatcagctcttccttggacctctggtagaatttagctgtttatatgtctggttctgggctttttttttttttttattggtaggctatttattactgcctcaattacagaacacattactggtctattcagggatacaatttcttcctggttcggtcttgaaagggtgtatgtgtccaagaatgtatcaattttttctagattttctagtttatgtgcatagatatttaatgctattcccattaagctaccattgacattcttcacagagttagaagaaactattttctttttttttttttttttttttttttttttgagatggagtctcactctgtcatccaggcatagtgttatggtggggtttcggctcactgcaacctccacctcccgggttcaagcgattctcctgcctcagcctcctgagtagctgggactacaggtgcatgccaccacacctgactaatttttgtatttttagtagagactaggtttcactatgttggccaggctggtctcgaactcctgacttcatgatcctcctgccttggcctcccaaagtgctgtgattacaggcaggagccaccatgcccagcctattttaaaatttatatggaaccaaaaagagcccaaatagccaagacaatccaagcagaaagaacaaaactggagacatcacactatccaacttcaaactctcctacaagcctgcagtaaccaaaagaggatgggactggtacaaggacagacacatagaccaatggaacagcatagagaatccagagatgagatttcacacctacaaccatctgatctttgacaaacctgatgaaaataagcaatgaggaaaggattctctatttaatacatggttctgggagaactggctagccatatgcagaaaactgaaactggaccccttccttaaaccttatacaaaaattaactcaagatggattaaagacttaaatgtaaaacccaaaactataaaaaccctagaagaaaatccaggcaatatcattcaggacataggcacaggcaaagatttcctaacgaagacaccaaaagcaattgaaacaaaagcaaaaattgacaaataggatataattaaactaaagaccttctgcacagcaaaagaaactatcatcaaagtgaacagacaacatataaaatgggagaatatttttgcaatctattcatatgacaaaagtgtaacatccagcatctacaaggaactcaaacattacacacacacacacacacaaattaaaaagtgggcaaagtacaagaacagacacttctcaaaagaagacatcacgtggccaacaaacatatgaaaagaaagctcaacatcgccaattattagagaagtgcaaatcaaaaccacaatgagataccatctcacgccagtcagaatggctattatttaaaagtcaaacaacaacagtttctcacaaggttatggagaaaaaggaaagcttttacactgttggtgggagtgtaaattagttcaactgttgtggaagacactgtggtgaatcctcaaagacctagaggcaaaaataccatttgaccgaacaatcccattactaggtatataccaaaagaaatataaaaaattctatgataaaatcacatgcacatgtatgttcagtgcagcactgttcacaatagcaaaggcatggaaccaacctaaatgcccatcaatgatagactggataaagaaaatatggtacatatacaccatggaatactatgcagccataaaaaggaatgcgatccgccaggtgtggtggctcacgcctgtaatctcagcactttgggaggctgaggtgggcagatcacgaggttaggagatggagaccatcctggctaacacagtgaaaccccgtctctactaaaaatacaaaaaattagctgggcgtggtggcgggtgcctgtagttccagctacttgggaggctggggcaggagaatggcgtgaacccgggaggcggagcttgcagtgagccgagattgagccactgcactccagcccgggcaacagagcgagactccgtctcaaaaaaaaaaaaaaaaaaggaatgagatcatatcctttgcagcagggacatggatggagctagaagccattaacctcagcagtctaacacagaaacagaaaaccaagcactacatattctcacttataagtgggaactgaatgatgagaacacatgaacacatggaagggaaaaacacaaaatggggcttgtcagagggtgtgggtgacaggagggaatgcctcaggaagaacagctaatagaggctggtcttaatacctaggtgatgggatgacctgtgcagcaaaccaccatggcacacatctacctatgtaacaagtctgcacatcctgcacatgtgtccctgaacttaaaataaaagtcggggaaaaatattttttattttttatttttgagacggagttttgctcttgttgcccagcctggtgtggaatggtatgatctcagatcaccacaacctctgcctcccaggttcaagtgattctcctgcctcagcctcccgaatagctgggattacaggtgcccaccaccatgcccggctaattttgtacttttagtagagacggggtttctccatgtttgtcaggctggtctcgaactcccgacctcaggtgatccgcccacctcggcctcccaaagtgctgggattacaggcgtaagccaccgtgcctgccaagatatttgatttttaaagcaaacaacgttttgtggggatgtacagcataggtaagagtaacacaaaaaatagaaatagagaaatacagtacaataaatttcttatatgtggcagggcacggtattgattcatctaaactgtaataggttaaagatggatagtataatcttcagtgcaactactaaaaattaatacaagaaaaattttcaatacaggaagataaaatactacaaaatatgtgattattccaaaagaaggctggaaaggaagatcaaagaaacaaaaaaacagaagaaacagataaattactaatggtggacttaaatgaaacattataattattatttatattaaatgcaaatgaaagacatttcaattaaaaggcagatatcagaatagacattaataaaaacactctacaatgcttgccattgatatactttttaatttattttattttatttgttattattcttttgagatagagtctcattctgtctccaggactggagtggttcactgcaccctctgcctcctgaattcaagccattctcctgcctcagcctcctaagtagctgggattataggctcccgccaccacacttggctattttttttgtatgattaggagagatgggattttgccatactggccaggctggtcttgaactcctgacctcaggtgatacacccgcctcagcctcccaaagtgctgggattacaggcgtgagtcaccgcacccagcagccactgatgtactttaaattaaaaaacatagatagaaattaagaggatggtaaataaagctaacacaaatcataataatagtgaactgcgttattaaaggagatgatgtagactgtaaaacaaggagcaaaacggaaaaagagggatatttcataaggactaaaagacagattcagcagaaagacaaagcaatcttaactgtattcatacctaaccataaagcttcagaatagaaggagcaaaaacttacaaaactaaagggaagtatagacaaatctacaaatatatttggagactttaatattcctctttgagtaattgagtgaacaagtaaataaaaagtaagaatataaaagattcaaataatactattgaccaaattggcactatatatattatagaacactcagtatatgcataatacagattctttttaagcacacataaaacactcatcaagtaagactacactgggccataaaacaaatctcaataaatttcaaaggactgaaaacatagactaaattctctgagaataacagaattaaattaaaaaaaaaaacaaaaataaagtaacatatttcttaattatttgtgagtcaaataaaagatcataaagaaaataaaaaatattttgatttgcagcataataaaagcataatagataacaaatttttttggactcagctaaagtggtgctaaggaaattcattgccttaaatgcttgtaatggaaatcaaaaaagatcaaaaaccaatgatctaagcttctatcttaaaaagctacaaaaatgaagatggtatattcaaagtaactaaaagaaaataatgaaggacagaagtcagtgaaatagaaagcaagcaaacaatagaagatgtcaccaaatacaaggtagtactctgataaaaatcaatgaagttgataaacacctaataaaactgatttttttaaagacagatggcatcaattccaatatcaggaataaagggagaacatcattacgagtcttaaatatattaaacagaaatgaaggcaatattatcaacatttctatgctagtaaactctgcagcttagatgaaatactgtaatatttcatctaagttgcagtttctttggcatagaaactcttttcaatggacacaaactaccaaagcttattcaagaaggaatagaaaactgtttagtcctgtatagtcttgtatagtcctgaatcgtcctgcatctgttgaaaacattgaatgtgaagtttaaaaactccacaaagtaattccatgtccacatggccttgcttgtaaattctaccaaatatgtaaagaagaaataacaccattcttatacaaactcttccacaaaatagagaacaaaggaaaacatcccaagtcattttttgaggccagggttagtctgataatataacctgacaagaacacaatgagaaaagcaaaagatcaatatcctccaagaacaaagatgcaaaattcctaaacaaaatagtagcacaccaaatctaataatatataaataggataatacatcaggaccaaggggaatttttcacaagaatacaaggtgggcttaacatttaaaaatcaatcagtgtaactcaacatactaataatatacaagagaaaattcatatagtcatctcaataggtacagaaaaataatcggacagtatctttatacctatttgtgataatgcttccattactttgattcaacattatattggagaccttagcatggacattataatggacaaagaaaataaatagaaggcataaaatttggggaataatgcataaaaatgactttgtttgcagatgacacaactttatatgtagaaacctcccccaaatctaaaacaaacaaataccaaaaaattcatataaaattaggttaataagggaattcagtaacgtcttaggataaaagttcaatgtaaaaagttatttgcatgtatgtatattaccaaccaactgttggaaaattaaatttaaaaaatcaatgccaattcatcagcaacaaaaaatacaagatatataagaataaatctctctctctctctctctctctatatatatatatgtatgtatatatgactactcctacactgaaaattacaaaatactgctgagatagcttacataaatggaaaaatataccacgcttatgggctggaagactcaatattgtagagaggtaaattatttttaagtttacttgaaaagtcaatgaaatgccaatgaatatcatagcaggctttctgcagaatttggtaagttgaccccaaagtgtataaagaaatataaagggtcaagatagccaatacaatcttgaaagaaaaaaaaaatcagataatttgcactacttgactttaatatttattataaagctatacttactaagacagtatggtattggcatatgctagacatataaatcactggaacaaaatactgagtccagatatagtaccataaatatatagtaaaataatttttgacaaaggcgccaatggcattcagaggggaaagaaacatctttttgaccaatggtgctggattacctggatatctattggaaaaattgaaccttgacatcttcctcacatcatacacaacaagtattttgtgatggattaaaaaccattatgtaatagttaaaactataaagttcataaaagaaaacatttttaaaattctttgtgatctagagatatgcaaaggtattttagaatccaactcactaaccataaaagaaaattttataaacaacatgataaaaatgtaaatgtctcatcaaaagtcactcttgagaaagtgaaaatgtaagccacggtctgggacagaactgcaaaacatgtttatgaaaaagatttgcatcttgaatatacaaaacaattttcataaataaataataaaaaagtaaatagctcatttctttacatggggaaaaaaggctcacctgagtaactttagaaaacagtgttctgtatccctgaacctgaaataaaagtttttttaaaaaaggatctatgaatccacctctaacctataagcttctgcttcaacatatctcacctttgcagtccaaaccaatgtatacgtttcatgtatacattagtatttgtattttacttttactatatatttatggcactatatcttgacttacaattttgttccattgatttatgtctttgcctgcaactcctgtctccctgaaatgtgtaaaaccaaactgtaacacaaccgactttggtgcactctctcaggacctctagagactgtgtttctgtgggccatggtcactcatattggctcagaataaactttttttttttttttttttggtgagatggactcgctctgtcatgcaggctggagttcagtggtgcaatctcagcctacggcaacctctgcctcatgggatgaagtgattctcctgcctcagcctcctgagtagctgggactacaggtgcgcgccaccacacatggctaatttttgtatttttactagagacagagtttcaccatgttagccaggctggtctcgaactactgaactcaggcaatctgcccacttgggcatcccaaagtgctgggattacaggcatgagccaccactcctggccagaataaactttttaaaataaaaaataatgaaagaaaaataaagaaaatggtgttttggctgaaaactatgtatttaaagataaaaggaagtgtacactgtacataaacactgtactttaattgataaatttgtttatcatagggattaaggttaaaagttttgaaaccagtttacatgtatactggtattaagtaaatagtggatggtagaaagtgggagtctagcttctcacttttggagagggaagtaaccgataagcagaaaaggaaggttagaatagaactggagtatagtcagagacatcaatatgaactcatgtttaaatatagactcatatatgcacccaaattaatagatttaaaaattatagatatatgtgtatacataggataatatacatacatatattacctagatttgtcccttgagagaatctggaaacactagtttaaccacgtgataaaggttaacgtcaccagaaacgtcaagtagatattacacatcacctcatgtgatgtattgagaaggacagttgacctctgtgatattctttttaaacactcataaaactagtctgatcattaaagtaaaaacattagataaatctagattaggcacatttcacaggatacttggccagtattctaaagataatcaaggtcgcaagaaataagaaaagcctgaaaaattgtcacaggctggaggacttagagtaacatgacaaatgaatgcaatgcggaatctcggactgaattccagaagagaaagtatacgttaataggaacactggtggaatccaaataaagtttggagtttagttaatagtaatatatcaaagttggtttcttaatgctgacaaatattctatggtaatataatatgttatcaatgtgaaaaactggttcacgggcataaagaaattctctttcctatttttttaacgttcctgtaaatctaagattgttccaaaataaaaaaaaaaatttgttcgtgaagaaatggacaaacacttggaccaacacttagcaagatgggatatatgaataaacaataaacacatgaaaaagatgctcaaaatctttagtcttagtggaaacacatgccaaaagcgcaatgagatgccactcactggaatagctaaaattaaaaagatgaacaacatttaatgttgaagaggatacagaggaactggctcccttatacactgctggtgcaaatgtagactagaacaaccactgtaccaaaatgttgggcaggttctgattaaagattagtatcttcttataacagttaaacataacacctatctaaggatccagaaattctacttctagttatctactccaaataaattagactgggtatggtggctcatgcatgtaatcccagcactttgggaggcagaggcgggaagaacatctgaggtcaggagttcaagaccagcctgggaaacatggtgaaaccctatctctactaaaaatacaaaaattatatggtcatggtggtacatgcctgtaatcccagctactcaggaggctgaggcaggagaattgcttgaacctgggaggtggaggttacagtaagccaagatagagccactgcactctagcctgggtgacagagtgatactctgtctccaaaaaattaaattaattaattaattaaaacatatgtccacaaagtgtcctgtaaagatcacatggacacaggaaggggaatatcacactctggggactgtggtggggtggggggagcggggagggatagcactgggagatatacctaaggctagatgacgagttagtgggtgcagcgcaccagcatggcacatgtatacatatgtaactaacctgcacaatgtgcacatgtaccctaaaacttaaattaaaaaaaaaaaaaaagaatcttcattgcagctttattcagaaaagcaaaaaactgcaaacaactgaaatgtctattattgggaacatggataaacaaattattgtatgtttaaacaatagactactacttagaaataaaggaacaagttcttgatacaaataacaatatgaatgaatcttaaaaaacatgttgagtgatagaagacacagcaagtatatactgaattatttcatttttatgagtttaaggaacggcaaaactaagtaatgaagaaagaaatcaggatactggttgattctgggagggcacagactgaaaaaaagaaaagagaactttctagggtgatgtcagtactctatatctcagtttaaagtgttacacaagcgtattcgtttatcaaaactcagcaatctgtacactttaagatctgtgcattttgctgtatataattgtacttcacttaaacatttaggtaaggaaaagaaaagctctgacttgaactcttgaatcaagtttctaaagtatatcgttggatgaaaagaaacaaaacaactgtagaaacagatataacagaaatatatgacatctgttagttctcactggagcataaactactgtaaaaagtgattatagtcatctcagactctcctgattgcaattaagccctctcatattggtgatacaaaagtactttctgtattgctgtattcctctcttatggcattcctattattgcagagatgaatgcaaatgataacccacttcagcctaggtaattgagtattatcctattatacttgtagttcacctccttccctgctcagattgagaccagtgccatattctctataagagaagctttcaaaattagtttgaataattatttatttaagagagagattgggtcttactatgttgcccagactggtctcaaactcctgggctccagtgatctgcccaccttagcctcccaaagtgctgggattacaggtgtgaaccaccaaacccagccaatttaatttgtaacaggttttaaaaagggaaagcttatgggtaaatataataaatgcatgcccacttcccaaattttccctattgctttaggtaaaaacaatactaaaaaatggaagacaaaattttaattcaagataaaatagactttccttagtattataactatgtttaaaactattttatttagttttatcacctataggaaactcagtctataggatcagatttaactcagcagaaaaatcccttttgttaaagggaaaataatggctgattatattcagactttttttgctgtgaagataagatatatttatcaaaattagagtagatggctccaacatttccaaacttagaatatatgctatacttctattctatataagaggataaatagatgtgtatataacctccctcaagtgtgagctggaaaggctcagtgcattgcatataaacagttatgccaagacgctggtttcattatgaaacatttacactaagcactgtttgcagcatgcatgccgttctgtgtttttctattactttcaaatgaagtaatctatctgtagaaaatgagcaaatggaatattcatgagttaagagataatttttatcatccctggagaccgtctttctttgggttattacctgcagagctcaactgtatgaaaattgattaaacataatttaccaattatagtgataccagagcatattccttaaagcaaacactaaaagcataatgattctcacaatagaaggtatgtttgcagggctggatccaggttctgtggggcttgaatcttatataatttggggacctcttatttaagaaaaatgacataaaattacaaaaacacaattgctgcaatcccccttggggcactggaaagagccatgcaaatgaatggcctctaagtttcatttgcttaaaggaaaatctgcctttgttaattttattttaagaagtagtggcagtagatcaaagaatttgtccatttaaacctatttaaaaactaacaaataagcctttgagttttcgtaattgacttgaaaaccagtggctaatgatgcttttctaaggggtcatttgactgaattcaagtacggtacttactttcactttttttgagacaagagtctcgctctgttactcaggctggagtgcggtggtgcaatctcggctcactgcaacctccgcctcccggttcaagcgaatctactgcctcagcctcccgagtagctgggactataggtgcatgccaccacgcctggctaacttttcgtatttttagtagagatggggtttcaccttgttagccaggatggtcttgatcacctgacttcgtgatccgcccacctcagctccctaaagtactgggattacaggcgtgagccgcggcgcccggccttactttcacttttatgagacggggtaggtagatagttcccgtctgaaaatccatgctgccacattgtgtgagccacactgttattattctttactttcaggaggagctgcttacacagtttaccaactccctaggccttgttccagcaaacataaatcttcaaaatgaaaagaactcctagtccttaagagttaggtcagaggaaatcttccattgccaccccaactcccttgctacaccacaagaaggattaatcacccccatctaaccttccataccctttgtagtcatctcattatatcacttttctcattttcattagttatctgtgtatgagcctgactttgctaggatgtgagctccttaagagcaggaaatgctctatgaacttaaaaggcctagttcacactgggggctcaacaaatgtctattgaataaattaatgaatgactgctttagaggtaagctactcaaggtatgatccaaagtatgaactagtagcattggcattacccaagagtttattaaaaatgtaaaatttccagacttaagacctactaaattagaatgtatgtaagaggccaggcgcggtggctcatgcctgtaatcccagcactttgggaggccgaggcgggtggatcacgaggtcaggagatcaagaccatcctggctaacatggtcaaaccctgtctctactaaaaatagaaaaaattagactggcgtggtggcgggcacctgtagtcccagctactcgggaggctgaggcaggagaatggcgtgaacccgagaggcggagcttgcagtgagccgagaccacgccactgcactccagcctgggtgacagagcgagactccgtctcaaaaaaaaaaaaaaaaaagaaaaaaaaaaaggatgtaagatccctaggtaattcctatacacaataaagtctgagaaacactgtggtttttgttattgcactagcttgaatggaggactctaccaagaaccatatcattttatacatcacaattgttcattattggttattaatatgtttggctctgctgatcacacccacagagggcaaataacccaatggactattatcctgcttactctttcttttccttaacaaattaaaacagtaatttaaaaagcccaagcttagtagaattagtgaaaaatgatgatgaatatttcaaatactaacctgaaagttcagctatcaattcagagccaaaactagggtcttcatatatatatacatatatatatgaatacatatatacatatatatgaatatatatatacatatatatgaatatatatacacatatatgaatatatatatgagagaatatatatttctatacatgtttatatatgtttttatgtgtacatacatatgtatatgtttatatacaaacatacatataaatatgttttatatatgtgtaaacatgcttatatatacatgtatattctatacatgtttatatatgtataaacatatatgtctgagtatatctatatgtatgtttttataaacaaatcctcaagagttcaacctcagtttttgtagaccaatgcttctatatctcagaaacttgagatgaagaaataatcttggaaaattacgtaaaattaaatttagccagattgcactctcagtacagcttctaaaaagtatgtgtcaaatgaaatctcaggttgtaaattacaactcacctagttttaatttcatgagagaaacataactagcatattcagtttacagtccacttccacaccctcttgttaagcagattaaccaactgtctggaatttttcaagcaaaaagagataaaatgatcttggctcaattttaagagtagttatcttttcaggcacttaggtaatctattgaaagagcaatcatatatcagaaatgtgattaagtaggaaaaggtataaatatatccatttgatgaagatacatttcaatgcaagtcttgaagaatagaaagagaaattaaagattgcaaagaactgtcacctatggcagaagctattagtcatgtcatggtgaagaaataatgactgtcttagagttgctcagttcttcaaggtgaacttcaaaagaataaagtaacttcaaagaaaaacacagaaagaagaatatgaatcacagtagacgtgttgctggtggagttaagcatgtacctgttttagttgatacataggtccgaaacacgtcaaagcttattttttccttttcaaaaatcatactctgaattttctctgcaacatgagctgaattagaaaacttccacctgatcatagtaggcatagtatcttggtctgaatgctacataatgaaggataatccagaaatctagtaaaatattgtcactgggaagagcgtgtatctgtttctggattaatcaggataggctaggttacactgttgagcaaaattaacacctaaatttcagtgtcttaacactatcaattatttttttttccttacaaaaatcttctacaagttgagcagtttccaggctgttaacaaagagctggaggtcaagaaggggctttttgctggttcagcttaaagtccattgcctagaacaaaacataagatcctgcctaacttcaaaggagctaggaaatgtagtgtcccatctacatgctcatgaaagagaggaaaaccagatattgaggtgcagtaatgatgttactagtgagcatatgttagatgatacctatagagggtccagcatcagcatcagaaacaaacctctctgaggaaagtaggtagataaggacatactctgagatgaaaagataaaaaaataacatcactggtcatgaacaggtcatttttagtgtagaaatagtccagaaaaatgatgtattggacaatgtcttagaatcagcttataaattgaatgcattccaattgctcactgcttaatgaattccagaagtagtggttttggaaagggaagaactgacttgttcggtaagttttggttttctattgattcataacaccttactgcaatttagtggcttaaaaaatagccattaattatctcacatttctgtaggtcagaagtttgatatgacataatgggattctcaactgagtctcactaggttacatcaaagtgtcacccatggctgtgttcctaatataaggctctgggtctaagctcactggttgaagtaatttccttctcatgctttctttgtgggcccctatctattcaagcaagcatcagcaggccagtccttctcatgctgtgaatatttctgagtttctcttcttattttaaggctcatgtaattacagtgaatccccccagaaaatccaggataatctccctattttaagtttagttgattagcaaccataattatgtctgcaaattccctttgactgcattatgtaatataaccaaaggaataacgccaagcaggagagatcacggggggcaaaaatctgcctactacactataataggaatctttaagcctaatatttgttttacatgtaacgattttgtttatctaacaggatattgtaaaatggacacatactttcaatggatttgggttgggatgagtgatgaataagaaagagaaagttataaagaataagcttgtccaacctagagatgagggaaaacgaaaaagagtaggaaatagggctaagagtaaggagaataaaaggagcagcggatgtgcaatggaaagcatgaaggagacatcaaacttaatactagcaattggtggagagaccatatagtgggctataatataaatcattagcaacaaagaaatgttatattgctcatagtaattcaggtactaagaagcttaaatatggtaggaatttcctgatttccctactacctaaatagattataataaataaagtgtatttgtttttctgaatttaccagctggcattatggaatcatgaaaatatagtaaaaattcaaggggacagtatgtatacaaagtggcaagctcacatttagctcctaaaaaataaatgaatggaaggaaaaaagtttgattatttaaaaaccactaattgtcattagtttatatcaaatcaatagataagacttagcagaatgtttcctaaaactaactggtcaatgaatatgttcaaactctccatcaatatgaacttctttccttatttctgtccattctctggtacaggttctaacacctccgaaagaagccagaaataaggtgtcagaaatatcatgaccatttatatgggttggctgtgtccccacccaaatctcatcttgaattatagcttccacaattctcatgtgttgttggagtgacttggcgggaagtaattgaatcatgggggcaggtctttcctgtgctattctcgtgatagtgaataagtcttattagatctgatggctttataaaggggagtttccctacataaagtctcttctcttgtctgccgccaagtgagatgtgcccttcatcttccaccatgattgtgaggcctccccagccacatggaacttgtgagtccattaaacctctttcttttgtaaattgcccagtctcacatatgtttgtatcagcatcatgaaaatggactaatacaaccatcaatagcacactaatattatctcaaaaacaaaaatcaacaacaaaatgggggagaagggattatgtggtcaaataaatttcaggcgtgttaacttcaagaaaacttaacagacacattccatgctggattgctcagaaactttaaagtgctaatgttcattgtgagtttttaagagagatatttaatctgaagagtttccaaaaatatttggctaggaaacatgttttcagtcagactatggcagaggttgctagctgttcaacaaattttgtgctctcttttccatagtagaaagtagaacctgtggcctggtgcagtggctcacacctgtaatcccagcactttaggaggccaaggtgggcagatcacttgaggtcaggagttagagaccagcctagccaacatggtgaaatcccatttctaataaaaatacaaaaattagccaggtgtggtggcatgtgcctgtaatcccagccatttgggaggctgaggcaggagaatcatttgaacccaggaggtggaaattgcggtgagctgagattgtgccactgcactccagcctgggtgacagtgcaggctctgctgaagaaagagagaaagaaaaagaaacaaagaaggaaaggaaggaaggaaggaaagaaaggaaggaaggaaggaaaggaaggaaggaaggaaggagggagggagggaaaaagggagagagagaaagagagaaagagaaagaaagagagagagagaaagaaagagaaggaaagaagggaaggaaggaaagagagagcgagagaaagggagaaagggagggagggagggagggagggaggaaggaaggaaggattgacagaaggatggacctgggaagcaagcttccaaataagagcgtatttcctggctcctcttgtatctacatattactgggtgataggttcatgacattggaatttgagcaaaagacatatgagtgcctgaagcaaggcttttaagaaaacggtatcccttgtctgtgatctctttctcctttctctgctagtagaaagaagtttggcagacccttaaaatgaaaggatcctgggtcactgtgtggaagaaagttctcagtgatcaggaatacatatattagaccagcgattttctacttggtgtgattttgtccctcaggaaacatttggcaatgtctgtaaatatttttagttatcactactgaggagttggcattactgacatttagtgagtagaggccagggaagctgctaaacattctacagtgcatagaacagctcttcatgacaacaaattatccaatgtatcaatagggccaaagctgataaacaatttagactgttaagtgagagaaaaatatttttctattgtattaaggcactgaaattatggggtttattatggcagctattggtaccttaacttgtatctcctagagttgatgttccaaggaccatacttcagggaaaacacattacataatcaatcctgtaaataccatgatttactggttgtcaagatgcgctgactctaccttcagagaatttctgaatgtaattccaacctctgtgttttagctggcacaatcctactaagatatgcatttcctctttcctgaggtattacaataatttcctaaatgaactttttgtccctagttgacttggttatttttacaacattaagcagtgacagaactagaacttgaagtcaagtttctacatctaaatcctttgtactcattcaccaatgtgtgagaggtactctattgttacggggagattttgaacttgagaattgaagagacctatctttaaatagtcttgattcttaataaaatcataattttagaaaaaccacaaagtacgtgtctgagtttggcctcaactgtaaaataaaaattttaaatttagattattttttagaattaatatacttcttgggatatggtaaattcgcatgaaattgtaacaaattattagggaaaaagaaatgtgcattgcctcaggcttactgacctatattttttcactgaactatttgcggatccatctaggtagatgttttctttccctagaaggagtgttttcagcgagtgggaaatctctaagttgttcaagcactgtcttcctccccaaagcttacatatgtgcgcctgcacagaatactcagacttatggccatcttcttgtctttgtgccccttaagacctgcagccagcttacggttgggcttcatttgtaatcattcactcattttattgtattggttttaaagttgctcctctgtgttatatacatgtactgtaacttggttcttatttttggctgttgatgttaaatcaatttgctttaaaaaacaattatggggaaacaaagaagcagcacaggcaaaatctcacattgttccacctgtcaggaatacttacatatctaaattttaccactctaccaaatgtctcacttttaccctgaaaatgtccctgacatagctgctaaaaataatcgttccctctatggactttccactctccttagtgtctctctttatttgtatattaatgtgttcgtatattcattccacaaatattcattaagtatcaggctctgtactgagactcatcacttcataacttgaactctggttatgaacttctcttatatctcctagacaaaattccttatggtactagaccacagattaccgatttatgtactcctctcacagaacctggagctgcacatagtaagtgcttagtaagtatctataatactcactgcttcacacagaagctagagatttactatttaccataggttttctaattaccttaatgactctaaacacagaatcacaaatcacacacatacaccaaaacttacttatgttggtttctatgtttcactcctggtgctagcaaactcaattaaaaattaaaagagggatacataaaacaaaactataatttgggcaatgctattctataattttatgtgctgagggaataacatcaatcttctaacatggataacaattacacacttaagaaggtttcctaatgaaagagaaataaaagctcaattatgtataaaaattacagctaccaaatgagtttaggggattaagaataccaaccatttatatgactaagaatttataagagcttaaaaagtgtcacgtgctttttttttctttttcttttctttttttttttttttttttttgacagggtctagctctgttacccaggctgaaattcagtagtatgatcacagctcagcgcagttttcacctccaggctcaagcgattctcccaccttagtctcctaagtagctgggactacaggtgcatggtgcatgccaccatgcccagctgatgtttttttttttttttacttttttttttggtagagacagagtctcactgtgttacccaagctgctcttgaactcctgggctgaagtgatccacctgcctcaacctctcaaagtgttgggattacaggcatgaggcactgcacctggtcacatgcatgaacttaagcatcctgattgggtgaaacaaacaaatcaaaacgcctgtatctgtgtaaccattaaaatttaatgttaggctgggcgcagtgggcctgtaatcccagcactttgggaggccaaggtgggtggatcatgaggtcaggagttcaagaccagcctggccaacatagtgaaaccccatctatactaaaaatacaaaaattagccaggcatggtggcacgcgcctgtagtcccagctactcaggaggctgaggcaggagaatcgcttgaacctaggaggtggaggctgtggtgagctgagatcgcaccactgcactccagtctgggcaacagagtgagattccatctcaaataataataataataatattaagaagcagctattctcaattaatgctatctatgtaaagtgctaagtagcaaagtttctttgtttcctccaggccattttctatcaaaagtttccttctagctggctgcccagtttaagtcacctgtacagcattttaagaaaattttcttatcatgtcagatcctattatcaagaagaatgttcaacttttaaagaaaatatcagctaatattttcttttacgtgaattgggagttggggttagcattacaatttgaaggcaaggactctctttgcttatccacagtgactactgccacgtttgtctcatgtaaagaacttagcaagtgcttactaagtgaaggaatgatagataaatttggccctcagataacattaaaattgaaatatatacacaattatatttaatattttttataacttctaagcatttatagatattatgttattagataaattactaaaaactaatagtaacaatattagcataataatactatattaaaattaacatagcaatgtattacaggtaaaatttaagttctattttttttatttttttttaaacagactttcactcttgttgcccaggctggagtgcaatggtgcgatctcggctcactgcaacctccacctcctgggttcaagcgattctcctgcctcagcctcccaagtagctggtattacaggcatgtgccaccacacctggctaattttttgtatttagtagagatggggtttcaccatgttggccagtctgatctcgaactcctgtcctcaggtgatccacctgccttggcctcccaaagtgctgggattacaggtgtatgccaccatgcccggccaagttctggtatttatataaatattactttctgatgacatttaattgagacactgtactataatatcttttttacctttttacatctatgactacaattcagaattcaaatacgattcataaataaggcatatgacaaggaagacataagaaagggctataaaatgtcgattttctcttccttagatacttaacaacaattatagtactatctaaaatcttttctgagcaggaaattttacaaaatattttgcacatgtatcacctaaccttatgtcaccacagcttggaagatgagtagcagtattctgctcttatagcctgagaacctgaggctcacctggagagatcagtggatgtgtacaaagtcacacaatgtagcttccacttaccccactctcatcaatttataaaaattcactctagagcttaatgatggatgcagaaagataggtttaaaactaatttactgactattaaaaatcctattaattggaaagatactaagagcagatcaccaatttggtaaaactgcaaatgaacaaaaaaagtgataaaatccttggctaatgtgtggcataatgaagatgttaatgagtttaatacttgggtatattttgtgaaactcatcatgtttgcataagagcaacttatagctcgtcctttggttgttaaaccttcctccagtgtggtgagtacaactgggtcaggttcctggacaggccaaaatgtagtaggatctattattgttcagctcccaaataatattaagataagcactaactgggacttataaggaatgattcaatactgagatgggatgtcaacaggatttgtcatgcttccttgtgtagggctctctaaaaacaggacttactgtccagtagtgaggtaggagttgagagtagtcagaccaagtagcatcatggaatcgagtaaaatgcttttgcccttgataagacattgattgagagagaataatgtgtttttctgcgcatgggattctaaacaatatattttctaaaaaaaattaactgctggtaagatatttctctgtgttttctagccactaagatccacttttattaccctacgtacaatgaccagagtgtcatgttacttggtggtgggtcacagccagcccatcacaacctcctgtttctgcctgtgctcagaggcacacatgtctttctcataagatcattaattgggaaaatttatgtgacttttttttttttttttttgaggcagagtctcactctgtcatccaggctggattgcagtggcacaatattggctcactgcaacctccgcctcctgggttcaacagattctcctgcctcagcctcccaagtagctgggactacaggcgcatgtcaccatgcccagctaatttctgtatttttagtagcgatggggtttcggcatgttggccaggctggcctcaaactcctgacctcaggtgatctggcccctcagcctcccaaagttctgggattacaggcaggagccagtgcatctggcaaaaattatgcaccttttaatcatgcacaaatataaagaccccatcctctcttccactccttccctggcacacatgcttatattagcccattaaggaacccagcctactttaatggaggcctgcctttccactcaagggtgagggtttaggcctccaggtttatggcagaaagacgtagagggtggaggacagagtgcttccccacccatgcaacttcctgccttcccctaactcctcccacattgtctgtccccactgttccccagacataactggctataaggttatgaagactttgaggaaggatgcagcagagagttctgacctatgctagaagaagttgagagcggttatttccagattcctgagaggtccaggcattgactgaagttgcatcagtgagaagcttagccagctaacagtcagatgccccagttgagtccagtcaatcctaggctgcttttgttacactgaaccagcctgacaaacctcctaaggtcttaagaggctgtttgtttgatctttcaatttctacttcacatttttcttaggaattattgaataaaatagtaagttagaatgtcagaataaaagataaatggtcttgcagctgtgtacatcatttcctaggaattggctggggaaaatcatgataatgacagctaagacatacactttgtactatgtgccaggcacttttctcaatattttatacatattaactgatgtcattcttaatcctatgtgatagatattattattacccccaactcacagaaaaagaaactaagtccctgctcaaggtcacacaggttgcagaacctaaattcaaatccctgcagtttggcttgagtcaatgctcttaactattataccatgcgctctactgctgcaggaacagccacctgttctgcatcctctcactgtttctaatcttacggatcttattcctgaaacaccaaactgaaaacagtttactgaattacctatcctttttcatgtatctgatctttctttgtatatgactgtcttatccccatggattgttcttcccccaagtcccctctcctttgaagacaatttcttgccctttaaatttagtttacaaagatgatttgcctttcctgaactcctaaacaatactaattactcccttgtttgcattccagtgtacttcttactccctcttcacagttaccatactaagttttgttggtctgtttacatatctttatcatctacaaatctaaggccttcttgaagccatagtctctatctcattcctctttgttgcatcagtacctcagctaaggtctggcacacagtaaagtccctcagtgaatatttctgtaatacattaatggattattaataacatatttgaatagcatttgagagcttctaatatgttttctatgcattcccttatttatctaagtagacaaacatgcatatcacacacacatactgtacaacagagattattcagcttcatttgacaactgagaaagctaggttcagggaagttggtcacagtttctccaacttaaaatcctgctctgtatatctggagacagttgttcccaaaaccaggaagatctcgtgtcacgatttttaattgtcctgaatgacctgctcgatggtgctcacaatattctagtattgattattccactagaatatcattcaagggcagtcgtttcctttagtggactctcttgctatcagtgatgccactgtgatagaataagaacagtgacaggacatttaaactctcattcctccctatcgtgtccttttccccaatgtatgttctttagaggacaaaaattctctatatttttcatctttatgcattccataccattaatcacactctatatagagaaggtactccaaaatatatttcttaaataaatatataacatgaaacattttcttttgtctttttttttttttcccctgggatggagtcttgctttgctcactttgttgcccaggccgaagtgcagtggcacaatctcagctcactgtaacctcctcttccagagttcaagcaattctgctgcctcagcctaacaagtagctgggattacaggcacaggccaccacgcctggctaatttttgtatttttagtagagacggagtttccccatgttggccaggctggtgtcaaactcctgacctcaagtgatccgcctgccttggcctcccaaagcgttgggattacaggcgtgagctgctgcacccagcctaaacattttctttggatagtttattgtttatcttttatttaaaatttggttagacttctaactaatttttaaccagggttcgcacattttttaagtccctaacataaatattttttgtgctatgatgttactagggatgatatttatttaattttacttcttggttttcatttgtttgtaacagcagattacagattctctgttaattcagctcttcagagtggtctgccagcatgtctaaccactcagctaccttaaacaggtactccctaaaagtagcatgaagttttaagaaagttaattgttcacacaggactcgactcacacatcctaattcagggatcaaaatgtcacataaatccctaacaatgtgaaggtaggtcaaacaaacaggactttaaattgcaaataggtcagtggaggatcaaataaaaatactatttctaataacatatgcattgtacagttcataaactgactactcatactatgtgcccagaaagtaattaggttcaagaatgattttaaatcaatttgtttaatccttttaactatcaaaaaaacaaaaataaaaacaatttactacaagtctgtttaatcctggggcagataaggaaacagtgtttgcctcagggagttacagatatataaacaaatatgatgtgatgtgtgcaagtttaatgtgccttggaatgactgggcacagtggctcacatctgtaatcctagcactttgggaggccaaggcaggcggcacatgaggtcaggagatcgagaccatcctggccaacatggtgaaaccccgtctctactgaaaatacaaaaattagctgggtgtggtggtgggcgcctgtaatcccaatcactccggaggctggggcaggagaatggcttgaacccaggagtcggagattgcagtgagccgagatcgtgccactacactccagcttggcaacagagccaggctccatcttaaaaattaattaattaattaattaattaaaattttaaaaaagtacctcagaacaaggaagagggtgtacatggtaggaggaggggtgaggcttcatggaggaggtggcatttcaggagatcccactccaaaaataaaccacattttgacaggtgaaatgaaagaaaaagacatattagacgtagacaaaaattagtgcaaaagcatacaggtagaaaagatcagagaattgcaaaaggaaattctgtgtgatcagagggaataaggcctaggaagagagacacacaatggatatgaaggaaaccaggccttagaggaggtcatgagtgtatatcatggaaaactgcaaagaggattgaacccccttatgtttgtgcccccactgagccatttattttctttaatcacagcatctgtaagaatatagttatttgttcacaataatcttatattaaactataatcatcttgagggcagaaactacctcacttatctcagtatttcaacagctagccctgtgccaggcagagttggtgctttaaaaaatatgtatattggctgggtgtggtggctcacacctgtaatcccagcactttgggaggccaatgtaggcggatcacaaggtcaggagaccaccctggccgacataatgaaaccttgtctctactaaaaatacaaaaattagctagctgtggtggtacacgcctgtacacccagctgctcaggaggctgaggcaggagaatcacttgaactcgggaggcggaggttgcaatgaactaagatcacaccactgcactatagcctgggcgacagagtgagactccatctcaaaaaaaaaaaaaaaaaaatgtatgttgactgagtaaattatattttttcacaccacaaaatctggactcaaagtcttggatctatggtggaatgttgtattatctgattatctggtgttagatatatttaaatcagtatcacaaactatttcatgattggtttcctctaaaactctgactcatctggttgcatcactgacatgatggactctcttatttccctaatgcccttaactatccatctcttccgtactctatctccagcctccactgaacttgcttatttggaaacattttatggaattcccctattgctttttttggttagagtcaatcatggctgttttaactgcattggtcatggacttactatgattaaaagggatttagggactaattgttctcagtacattagtccttgacacattcatcttggatctcattggcacttattcaattggtgctgtttggcagctgctcaattgttagttattatctatcgggaacaagactttaatcagaattttactcccaactatgtattgccaatttatatgtagctcatgccaattcagggaaaaataattccaagtggttcttggagtttggtgaagtgatcctaagaaatgaagcccacatatttctaaataaagttggcacattcggatgtgatatgatacatgaaagaaaagtgggttgtttgaacattaaaatgctggaaacatttatcattttaacaaagcataattttgagagaccaaaatcaaaattcataaacacaggtaagataataactgtcttttagaatccagaaaaaaaatttaaaggactaccctactactgcttatgctaatttcagcccaatgcttgtaatgaaatcatggcaggccagtgtagtacattggtaaagctggtgggctctgtattgatgtcgcctggcttcaactttagcttcagtgtgcctaaactgggagccttgggtatagttttaaacattctgggcctcagctttctcattccttgaatgaggtccacaatcatatctccattaaaaagctgtggtgaggatcaaataaattatctaaggaaaaaaaccacttggcacagttcctgctatatcatatgtactctatagatgctgggaattataattatatcctggtaagcactcaaataactgagagacaaaatgacaaagtcctgtaagaaaggtccagataaaattctttggccatattgtctttcaaattattttttaatggaaaagttataaaccagaaaaagaagaaaatgatgctggcaggtatccctgtaataaaaaagagcgaacacagagaaagaaaatcaatggaggatttaaaatgttcttcttgctttggcatctaacctcctgcttccaaattttttccagtatcatggtttaactactttaatgaagcgatgataccatatttctcttgatccacgtaacccaagtggtttacagaaacagaggtcaacagggtcaatatttctgactaatattttaattaaatctcaataagtgggcagattcccagaattgatgtagcgttgtgatatagaataagagaaatggaaagcagactctctgagtgagcacttatgtggtatcttgttaaaatgcagggatcttgttaaaatgcagattcagaaggtctgggttgggcctcagatcctacatttttacaagctcccaagtgatgctaatgccactggtttgaagacccctctctcaagtagtaagggtttagagcacagtcactgcttgggtttgagtactggctccttctcttaccaactacttgaccttggccacattagttaactttttcttgtatcattttttaaatcatcaaatgaggataagatcaatatctaactataatggtggttgtgaggatcaaattaattaacacatgtaaagcatgtaaaacagtacccagtactgagtaagcactcaataaatataaatgatttttatgattaagtgaagttttctcattataaacatttaagctagtcaagagagatgaatatcccagaattttaatcatgtttaattcagcacaataatttattttaaggcattaatgtcaagaatcacataaatctccacatgtgaagctttgcaagttataatttttcaagccaatgaacttaaagaaggtaatttacaatttttttggtggtagccatacacaaaggcatgagcctgtcatgatagaacagtaaacttcttcatctacctttttcattaagaaagaagaactaaatatgtttacaaaataactaagatacaacctactaggagccccacagcatcattagtagtttgttttcttcctgctctgttattattctctctcacaactataattatctgttgtttattatctctatccctcaacatgaatttaaactccatgagggaggggcaatgttgatcttgtttgctgctatatctcagcatctagcttgccgcatgatatttgttatgccagtaataaataaatgtttgtaaaagtataaaataaatgaatatgtaccttagttgtacattttattaatttattcaagaatgcattgagtagctgtgattttttttcctggttctaagtgctgggaatttttaaatacataagacacagtatgttcaaggagcttatggtctacttaggggaaagatatgtgagcacaaaactgaatacatgatcaactccatatggaaagcggatgaataaggaaagagctcataaagtagaggtgggagtgaaataagagctttccagttaaagaaaaaaaattatgcaatttcacaaaagtgtgaaacagtgagacgaacaggaaaccttagataggatatgcactggaaattaacagtggagacaaggcaaggtccaaatcataaagacaacatgagtatcttctatagcagtattggttatagtggaaatacaagaacttgaagaataaaaagaataaacttcttcatgaaggatactaataatactgttcagagaatgtagcaaagacaattaactacctcagaatatacattgtcttcttctcattagaaattgttaccctgctaaaaaattaaacacactagcgtctctcagctaggtatagacacgggattgtcttcaaccaatggatgaattgattcttctgggtaacttctggaagtgtccttaaaggtgaagagcacaaccttcttattgtcccttcttacttcctgaaatgtaatataatggttggcgctacagcagctatttgaaccattaggtaacctagcaaaagggagcctcaagctatgatgttagaagagttaaatagaatgatgctggatcttaactatggagcaccttacaagccatgggttgtctagcttacaacttcatttacatgaggggaaaaaaatcattttttctcactgattttgtcactcttactttgggagttgtatgccactgatcctaattctcagtgatacaactacagaaatggggaagtgcttcaagaatgactggcttttgaagtagatactgaaggacgggtaggagattatcaggtacaaaataagagattgggcattaaagaagggctattgtgttcatggaaatcatcaagaatacagtgtattcaggaaactgggagaactgtgtagtggaatcatagggaatattgtgtgaaaggaatggaggaagataaggcaccagtaaaaactctgaaatatcatactagtgagtttatattttatgagtcaatgcaagaccactgaaaactttcaggtagttaaaagatgggaccataggtagttttctggaataagaactcagagagctatgtggacaggaggaaggaaaatcaaaatcagagagacaagttcagaggcaaatgagggagtccaggagagtagtagaccaagggtcttgacaatgaagaagaagatagcacagagacaggacacatttagcaaacatactatgtaaggattactgatcacatacacaccaggacagaaagactcccagaaatgtaatgtgagttgagttgatagtgaggtaatttaccaccaagatggggaaggaagagaaacaaacaacatagaaactaaagccagactatgtgaaataaggaaaaaaatatatataaaagaaaaactgcaacacaaggatctgtgcgcagtaggatttctcttgtattcaggttacaattctcgtatcaccttctccaagagatctttgccatactatctttctaaagaagccactgcacttccctcccctcaaagcactttgcttcatttttttcagagcgcttactattttatagcttcctttttgtttgttacctactttgacaagaatgaaagctcataatttccacaagagtggaaattatgtcttgcttacagtaaacctaggtaacagtacctggcacaagtaggcattcaagaacttttattacatgagttaatcaaattaccttggagttgtttgaaattcagagatttctacggactgaatcaccctaaaattttacccccctaaaattcatatactgaaatcctaattcccaacagaattttcagatggggacaatgggagaccattaggttatgaggtggagccctcattatgggattagagttcttagaagaagatgaaggaaagagcttgcttcccactctctgctcttctctatgtgaggacacagcagaaggatggttatctgcaaaccagcaagacaggcctcaccagaaccaaaccatgctggcaccctgatctcagacttcccagtcagcatgataagaaataaatttatgttatttaagccacccagtcttcagtattctgctatactagtctgaactaaaagagagtttataaataagaataaaatattgaagagatcaaggccatgatataggagagctcccccatctgatgaatgacaaggaagcttagttccagcaatgcccataaagacctgcccaacagaaaataaccatttaggtgggaggaatcagagggcctgagcacaagtccaatttgccattacaaaatgatatgaacttggaaacttcacaacctcaaagcacctttcagtttccttagctaaaaaacgatagcttcctccacaattttgagaactaattaaagtaacatggatgaaagtgttatagtaggtagctagtcagacatgagcagggcaggagagacctcctccctagccacaacccctactactagaaatgtcaggtaaccatcaggtgatggtcaggtagttaaccgctactctaaaataataattggtcacagtcagtgatacaggaggtagaaagaaattgtttaggcagatagtgagggcaaagagtccttggcagagcgtcccttctagcaaaacgcagcccaagaaattatttttctcctaataaagagcagcctgaaaaatcaagctgaaaacataaataagcaagctggaagcttgcacaggggaatgctggcagctgtgccaatagaaaagggctagctgggggccaggcatgtccaacatggatgctccatcttccctttctttgctaccacatgtacaggaacaaagaaatgggtaacatggcatagctcaggcagagaacctgcctgcaggataaaagattagggtggggcctacaaaaaattcatcccctgtgcaaatggcacacctggtctaaccagttttttgcaccctatgtaaatcagacactgcctcctcaccagctcatctgtgaaccccaatgcatttcaccacagatccagcaacccacttttctggaacccctttctgcaggaaagagctattctctttctttcgcctattaaacttccactctcaatctcactttttgtgcgtctgcatccttgtcatctgtgagacagtaaatctcagttgttactccagacaacaaggccgtttcaccagtgtcagggaaaggcagcttcccaataaatagcaaaaacctgacactggtgatcagcagcttcctgacaagatcttaggagctggcagagtgggctcaaagatacacattaagaggcaaagtggcattttaactggcataggaccttctagggacattgggctggtaagggaagaatgcctcacatgcagcacctgctcccctcccaactgctgacaggccactgcacatgtggacagcccaccccgagggaagaatcatgggggaagagatgcaagaccctgaaaggatgccaacaacatataaaaccccaagtcaaaagatcaagccgtgcacatgatctctcaaattgcccacttggccagcctccaagtgtatttcctttcattcccactctaaagctttttaataaactttcactcctgctgtaaaacttgccttggtccctccttctgccttctgcccatcagttgaattctttcttctgagaaggcaagaattgaggttgctgcagaaccccgtatggattcaccactgctaacgaaagtgcgttggttcaggactttcaccccatgtgtcccagatcactctcaacttctaattattatgtattagacaaagtgacatcactaatgtaaaccaaaaataaaattctaagccccccaaccaaccaaatggacccctcctccaagccaagtgcattctaaagtaaacccaaaacactagttcaggccatgatgggaatgggtggttggacatgcttcattaatccctcctcctcctcccgttggaattcaggcacagctgaccagcattaacgttacaatagaagactgacaaagctgactatttagagtaataaaataccaacatgacagagagcaggccctgaaagaaattaaagcatcttaccccaaaatatatttatttgacataatttgaaatggccacacaaagttttctcttatggggaaaatctacattctgtagaaaatcccctcccctttccaggactttttcatgatccaagagagaattaactaagagtctggcaccttttaaagcctgataagaaacatttacaatctattattcgctgtgaagcctgcggcctggaagcttcacctgcctaataagaaccttggtctccacaacctcttaccttaacccaggcactcccttctattcattccaggtctttagataaactctttcaaccaatgccaatcagaaaatctttgaatccacctaccaactgaaagcccaccccctactctcttcaagttgttccacttttttggactgaaccaatggactgaacaaacaaatgtattgattgatatcttatgtctccataaaatgtataaaaccaaactgtagcctgaccatcttgggcacatgttctcagggtctcctggagctgtatcgagggccgtaggtttcatatttgattcagaataaatctcttcaaatactttacagagtttgaccctttttgatgacactaactgcattttaaagatctcttctcagcactttgagagcctaaggcagaaggatcacttgagcccaggagcttgaggttgcagtgagacatgatagcaccactgtactctagtctaggtgacagagggagaacctgtcttaaaaaaaaaaatctcttcccaggttgactttaaactttcacaacatgtatactcgcaaatttcctgtcaaccacaatctcgaacaatgtgtttctctttgtagcacttcaaccttttattaatgaagtgttcaacaacactgtgctggaccttagttgcttttaagtgtctccttcagtctgttaaataatttagcaaattaacttttattacaactaccgagaggcagggtagtataatgctattcttattacaagccccttactatctgctgtgtgaccttggataagttattaatctctttgcctacaacttcttacctatagaagtaacaataatatactttgtatggttactgtgaagattgaataaattaacatatgtacaaaattttaatagtgcctagagtatggttcagtaatagctatttttattcctacaatgacattgttcagatcattttcatatctgtactgtgagatatttccacctttctccattttattaaaaaaaaaaaaaaacaactaaggctcagagagcttaagtaatttcctcaagttcacaaaagagagagttagttctcttagatgccaagtctgtgcccttggccataccaaaataacattccattttaaagaatccagataatttcactatcaaagcataaatttattaaatcaaactgccatcgaataaacctgagttaaataaacttttggccattgtccttcttaaagtatgtgcaatagacattcaaagacagggaaatatcagtgaggttggttgtcagagaaagcttctggtggacttgggcagggttttgatatttgatttttttcttacattgagcctcaggttctacaataacctacctcaaggtcaaccccagtctagttttcagctgtagtttggcttgcaaatttcttctctcagtatttttgggggcccttaggccaaactgctaaagcacaggccatgactccttttttaataaacccaattacaactcataaatggtgacatgtgtcagcagaacaacccttggaggggtgtttcattaacttgatcaagtctgagcctgagggcatgtgccttgcatagctagctagctttcttagcagtagctgtgtctgttaccaagttaacaggtggcagctcagtttattgcctatataataagcacactaacccaaccacccatttctgttggaaggccttcccagaatcatagtaggttagcaggttagaagaactagatgctttaacttagttatttagttatttatcacttggagagattttttaacatcccaattcttatacccagactcagacccattaaacaggaatctttattcctggggttgaagcatcagtatgtttttttttttgtttttttttttgagatggagtctcactctgtcactcaggctagtgtgcagtggcatcatctcggctcactgcaacctccgcctcccgggttccagcgattcccctgcctcagcctcctgagtagctgagactacaggcgcgtgccaccacccccggctaattttttgtatttttagtagagacggggtttcactgtgttgtccacgatggtctccatctcctgacctcgtgattcgcctgcctcggcctcccaaagtcctgggattacaggtgtgagccactgtgcccagcccagcatcagtatttttgaagcgggaagcaattacaatgtgggggcaaggttgagagccactgctttgagacatcagcaaaagtattagcaatttgctttaaaaacaagaaaaccacgaaaatttcctgagattgtctttaaagagatactgattataatgcgctattgtttattcgttcctctcagcatgccatttgacctatctgaatttgttatttcattactacttttccttcatgtgacagctcattagattggtaatgtttcagttttatgctactgagtttccaaaataaaatacttgggggcaaaacatcatttagggcacttggtagaaattaggataatcaaaatgcatttccattaatgctgttcatgaagaggaaactatactttgtcaccaaaagtaaagttcatcaaagttcatccagctcttcgtgtatttaaacaaacttggaacttccaagtgacaactgaggggaagtaatttagggctgagatatgatacacttagaaaaggaaagacacagccgggcatggtggcttatgcctataatcccagcactttgggaggctgaagcaggtggatcatgaggtcaagcgttcaagaccagcctggccaacacagtgaaaccctgtctttactaaaaagaaagagaaaaaattagccgggtgtggtggtggggcacctgtaatcccagctactcaggaggctgaggcaagagaatcgcttgaacccgggaggcagaggttgcagtgagccgagagatcacaccactgcactccagcccgggcgacagggcaagactctgcctaaaaaaaaaaaaaaaaaaaaaagaaagaaaagaaaagaaaaagaaagacactagagggaagtcagtcactgaaacaaggtagctgcaaggtagctgtctgatttcacagagaaaaatacctatagttatccctcaggaactggcccctaaaaaatatcagtgtcaaaaagtcaatttaaaagcccagcaaggccaggcatggaggcttacacctgtcattccaatactttgagaggccgaggtgtgcggattgcttgagcctgggaattcaagaccagcctgggcaacatggcaaaactctatgtctatgaaaaatacaaaaattacctggatgtggtggcacacgcctgtagtcccagctacttgtgaggctgaactgagatgaaaggattgtttgagcccaggaggtccaggctacagtgagccctgatggcaccactgcactctggcctaggcaacagagtgagaccctgtctcaaaaaagaaaaagaaaaaaaaaaaagccaagcaagatttaacaagggagagatgaagttataaattaccccaagcatcacataaagttcctggggccccagaaatatgttttagtatttgcttttttttttttggaaatagagtttttagctcaatccaaatattacactgttaaaattgaggaaagtaacataaaaatgttaagccatttctctttattactccagtctcatttcctctccttgatttttactcaactgtcactcttcctctttcttttcactcaactagccactgtcttccctgtcatcatctatgactgcctacattttctttcaaatatatatttgagaaagaaaaaagcatttgtaaacgaccacactttgaaaagagtgcttatctatgagcaagttaaactataaagagccaataaattgggcagcccacttttaggtggtcacatgcacattgatccacatgatcatgtagattaaattaaaacacacatatttacctgatgaattacttttcaaataaaaattcactctattaaaacagtcaaattcaaataaacaattgagtgtaacattgaaaaaaacttttattgaaatcccactacatgcatggactatggctatttatggaatttatttattttatcatttttattattattattatttgagaccaagtctctgtcaaccaggctgcagtgtaggggtgtgatctcggctcactgcaacctcaaccttctgggttcaagtgattctcatgcatcagcctccggagtagctgagattaaaagcaggcatcactacagctagctaatttttgtatttttaccagagacagggtttcaccattttggccaggctgctcttgaactccctgacctcaggtgatcctcccacctcggcctcccaaagtgctgggattacaggcatgagtcaccatgcccagcctggaatttaaagataagtaaagcacaattgtatctggtgaatatcaagtactaagaattattaataaatagagaggaatatggtaaatactaatttaggactgcaacaatggccaatggccatcatttgttgaacatctattatgagccaagcaatgtctaaatattatctccaatgcttacaaccagtggtttctgaaaattttttagtgttcctaccagtaaaatgtttgcaagcgtgctccccgatatgtgctagtctgtatagatatagtatactgatacaattgcaacaatacagtgttttatatataaaatgttgaaattagaaatgatgaaaaactataaaggctagcacttgatggatctgcttcagcatcccctgggcagaagcttccgacattgaagaatactactaacatgttgtgtggtagaaaccgctgcttctccccaatattcattacccttttctcccataataacgggatccctcacttttatctgagcccagggcatctcagaataaaggttatatggctcagtctccctttgcatctaggaatggctttgtgcctaatctttgaggtatgagggaaaaatcatgcttacaacttttcagacattgctttaaacggacgaacaatgtccatctctgtacttcttttaacctgctatttagcacgtcagcatggtggtaggcctcttggactacatgtgcaagggcaacccccaagggtggtaaaaaagaaaataaaaggtacttgggtccttttaagaccttgtggagcagcatagacattctagctctggacagctaacctagggactgtcatatatgaaagaaatacattcctatcttgcaaacacatcattattttggtctctgttatatgtaactgaacctgtctcctaaagaatacaatatgcaaggtagtttttattgtctctccttacagctgagggaaaagggtcagagaagttaatttttttagttatccagctggtatatggttgaatcaaaagagcccagactccattctctttctactaaaataacaatctcccatgattgaaatactatggaatcaaggaggaaggagacattaatatgacctggagggattgatggaggcttcctgatggtggtggcagtttattgagatctaaaagatgggaatggaggaaaaggcattgtggactaattgaacagggtgaacaaaggtaaggatataggaaaatgtagaaaaggctcaagaggagcttgtgtcagttgttcttaggtgatcactattaagtctttggctttattcaaaatatgtttcagggcacctacaatatagcagataaaaattaagacctagaaatagagtgataaaatcagatgtcataatatcctaaatatatgagaagataatgctaccagcaatgcctacatgttaaagtccaaagccgataccaagcaaaaaaggccttcacaatcagactcaacccaacctcatattatgctattgctctgtgctccatatggatgaaactcaggacatgtgagttgcctgaactctgacctttgtacttgcacttccctcttcttggaatgccttttacctactttgcctagaaatgtctttttattctttaagagctagacaaaattctccctttctctgattccttgaaataggatggcttattattgtagtttcttcccttcctgcctgtctgcctgccttccaccagtcagtaaaaatgtgcagggtttctgaggtataactgtgggaaagataaagcaatattttctttgtgcttcatgaagtttacattctagagagaaagatcaactattaatgaaatagctgcaattcagtgtgataactaccttgataggaagaagagccttcggggaagctcctaagaggaactctaccctgaatctcactttcctagaagaagcataatttaagctgaaccctttaggatatgtaagaataagccaggcagagataagcaaggcgtgtttaacaacatgtgcttttcaccatgcattatccattttcattaacatgtctattcattagactaggaaacaatgtgtttaaaggtcccaagtgattcaaaaagaagaaaaaaaaaacccaccaggattaaacactcattcagattcatgctaaatgtctgatcattgtgccttagatatgtttattttgtccttcctgtatgcagtatttcctactttcacctccacttcagtttagcaactagagctgcttaaggtctcccactagcttttaaaaatctcttgtaaattgtagagcagcatctctcaaacttcagcaatcctaagaatcacctgaggtacttttaagaacaaattttttggttccactctcagagattctgattctatagctttggggaggagctggagatcccacgattctaacaacctgacctgtgagacctgacgctgccagttcacagactgcaccttgagcagctttatgcttgagaagctacacaaatatttttcaggattatttcccccttgttcttaaaagtgctctgctaggttacacttcttggaataagagtggtttctctgtccaggtaggtaaggcttttaggggaacccctctaagaaagacgggccaatattgctactttcacataacagtcacattcttcacttggacaaccgttttattttcccgttggctctaaatccaaaatgacaagcctaagtaagggcttcccagtaaatgagaagctatgagtacagtagtcaacaaactgccctctgcaagggtaatgcaaggcaaaaaaagtgaattagtttgtgaatggtaagtaggtcaggtcttctgttggtttttttttgtttttgtttttgttttgacttggcttttaaaaaatcatcccaatctaaatagaactttttttttttttgaaatggagtcttgctctgtcacccaggctggagtgcaatggcatgatcccggctcactgcaactgctgcctcccaggttcaactgattctcctgcctcagcctcccaagtagctgggattacaggtgtctgccactgtgcccggctaatttttgtatttttattagagacacggtttcaccatgttggccaggctggtctcgaacttctaacctcaggtaatttgcccacctcggcctcccataatgctgggattacaggcgtgagccaccgcacctggccaaaataggaattttataattttacaataagaaaatgatgaatcactgaacttttaagaaagctttcagtaattgctgacatttgcctccatgtgtatcatgtttaagagtcttcaaagttaagcttttaagagccatgagaacagggatcatgtctccatgtgagcatatcccacaattcctggagagtgctgactatttagaagatttgaaaatagtcaacttaaaaaaggaggaaattaaaccaacacacaaaaattggaaggatagttttgatgattaattaggttctctctctctctctctctctctctatatatatatatatatatatacactctcacatataaagaacctagagtataatcatttcttgataacaaattagctcccttatctcttctatttctttcttattatgtattgcctacaacagctctgtctgatagaactttctggaataatggacaattccatatctgcattgtttaatacaatacccattagccctactggctactaagcacttgaaatgtggctagtgcaactgaggaatgaatttgtaattttgtattattttattttaattaaatttaaataaccatatgtgacttataactacttttttggaaagcaaaggtctagaaagtaggacaacatagtagttgttcatagtgtgttcaatttgttgaataaatagagctctttccttatagatgtgtatatgtttaaagtaaaagagttagaaaatggtagctatctcaactgcaggccaaaacatgtagtgaaggaacaaaacatcaggatccaaaccaaaaaataagtttcttattgagcagtgtttctcaaacttaaatatgcatacaaatcactgaagtttttattttaaaacatagtttctgatttagtaggtctttggtggaactttagattctattgctcacaaactcccaggtaatatcactgctgttagtccatgggtcacactctgagcagcaaaggtctagatgtaggtaagccatggacctatgtaactgctactggcccaactcctgaactagcagtggcttctcattttgactcaccagttcaagattcagtcagagaaatgttttattttatcatagatacacccaccttacccccagtctcacgatgaatattcattaagccccttctgcatactaggatgagtattcataacaacccctgcaaggcaggtagtattattcctattttatatataatgaaacagaggcttagagaggtgatgtgacttaaccaaaactcaagaaaagaactaactggcagaggtgggtttacaacccagtcgtgcataaagccaaaggctagtttctctctttatactcttttgttactcaaagtatgatgtacaactaagcagcatcaacctcacctggcaacttattagaaatgcagactgacgcatcccagacctagtgaatcagaaacttcattttcttttttttttccctgaggtggagtctcactctctcacccagggtgggagtgcagtggcacaatctcagctcattgcaacctccgcctcccgggttcaagtgattctcttgtctcagcctcccaagcagctgggattacaggtgcccaccaccacacctgggtaatttttttctatttttagtagagacagggtttcagcatgtcggccaggctagtctcaaactcctgacctcagttgatccacccgcctcggcctcccaaagtgctgggattacaggcgtgagcccacctcttgcttataaagcaaagcaacaagcagttaagagtagggattctgctgattgtggcagttgagaaatgaatttagattggctaggtttgacaccagagcaaatattgacagctttgcctctattgctaaattcctattgcttcataggagtagttgagacaaaataaagctgtttcctggtaagtaaggattttaaaatttggaactgcattcccaatagatgaaaacattaacaatatagttttaacaatgtccatgggaaaaaccacaaaaagaagaaagcatgtttgttgaaagataaatgtactaaaatcagcaaattcttccaaaatatcataccattattaatcactgccaggatggttcaaaggaacacacatatttctcctttctttcccatcagaggcaattatggaaaatggtccaatcaaaagtgaatcatagcctaaatcataagaatatgttatttacactcaaataaattaatgtctaaatgtacagacctacaacaagtgcttggtcacctcacttctgtaatatggcaacttccttctcagagagctcttgtcctcagcttcctgatgctggtatcaatcagcagtgccatttaaatgttacttaaaacatctcttagacacaaacccattctctggctcctgagtgaagctcattgctaattcaattgtgtctctatgtcactgaacccatagtatcctttttcttgtcactgacactcatgtgttcagccttttttttggttcatctttttccctttagttcactctcttgtccttggccccagaatcatagttttgtttgcatccaatggccttttcacattgaaagcactctgtaaaaatgttgctgatattatatgatattataattgtccacaaataacttttacataaataactttcttggcagccaaatccaatgggggatatactactaaggacccactcatattcttcataacctaactcttatttgtgttctctttttcttctacttttctctctcccttactttcctaggagggttttccaagcaagagacctgaaacttctcccttgtctccactattatttctacctctagaaacaaaatttcagcaacaaagtgtcttataggaaagtaaaggcattgtactgccagtacttgctagatgtttcttttacttctcagtgtttgcccttagacaacatacaataatctacacattcactctccctatcagttgaaccaggtccctctgacactttgtttagtgccattgacctacaatataaagtacaagattttttcttttatatctgctttgtttttattttttattctcataaagggacatacacagattctcagccctttatttaaggccctgatgtactagtttattgtttagcaaatactcactcttcccctaattcgagcttggcaacatgacttattctggccaattgggtgttggtggatgtaaggtgagcagaagctttaactgtgtttgtgtcacgggcttgatttcttgtcctttgactatcacaatatgaaaacataccctggatagctactgtcccacctcctggtccccagaatgaaacttctgaagcagagatgccccagccaacctggtacaatggcaccccactcacccacttattcgtggtttcacattctgcagtttcagttatctactgtcaaccattgtctgaaaatattaaatggagaattccagaaataaacaattcataagttgcaaattgctttctattctgagtagtatgatgaaatctctcactgtcccactccatctcttccaggatgtgagttatttctttgtttagggtatctgtgctgcagatgttacctgccctttattcacttattagctgtctgggtgatcaaattgactatcctggtatagtagtttctgtgttcaagtaactcttattttacttaataatggccccaaagcacaagaatagtgatgctgacaattcagaaatgcttaagagaagccctaaagtgtttcctttaagggaaaacttgaaaattcctgacttaagaaaaaagaaaagagacagcattgtatgatgaagctgctaagatctatagtaaaaatgaatctttcatccatgatattgtgaagaaggaaaaatataatcatgttagttttgctgtggcaccccaaactgcaaaagttatggccacagtgcctgatagttaagatggaaaattcatgtatataggatttggcattatctgcagcttcaggcatccaccaggagatttggaatgtgtcatccatggataaggtgagactactgtattctgcagcctgaagcagctgtcctagctaactgatagagaagaaaaaaatgcttattgccgctgatttttttttggttgtggttacacaccaaaaattggcaattacatgaggtaacagtaaatggtagatcaagcactaccatttactagttgagatagaaaatccatatctttaaaatgaaaggtttgtgttcattgaactccaagatatttaacaagatggaaaactcatgattctcaagtatacctctctcaacagtgcatttctatcaaagaggtcagaatattaccaaaatataaaaagaatattagagaaggttagagcaaaataaaaaagcattctagaatctctctaattttattttctaaagcataaagaatactatttgttagggtgctgttcaatattgaactctaaagtgtctgctgaaaggagaggagagcgcaatgtcagttggttgcagagtaccagagagtaaagcattattatttggctgagtcaaccttcagggaactggattcacaagcaggctctaatcactctgagctccctaagaacaaagtactttcagtacctggcatgaaacactattcaacatgtaatggggaagaataaaaatattgagcaaaaaatagaaactagagagtattgaagtggaaaaatatctttccttgtttctgcttgggtgattttaattttcatatagggattcctgctttgcatgagaagctagactatgtcacatttaaggtcatacccaaccctaatatatcatgacctcatataagacagagcttacttaaggcattttcatgtaagaacctcagtgaccccttcattaatgcaagctctaatgtctcttaacttaccttccttaataaaaagaagtctctttaaatatattttgtacttttgtttgacacttacataaaaattccctttggccctagaaatttcctgtagctattcaattgtcatttgcatttgtgccaaggaaccattttcacaagaaccatttctatcaaaaatcaaatttgctaattagcaaaattaatacatttacttgcaatgaaattattttttagaaagactttaatatatgttaaagcttggcattctgataatatttttaagaaggaaatgttcttacgcaacatgactaaaatgccctagggaactctgaaatcgttttttcattaaatagagctgaaattatgtgaacaactagaacatgaggaagaaaagaggaaaacaaagtatagaacactggggaatgagaaaatagactgtgaaaggaacagtaatttgttcaaggttaccccgtgagtcaggaacaaaggggagagttgggactctgccaagaaccaaagcttatccacattaatgagtatgcactaaatctgccattttcaatacataatgtattcatgttttttctacatcggggaaggtattcatatttaccattctcctagaatttagcatgttttacctcataagtgtttattttttttttcaaaaaaatgataaatactttagctgctatcaaccagaagctaagaaaatctctgaggcaggtattataagtcctctcttataggttaatttaggtgcatagagattaaataaattacttaagaacatactaccatgataattgggccattttcatcatatcaagctcctcacaaaccactataaagatccttacccttaaggaagcacaaagtgggttacattaagtatgaaaaagttgattaggccaggaatagtggcttacactcgtaatcccagcactttgggaggccgaggtgggcagatcactgagatcagaagttcaagatcagcctggccaacatggcaaaaactcgtctctactaaaaaatacaaaaaacaaaaaaaaattagccaggcatggtggtgcactcctgtagtcccagctactcgggaggctgaggcaagagagtcacttgaacctgggaggcagaggttgcagtgagccaagatcaggctccagccatttgtactccagcctgggtgatagagcaagactctgtctcaacagcaacaacaaaaaagatgattaaaaataatttttgaaggactcaaagtcagatacaaacctggtatttggaagaatgggaagaattttgatgaatttgttatttgcgactcattttactagctaatcatttgggataccaattgaacatgtctacaaaagacccttagatcttactgataaattatttctacatgaggatatctggcagttacgccaccagaaccctaataggaggctttgaaataatttagatccaccacaagaaagtggtcttacttacaaaatcagctctctgtgctccaggcctacttcttgagagcactgcttacatgctttgacaatggctatagtgaagagattttttgggacataggattccttcatatataaatggatccctgtcctgaatatattgaagcttctgtgacaagttatctctcatccaaatctgcatgtatcaggggagtaagtaaggaaactatgttcccaagctgacaggcagaaaacaagggagggaagaaagaaacacaggtaacagcatgttagaaattaaataagacttctaactctacagccaagctatctggattgactcttgactctgcctcttactgtgagtccttgaaccagttacttgacctctttatgactcattttttcccaagtgtaaaaatagagaaattaatagtacctacctcataggattgttatgaggattaaatgagttaaaatttgttaagtgcctacagcagtgttaggcatacactgttacagaagtttggtaagtaaagaaaggtaggaagagtaagagaatagtggatgtaggtacctttaagacattgctttgtttgcttctacagagccctttactttccagtgttggggtctcttggctccttccagtaagcctaaccttgtttccggtctggtcccaaactattcttgttcagaaagatttaagaagccctagttcagtagttcaggtgattcagcattaagtcaagcttgctgttattcttgtcctgaccctgtgtcccagttttagttcctcattcttataatcaagtcccaaccttgtactccagttctgacattctgctcccctgtggctgagtcccggattgcagaacctgctcaggaccgccagaacctgctcaggaccgccagttcttttgaggtatttgaggtaacatctctcaaaaggcagcctatggactagacacactttgtttggcagacacagtgtttgcacttttgaaaattagttgcctgtatttagaaattgcaaacatgtacaaatttccatcttattttgtaaaatgatctggcaccagtggattccaagtggcagttgctctctttaaatggccatgtgctttctattccccacaggccccactctgactgctccatttgtttctgtgatttgcttggtcattgaagggatttgaggctgtgggctaaaactgagaagagccagtacttaccaagcacttactttgtgctaggtactgttctaagtgctttctgtgttttactcatttaatcaaaggccaggaatctgtttgttgttgtccattacccttgtagcccttcttctcagcttcataccccctgtctagcatgcatctgtggctatcccatcttgtttgatcactatcctccactcatcagctagcgcccactcacaaagccttgttggacctccataatgtcaaccactcacccacattgtggcctatagctggtctccaatcttccctgcccagccagactctatcttcaagaacttttgccatcatagtggttgtgttacaggtacagaatcctaggcttcattggtttgcttgatcctattatctcatgctcatgctttcataaaaccataactttcattatatatagataggctctaccctcacgaaacttttggccacttcttattagaagcccaataaaatccataaaaatatttattgattacttactttaggttccagactatcacagaaattgacttgaatattccttttataagaaacccaaagaagtttgctagtgtctatgagcaattcagtctcttttcagtgagccacttagcaaactaacactatttaaacagcgttgtttatttttgtttcataatgggcccttgtgttttacaaaacatgaatgaaagagggaaatatttgatgactaagacaagatttagaaattattaaaagaaaatttacaaaactacatgtcattccataagattatttagtttgggtgaaactaaatgtgaattgaatttaaattcagccaattaagttctaccacagttttaaaagaaggtagtaatgaaaaagttacttacataaggaattgtgtccaaagtatctgtgttgacaattataggagcaggactggcctgaaaaaagaaatagaaaaaaaattaaataatgaatagtgtattctgagacagattatttctgttaacttatttaacaaagagctcaacaggcatttcttgaggacctctacaggcaccgtgtcaagtgttagtagggtaaataaaatgactaagagtttctgtaccttcccccaactcaaatatttgttacatttaccacataaagaaattaagtaagcattcatataatttacattcattttctcttacattctacaaaacaatgcaggaggtgaggatttctgctatgtgtaaggcaaggatttctaataaattgggtaagagttaaaacttgtatcttttctttcttttttttttttttttgtgagacaagaatctcgctctgtcacccaggctggagtgcagtggtgcaatctcggctcactcagcctccgcctcctggttcaggcaattctcctgcctcagcctcccaagtagctacgactacaggcacacaccgccacacccagctaactgctgtatttttagtagagacggggtttcccacattggccaggatggtcttgatctcctgaccttgtgatctacccacctcggactcccaaagtgctgggattataggcatgagctaccgcactcgacctgtatcatttctttatgaaatgactttgctaaaggaatttgatttctctctcaaggaagcaaaattaaacctaaaccaatattcatagttattctcttcaaactgccttttgagagtatgctatattcaatacaaaaaggcttcacttatcaacatctacgtttacacattatgcgtgctgtatcctgtattttctttctttctttttttttttttttttttttttttttgagatgaagtgttcctctgtcgcccatgctggagtgtgcagtggtgcaaactcgggtcactgcaacctctgcctccccagttcaacgattcttctgtctcatcctcccgagtagctggaactacaggcatgtgccaccatgcccagctaatttttgtatttttagtacagacggggtttcaccatattgaccaggctgctctcaactcctgacctcgtgattcgcccgcctcagcctcccaatacaggcgtgaacaagcatgccctgccatattttattatttatgcacctctaatcataaacctctaaatccctagatagaacattgacagtcaaatatgacagaaaatcatattggatatgttcaactttcttttttttaaaaaaattgtacgatttgcagtaattctctttaaagtttagcgggaatctgtgtaaaactgatacaggagtgctacaaggcaaatcactagaaaataagagattgcaatctctatttgcatcaccagtctaacttcatgaatattgagtagagctatctttactttttagtttctagaattttcacaacaacttttgctttatcctccaaaggatctttcatctttgtctcaaattacagatttcatttagataaaggacatactttcatcttgattaatagagaactcttctatacgacatggtggttttggaaagtgctcaaattttggggtatttcattagctgtgccctctggagttaacagagttaacagctttttaatgtcaatctattctgtggaatcctaatcaaatgataaaacaaatagcaatccagcaggttttacaaaacaaaatttcatgtctttaccaaaaacactgggcatggaaaacataaccttggcatacatatgtatataatggatcaactagttagtcataatattttcatgattctcaatgggacgtatcttgtgggtaaataaagactctggagaaagacagtttttactggatctcattaaaaaaaaataataagaggcatgtagagaagagaaaaaggtatgaggtctgcagtcagaagacatgggctcaaggttggtttagcaactttctgattgtatgatttgggggctcagtgacttcctagtggtgtgatcttagggcaagtccactaaccctctctgattaattttccttccgtgtagaatgggaatagtagtaacaactttccaaaaaggttgaagatcaaatgaggtgatatagttgagtgtgcttggtaaacagtacatttcagaattaatgttaaatattattagtagtaagtgtctcttaagatagactactgtaaagatatattattggatggcttgtaaactgtttacactgcagagatctcaatgctatgttggtggctacaactgcactaataagaggcctgtttagattgtggttctaaaacagctcatgtcaaaggcaataataacaataattactgcttattaagtatgtattaccatttattaaatatatacataagcatatatatcctcatttaatctccacaaaaccttactgatgaggcattattatcactatttctatgttatatatgaggaaaatgaggctcagtgaaaatgagatttgacatttgaatattgttttttctgacctcaaaattcatttttccccactaagctgcttcataatcccagtatctaggtggttctatcacaagagtcttgcagtgatatgtcagccctatactagagtaccatacaagaactagacaaagcaaagaccaccctgaaggcaaaagatgcctaaggatattgcaggttagacgttgaacacagtctggtgaagccttagtatgtatttttaaaaaggtttttagttttgatgacatctctcctatgctttctgtttggtttccatgactcacaaaagtgtgcctcatatccaagaatagactgaaaactctctgaatatcacatgtaattcttgtatttccccatattttctagtatagctttgattaataaataggtattaattttatttggggctttcatcccatctttgctttttttcttacagattataataatgtgttatgggaataaattttatacatacgcctatttcctatgtaatgccatttaaaacttttgtatgtttatgttgctatttttcattttttaatgtaaatttagtctttccaagaagactgtatgtctaaaaattggcaagtattgtatacttttctagaattctccacagcacttgggtatacagaaggagctcaaagaatactgagaaatacttagaatttattgactaaaggtagtgataaagtatagaagtaggtataaaggaaagtaatatatctttacgagctttgtaaagcacttctaaagaactggaaccccaaaatctcatgataccaagactgtgactacttttccaatatccaatatcactttctttctttgtttagttactattacttaactaaattcagcttttataaaataataattaataatttcataactctaggatgtagagtctgtgaatggactccacttgaagtagaggacaagaatttgaaggataagatctatgttatgtggaatctatgttatatggaaagtttattattccttcttggtgccaaagggatccagaagccactgctaacacctacctctctaaaagtcattaaaaatgcatgaacaaacaagattgtgtaaaaataaacatatatcacatacacctgacattggtaacgccctggtgtgactgccaaagagatgccacggtaggctcttctgaatgacacactaccccactgtgctgctacaccaggctctctgaagactctcccactgccctgctccaggaccttcacagcccaccccagactacacagagcatagatgaattctgagcatggcctatgagtgtgctcttctcaccagttggtaattccaaatcttcctttagctcatctggctcctgattctttgttcacttttacagtcaagagaggctatgactagtttgatctagtttgtttctgagtcctaaaaaccaactatccacttgctttgatagttcccaccaagtattttctccacatttcacactgccctgccatatacaccctctttattttattattatttttgagatggggtctcgctctatcacccaggctggagtacagtggtgcaatctcggctcactgcaaacttcaccttccaggttcaagtgattcttctgcctcagcctcccaagtagctgggattacaggcacctgccaccacgcctggctaatttttgtatttttagtagagatgcagttttgccaggttgcccaggctggtctcaaactcctgacctcatgtgatccacacgcctcggcccccaaagcgctgggagtacaggtgtgagccaccacgtccggccatacactctctttcttccttttggatatcctctttaattggatgcctaaatcaaactggtgactcagcagattctagtgtccttctttaatatgcttttttccattaactggaaggagatttatgaaaaatctagaacaaaatctttctttaatcagaaaattcaagatttatctttatatacatctaggcaagatttttgaaactataagggatgaagaaaaaaaaattctttcttaagtaaaccaaactatgaagcctttttttgtgttgtttgccttttacatgacattctctttcatgcacagaaagccagttttcagcataagggactagtacagctaattacagagaagcaagaagcaagcagaaggaatactgatataatttaaatgatagatcaagttattaatgaatgtcagccaccttcctatccttgggcttcatgtgacatacaaatgttctcagattacatgaacaattttgtttatactagtaatagatacacttttttttttgcttgcttccaagagactctaaataaaaaataatctgacaaaatgaatgcaactttacaaaggagttcattgattctgactaatgtggttaccttttgatatgtgttaagtgtcagatatgggaaatgcctctgacatatgtggacaggtggtcatgaagccaactatggtgaagaagcctcctcaagcaaggtattggcaggaaatgtagagtagctagtcagccaagaaacactctcatgtagcttagctccgagaagtgtaggctaatcagtgggaaggtcaaaagacttaatctagtacctagacttttaagaagcaaggtagaaaaggagagaactagatcagcaagaaattaacagtaacactcatggtactaggaactatgcagggatttcagctgacccgggacatgcaaatggaaggcaggtgattgtcattacgccaatttaaataggtggtaaaatagtgcaagaataacatatgagctgtttttggatacctttggcttatcttatcagccttacaggacaggattactgagtgggcaagatttcttgtctatttagagggacacaggccctataaatgacttttatatatggtatggcatgacattttgaaacaaaatggaagccactgaaagtttgaaaatgagtcctgtatgtgggtgtatgtgtgtgcatgtgtatgtgtgtgatttcattatgagaggtggagatcccagaacctcaaggtaaatattagctgttttagactggcagctacaagatagcatgctagcaaactttttgcttcacaattcacacagaagatttccatcgggatgagccccagtcagaccatatgctaatcctggctagggaagtagaatattggggttactatgcacataccccatcaactttgaagtaagacatctaacattaagtaccggattagatatgctgagtgttgaacacaggataactgtattgtgtattagattttcccccataaccctctattatgttggcttactctggaaaaaaaaaatgtggcatggttgggggagtgacttccgccttcatttcctgaattacattttagttctccattggaacgaaactctgtctttcctctccttcttttccacaatcttttaggctggagttccacatctctaggtgctagtaggaccctactcctatttggaggatttacttggaacctacaattatcactacctgaaggtttgtagtattatgaccctgccacacctaaatcccctgatatattaatactgggacagataataataagtgtatgtacttatatagcaaatactttatgtgaattaacttatttaatcctcacacaattctatgagacaaacactgttattctcaaagtagagctgaggaaacagaggttaaataactttctcaaagtcacacagctggtaaatagctggtaaatcttcaaacccaagcaatctggctccagagccatgttctactgccccttagaatgaaaacagatttcaccagttatctctggatttttttttttttttttttttttttgagataggatcttaccttgtcatgcaggctggagtgcagtagtcccatcttggcttaccacaacctctgcctcccaagctcaagccatcctcccatctcagactcccaagtagctgggactgcaggcatgtaccaccatgcctggctaatttttgtattttttatagagacggggttttgctatactgcccaggctggtctcgaactcctagactcaagtgatccacctgcctcagcctccccagatgctgggattacaggtgtgggccaccgcacccagccagatcctaatttttgctgttgatcaacaagttacaagccagttcaaatctaaatttatttaatgtgccttgatcttggctggcccaagaaccttcccctccttcctctggtgtagttgctgaggcccagtgtgtcataagaagaggcctgtaggaggcatgcctaggaaaaggctgatggccccagcatacccaggctgactgattcaggcattctttgagcaagccccaaataaatgggtaattgactgattaaagacacatcgatggttgtgtaagagaggaagaacaaaataggaagaacaaatatattctagaatcatagaacttttaaagctgagatcttaaggaacctttaattacactcttacattctataaatatgaaaatgaatacaaagaatatgacataacccagatctcacaattacatagtatcaaaactgaggttaacaagaataacaataataaagtattaagcatatataaggtgcttattatgtttcagtaatgctataagtactttaagatatatgaatgcatttaatttttacaatgttctaaggaaaacattattgttcccattaaaaagaaggaaggaatgaaagaaagaaaggagagaagaaaggaagaaaagaagatcccaactgagcaagtcacttgcctaaggtcacaaatctaagaggtgccacaagcagtttttaaacccatgtctttctaaccccagagtccataatggtaactccaacatttgattttttttgcctgagtttttctaggcgaccagactgaaaatgcaattattttctgcctggaaacttgttagtttctcttttacagtctgaagagaaatttatcaccgttctgacttagattcaattccccagttatcagaggtttctgggtcccttaatgtcttgcaaacccccacttaaaaatgggacagtgctattttccagttaacctatttctcaagaatttagctgaataaagaatgcatgtgtaggccaggaacagtggatcatgactgtaatcccagtgcttcgggatgccaagccaggcagatcacttgaagtcaggagtttgagaccagcctggccaacagggtgaaaccctgtctctactaaagatacaaaaattagccgggcatgggggtgggtgcctgtaacccagctacttgggaggctgaggcaggagaatggctggaacccctggaggtggaggtggcagtaagctgagactgtgccactgtactccagcctggggagactgtgtctcgaaaaaaaaaaaaaaaaaggttcttaggttattatacttattactggagattagtttttactttttgctttcctagattttcttctccttttaagttccttctctacaagacaactaggtgggtgcagttcaatccagcccagctctaagtcatcactactaatatcatccagtggctttggcttgtcacctgctttgcccctgctctacggagacataagaccgctggacttactgagacacgaacagtgctgaataaactatgtgagtgcctgagggcgtggctagttcatcctgcagactgtgtcaggatgtctaaaggaagcaactttggaggaagctaagattgtggtccctttccctagcatttaataaaatgcctggatggttacctacctagcttaacaccagcctagctcagaaaacaaggtagcaggatggaagattcatgttttggcttgaaatcaatttgactctgcttgcctgaactcttaataataaaaataatattaccctcactttcagataacaaaactaataacagtaagtaactcgcccaaggtcattcagctggtaatagcaggaccaagagtcagacaacggtagcctggctccaaagtggataaatcctaaccactgcaatacatttgcttctgcaccctattaagatttgataagtaaagtctgttctagtcaacacaatttgtcttacttatccttgaacactcaccattagtattttttatccccttggactggagagttaccatctctgtttgatcctcctttaaaatacaaagtagtaaaatattttgcagaaaataaatgaatatcctatgaatatcctaaagacctcagataggctgagttggtcttcccttttttttctagtgcagaaatgatggagcagcctggagaatgaagcacagaaagtagagaccagtagatcccacaaaaaaattgagtcattagctcaaatctcaaatgtggtttagtcaatgtgccccatgccaaacagaattttcttcactttataagttttttctagaatcaatcctatttggatgaagaaatggggattgcttgaactgttagtatgaagattcttcagatctccatcctgcatgctcgccatatacgtacttacacttagtataaaaggctaaaataaattactcactaaaactacatctacagatcaacactgaaacacaaattggcaattatatcaaccaccaatgtcatgctatataaagtatatcacacacattcaatcatttaatttccatagtgagaggaaagggaactaacattgattaaccaactacctactgtgtgccaagcaaatatggtaagctttttacttgtgttttattgtttactccttacagaaccccagaaggattgacggaactttctcttgtctatagagaagtaaacagaggcacagaatgattctgtgaatttctcaaaatgtcagatggctagaaggaagcaaaactgagattcaaacccaggtgttctgactctaagccctttgcttttcaccattaggccataatgcctcaaaccccactgactcacaccgagcttttacaaatctgctttatttatgcaaatgatttctgaagatcccacaaaaaatggagtcaatagctcaaatctcaaatgtggtttagtcaatgtgccccatgccataataaccatacctacttaattcactgattcactctatgtggtgctattcctggaaagatccatgtggataccatctgttcctcgttgctaagctactaaagagctataatcttagcagtacagttgtattatccagatttaggtgccagaattcagagcaagctgccaataacctggttctttaggttaaggtagggcttatttcttctgtagtacatggataatggttttatacacaatgtgggatcactaaattattgctatttagtttccatccttcttctctcttttcctcccaccaggcaaggatccttactactccaagcacataccttgctcatgcctaccgcaatgtctttgttttcatttcttccttttcctacatcctaaatcagttgcagtcctcaatcttatctctctaaccaaattctttccatcctgcaaggacaatctaaagttccagatgcttcatgatactttccccatcatcactccaggactcaatctatacatcctattccccacattttaaagcactcattatttgtattacttcagatcacactgaattttaaatattaaaggaaataagttatgtgaaagcactaaaccctgacattctgaatgaatatttctttatatttttatacatgttgatagctaattggttcatgtgtgatattcatgtctccgtgcagaaattgtaatcattttgaagtcagggtcctcctctctatttcttcatcagccactccacctacactcctaacagtgctgggcatacaacacacactcaaacactcaaacagtaattgttaattgatttttagacctattggactagagccacagcaataggagttacaattcatgagaaactcttggggcaacagaattagatacaatgggtagaaaggggtaactgcatgctgccctctggtgatgagctcttataccacactgcttgatggtgtccatgtgtgagcatctggagcctgtcatgcactccagaccatgctattcactgcagagcatgaaaattaaggaaaattataaacagaaagactcctctatgctaattatacactggtactttgtgcttattcttccctattcctcattgcaaccctatgaagtacatattccaattatgattatcttatagataaggaaagtgaggcatggacctgtaacacaacttacccaagatcaccagactaataaccagatggagccaaggctcactcctcttgactccaaatccatattcttgtcttaccattaccctgcatggaacaaggatggtagctgctggcagtgttacttgttctaacttattattccactgtacatttcaggagaagttaggtgggaggaagtatgggatttggagaaaaaactaagaactcaaaaatcacgacaaagcaaaatgacatctacagcatttctcaaactttccagataaaatgtgagaatatatccccaaagacttacccaaaactagacatttattcaaagcctcatgtcttatattaaaaatgaatgcaattttcatcctttactccataatcatcttttttttcataagttattggggtacaggtggtatttggttacacaagtaagttctttagtggtgatttgtgagattttcgtgcacgcatcactcgagcagtatacactgcaccatatttgtagtcttctatcccctgaccccctttcactcttcccctcaaatccccaaagtccactgcaacattcttaggcctttgcatcctcagagcttagctcccacatatcagtgagaacatacaatgtttggttttccgtttctgagtagcttcacatagaataatagtctactgtctcatccaggtcactgcaaatgctgttaattcattcctttttatggctgcatagtgttcctatttttaatagaaacataaagttttgagtcattgataatggaatcaacctgacaacccaggtggttcctgcatggctataaaaaatcaggcactctgtctccctggaaataaccacactccagtcaaggaattatgttcctaatataaagatggcagaactagggagtcaggagatcttagtttcagacccagtaagttaagtaattcagcagtttactgagtctccccagttagttttattttttaaggaataaagagggaaatggcttctgaaagtccacttctcatcaaggatctaattttactcttgcaaagttcatcctgctaggaaatactgtaaagaaagcaaggatgctgtataacttttcattctgggaaatgatctctgtttttaccactcagacatagaaagttaggagacaggacattaagaaaagcatgcagaaataaaagacaaaagttaaatttgataaggaacaattatagaaattggtttctaatgacttggctgaagcataatgtcctgtatgccttagacaaggcacctcaaaaatctatatatggtcctgttgttctatgttcatagttcatattttgtttttcttgtaaacaggttaattttctggcctaagaactatgtaatcagcagcaaggagttctcttctatataaagagtaaaaaagatttgaagtgaagctgagaattattaccaagctctttcttccattattgcctctatccattttctataaggtataactccagaaaaaaaatccctctgccttcatttttcccctactcaccataatttgacactagatcatacactaagatttgaaacataacaggtgaggctatacagaaagtcttaaaatattttatatctagaatgattcttttgtgtgagaagaaattttagggagagaggcaaagatgaagtatgagttttagtttgctgttatccatcagtaatctgtaatgtgcttatgtttatggtgggcctggaggatgttccaagacttgtttctaaacaatggcacttgggcgctcattacaagacgaacagggtacaggatattttagtttcattttcccttattttaaattctcataacatctgtaagtctaagaatctcccctcaacccatttttcttcaaaattaatgttcaatttggaaacatttccaatgaggaaaaacatggagaaaaataacagataaaaaggagacgtgaatggggactagaaacatagaggttcactaaatactgctggcatttgctgatgccaaagaatatactctgcagatgtgtttctatattgtcatcaactaggcaatgaagtctttgttctccaagccaagagcctacaaatctctggatccaaaatgccaaccagttcctagccccacagctgttctagcttcccacagtggcagtgtctatgttactcttgctttctcagttttctggtggctttcttactttaaattattctataaagcaaggatactgcttgttcagtttacctcctagtaggcctggcataatgctacaactgtgtgtttaacataaagaaggaggaatattatctgttgctgtgggctagaggagagatggggaaataacaagaaaaaagaatgaaagagaaggagcacagggagtaggttgttttctggtatgtggggactctgtcacaagttggagagtgaaatgatgattcccaggctgggactctctcttctgtgctctcagactcctttttccattggaattgtaatctcaggtactctggaaccttcatttgttttataaaggtttttcctaaccaactagaaaggagatgataacttccttatgaatatatttgcaatcatctcgtgactgctcctcacccaccgttactggataagaacatttgtatcttatgcttttatgtcataggatgagcatcttctagtcctgcacttggatttagcagacgaggcttctaggactggctgtggccctgtagaacttagtcaagtcacttaactctctgaattatttctaaggttatatacaactataatgagaatcgtatgattcctgattttaatactagtctaattttgaatatcataaaagtagtaataaaagagtttagaacttggattatctgtctgggatttaagatctttctcctcacttctgcaatggtcttagctaattaatttaatctctctgaaaatttctattcatgtatagatgttaaaagttattatttcatcaatatcatgtggttcttcaagaagcaaatgtagccatatatgaggacattatgcaatttgtaaatgtatatatttgggaaaatatttaaaaatttgcagcaacagtaataacaacctttaccaggcacacttttgggtcaggcactgtgttaagagttcaattcacatgattttgttagacttcgaacaatgctaaaaagttatatataacatctaattttacattggatgaaacttaggctcagagaatttgagtaatttacccaagatagcaaatggtggaagaaggatccttcaagtagctgaaattctgaatcagaataaaaactgaactcggattttagtcctactacattatgtcttactgtttaaccatttctgatcctggccatttcaactttctaagctttaattttcatataactactatgaagatgataaaactcgtcttgcctaattgtgaaagttgtaacgagaagtaatctagtttatactactttgaaaattgtaacaagataaataaatataaggaagataggtagtagtagtagtagtagaggtagtcttagcagcagcagcagcaagagtaaaaacattggtgtaattttttcaactctacatgatgaaaatgagaattcccattgctcctaagcatcttctcgctaaataaaaatatctaaatgaagcttcaaaaactatggcatatctagtattagctcattaaagcttttcagattttaatgtgtatatatttttaaattttggtttgctacatggaagaggactgccattattaactctgaacagctgtctatttttctgttctgtaacaaataagcttggcgttctatttttgcaatttctgggatgggtatggaaagtggaagtggcagaatgtaagctttactctattgtacaataactatatcagtgctaatactccattttaatgagtcatcaaaacattttataatgagcaatactggaatacaaagaaggcaccctgcacctggtgttagtttttcgtggcctccagatgtgtatgcacaggcatcacaagaccggtagtcaaagaaaatgcaaacttcacaagtgaggaagatataaagatagcaggctcttgcttttttgttaaaaacctaaagtgacaatttcattccactttaccagcaatctgcaaatgttcttgcagtcccaagctattgtaattatccaggtcgcttctggtgtagttcccctctctgccttaaattgaacatctccatagattaagtgtcatctttattcctatactaatagaaattccattaatagccttgttcatattcttcagaaggaaatggactaaaaattggggtattactaaacagaaatgcaaagcaaggttaagaggaaggaaacagggaaatgaatccaacatgattgaggatgatgagttaagtactatttagaatccagaaaggacaaaacgcacttggaacaccatgaactgggactgaaagtcatcactgaacaaatcctatttagagctgacctcaacatatgatggttcaaactatacatccagggaccacagaggcagagttggtggatgtgatgctggagctcaggagacatagtttaagaatttatctgaggcaagaaggatcatttcctcattatcgtttcattgttgcctaaattctcccttcttaagtattcaccattccatctatgcagatttacttaggaaacataatatttaagaaaccatacttggcactgcagaaagtaggaagaggagaagtgcatagtcttgccctgcaaggaattcataatgtcatgtggagataaaagaaacctcccaaatgcttataatccaaagcagaaaaaaatgcacgagagaaatagggacaaagtcccatgacaggcatgaagaaaggcaggtgggattacggttggaagacctaggttctttcctggtcttactggccacaagattttaaacaaggtacttaaccccactaatcctctgaaatgtagataataacaatgatccatttcatgttggtattgtgatgattgcgtacaaaagtatagattaaagtagttggtaagaaatttccctactcttatttttcctcagggggatgttaatcagggttgaagtaaggagggaaaaggcatgtcttctggttactaggcataaggaaaggcttgtggaaggggataggagttaagtcctgaaggatacaaccttactttgaagaccactgtcctcagctgatctgtttatcttctcttcaactccgtccttcatcttctttagcactgtatcctattcctgtaccactagtcactaactggcccctatcttaaagttctgtggctgtgggtatagaaactcacttgcactggcttaagcaaaatttggaatttgttgtcaggctaaaaggacaagaagcacagcagggcaggccgtctgataaactggaactaagaactgggagttttgggggacccagaaagtcacagtccagcctctcttagttcttttcagcctcatttctctgtgtctttctttgagaccacatagtttctcacctccttttctttttctacatttgtttcattcttttacatttctgcacaaacgttctctgcttctccatggatatactcaattctaggcaccattgtcaacctgtaggtcaggccacacatagcagggacaattaagccaggtttctgaaaataatctctttcttgaggttctcttctgaggctccagtgcctttgtctgtgggcttgaattatttagtgttgtttttatgatttacctgtataattcctgaccttaaatatgacccaactctcatcctggttgttctgaccttgcttctgtaatgctcaaagtgttagatcacaagttggagaaagttagtaacatactctcatttcatactgctctttcttgccttagtgactttgttccagttgtttttaacctctcacctccctcatcttgtaaacccctgttttaaaactgtctcaagacttttctcctttttctagccttcgctggttatctttcctttccatctcacgcagatggatcactcttcccttgctgcatttaccatggtttgtacatcttttaattgctgctcctaatcacactgcaatatagttttcttggttttagtgttttcttcttactctaatgaggtggttaagaataacgctctctgaggttggaacactgagttcaaggaccagtcattccatttattaactatgtgactgtgggaaaggtacttcacctctttttttttttttttttttgagacagagtctcgctctgtcacccaggctgcagtgcagtggcgcgatctcggctcactgcaagctccacctcccaggttcacgccattctcctgtctcagcctcccgagtagctgggactacaggcgcatgccaccacgcccggctaattttttgtatttttagtagagatggggtttcactgagttagccacgatggtcttgatctcctgacctcgtgatccgcccgcctcagcctcccaaagtgctgggataacagacgtgagccaccgcgcccggcccatctcttttttacagtttgtaaaatggagatgatagtacctacatcagaagttgctgacagaattgagataatacatgtaaaatgcttggaacagtgcatggcataaaattggtactcagtaaatattaactatcactttttgaactgccagtacctagcccagggtgtggcaagcaggatgtgttgtttgctggataaatgaattatattttaaaactaaagcatatttgggaggatgttttatttcttttgttttgtttgtagtgactgagaaagtatctactattgctacactttctgataattgatgtttatctgtgtatgtatacatgtaatattgaattgcaattgtgagaaacactgtaaacaacttgcataggatagtattcaagtgtgtaatagagatacatgtgtaactgtttatttaatgtctgtccccaccactagaaggtaaatacccccagggcaaggtttgactgtgccctatttattattagatgttccaggcatatcgtaatttctgacacataaaaggtatttaataagcattcattgaatagacgaacacatggaaaaatagactgtgtttacacaatttacaagtgccttttctgtttcctccacttggaatgtcctcttcttccatcattactgagcgtcaaaattctgtttaaccttcaaacctagctgagacagccttccatgaagcttgccccttctctgaattcttgtggtaattcatagactcttaggatactctacattttgcatatggtattacagtgatttgcaaatcaatttgaaaattcttgggggcagaattccaattaggggttctcctgatttatacacgtttatatctctcccaatgcttaataagccgcataaccttcacattagggtcagaataagtttttctgagatgaatgaacgaatgaattaatagtattgcgacttctttttgactgacagaagccccaagtctagcagcaagatgagcataagaactgtacttaggacccactgatccctgtgtgaatgtttttatgaaatccagatatgattgttagcagtataaggaaaaccaaatttgtacattgcagcaagagatattagggcaccatttggtaatactatctctcttacaaagtgatgatgtcacaaagaagttttaagtttacttttgggcacttgtcctgtctagaatagtgtctgacacatagtaggggctctagaaaatgtgagtgagctgattgaactaacaaacgaataaaaacacaggccagtctctatgaaaagaactactaattatgagactgtttttataagcatatctactcatttgaataaaattgcaaagcctctgatttgcctaatatccaaaaatactgactgcctagaagaatgtccttatgcctccaatgatggaaccaatttaaaatacttcatgagaactttttattattcatgcatttaataaatatttaggagcttacattcgccagacacttaggctaaaagataagaaaagttctgtgttgctgttttgcacttgtggctcttggatcagcagatgaacttgcttgagactccagattttatttacatcttgttaactctaggggaggatctaatatgtgaaatcaaatcctgaaactttgaaggacttcatagtttggtttccttcttctctgaagactgttttgagcagcactatccaggtatcagccactttaaggttcctttcaccaatatgaattttatatgggaggttccctgggggcagattatatcatgacttgagattttatgtcaggtttattgttagttcacagaactacattgactgaaaaaccagttgtgattcatagcttatggtgtgtgagtgagatgatccggaccatctaggtggctccgcattctaacgatgcgttaggaatccacactcacagtagatgcacagaagagcatttacttgcttacgaccttttcaggtcaattctcctaagattaacgacatcaatatgtgactatactttatagacattgttcattttcaagtatttgatttaaaagagaacaaggtttattttaaaggaggcaattatttgagccgtatatttgtcactgatttaacataatagactcagcatgataggatatgtatacttcaggatttattacgatactgtaaacaatgaagtgtatcattagtacaaattccatacaagtgaaaatacatgtgtgtacatgaaatacatatcattgggttaaaaagtgcataaagcagggaatacatagagtaccttttctgctgacaaaaaaataaattgagggtcagtttataaagagttattcttaactgataatattttaataatggctataatttctaaaagaagctctcatgaaattgtgatgatataatcatatgtttaataaagacttggaagatgcttgagatatattggcaaattcccaatatgttctgaaaagatttagagcagtcaaaactaaagcaaacctgaatgataatttgggcatgattttatatatgtgtgaattaagcaaaactggaaacacactggaatcaaagacagagtagcccacgaattatgagaattgaatccaaggttaactggacacataggggtctattccatgtattaacacatccctgcccctaccactacaccaccacaatgctatagtcaaggttctgagttttctccagatggactttaatagaaataattttatgagatcagtaaagacaaagctaataatgaaaactgtcaagcattaattggaaattggagacgcttgttggttgatttagtcattcctcacttgctcaccaagcactctttatgtgccaggcactgtgctagacactgggaatagatgcacttctgtatttaaggagctcaagacaagacaacaacaacacaaacaaataaatgttagttcctttctccaacttactttcctattcacatttaccccaaaagtaacaatataattagagagactgagaggaaacacttaagaataaaatgttaggtgataaatcagagatgcacacaagaaatcaagaagggggaagataaccctgcctggcaagggatggctccgtgaacgaggaaatacttgaggtccacaaggaatatcacactttgataataacaaaaaaaaaaaaaaaaaaaaaaaggaagagaagtctcataaacataggagaagcaaactatactttctagattctagttcaaagcaggatccttatagcaaaatgatttagagagtttcccaccattagttttttagacttcttacaaaaattatataagctttatggctttagtagtcaagatcaacttaccgtgatccaactaaaatatagtggttcaattagaagagcttcaaatatagcccagagtttgtgacatttaagtgatttcgaagttacagggaaaaatatgatggcatctaacttgagtcacttgaaaataacatgaacttcaaggaagatttattccaactgttgaaagaagcatatctcttgagtttctatgtcagaaataatgtttttcttgagaaggtaccaaataaattttagcagagattattttttaagactcttctctcatagctaattggtgatctcaattcttcaaagtagatctaatgaaaataatcaaacattttaatattcttcttggtagtcctatttaccttatctcggcctatcaaatgttgccagcctgattcctctggttaaataaattataaacacaaacattatttctccaaaataaaacacaatgacactgattcactaattcactttacatagctatacacaacttctgtcagaaatttttacaaaatctaaatattgcatcactactttactaaagaagcaattatacttttcaagataacttttttggtgggttttacttggagtaaagaatagcaattttggtttcttgatctatatatcaaacctaactgcaaaagatattcaagtagctctgggggaaccaatggggaaataaacattgcagtttatttcaaacattaatatatggaatatcaatattgtttcctttctttagtacatgccactattagaaactactgtcttcagtgggatgagtttgattggaccactgtttattctttctcaccgattaatgcttggacatattaagaattaggaattcatacagagaaaaaccatatatttagcctgaatgagaactacagagaaaataactatgatcatcaaatgcacagaatttatacatttctctatagatacaacaggagaaaaaggaagaataaataaaagaatccctaggaaaataaaagaaaattttccttaccggaataaatgcatgttgcatagcttgttcacattgttttaaggaagcaatagtatcccacaaaagctgataattctcagcccgagaaacacttggccgttgcatagcgaaagctggtaacactcaaactgagctcacagaacccagttgaagaggaaaaaaaaaaaaaaaaaaaaaaaccctgcagatctgttacataaacttcttaattagatctgctacacaaactgctatcttaagacttaaaaaaaaagttaatcagaacatttcttttgggggataactgggcatgacttgaacagagacagatgttttcatcgggaagaattttcattcctacacttgtgaaaagcaatcccatcagtgctctcctgtcttcacacgggtctggtgaaatggcacataccataagcgtgtagggggaaagaagtaggaagaagagagatgtgaaaaaatattcctaccagaagatttgggtggcaggtcatggtggtggaatttaagtagcttgtgaaaagtagtaacattgaagggagtcggttatatacacacatatatgtacatatacagatgtcagcacttgtttgctgtgtcagaaatacaactatatacatgcatactcacagtgtcatttaatatgtccagctctcctctcagtttagttaagagctagatgtgacatattcttcacctacagagtattactgtcttaatggcactatgagttgtttatctgggattatctctaaagacaagccagaaggcatcataaaatgtaagagtaactagaagaactttatgttgcctatatattgaagaaaagtcacttttattccttattctagataaaatttacatagataatacaaggagaatcgtgtctttaaatgttctcgggaaatgagagtaggctggaatgtgttaattccaaagaaatatgcatgtgcacttcgacaacaaaaaagactcgtataagcatgaaataaaatatgaacagaatttagggacatattctcaattcccttcaccaaggacagtacccacacagggaggtgaggctccaccagtccctaatgtctctgtaggattgctgagctagaaggtgctaggaggtaaggcatcttggaaggtgatgctcagagcacttggaagttccaaaggaatccgtactctaagggctggttgcacagtcaacaatggtgatatttactcaagcatgtcaagaggtaagaggcaaaaggagagaaactcacagcataataaattatgcatttaattgacctagaaaatccaaggaagaccaaacaaggtacaaattgtaggaaacagtttgataacatacacgaaatattttccctgtattatttttggaagagcagcatgatttgggttacctagttttcctccatttgtaccctgatgatggtagactggttcatactaatgcccttgtagtgttaaagtctcaaaggctgacaccagggaagttttcctcttaccttcatttcttttcaattttgaactgaaggaatgaaaagtagaactgatctttcaaaatctttacctaatttgtaaattttacctaatttgtagggaaattgtttttccttagtacttcacgagcacacaccataaggctattgccattagacagtttgtttttcaatatcaattcaaccaaccttctctttttctcattcatggtgttctgttcagctcacacccacagtccctcctctgccttcattcctgcccttatagtctcccatctgccccagccacatgcttcttctccatgcattgtcgaccagccagcccacaactttcagaaaatattccttcactagtaaatgttctgaatttctcaggaaacaacaggaaaataaaaagctgtcttttaagttaccttccaaaatcccagtcattcctctctgaaattcttaagcaaatgcttatcattattccagaccccacttgctgggtcttgtgaggcttttccaacctcctgtttatcaggttcctttattctttcctttaaagagcatgtcctaaaaatcctcttctctttagtttttggggaaaaaaaggtaaagaattcatagtctttgtgtgtggaaacagttttaaaaactgccctttgaatcttgcattcattcatttattcattgatccaacaaacatatcaagcatctcccatgtgctataatttttttttttttcttgagacggagtctcgctctgtcgcccaggctggagtgcagtggcacaatctcagcttactgcaagctccacctttcaggttcacaccattttcctgccttagcctcctgagtagctgggactacaggcacccgccaccatgcccagctaattgttttgtatttttagtagagatggtgtttcgccatgttagccaggatggtcttgatctcctgacctcgtgatccacctgcctcagcctcccaaagtgctgggattacaggcatgagccacacacccagccgtgctataatttttggtagtactttggacaaatgaatacatcagatgttgcctctacctttaaggagaatctaacagaagggatggtaaatcagcacaaataacaaaaaggcaaatttaaaaacgtgtaagtaccataaaagaggtagcataaactatttagaaagcaatgaaaaagaagagattatatccatggtggacattagggcaggctcatggaagatttagcactttgctagagtctgttgttagggtagtatttagttatacagatatagggggaattctgagaaaggaaaggtacagcaaaggcacagggtgggaaaggcttcattgattattgttttggaagaaatgtgacaccaagaaaaaaattgtaaatcaatgattacccagcttaaaattaagatttagaccaaatttgagcttattcttgattgaaaactaatagcttcctattcttgatgctaaccaatattacctttaaccaactcacagataattcatgttcataaattcagtgaaaatcttcttaaacctcttgaggtgataagttctatgtgtttattcctcactgtttgaaataggcacattgatatacgtttggaggccctaggtggctcaatcatttaggttatattacttattatttttcattaagcaaatattacgtgttttgtattcctgcccactttcataagttctaaacttcctactttctaagttcaagtggggtccactataaatccaatatttaccttatcaaatatttaacttagttcaatttgactcagtttaacaaacatttattgagctctactatgtgccaagaactgtgctagaaatagagaacacaaagataaatgtaatattatgtcaatcctctgtttcttttctactatcactcagtgtgcaactgtctctgcccacaagtggagcatatgtattttcttcctgttagcacgatgcttgataagtaattgctaccattttttttccattaaacacgcagtcactaggctacatgtctatcacatctaaatatgtcacgatgctctaacttagactgcagacctcagaatacctaacggtacctttgtatggtgggactaccatacgttgagtgctttctgctggtgaatggtttaaatttaacttcatgacaattgcacttccagtaaaaatagagtaacagggcctggatttgcattcccacctaaaataaccaaacaaaaggacacaatgtaggaaagaatgggtttcaagaatgcacatgagacaaaaaacaatgaacacagagagaaaagaaacaaacaaggtgggccctgtgatttctaattcttatagcctttaacttccaggccatattccagaaaggaggaatccagttgtggccaatggacttgttgcgttgagaagacagaattggtttgctgggaagatcaaggcagcaagtagaaatagataaatccacaattataattgaagatatcaacacctttaaataattaatagaacaaatagaaaatctgtaaagatagagaagacttgtataaaactaggcaccaatttgagctaataaacctttatagaatattttactccacaacagcaaaatgtacacatttttaagtgctcaaatagtatttaccaagatagaacatatttttaacttgaaatcaaattttcataaatttaaaaagattcacgtcacaggaaatataatctctggctataataggactaagttgaaaatcaataacagaacaatctctggaaactctcaaaatattaagaaaataaatgacacaattccaaatagctcactggttaaagaaaaaaattaaaaatgagaatatattttgaactgaatgaacataaactacaatatattgaatttgctggattcccttaaagcagtaattaaggaaacatacatatcactacacgcttatatttgaaaagaaggtagtgtcaaattactgacttcagcttccatctttcacgagaaaaaaaatatagcaaattaaacccaaagtaggcaaatgaaaggaaataaaaaataacagcacagaagatagaggaaaaccaatgaaaatgaaagctggttctttgagaatatcaataaaattgatgacactctagcaagactgattaggagaaacaaattatcaaaatcaagatggaggaagatgacatccctgccaatcctacaatcctacaaacatgaggagctaataaggaaatctttatgtatgtaggtatatatttatttatttattcttatagacagtctaatgttatgatcatggctcactgaagacttgaaatcctggcttcaggcagtcctctggcctcagcctcctgagtagctgggaccacacgcctggctaagttttttttttttttttttttttttgagacagggtctcactttgttgcccaggctggtcctgaactcctggcttcaagcaatcctccagcctcagtttctcaaagtgctaggattataaaacatgagccactgtacctggctgagaaaatcttataaacaactttttccccccaaaaattaataccttagatgaaatggacaaattccttgaaagatgcaaactaatcaagaagaaataagtactttacatagtcacatcataagctattaaagatatttgtaattaaaatcatcccactaagagaactccaggcccagatggcttcactgataaattccctctaaatattttaaagaaagaaataataacgattctacacaaaatttttcagagaactcaagaggaacaaatactttccagatcattttttttttttgaggccagcattaccctaatcccaaaccagatgaagatattacaagaaaagctaatatcaataaaccctcatgaatatacaagcaaaaattcttaaaaaattttttagcaaatttaatcgaacaatatataaaaaggataatgcatcatgaccaagtaggctttatcctgggaatacgaaattggtttaacatttacaaatgaaccaatgaaatttattaagttttcttttcctgaaaattaaataatgaatttattcatatgttgaacacctcgttaactattttcacaaattgtaattatgaaatagtaaacattattttatttatttatttatttattttattatactttaagttctggggtacatgtgcagaacatgtaggtttgttacacagatatacatgtgccatggtggattgctgaacccatcaacccgtcacaaaaacaccaaaagtaatggcaacaaaagccaaaatagacaaatgggatctaactaaagagcttctgcacagcctatgaaactagcatcagagtaaacaggtaacctacagaatggtagaaaatttttgcaatctatccatctgacaaagggctaatatccagaatctacaaagaacttaaacaaatttacaagaaaaaaacaaacaaccccatcaaaaagtgggtgaagggtatgaacatacacttctcaaaagaaaacatttatgtagccaaaaaacatatgaaaaaagctcatcatcactggtcattagagaaatgcaaatcaaaaccacaatgagataccatctcaagacagaatggtcatcattaaaaaggaaacaacagatgctggagagaatgtggagaaataggaacaattttacactgttggtgggagtgtaaattaattcaaccattgtggaagatagtgtggcgattcctcaaggacctagaactagaaataccatttgacccagcaatcccattactcggtatatacccaaaggattataagtcattctactataaggacaaatgcacatgtatgtttattgtggcactgttcacaatagcaaagacttagaactaatccaaatgcccatcagtgatagactggataaagaaaatgtggcacatatacaccatggaatactatgcagccatataaaaggatgagttctcatcttttgcagggacatggatgaagatggaaaccatcattctcagcaaactaacacaagaagaaaaaaccaaacaccacatgttctcactcataagtaggagttgaacaatgagaacaaatggacacggggaggggaacatcacacactggggcctgttgtggcatgggggtgctaagggagggatagaattaggagcatttattaacttttttttaaagaaacaaaactaattaacaacttaacgattatcttagtaggcacagaaacaacattttacaaaatccaatatctatttctggttttaacaaaaaactcttaggacaagataagtacgtcccttctcaccacttatattcaacattgtcggagaggttccaaacagtgtaacaaggcaagtaaaataaatacagattggaaacaaagaaataaagatgcttttattacacatgacataattatctgtggaaaatctcatgaattctaaagaaatgctagtagaatctttagcaaatttaacaaggttgtagaacacaagattaatatccaaagatcaattgtgtctctatatactagcaataaattcatagaaattaaaataaaaaataatgcaatttacgacaaatttttgaaatattaacaacttagggataaacctgattttttttttttgagacggagtcacgctctatcacccaagcaacccctgtatcccgggttcaagcaattctcatgcctcagcctcccaaatagctgggactataggcgcacaccaccatgcccagctaatttttgtattttttgtagtgacagtgttttgccatgttggctaggctggtctcaaactcctgacctcaggtgatctgcctgcctctgactcccaaagtgctgggattatataaaactgatttttaaagtgtgcaaggcatgtacactgaaaactacaaaaaaagaaaaaagaggatataatattaagatttcatgctctgaaaactgaatcccagatagtgactacaggggttgaaccatacatctataaataactgtttttttgttttttgttttttttgagacggagtctcactctgtcgcccaggctggagtgcagtggcacgatctcagctcactgcaagctccgcctccctggttcacgccattctcctgcctcagcctcccgagtagtagctggaactagaggcgcctgccaccatgcccagccaatttttttttttttttttttttttttttgtatttttagtagagacggggttttactgtgttagccaggatggtctcgatttcctgacctcgtgatccgcccgcctcggcctcccaaagtgctgggattacaggcgtgagccaccgtgcccggcctagataactgatttttaatgaaggtacaaaggcaacttaataaaggaaagataatattttcaataaatgatgcagggacaattggttatccatatgcaaaacaacaaactttgattcacacctcttgttacatgttaactcaacgtggattatatacttagatgtaaaacctaaataaagcatctaaagaaaaacatgagagaagatctttatgaccttgggttaggtagaatacaaaaagcaaaatccataaaagaacaaactgataaatcagacatcattaaaattaaaaatttctgttctttaaaaaatattgttaagaaaatagagaagccacagaatgaaaagagatacttacaaatcatacatctcataaaggacttgtttctaaaaaacaaataactctttttttttgtctttttttaaaattattattatactttaagttttagggtacatgtgcacaatgtgcaggttagttacatatgtatacatgtgccatgctggtgtgctgcacccattaactcatcatttagcattaggtagatctcctaatgctatccctcccccctccccccagcccacaacagtccccagagtgtgatgttccccttcctgtgtccatgtgataaaacaaataactcttaaaattcaatcagaaaaaaaaacccaaaaatgagccaaagatttaaacagacacttcaccagtgaagatataggtatcaaataagcatctgaaaagataatcaacatcatgacttgttagagaaatgaaaattaaaaccccagtaagatactactacatacctattagaatggttaatatttaaaaagactgaccatatcaagtgttggtgatgatgtggaagattggaagtctcatacactgctggtgagaatataaaaaattgtacaacccctttggaaacaggtcagtatttttttcttaagttaaatatgtacctaccctgggatttaatgattctgctcctaggcatttactgaggataaataaaagcacatgtctattcaaagacttttatacaaatattcatagtagctttatctgtaatagccaaaagcttgaaataacatcaaaagatgaatagattaaacaattgtggtatttgcatgcaacagaatagtgttcagcaataaaaaagaatgaaatattgacacatgcaaaaacatggactaatctttaaataatcatgttgagtgaaagaggacaaacaaaaagtacatactatatgatctcacttatataaaattatagaaaatgcaagttaatgtataaagacagaaaggagagtaatagttgactgggaatggggaggtagagcaggtaggataaggtagttggagggagggattacaaaagtctggagagattacaaaaaggcatgaagaaatttgcagaggggtgatggatatgcttagtatcttgaattgatggtttcatatgtgaaaactcatcaaactgtacctcagtgaagctatttaaatttttttaagtttctagagaaaccatcaggaagtcttatactcctggggcttatcataagtgataagcactcatcatttaatgctgtaatcttgcagttcaatctgtctccttgaagaggggttgggggagaaaaaaaagcttagaaagcaatgaccttccagcaggaagggaggcagaggatatggataagtttaatcagagaaaaagaccaagactttaccatccaggaccttacttctagttatggttcttgctctaatttagctgtaagatcttggttcagtcattttgctttgacatgcttcaatgactcaattttaaaatgaaaggattagatgcaaccaactctcaagttctttcagagccataactcaatgatctataggtatattttaaacatcaacaatcccattttcctcacaactcagcacttataggtatggccctaaatttagcagaaccacttcatgtaattttgaagtatgtactatgtcatatatgctggtaatctctctcctgtgatagagtaaactctctggagggtgaggtcctctatcctaaaatttctagtttccccatagtatttaaagttcagagcctacatcattgtaatattgactttacaactgacactaaaattataacaatgcatatctatcattttactgcttaaaaagctactttcccacatggcatccccatgaaggtcttattcgtaatatacagatagagaaataggttcacagaggctaaagtaactgacatcaccactaactagccttgtgaccatggccaagttccatagtttctgtaaatagagcctgtgagataatagtacttatctcataggattgttgaggattaaatgagttaatattgataaaactttagagcagaacctggcacatagtaagcactattattagtgtttatgaaattaatttaactttactgatttatttaacaagtaagaattaagtaatagatctaagattaaattcacatcttttggttattagtccaacatacatttgaccagtgatcagtaattatataaggtaattgtagattcacctttcctaaccaccattacaccctagtctaaaggatgtaacctcctagttttcttcctccctgaatcctatttgcttccttttcctccatagtatttactttttaattttcttcctcctccactaaactgtaagctcagagagcagaagccaatgtacagccagctccagcacagtacctagaatataagactctttaaaggtttgcttgatattattactattaatggggcctaaatagataaaagctaattacaatttcaaaaatatatgttagtatatttaccaggattttctgtattaaaaagatctatggtgaattcagccatgactcttaaaaacaaaaaaacaaaaaatggtccaggcacggtggctcatgcctgtaatctcagcactttgggaggtagaggcaggtgtatcacctgaggtccaaaaccagcctgaccaacatgaagaaacctggtctctactaaaaataacaaaattagccaggcgtggtggtgcatgcttgtaatcccagctactctggaggttgaggcaggagaatcactggaacccaggaggcagaggttgcggtgagccgagatcgcaccattgcaatccagcctgggcaacaagagtgaaactctgtctcaaaaaaaatcaaacctggcatctgacccattttttcctatttgagagagtgataccttgatgggcaagactcacatgactgtgccatggcaaaatggcaaatgccatattttataaggggaattatatgacctgtggtgtattgaagtccatataatataaaattgtgctacatattcaatcattcagtcatgtctcaaacctgcttaagagacgcgagtcatcgtattacagtgatatcctacacacactgcagagtctctggaatcatatgcccagtactataagggaaagaaaacaagagacctgagagaagttgactgaagtaggtgggaccccaggtcttgtttgcacatagttctgcagaatgctagatcacagcatgttaaacttcagaccagagtcaagccaggactaacctagatagaaccgtgaggcagatgaagtgtgtcttcaccatcttcttccccatctagagccctcagccattctctactggactttcttgacagaaggaaagctacctgaactcaactgtagggcagtattaagaatttaatatgcctctccccctacttgctttcttgacacttttcaaggccaggtgttaatcatatttatcagcttgttctcagcctttagtgcattgcctggcatataacaaaggacaccaaaggtttcttaaataaataggtggacgtagaaaatgttttacttgatgttgatgttaggaattctttatatttgcagagcatgtttcgattgacaaaacacttttataactaggacttctctgttacttttcacattctccctatttacacatttaaacattattatgtaagtggctcccttgtttatttttttggctcagatttctctcctaaattgaatatcctgttgcttgctggtcatctctgctcagatatctcacagacctctcagatataacagctccaaaagctgagctttcatcctccttcttccctcctcaaatctgcttctctttcaacttcctcatccagtaaatcccagctccgcccactccatttctcaagttaaatctcaggagccttcacaaccacttcatcaagaccctctgatggaataatttggacctgtctgtcaccagggtcagcttggcccatctcccccttctctgtgacctagccccacaggccctcttccattatttaggatataatacatcccattctcattttggttcctatgcaaatgccagttcttctgcctcaaatcttctcccacctgttctccagaatgctctcccacttatcatttaaatcttagcttcactgtgcatcgtaggaggcttaccagatccctgtcctctatttgctagatgccagtaatccttccttcttccagatgtgaaaattaaataggtctccagacatgacctaatgccccctagggaaacaaaagtaggcccagctgagcaccactgccctataccttactcacgacatcctgttatagcttttcatggaaactagtttgtaaacctcttttgtgactattgtgtgatgtttacattacatacctgaattacttcattatggataaaaactagttcttttgcttacaatgtatcatctatatatagatagtgtccagcatgagtaggtactcaataaatatttgttggataaatgaatgaatttcattctcatacaaactctatggaatatgcacagccagaattagcaaccctatttctaaattgaggtagaagacacactgagtggttcaatgagaggcccctgaatcacatcatcaataaacggtagacctaggaatccattaacctaggttttatcactctcaattcctcttaccagcatgtatccttttactgccattaccatgtttttaaccttctcagattacttcatctcctttctcttccaagttctttatcacgtgttgtccttgtagtccatgcacagaaatatacacctagctctatatcaagggctgaaaagctcagactttacagtggcttccagtgatgctccactctgctgcttttaaaaactcacagcatattaaatataagagaggtggttagggcttctcatgtaataggagtgcaagggggtaaaaaaaagtcaatagctctcctgagtaaatttgctttcatcatacacttagctagtcttgtggtctactctagtaaacagttaagatactctaatcttaaggaagccattgcaatattgttaactagaacatggaataacttttaaagatggctggctaaaattatcttttactttcatgctgcttaagtatggccaagcagaaaaatctcatttgaaaatgagaattctcttaaatggtacttttagcatgctaatgcacttccatgttccaaggttttgaatagcaagatctatatggcacactcaattttttccctcaaataaactatttttcaatagcctaagggccataatggtcaacaagtgtctgagtgaggacagggaatgctgttgagaggtaaatttgactcagagatgcccctgagccatggaaaggagctgtgctggtgggctttgtaatgttagaatccctttactgttaccaaaggctggggttgacgcctaagctttcccatctctctgcagaagcagagaggatagttaagcgtacatgatctggaggtcaactttccagattagaatcctaacttcaacgctttttaaatgtctgatcttgaccagattactctacactttgggcctcagtttcctcatatgtaaagtgggtttgataatgatgtttatgtcatataattgttgtgggagattaaatgagttgattcatgcatccagcataaaataagtaccaaataataattgttacctattatctgtcttctttacatgtacatatttctatttctgtgtaaataaaagtatttggtgttttagtaagctctgcccatatcccagattttatcatctcactaattcacaagcacctttagggcctaacctccattacattttcatcatcataaaagtatcacatttgattcttacaacaatcctaggaggtcgggatggttatatccattttacagatatgaaactgagatctagactagttggactgtgcctgtgattatgcaattagatagtgttggggggccagggctaaagctttggacttcttaggaatactcttcttttcttttcaaaccatagaattttcacagactcaagtaagacttgtcttaacacttttaggatattaaaatgacttcagagcaaagctccctgggaatctgttctccctactccctgctctaatcaatgtatcttcactgggtagcagctgcatgttttagtcagtgttgcgtaagtctctgtttctatctctctctccttctttacctcttcctccctccatctctcctttcttctctcttccttacttctacctctctccttctctccctccatatttttctctctcttagacacacacacacacacacacacacacacacacacacacaaatactttattcgtctatttcatatagaaggagaaggtgtcattaataatgactttgaggtttccaacatctgtaatgagacaactgtgatcaggtgagagccaataggtgaacttggattactagtgcatggaaaggtcatgcattaaatgaaaaagcaaagaaatggagtttggattaaaaaaatagtatggaaacgggagagagcagtccttgattctagtaaagcttgtaggcagtggaacaataataattaattaaaaatatttctgagggaaggtagatgagtctgggtagctattcacttcactaaattgatatcatatgatattaaataattaacaatccattaattatttacaatgtacatttggaaaatttagttaatatcaccaagctttagttttctctctcataaattgtgaataataattaataataatattaatctcctaggattattgtcaggattaaatgaatacttacacttaaatatttcttagagtataagaaagtactaaagattaataaataaatgttagctattgtcaacagtattattattttattaatgctatcaggaagggacaagtatagaaggcctccaagatgagggtgataatagatttctatttgatactttaggcaataagaagctatgaagatagaatacctatgactgaaaagatattttgcagttatttgttaaaataagtatttagattcagggagttcagttagaatttatttgaaagaaccaagtacttctaagatagaataagatgtgtaactaaatctcagagtcattaaaagcattgatctccagggctcatgagatctaggtctattcacccccaaatgaaattgcatagagaatgctaatgtatcaacagaaaaacccctaaatgaaacgaaataaaacatttgaaattatactatgaagtcaagacagtgatatgtaaactcttccaaagcaccatagtcacagacaatggattccaccaaaataggccttgcaaactttgcttcattgaactatgttgacataattaaaagtcagttaatgtagggatcacaaacatttatagtggggagaagcttttgtgatatttacttttataatgaactgagacttaaatattgctcatgcacagaaatatgttttgtgaacttcgcaagaattcttttttcatcagtaatctcttcattaaaaagtcgaaaagcaaggcccttaatcatgtcatattcttttggagtcctttactcagcaataatttcatttaaaaacatttcagtgaacactaattgaacagaaactgtcaacttcctttcataatgaaaggaaaactgccatgatgaagagtttctaatcattatatctaattaaaaagttaatccttaagtttttcatgtttaagttctttcaaatgtaacaaaagaatttctctttcaaaaatgggaaacaaagcacagtcattaacgaacaatgcttctgtgataaagctacaaacttggaattaaaaaatattggcccaagcttttatgaggaaattaggaaaattacaagaatcagccaaaccttggccttcattgacctatttttttaatacagaaaaatttcattgtagcactgacagtgagggatcaaaaaataattggaatttaagccttttgaaatacagagagaaaaatggcctctgcatctcagctcatgggggaaatgagacatgactcactctctcagtatgagtaaaggtaattcttttaggtctagagatagagttagaagcaagttcttctaaataagtgaggctttaccccaagattctgactcacaggaaaacctttaaagctacagtctaacctcctgaagcctagtagagaaagagaggattcctaggcaaacatgggagatgatccacccaggcatgactgtctcactctgttcgtaaacaaggcagaagtgggagaaatagttctgaaagactaaatgcaaactgcaagatgatgagcagattgctttgactatctctacttccagcctatgcgtgcaaagtattttaggatactgtgtgatgatcagagaaagaaaacttgtttgaaagtaccgttttctggatggtcaggcccctcaaagtagtaaccagatccagaatatagtaatgcattacataaggggcttgcagatttcattaacaaagaccaacaagatcactcccaataactaagtttgctcattctggtattacccaatgtagcctctagcctattataaagcagtcctcggtaaaggctgagtatctatagcgctgaaataatatgattagatgtcaactcagatcatggtcttcactgagcaaaggcaaaaatatttctaatgcaatataaccttatttcattctatattattgcctctcagggacaggagggacagaagattgagcaaaagtttttgtaaaataattttttcacataggcgccttttagatttcattgacatcctctgctttctgccttcactttacatgtttttccaggaggcatacatgctataatgaaaacaagtgagaaatgtgaagtctttgctctgttgcttatgaggtgtgtatgaccaaaagaaagcctcttggtttttctgagcctttatttgctctaatgagaaacagggataataatccctgttatcgcagggttcttctgagactcaaatacaaaacgtgaaaacatttttggaaacacagaaatgagtttttgtgtgtgagggaaaatgatttaacattgattgaatatccaccaagtaccaggtacagcactaaattcttcatgtactaggtcttttcataaagtaaccctgtgatataggcattgtacccatctaagaggtgagaaaaggaagtgggagagatattgagtaacataactagggtcttaaagcttgctatttgtagagatagaattaaattcaattttgtctgtctccaaagacagtgatcagctcccagaaagtagaaattgttcttttggtagtacattgtttaaaaaagcaaggttttaatgtgagtcatccaaggtttgaattctaatgctaaaatcactcagtgttgctatgagtaagttgcttaaactctctctgaagttttattgtctcatctaaaaatggggaagaaaagtaactaacccctatatttttgtgaagatgtctagaaaaaaaatgcacatctagcaattaaaagtgttatttggcatacattatacattcaatacatgttagctactattgtttaaaaattactactttttaaatttgttagtaaccaattcagtaaattatctaggaatctcataactttttataatttactctgtgtattctaaagatgaggcagtttttattacatatgactgaccattgaccaaaaacaattaaaggctagctaagttagcttagatatataaaagaaataaatccaatcaggtacaaggtgagaagttatggttaaaataaaacagaattaataaggttaggtagacaaaaaagaatattgccaagttagactaaatgggcaatgcgcaaatcctaactatctcaactgacagtacgctaccttttgagttatcattaatgagtagtataatttacattatgtattataaacaatatggagtatatatcccctcattgaaaacatgaaaaagtcagtattaaagtcctaatctctaaatttatattctcccttaactgttttatataagcttattaaataaagcaaaaacacattagagcatgagtttttctcctcatgcaatgacctttatctccgtttgatttatatgcagaaaaacaaaagtaattccagctgacagatgacacaaagatcagagaggcacaagggttcatgtaaaaacaagtcaatttgttattaaatattggtagcacaaataattagctaattaggcaaagtttttctataaacctatttcttcatctgtaaaatggaactaatatcttcagtctcacacagttgttgtgtaggttagataagttaatacgaataaatttccagcctagctcctgtcatttagtagggaatcatcaaagtaggttatcttcaatagtttcttttaagtattttggaaaacaccccctctatttatcaaatgcttacaggttctaaactttgtcttaggtattggtgacacataatactgccctgcctttaaggatttcacagactacagtagctaatcatttcactaaattgacatcatgacggaatgactatagagtgtgatgaaaaataacatggccatattggttggaagtctaggcgaggttgggaaaaagtagaccaaggaaagctacagacaaaaagaaatgtcactgaagctggatttgcagaggcggcaggaatttggcagaaagacaagagaggaaatgattttccaggctcagagtaacgacatatgtggtaagttattctcacctcatgcctatagttaccagtggagagacttctccaggctaattctctggacctctttccccatccccagaagatgggagttttatgctaggtaagtttgaaaaatgggactaggaaagctcagctcacccctgcctcctgggagtcagcctgcctgctagagcctagcattcccttttcactgtaagatgaggttagctaggagaagctatgcttctgcaagagaaattgataatttgaagggtaaattgagttcaggggtatgttagcaagccctttggctgcctaccatagccaattcttccaagctagctttttatcagtagtagttctgatttttataagctatcagaatctggcacctatatcttatctgggtttgaccttaacataaaaaagactctattaagccttgtcaaacttgatagagaatgaaagtttagatgcgagaaattacatactatatccaaaaggtggtacttcttattttttcagaagaataaagtacttcagaagtgggaagggagataaattagatgtaaaggcaggggggtccaatccttggcttccctgggccacattggaagaagaagaattatcttgggccacacataaaatacaataaaactaacaatagctaatgagctaaaaaacaaaaaaaaattgcaaaaaatctcataatattttaagaaagtttacaaatatgtattgggcagacaggctgtaggttggacaagcttgatttaaggtttaaagttggtcagtgagtaagttataggggtttctctgtcacactaaggaatttggtctgtatctgaaagcagtgtggagccaatgaaggatcttaagcagaatgacaaggcagtgtgtgtgtgtgtcgggtgtgggggtgtggggcgggtggtgtgtgttggaagtattctggcagctttaggtggatagattttgtggtgcactggaggcaaaaagccagttaaaaggcagttctaatagtccaggcaagatctctgcaagtagatttagtcattgattcattttttatctcaacttttttttttagattccatgaaatataagacaaaaggtcatcacaccctacttttcaatcacaatttaaagatatcataggctgggcacggtggctcacgcctgtaatcccagcactttgggaggccaaggtggatggatcacctgagctcaggagttcaagaccagcctagccaacatggtgaaaccccatctctactaaaaatacaaaaattagccgtgcatagtggcaggcacctgtaatatcagctacttgggaggctgaggtaggagaattgctggaacctgggatgcggaggttgcagtgagccaagatcacaggccattgcactccagccttggtgaaaacagtgagactccgtctcaaaaaataaataaataaaaataaagatatcataaaggctcagatgggtaaaaacttcatataatgagagttccaataagaatgattctcttaaactaagccgttgctgaagtgaagagatgattatatggacaatctagaactcatcacaaatactcatacctaatttaaaaaacattgtctaaaaggcaagctaaatttccccaattatgcaataactagatattctacagaaaaaaacaaaatggggaggacatgaacctcctgtctaacgccatctttccttccctccctggaccacgcattgccaccaccagaaaaagagtctgcatgtaatagcagccatataacagactagggtataaaggttcatgaaagataatacagtacaccattcaccttgtaacactgtaacacaataggaggtaagttctagaagatacagagcaagactggaaattgcagctgttggcctaactctccatattctaacctaggtccttcttgctaaacaaccactctgtttttaatttattgagttgtatgagtttattatcttaaagttattaagtaatatcttaaagttattatgcataagtaaaaattaggaaattgagctagctttttaaagaacacctcttggccaggtgcagtggctcacacctgtaatcccagcactttgggaggccaaggcggtggatcatctgaggtcaggagtttgagaccagcctgaccaacatggtgaaaccccatctctactaaaaatacaaaaataagaagggtgtgttggcgcatgcctgtaatcccagctatcccagaggctgaggcagaagaatcgcttgaacctgggaggtgaaggttgcagtgagccgagatcgcggcactgcattccagcctgggtgacagtctgagactctgtctcaaaaaaaataaataaatgaaaatgaagaacatctcttgctctctataagagacaaaatttaggaatataacgccatattttttattcagcaataatttattaaggacttaatgaacgttatcttctgtgttaggtaggtcaccaatctgtcctttggatagaactgcggtagccacactgggctctgagcttggggtaagggtggagtatgcctaaattatatctagttgtcttccaaatttcaaaggaggtcaaaaatattttatttatttcagaatttgacacatttaccccaataaaatatgatgaagtctcaaaaggtaaaagaaacgttaaatagaactttcagaggtgtaagtgaattattttgaaaactatattgtttttacttcatcattaaacatattaaatttccagaaaacccatcagcaataattaatttctgagctgtataattacctaaataagtatagttctctgatcattttcatcaacgaatgcaggcttgcataaaattagtatgaaagcagtgactctttggactcagaacctgagctctgattacaaatcagttccttggtcatggtataaattaaggtaagttactttgcttctaaaagtctacttgtgcatctataaaatgaggataagatgacctatctccctatgttattttgggggttatgttaaaataatattaatagtatatgagaaatgcttaatagttggtagttgttagtataattataatagtaacataaagccatcacataaagcacatggcattatcaaatgccagggctataaaagaaactatgcatccaggctgccacttttttctttcttatgcatggctatactaattttcactgtattctcttctgggggtgccttgatgaagtctcatcattcttctgagcaccataatccagacaatcactaggaatcaatcggagctgacacagtgaaacatgaatcattttttaaatctacttgaacttcctcattttatagttgagatgtagacactaagattctgcgagttcactagggtgattcagggtccagagtagtacagatactagagtcctggtttctacttctgtgcctttcatttcaacacactcactcattttcttctgaattgtgaaattcaaacatgaattcacattgggggggtcagatcacttgatataatctgccactataatatttctgctgatctttgaattaaaccacgacccttgaaatacacagcttacagaactgaaacaagaatctgttcagaagactatgcactctgtcaaggcaactataatggtattctatcatacagtaattttagtgatgtgataatggatattatgccaagctactgccactctggataaagacatctcatgatgacaggacattttcagataatgacaaaatgtggtttatcaatttctacatcagtttagtcaattggtctggaaggtgcagagggaatatctgttcccagtggctgaaacgtattcccgaaaacacaacttgtttattactatcttaaaatcgaactgaaatttaaaggaggaaaaaattttagagcaatgtttggctttttttttcaaaattcctcttagaatttaattaaaataatcaatatcgactcttgaaataaaatacttagaatgaacaacagacacaggcctgtgatatgattttgttacttgaaacttaattgtgagaaacagacaggattccactgtaaatgttctcaatctcttaccctgtttctccttcacgtttggaggagttgttaatgaacccaatggatgtgttccagagatgtacttatgatttttttctctctttgagttggggtcttgcctgtaacctaagctggggtgcagtggtggtgcaatcacggctcactgcagcctcaaactcctgggctcaagggatgtgcctgcctcagcctctggagtagctggaactacaggtgtataccaccatgcctggctatgttattttactttttgtagagatggggtcccactatgttgctcaggctggtctccaactactggcctcaagcaagcctctcaccttaccctcctgagtcactgggattaccatgcccagctgtacttatgatttcatatttcaacttgagagagagagagaggaaataatatgctcaaaaaagctaaaatattttttcagtagggtgaattgatgatttccttctcagcattccccccaaattctttttagcaactttccaaaggaatctgggatatacatcatccactgtatttaaataagatattccaaatatctttcatgaaagtattagagaaagggtcaagacctaaagaggggggaaagggtcaatagcagatattgggtggggatgatctacagcctgtggtcagtatctgggggctttattaagatactctcccaatttccaacttaaaatgtggtaaattataattgacttcataagatcaatactcacccatgtgaggtaacctcaaagaatttgaaaaaaaaaaaacacctagacgagcatgattgattaatatattagcctgtctgaagaaaaattgaatcaatcagaagtttgggaggaggttaagggttaagaataaaagaaaagaacaagggtagtgagtgagagaggcaagtattgtctagaaatctaggaacttactagatgagaaggagtgtgaacattggagttcaaacattgctgcaattaaaattttctgaagatgttttgactccaggaagagatatataatacctgcaagttatttttggcttcctttatttttcttatcttctcactgtcatattctgcctcaggaatccacactatttaatccatcctttttgctctacatacaaaatatatcctcagtctctacaatagatccccatccccattgctgctacctgagtccagccatcattatctctcggttacaagtactgcaaaatatcattctaactagtctccctccttccattcttgcccctcccctcaaactcattctcactgtatacaatacatcatctcatgtctttgtttaaaggagtccaatggctttttgttgaactttgagtaaaatgccgacttccttccatgcccccagtctacctgacccagccttacctaaccctccaaactctattctcagccttcttcttgacactttctcttgtccacactagccttcttctattataataacttgtcaaactttttccaaccctgaggtccttgcgtatgctagtcttttatctgtaacaccacccaagaattgtcataaggttgcccccttttcacctttcatctctcaagtaggaactcaattgcctcctcattaatactttccttactttaatgtctatctaaagaagcacctctccaacctatcctccatatcacattaccataatttaatttgtaatagcacacccctgtctgaagtaatcttatttgtctacttgttaactttcatatttctctactacaatgcctgttgtatttattgctatgttttcaagttcctagaacagggattcttggttatactatctattatcaatatatgtttgcaaatgaataaacaaatgaattttatgaacatgggcgtttccattcatgtgaaaattatatgtttcatgcaaatcaatgacttttgcataccttgatataaggtatattttaactagtctgagtcagtttcttggcctcaaatctccctggacacttagaatgattgtctgggctttcaaaaggacagaatgtgaagttcagagacccaatcacagtgttacctaaagaagccccttgcgaccccgccttgccaaatataacactgttccacctctaccaatttttaaagataccaccctttcaatcactcataaacattttcaggtcctatcctggcaataaagttacagaaataaataaggtatactttgttttctcacaaagcttctaatacgatagttgaaacagacctgtaagtaactacaatgctaagtgtaaagtgggcatattttccacattttgtgggagcacagagaaatgaagccctcaaataagataacattagaaatgatccttgaatgatgagaaagattttatccaacacagaaatagagtcattacagagagagagagagaaaagcatgagcaaagatttggctggagactgcatggtggcttcagggaatcagagaacagtgaatagttgggtgtgaccagaacacaacagtagtggttggagatggagcgggaaatacagattggggccaaattgaagacaaccttgaatgctttgctagggaatccagttttattttgtaaactagtggttggcaatctgttttctatgagatgttcataaataaacgttcacgaaaaagggatttcattatcacacacatttaagaaacgttccacatattttaccagtctcttggagatataagcccccaagagctttgaaaaatcctaggataaaaaatagagaactgcttaaaacatgtttaatccaacatagaccactcattaacatttccaaagatacgtaagtgtaagtcagattacacttaaagtgaagccttctttaaatgatttgaagttgttaaatcatttaaatcagtaagtgatacaaatagaactgagtgttaagataaatttggcagcaatattcataatggattgaagagatctaggaggctacaggttattgcaaacagtttatgggaatgataacacaccaaaactcaagcacggagagcagaaatgtaaaaagggaaaatatttgaaacactctggatataattctatatcaattagtgattgattaattcatgagggccctaggaatagaaatgtaatggatctggtgatgacttcctgatttctgacttggcacactaagtgaattgtaaaacaggtttgagtgcaatgaagagcaagaaagaagaagaatgatgaaaatagactgaaggctctgagtgaactgcaaagagtggtagggatcttaaagtcaattgttatacttgcgtttgatttagttattggaaaaacgagtccatagggaactcccaattatgttgggttgttttgtaaactcaaaagaatctctttcctcaacgtacttacagtcttcaacctatttaactgttatcattccattcagtccttcgaaaataatgtttcttctactagaaaccagactgctgtcatgctgcaggtatgttgttttcacttttccttggaacaaccagaaggtgcccagctttgatgagaagagtcaagagagttgttgcatctgtaagttttattctaaatattagaatcagcagtataagaacaacgtgtttgtaacagataaaatgttatacaatcaaaaccatataatggttttgattttgggtggaggctgcctacattttaagacatgtagactcaaacttatctttaaatgtctatattcaaatttcataaaattcctatccctatgtaaacatactaaaataggaaatttccaggatatttccctttcccatctgatcagtcacattgtttttcctcttcaagctctcttactgtcaatttaatgtccatattgcactcttctgcaaactgtctacagatagaggcagatagcctgtctacttctgtctgttgcatgaactattttttcatatgtcactcaatttaatcttgctcacttatatcagggtgaaaaaaaaagaacattcagctcttttccttccagagaacagacacaaggaaaggggtttcagtgacaagaaagacaggtgcatagatcactcatgacgatggttaagaagaccctgctatatttaggataggtggaaatttatcttactaggaattttaaatgggaactactttcctatttgtatttatttccttaattccttcctactttccttccttccttccttcattccttccttccagtcaaaaaattaagcatgttttaaattgccaactgggcatagtaatctattgtggcaggtattatagaagacatcataagagcttcgtaatagaatacagtcataggaaaggtactcattttaattaccaaataaaagcaaattactatagcaatgttcttcaatttttaacctatcaaattaataaaggattttacaaagataaaaacatcaagagtacaggcagaaagacatgttcatacactcttcaaatgggggaatcataaattggtaaagcaaatagttttagaagcaatttggcaattaactctaagctccatgggccaataatcagtctctcttattttccagtatatccccatttattaacctagtgttttgtcttgtgttaactgtttaataatgaattgctgaatgagtattgactgaatgactatgtaaatattatgaaccttaaaaaattcacaccctttgactcaacaattggtctttttctaaaaatatatcctcacgagaagtgtagtcaaaagttctagtacaccaaggtttacttcactattgtttatattaacttaaagaaaggtaacctacatgcccaacattatgggttttggtagaaaaagaatatttggcagtcattaaaaaagatgtcaacaagcagccaacaaacatgaaaaaagctcatcatcactggtcattagagaagtgcaaatcaaaaccacaatgagataccatctcatgccagatagaatggcgatcattaaagtcaggaaacaggccagtgcggtggctcacgcctgtaatcccagcactttgggaggccgaggtgggtggatcacgaagtcaggagatcgagaccatcctggctaacatggtgaagccccatctctactaaaaatacaaaaaaaaattagccaggcctggtggcggcgcctatagtcccagctactcgggaggctgaggcaggagaagggtgtgaacccgggaggtggagcttgcagtaagccgagatcatgccactgcactccagcctgggtgacaggcgagactcaaaaaaaaaaaaaaaaaaaaaaaaagtcaagaaacgacagatgctggagaggatgtggagaaataggaacacttttacactgttttacactgttggtgggaatgaaaattagtacaaccattttggaagacagcatggcaattcctcaaggatctagaaccagaaataccatttgacccagcaatcccattactgggtatatacccaaaggattatagatcattctactataaagatacatgtacacatatgtttattgcaacactattcacagtagcaaagacttggaaccaacccaaatgcccgtcaataatagactggataaagaaaatgtgacacgcatacaccagggaatactatgcagccataaaaaaggatgagttcacatcctttgcagggacatggatgaagctggaaaccatcactctcagcaaactaacacaggaacagaaaaccaaacgccacatgttctcactcataagtgggagctgaacaatgagaacacatggacacagggaggggaacatcgcacactgaggcctgctggggttgaggggctaggggagggatagcattaagagaaatacctaatgtagatgatgggttgatgggtgcagcaaaccaccatggcacgcgtatacctatgtaacaaacctgcatgttctgcacatgtatcccagaagtataattttaaaaaatgatgtcaacaagaaaaatatttttctaacttagaaaaatgttcacaatatgatgttaatttttaaaaaacattgcaacatgatgctaatttttaaaaagaagttatattcttaacttctcacttaacagacatatataaatgagactcaagtttagctagatctgtgagcacgtgtcaataaaatttgtatctttcactgaagatacatatacagagacagataaaaggactaaaaagttgttactacattaactgtagttaactctaggtggaattacaggtgacttttaattttttaaaaataattaattcatactattttttaccataagcttgtattatatttaaactaaataatacaaattgttttttaagtagctaaaatattcagttttaaactaaaaggatttatgattaactactagtttttattttattaaaaaataaaacgtgggccaggcatggtggctcatgcttgaaatctcagcactttgggagaccgaggaaggtggatcacttgaggtcaggagttctaaaccagcttggccaacgtggtcaaaacgtgtctctacaccaaaaacaaaaaaaaatacacacacagacagacacacacacacacactagcctgccatggtggcgtgtgcctgtagttccaggtactcacaaggctgaggcaggagaaatgcttgaacctgggagggcagagctgagattgcaccactgcacttcagcctgggtgacagagtgagactctgtctcaaaaaataaaataaaataaaacaaaacttgaagttggaaacatatttttaaaaattgtaattaagtatgataacaggtattatagagattgagtaaaatagattagagaaatgaaaaatcagtgtgtaaacataatcaactttagagctagtatataaactgagctttggacaatgaatgtcatggataactaactataataaccataactgtaacagtcaatgttgactgctaactgaatagtgcagcctgtcagaataaaatgcaaatgtgttcaatcatagattttttatgcaatggtggtaactactgtactccaagcacttatatttaatgatgaaaatgatgaagaaaaaggtcatgtagtctacaacagagtatacagaaactaattataaaatgtatttcgtgacattatttcaaccttacagagaacaactgactcctaagttaaactatgatactgtgtaagatcaaaatttttgtccgatttcctctcaaactatagtactctacctttcatcactgaaatagtatgacccacttgaatatggaatctaatttctaaccaatgattccaatatttcaatagcaccacagaattgaataagaatctgagttaaactaaaaacaaaacaaataaacaaaggaaacaaaacagtaaatctgtgtaaacttaaaataatatgcttgttattaagttgagctactgtgggaatagaaggtgtcattcttgatcttaagacacctgcataatcagtaataataataaattcaaactgattgagtgcctttatatacaaggccctgtattaatatacattcagaaatcaagaacactttattaacttactgttacgtgctaagcactagggaaacaggtaaataagacaggtcatgctctaaggaaattcaggttaatggcgcagaaacatattgaaaagtatcaatacttatccatactatggtaaaaagtgataaattgtgcaggttatcctgcaagacatacaggtattgaacacatagttcctcttctctacagtcataaatgcagataagtcttggccccaaatcataatttaataatgatgctacatgaattgtcacaaagaggccacaagattgaacagctatgctactgtgagttaggctacattctgggaatacgaggaatctcacactctctaatcagggagactgagaaggaaactaaccgcgatgtaaggcaatactctaattttgcaggatcgcatgttaaatagcaactttgagagctcaaatgaaaggattaaagaggaagatgtgcttaatccagactttttaaaaaatggataggctttgttgggcagaaagggacattccatcaggtgggaaatggaaagccgataacctagcacagaggtcagcaaacttgtttctttaacgggttggataataaatatttttctgactttctagccttacagtttctatcacaactattcaactctgccattgcagcacaaaaacagctacagacaatatgtaaacaaataagcatggctgtgttctaataaaatttatttatagatagcataattggaattactcatgattttcatgtctgaaatattattcttttgattttcttcaatattaaaaataattcttagctctggagctacacaaaacgaagtatcaggctggatttggcctgtggctgtagtttggtgactcctggactagttggaaggcaagctaaacacacagatataatggtatacaaaacaatattgaatatctcaacaaatggttccattctatcagattcaacctttccatttgataatgttttgtaatgtcctccttttttcatctgaaataaaattcatagatgatacaactgactacacatattttttaaaatgtagtgcctttaccaaagtaaaagaagaaataaaaaaaaagtagtttatattaaaatagtgtgttgaaaacatagtgcaggttatcctgcaagacatataggcattgaacacatagttcctgttctccacagccataatgcagataagtcttggcacaaaaacataatttaataatgatgctacaaaaatgaaaatatggcagtctgtgagtcctactatgccagacaatgtaatgagatagtgaaatgcctgcatatatttataaagaataaatttggatttaaatggaataaaaagaccagataccatattttacaaagggtacaggaaaataaaacagcagatatacaataaattctaggttaaaaattagtgttagaaaaagtaatagcagaccatttgtatttgataaaacgtcagaggaaataactttagtagctgaaatacagataatttaacaaggaaaattgcagatggtaggagtaagttaaaaatgtgtcattcttgcagataaactgggtcttactgatatgtttaatgtcaaaatagggcatgccagtaagagagtcatctagctagttatctgtctatctatctatttatctacctacctacctacctattcctgtttggaattccttctcatgagaaggcatatatttgatttctagcactctaaaattctatcctttgataggtaatgaggaatgatagatataaactctgaaacctaagggcttatggggaagtggagttttgatacaagttgagtttgagatttgacacaatatcagaataatattgaaaaaacagaaaactctaaaacagagttttattatctgacttgatgatgtcaagtaatttgcacaaatagatttcttattatgctttaaagtgctttaaagattaatgtatggtatggcaatcaaataaaatattttaaaaacaactttattaatgaaatttggtgagatccctgtattttatgtttctatcaagttaaaatatttgattctagatcttgtgaccaacatcactccttttctgttcactagggactaaggttaatgataatgttttgtatattttaaagtagttaaaataatagatttcacacgtttttttcacatgaccacaaagaaataatagatgttggagatgactgacatgttaattactctgatttaattatttcacaatgtatacatgcattgaaacatcacatagggccccataaatatataaattattatttgtcaattaaaaataaaataaaacttgaaccaaaaaattaaaatatttggttccaaatctattaacaggagtctcaaatctctttacttgcatatttgcagatgaaatctatacacatagattgatgcaggagaggtgtgtcaatactaaaatcagcattatgttttaaggatatggtcttccaaaatggggaacaactgacaaaattgctaacagaacaaagtgtaatggtcccttgattttcgcggagttatagtcccagaaaatgtaataatcattgaatccttgcaaaaatacttgtttgtaaaattgagtttgattttaggcttagataataataaacttttttcgttaatattcatgactgtctagtggaacgctaaaaattgtgcagtacatggggcaattatttgtggggcaagaccactctgcacagggtgtctagcatccctgaccctcttcccctaaatcccagtatcacttccaatctttaacaacacttaagtacctctctgctcttctgaagtgctttctcaccagtcagaatggctattgaaaagtcaaaaaataacagatgttggcgagcttgttgagaaaaaggaatgtttatacacttcagtgagagtgcaaattagttcagccactttggaaaacagattggaaatttctcaaagaacttaaaaaagaactaccattcaacccaacaaacccattactgagtatatacccgaaggaatataaattataaattattctactataaacacacatgcacgtgtatgttctttgcagcacttttcacaatagcaaagacatggaatcaacctaggtgtccaccaacggtagaatggataaagaaaatgtgtacattgataacatggaacactatgcagccataaaacagaatgaaattatgtcctttgcagcaacatagatgcagctggaggtcattatcctaagcaaattaacacaggaacagaaaatgaaatatcgcacgtcgtcacttataaatgggagctaaatattgagtactcatgaacacaaaggggaacaatagacaccaggacttacttgagggtggatggtgagaagaaggtgaggactgaaaaaccacctattgaatattatattactgtgtccagaactggtgtgttcttggtctcactgacttcaagaatgaagccgcaggccaaggcgggtggatcacgaagtcaggagatccagaccatcctggctaacacggtgaaaccctgtctctactaaaactacaaaaaattagccgggcgcagtgaagggcgcctgtagtcccagctactcagggccctgaggcaggagaatggcgtgaacccgggaagcagaccttgcagtgagccgagatcgcgccactgcagtccggcctgggtgaaagagcgagacgcagtctcaaaaaaaaaaaaaaaaaaaaagaagccgcggaccctcgcggtgagtgttacagttcttaaaggcggcgtgtctggagtttgttccttctgatgttcggaggtgtctggagtttcttccttctggtggggttcgtggtctcgctgactcaggagtgaagctgcggaccttcgcggtgagtgttacagctcttaaggcggcgcgtctggagttgttcgttcctcccggtggattcgtagtcttcctggcttcaggagtgaagttgcagacttctgcggtgagtgttacagctcacaaaggcagtgtggacccaaagagtgagcagcagcaagatttattgcaaagagcgaaagaacaaagcccccacaacgcagaagtagaccccagcaggttgccactgctggctctgggagcagcctgcttttattctcttatctggccccacccacatcctgctgattggttcattttacagagagccgagtggtctgttttgacagggggctgattggtgcgtttacaatccctgagctagacacaaaggttctccaggtccccactagattagctagatacagagtgtggacacaaaggttctccaagtccccaccagagtagctagatacagagtgtcgattggtgcattcacaatccctgagctagacacagggtgctgactggtgtttacaaagcttgagctagatacatagtgcccattggtgtatttacaatcccttagctagacataaaggttctccaagtccccaccagagtcaggagcccagctggcttcacccagtggatcccgcacgggggccacaggtggagctgcctgccagtcccccgccgtgcgcccgcactcctcagcccttgggcggtcaatgggactgggtgccgtggagcagggggcggcgctggtaggggaggctccggccgcacaggagctcacggagtgggggaggctcaggcatggtcccgagccctgccccgcggggaggcagctaaggcccgtgagaaatcgagcgcagcgccggtgggccggcactgctgggggacccagtacaccctccgcagccactggcccgggtgctaagcccgtcattgcccgggccggcagggccagctggccactccgagtgctgggcctgcagagcccacgctcacccggaactcacgctggcccacaagcatggcgcgcagccccagttcccgcccgcgcctctccctccacacctctctgcaagctgagggagccggctccggccttggccagcccagaaagcggctcccacagtgcagcggcgggctgaagggctcctcaagtgccgccaaagtgggtgcccaggcagaggaggcaccgagagcaagcaagggctgcgaggactgccagcacgctgtcacctctcattactaccaggttaatgaagtaatttgtacaccaaaccccaggaacatacaatttactcatgtaacaaacctgcacatgcaccccccgagcctaaaatcaaagttggaagaaaaacattaaaaaataatttctaggggctctcctctctccgtctgtccttgggaatcactggtctaaattctgagtaaaaaaacaggtttatgtaactttttgtataatgtccaacagttaattatcaataaattgcatgcctcataattatctgacaataatgactctacatatgagcacagaagggctaggagagggagggcaacttataacaataaaaggaaaacttaattccgagtttaaggacatggaccaattctgccacaaactgaaatgaccctgagcaattctcttaacttttctagggtacagtttctcctttggaacatgtactaggtgactactaagattccatacagttctgatataattacaaaacatctagattcctttagaaaaccaaaagaatggaacaaagtagagaatgaatgagaataaaaccaggtgaggctacacttgtaagagatcaaataatatcagaaaaagaggatagaccatgaagaaggtggtatcaaacagagatttgattcttggcatgatggatacatagggagatagaacgtttgtatgagattcacactcagcaatgtgagatgatgctcttgtactaaagacagtgtctctctgcacttttattttgtatttatattaaatttacaataggtggttcccaaataccacaaatgttgcaaacttgaattcaatttacaagttacacagcaagtatcttattctggtgttaagtgctgtgggaatcaactccagctgcttcagatctacatagttcttaaccataataaaggagggaagcgatcttcagagacccaactcactcagggttcctgagaccagaaaataaagtaggctaagggaatccaggattctgcaggggaatgccagtactcccaaccatgtagaacatcccaatgcattaaggaaatttctgttaaattagagatttatagaggtctccttagggtattttacctcccagcatacttcaaaaggtcttatttttgcaagacgcggtggagagaataaggaagtcatacacacctgcatgtgaaatgcatgctacccttatcagtggtgtgatcataagcattactcttaggttccatttacatcttcaaaatggagataacaacatcactctgttagtgttattgggaaaattgaaggaaatgactaatgtcatttcctagcacagtgtctcacacattgtgaacatggtgattatgcaataaatattgtcatttttgttcttttctttcccattctgtgtgcttggcctctccttgccctatcccagagagaatgctctgcttatgtcagcatccagcaataagagtgctaggagtgttgaccaaacggcttcacatctgccacaggaatacttacaattttaattccttctgtgttatcacttgctctcttctgtttcccttacctgggggacagctgctatttcccagagacaagaaagtcttattcttccttggtaaggggctgcctttctaagaggagtaagtcaaagcaggtgctgagttaaaacaagctgtcagatcattctggctgagcataaactgagcctaagatttcatcctagggcaaccctacttcttggactaaaaagtcctccgcactcaagttgctgcaaactgctggttctggagttgctgcaaaggaactatgaggggagatttacagagcttggctaaatatttcgaacacagttgttcttgcagaattttgctgaggaaatctttcagcatttccttacctctaaatacaagcttatgggaatgctacttcatcaacacaattctattttacatgatttttttttctagcatgcacagttgtaaattgctgagaaccttgaaggacataatgtcacctcagtatcagcatcatgtggtactatgccaaaagtttctggacagttgcctagcctagccttcatcattataaggaagacatcaaaaaattcagtggaaaatccataaattctaatgaaagagcacaatatgaatgatgaatttcctggacagtaagttcttcaggataaaaaacatactttagatatcattaacaataataaataccatttactgagtaattgtgttctaagtgccatactggggtttttatataccgtattttcaattcttataacatttccctgcaacatgaatttattatcccaagttttacagaggagaaaaatgaggcttagagaggttaagcaaataacatcacacagagctagtaaattcaaatttgagattgtctggcttttaagcataaaacatttccaaagtgcttcccaataattaataagtgtcagttgacacagtcacatactattagtactggatgagatttgggtgttcatctagaaaaccagctgtcttacaaacagagaaactgaggctcaaagggttaactgatgatgaagcataacacataaagagtggcagagcaggcactcaaactttatgaagtcctcatcaaggtccacccggctatctctgaccaggccccaccctcctctccaggcatctcttttaatgaaccttctctcacagggctcaatgttccgggcaaatagaactgtgtgcacaggcaccaaggtgttacatgcttttctgtatttttcatttctgctcaaaaatttctctctttttatctgcttaacaaacacgtacaacatttttaattcaatttaattccgtcaaagtatcactacctctatgaagccctcactgattcatttctcttctcttcccaatcaaaaaatgtattaagaaatagattagtaatagccaatgtttactcattcatttattccttaaatattaattgagcatctaccatatgaaagcactatgctaacattttgttaatcattcatcaccacaactctctgaggtaggtgttatttatatcctcattttataaaacagaaaatcttggctgggcgcagtggctcacacttgtaatcccaacactttgggaggctgaggcgggcagatcacaggtcaggagtttgagaccagactggccaatatggtgaaaccccatctctaataaaaatacacacaaaaaaagaaagtagccaggcctggtggcgcgtgcctgtagtcccaactactcaggagaccgaggcaggagaattgcttgaacgtggacggcagaggttgaagtgaaatgaggtggcaccatggcattccaggaccagtgcgagactgcatctcaaaacacacaaacaaacgaacaaaacaaaacaaaaaacccagaaaatcttaaaagtttaaagagatgcagtatttttttccaagtatttcaattttttaacttctctgtggttcctctgtattctgaatatgcattcattgtggttatctgcagcactctctgaaattttgcttcgcttctaagttgtgacttacgatgatataattatttgtatatcatggtatacatggcatatcatttgctaaattttataggccattataggctgtaagctccacagtagtaggagagatatctactttctttacaattttattttttattttttattattattagtagtagtattattttcaagatggagtcttgctctgtcaccaggctgaagtgcaatggtgcaatctcggctcactgtaacctccacctcctgggttcaagagattctcctgcctcagcctccccagtagctgggactacaggtgcccgccaccacgcccggccaatttttttgtatttttagtagagacggggcttcaccatgttggccaagatggtctcaatctcttgacctcctgatccacccgcctcagctcccaaagtgctgggattacaggcgtgagtcactgcacctggccaatttttttcttttttttcttttttgagaccaagtctcactctgtagctcagactggagtgcagtgtcaccactttgactcactgcaacctccacttcctaagttcaagcaattctcgtgcctcagcctcctgagtagctgggactatggtgtgcaccactacgccgggctaatttttgtatttttagtagggacagggtttcactatgttggccaggctggtcttgaacttctggcctctagtgatccacctgcctctgcctcccaagtgctgggattacaggcgtgagtcaccacactcagcctgtttactataatattatacacacaaggcctgacagaatagtacatagtaggcattcagtacatgatagtcaaagaaagaaagaaagaaagagagagagagacagagagagagaggaagaaaggaaggaaggaagggagggagggagggaggagagagagagagagagaaaggaaggaaggaaggagggaaggaaagaaggaaaaagaaaaagaaaggaaagagagaaaaagaaagaaagaaagaaagaaagaaagaaagaaagaaagaaagaaaaagaaagaggatacgaaaggaaaggaagaaagaaagacaaatgcacaaaactctggtctctgagtctccactgttctgtgctgcttccctagattagtctgcactgggaagaaatgccacataaacaatgatggacatgtttcttcccaaggctgacactaacatcctagatgtacattttggaacgcacttttgggcactataattttctatttccttacctatgattatggttatattaattctacagatccaaatggaatgaaaacttatttgagagggacagaagctgattttcagacctgctgaggaacaacataatgacagagtcctgttagtacacagtaccccaaataacaggagtttggaaaagagccttaggaggaactcaagtcattactatggccctctgttatagcagctggaaatcacactgctgagttccacgtaatactgcaaatatctccgagggcaagatccaagctcccagatgcttaacaactctctggcacattctgtaccacatgtgagtccctgaactattttaaaacatgcactattcttctttacgctttatcaaggattctaatgtttagtatcattagcctccagctttaggttttacaatatttcacaggatattcccagttaatttaaggggtaaaaagtagtatcatgaaattctcaaaacagccttagttttagtggacacatgaatacatataggtacacacatgctcttatttttgtgataatatacgtaagtgtatagtactaacacatctctatataatttagatattagatgtatgctatggatgcatatataaatggaaacagatctataaatatacatatatcagtagttttgaggacctactagaagtaaaggaaataaaatttacatgaaaaaatactttatatggatagaatgcagcattctttggaagaacaagctgatatactctaggacagaaaaattgaaataatatagaactctaatttttatatgtgtgcatatatatgcatatatatacttaaatatacataaaatatgttaatatacataagtagttaggtatagtgagacatttgaatacatatattaaagtctgtgtgtatgtatgtgtagagacaattgaaattatttaacataatgtatttgaaagttttcaagcattggtgaagatggattaatcaatttagcatagcacttttataggactgaaatggtaaagggtggaaggttctggtaagtgaaaagtgttaaaacattgaaaatcctaaaagatatggtttcatagctccagtatttgtggatcactattagtcccagccaataatacagtacatgtgaatgggagggaaaatgtatagaaatgcttatgcaaaagaataaggagagatggtggctacctcaatttgttgccttcttatatgtcactggatctctaattatcagtatacggtctatttcaatccttgaaagcattaaatggctgtaagtttcagacaagtaggaggcattgttaaaaactaaggaaataaaagtttccctcagttgatgaaaaaatatgaatatttttagagtttgcttattataacctagtattagagatttgggtttgggaaattaccatttacgaaataaaaagtatgttacatcttggattaaaataattgcaacaataaagcaagtttgctttctctgctctgtgcaacaaccataagctagatgctattaagtaggcttgcttcctagcctatgtgagccttgagaatttaatgtaatcaatacagagatataagctaaagacatttaaatgaatgtatttgttaaagagtatatacagtgttcacaactgttaagactttttattcagtttggaattcatgttaactttaaataataactgcatttctaaatgtcaacttctattttaagccaaaccagtttaataataaaatggtaatgtattttttatttaaatcaggaggctgagatgctctatctctctaagcaaagcttataattccatgcaaatcaatcaaaggccatatatatggctatgcatatgtaactatattattaagaccagtgataaatgacattcttggaagtactttttaaaaactattattaaaattaaaatattctctgcacctgtcaccataacattttatttatgatcaatatctacttctccactatgctaaaatcatattaaaattgagattgaatttttctgcaaatacagcttttcttcaatacatattaaacagtcattgttctgtatgacagtgactacaggtgtattttatttatattttacagcatttgcaggaagttattttctctcctttaaatgaagagagaaaaaaatgagccaattttatttctgataaaatgatagtagtctgggggctagaataacctaggaatcaaattaaaggtatctgcacatctgctttagaaatgcgttatagaagaaagagagctatagatgttgatataaacttattgcttctccatgaataaattaagtgcttaattcttttattctgagtttaaccatcctctgttttgctcataattattccttttctttgtaaaattaattatttagtgtaaataattgttcttctccataactgaaaaggcatacagtattataagagtaaaattagaatagcatacttcaaatcactgttttctatagctaaagaaacaaatgttcttttgcctttaaagagatggaaagtttagttaaaatttattttttctctgctctttaaaaaaataataataaacaggcaggacagaacaaaagttaaaaatgattagaagtaaaagggctgctaaaagactatgataaaaaataatataacctgaggactagagaagttgaagaaaagtcagtgaaataaactgagcacggcatccctagactttcacaggccaccagaggtatgagcccacaaacatgtgtgaaaatgacaggtttttcttggcctaatattttacatacaggcatacccgtggtactctgcaaagtttccaagccattctaaccttaaacaacttgctctcactttcttcagacactcaagggaaagtcataaggaaaaggctcacctgtgctgggctgaaccaaccatgtgggcaggtacaatgctccccacaagtccctttgcccttggtgctcgtcttgtgggggcttttccgcacactgtcccacaaggtcctgttgaagctggaccccccggtcctgtttgaagctgggccccctggtcctgaggagggcatggtctgagaactgtacccgagcccctgacagttcctctgccagccacaagcacagtgggcatccctgatcagggtgggcgcactcctgacggcatccatcccatcggacccccggctgcagctgtgttgcttggtgaggtatgcattcatactgcactgatgcctactctttcctttggtcagctctgcacagaaatgtctcctccctcacacccctttcttccagccagttgtaaaagtcttttttccaccgtggattcctcagtatctttgacagctgctataagcagtgcatcgtgggagcagtgggagcagcgacagcagctccgcacagcattatctgcgggctggtagctctttgtcaatagatgactcaactcacagagcaacttgacagtatccctgctctaggcagaagcaatcaatgctccacacagctgggctacaagactgtacactgtgttacaaaccctttttggatggagccctacagtaaagaataactctttgctgtttggcattccggcttttccctttccttgccgatccccacacaaaatacaaaccttaagaaagagaacttattatgagattcttatgagattagtaggacccttctttccagaaaggatgcatctaggcttaaactttatagcataagcaataaaaaatgatgggaaagttaacctgtaaaggaattttcaacatttataagaatcacttatctagagagagatttgccaagacacagacccagtcatgaagtaactatataagatcatcaatattaactctgaagaacataaattcatttggaaaaatcattgaggtcacaccattatactagagtctcttaaaatttggaagtttgttttaaatcacgattatgcattttagtccaaacatatattctttatgctatacacgattattaattctttcttattcaaagcaaggcagttttcaaggtttaaaactgatgggttgggcttattttaaaacagtatttttccttaccccaaattattctgagggtttcctttcaaatactttaccataacaaatacattcaccacaaatagagtctgcgttttaaagtgaaagatgcatccaactctgccatacagtattttggtttccaaagacagaattttcaaattctttcactgaaaaatgagctaattttttctaacttaaagcaattgccttccaaagaggatttttgtgttaaattttagcatgcttgctgaatccatacatagtattttcagtgaagtgaaaggctaattgccataacattaataatttttattctgtttgaaactttccacatccatttccaaaatgtctatccttatcacacattactaaggaaataattttggtttaagtgtgcagccagttaccatccatgcagtacctaacaaagattatataatcctatgaaataattactttatctgtagaccatcagatgccatcaaatctaccttctcagtggattgaccaggtgctggggcagtataggcctgatttttgcctgagctggcaaggtgcttattgcaagggctgagatcatagcaagttctacatttgaacactaagactccctggataaatcactgttagacttaaaaatcttgaaagtaaggagtaggatcttctttgtccatgtatctccatataagggtacttttccaaattctgcacaaggggctgatattagcattgtgcccatcacagaaggtattcaaaacacgtttgttcaataataatggccagatatgtaagtttagagggcaggttctggtctatgttaatggccatttttctctaagcacctttcacaccgtccaccacaaaacaggcagtaaatacatacatatgtttgacggatgaatggatggttgggtggaagtataaatggaaggaaaaaatagagaaatgaaggagttgatacacatttttaaaataataatatttaattcagcaatgttctagaaacataaactattcctttaaagttaaatttagttctggtgttgaggtattcttgttaaggaaatttgtcaaaaatatatgaaacttgaactgttgggcagaaataacaaaggcattaatagtttttgccttcttaaagaagatcaagaagttaaaatcaatacctgaagacagtgacgaaaagggagaaaattatttctctctctctctctttccctccctcccccctttttattttagatcaatagattatacctgaaagaactgttgggtcgaagaaaaccctagagaactttaggcttttctggtataaccatgatgcatggctgtacagtaggatttgatgcaatatgccaatgccatcactctcaaatgagaatgtcggaaagtgataagtttggctgtctccaatcttatctaaccatagatgcttctctagttttttaggcagatatcattgcacaagggcccattggcatcttcagggaacacatgtccggttctcatccatttgcctctcaagtataagaatcaatctacatagacataagtcagtgtgcatccatcacaactttgtaatggtgtgtgcagcttgcagcaaggcagaaacaattttctggcttgacactactcaagatattacaaatcttcacagagacttaaatctgttatgaatgggttgttcagaatgcgcaatttcttcccatcacaagggccacagaatttctattttaataacttagcatgtcatttctttatagttaaatagcatccattgtataactaatgttattttgcttaaaagatctttaaggctaaagcaaacttttattaagcttactaaaagactatattgaaatcactccttcagtttagtacatgtaaagtaattccatactcctatctttccctccccacaaacaagacttttcttttcaaacatgacatttggctttctgaggacagcccacttaaacagataaatatgttcaactagccctctgtactataagacagactcactaattaatggtaatccaatttgatcaactataattggacaattgtaatgaccatgagatgacatgaaattctggccaaacaagaattagcgatgcacaagtacacatcctacttatcactgtgatttaacatgggcagatggtgcacagagcaatgcctagatgagatataacttattgaactctctttgacctggcactggcttcatagaacaatcactagtttcaaagcaagcgtttaagactaatatcctagcttgatttaataaaaaatagcaaaaatggataaatatattgtactgcactaaaacttgatacagaatctttttccagataaaattatgcatatgggaaatgaaaatattaataataaaaggagagctaagtgattgctaaagagtgactggtgacagacatccttatcagccacaagtaatacgccaaataatcataaaatgctttgaaaagtgtgtacagtctattcctatgattgcaaaaactagagatttataaatgctaagaaatccgcattcttttacatctaataacctttggcctagataatctccagatccaagcacatttccttcaaaataagaaagccaggaatacgtaaagtattttaggctctaaaattatttccaaaatatttaaactaatttagtcataacttttgtgagacaaaaacaagcaggaatttagtgtggaagaaaacatgcttaattgatgcaaagatttaaccaaaacagaggatttaatagaaggtagaaaaaacttttaaaatgtcccgaattgtaactagcatagttggatttgggtgagtgttgatggggaaggggttaatctgaattaattacaagtctaaattataaaattgtattcaggaaatgtaaatgtattatattctaaggtacttagtatcacaaatacagaaatcagaacattaattatgtaatatttcttaaagattctgaaagaaacactagtaaaaaggtaataatcacttaaaatttgcatatttttgcaattgaatctaagtgctaaactatacttctaccagaaatttgttctcatccttcaagattaaactaatgtcacttctgtaagcttttcagatccccttggcaaattaagtcatgctctacagtatttgtatacttgtctgtgtaaatatctttaacatttatctatttctttcaatcaccatgatgaccactgtgatgtctaacccagcatcatttctgtgtagaactggtgaaacagctttctaactggtctctcgcatacacccttgctctaattctctctcacacagcacccagagtaattcctaaaatgcaattatgatcaggtcctttatgcttgatacctgtcagttaaacgtcattttctgggactctttatcctcattgatactataatctttaaagtagtttggatggtctttaatcatgacccatgtgatctggcctctgtggctttttaccagtcttgtctgtgcctcacactcttgctctgtcctccaaccatacaggccttgaatacttgagctcaatcctaccttgtggccatggaggatgttcttttccccacttcatactttcacataattaattcctactcacccttctgtaggctgcatcaagaggcaactcccccaaagccaccgtaaataaacatacagtataatctaaaaagaagtgggattactatgcaacacagctccaaaataaagcttctagtctttacttccaaccagattgccatccagatctcttttactcagaaattctggtgtcttccctgtcctttggagttcaacttgcatatcatcacctcctcaagaaagcattccctgaataccgggtcaccttctaagatagctcatgtcatctttccattaaacactcatttagcacctgtgcttctctattacaacacttaacaaaattgtatttaaaacaagaattacactataacttagtttgtacccttttccccaaacagaaagtaagtggttgctagtagggcaatgaaagagctctcttatttgcaactgcatcctttgaactcagcacaaagtgtttaaccctaattgaaataaatcaaacatggaagaagacaaaagtatctttcaatgatcacatcaatataggtattctggtctgtgttctacttctcagtgtaaaatcaataaataagcattttgattttaaaaacaaaatggcaatgtgttcctacagtcagcactttagtggaacatttagtatggattagtggcataagtgtatgaactcatttttcaaagaaatttcctagtggtcttagcactgaagctgaagcagcttctgtttattttagcaagatattaattcataaaagctgcacttcctggcagctgtgcatttctctcaagctttttcaagagttctccctttatagctagatagtacaaaagagggagcagttccctaagtcaaaagccagttagtggtaaaacatgaagagaatcctaaactccaaagtcatattaattttaaaataatataagccaaaagtcataataatttcacaagaatttttttttttttgagacagtcttattctgttgcccaggctggagtacagtggcaaaatctcagctcactgcaacctccacatcccaggttctggcaattctcttgcctcagcatcccgagtagctggaattacaggcatgcaccactacacccagctaatttgtgtatttgtagcagagacagggtttcaccatgttggccaggctggtctcgaactcctgatctcaagtgatctacctgtcttggcctcccaaagtgctgagattacaggagtgagccaccacgcccagccgataatttcagaagataataaaagtgtgcttcaaagaatatgaaggcatgtaaatatctcctctaattccctcgcaatcaagtcacaaatttaaaaaatattaaacagaattattatccatagcaagtattttctttagttttttttttaagttgtggtaaaaaacacaaaacataagatctactctcttaaatttttaagtgtccaatatagtgcttttaactataagcacaaggttgtaaagcagatctctaccactttttcaccatgcatgattaaaagtctacacccattgaacaacaaaaccccatttcctcctcccccagcccctaacaaccaccattccactttctatttctttgagtttgactagttcagatacttcttataagcagcataataccatatttgtccttctatagactattccacttagcatattgtctttaggattcacccttgttgtagcatatgataggatttccttcttttttatggttgaataatattctgttgtatgtatatagcatattttgtttatccattcattcatcaatggacatttaggttgtttctacctcttggctattgtgaataatgctcaatgaacatgagagtacaaatctatatttcagatcttgatttcaattcttttgaataaacactcaaaagtggtattgttgaattatatggtagctctatttttcattttttgggaacctgcatactgtttcccatagcaaccgtaccattttacattccccaaaacaatgcacaggacttccaatttctccacatcctcaacaacattttttttgctttcttttttccttttttttttttttttttttgataatggccattctaacaggtgtgaggtgatacctcattgtgatttaaattcacgtttccaagacgattagtgaggttgagcattttttcatataccaaatggctatttgtgtatcttctttggaaaaatatcattcaggtcctttcccatttttaatcagattatttgttttttggctattgagttgtaggagtaccttatctattttggatattaagcccttatcaagtatatacttcgcaaatattttatcccattgtgtaggttaccttttcactctctttatcgtttcttttgctctgtagaagtgttttagtctgaggtagtaccacttgtctatttttgtttctgtttcctgtgcatttgttgtcatatccaagaaatcgcagtaaagaccagtgttgtataggattttctttatatttttatccaggagttttatagttttaggtcttatcttcaggtctttagtttattttgagttgatttttgtgggtggtataagataatttaattcttttgcatatgattattctgtttcccaacattatttgttaaaagagactcttctttccccatgtgtagtcttggcacctctgtaaaagatcatttgatttttatctgtgtgggtttatttctgggctctctattctgtttcattaatttgtatgtccagcttagtgccatagtgtcttgattactgtagctttgtaatatatttttaaatcaggaggtatcaagttttcagatttactcttctttctcatgattgttttggctatttggggtcctttgtggttccatatgattttttttaaattttcctgtaacaaataccatcgagattttgatagtggttacattgaatgtgtaacttactttgagtaatatggacattttaacaatattatctttcaatccatgcacatttacatttatttgtgtctttaattcctttcagcaatatttggtagtttttagtgaacaaatcattcttctgttaagtgtgttcctcaatattttattctttttgatagtattgtaaatgggattgctttcttaatttcctttcatatattttactgttagtgtatagaaacacaactaatttttgtatattgattttgtatcctataattttgttgaatttttaaattaagttccagattttttgtgtgtgcaatcttcagaattttctacctataagatcatattatctgtgaacaaatataattttacttcttcctttccaattgaggtttcttttctttttcttgcctacctactctggctgttacttccagtactatgttgagtagaatggtgagagtgaacatccttgttcctaattttagaggaaaagctttcagtttttcaccattgagtatggtgtttagcttaggacttttcatatctgatttttatattgtaaggtaattttcttctattcctaatttgttgaggttttttttaaatttaattattatactttaagttctagggcacatgtgcacaaggtgaaggttttttacataggtatacgtgtgccatgttggtttgctgcacccatcaactcgtcatttacattaggtatttctctaatgctattcctcccccaaccccctcaccctccaataggccctggtatgtgatgttcccctttctgtgtccatgtgttctctttgttcaactcccacttatttttttgaaatgaaataaatgtgtcaattttgtcaactgctttttctgcatctattgatataattgcattatttttatatttcattcttttaatgtgatttatccaattgattaaatttcgtatgttgaaccattcttgcatctcagaaataaattccatttggccatggtatatgatcttttcaatgtgctgttaaatttcatttgctattattttgttgagaatttttgcatctatattcattgacgatattggtgtgcagtagtatttctgtgattttttttctagctttagcatcagggtaatgctagccttataaaatgagttttgaattgttccttcctcttcaatattttggaagagtttgagaaagattgccattaattattctttaagtgtttggtagaatttaccagtgaagcaatctggtcctaggctttcctttgtggggaagcttttgattactaatttaatctgcttattgtttataggtctatataaattttttatttatgattcagttttggaaggttatatgtttctaggaatttgttcatttcatctaggttgtctaacttttcatacaagtgttcccagtattcttatagtcctttttatttccatataaccagtagtaacataacttctttcattttaaaaaattttagctatttgagccttctctttttttattggttaatctagctaaagctttaccaattttgttgatgttttaaaatatgtaactcttagtttcaatgatttttttcttttaattttattctttatttttttctctaattattttcttccttctgctaactttgtgcttagtttgtcttcctttttccagtttcttgaaatgtagaattaggttgtttatttgagatctttcttccttttaaatggaagtgtatattaatacaaactttacttttagtactgtttttatggtatcccataagttttggtatgctgtgcttttatttccatttgtctcaagacattttctgatttccgttttgatttcttctttgacctattggttaagagtgagttgtttaatttcctcatgtgtaaattttccaatttctcttcagccattaatttctagttttatttcattgtagttggaaaatatatttggcatgattccatcttcttaaattggttaagagttgttttgagacctaatatgtcatctatcctggaaaatgttccatgtgcgcttcagaataatgcatattctcctgctgttagctggcatgttctgtatatgttaggtccttttcatctataatgtcattcaagtcctctgtttccttatcaatcctctgtctggatactctgtccattattgaaagaagagtattacaatcccctaataatattgacttgctctgtatttttctttaattctatcaatgtctgttttatatatttgggtgctctgatgttaggtgaatatatatttaacactgttatattttcctgaattgacccttctatcattatataatatccttctttatattttttaacattttttacctatagtttattaccattttcctggattatatttttctatcctttcactttcagactttcagccaatgtatgtcactaagttaatgtaagtcttatagacaacatataatgagaatcttttttttttttttttttttttgagatggagtctctctctgtcacccagactggagtgcggtggtgcaatctcggctcacttcaacctctgcctcctggtagcagggattacaggcacacaccaccatgcccggctaatttttgtattttaagtagagacaggtttcaccatgttggccaggcaggtctcgaactcctgacttcatgtgatccacccgccttggcctcccaaagtgctgggattgcagttgtgagacaccgtgcccagctgagaatcttatttttaaaatccacttagctattctatcttttgattgcaaagtttaatccatttacatttaaagtaattatatattgataaggaaggacttattatagccattttgttaatagttttctgttttgaatcttttttgtccctgtttttctctcttgttgcttttgatttctttctcattttcttttgcatatcttctatagctatagttttgtggttaccatgaagcttacataagacatcttgcagttataataatctattttaagctgataataacttaacttcaattgcatacaaatactctactcttttactcttccccccacataagaactttatgtttttgattttacaaattacgtctttttatattatgtgtccattaacttattttttacttatggttatttttatacttttgtcttttaagttccttagttcttaacacagtaactgtagtactaaaccctgagctttgtgaatgaggcataaatatgctcttgtccaaagcttgcatcatcttgaaagttaatttattcaattgtattgatttaaatgataggatggcttttgattagacttttgggagactaatacgtgtaacatcctgggtgtattgtttccaagtgtctcttcccccaactcttcccgttctagatcctctactgactctttcctggttgccaaaagcagaaaaggtagtgtaggagagtgtggaggccctagaaagggcatagcatgtgctatcccttgcccactgcactgttttatgagggagaaaatgtatgaataatgatatgggtaaaaataacattatggtaatgagtcataactgaaaaaagcaaggggggaagtgaagaggaaaaaaaggaggaaggaaggaagttggaaggaagctagaaggaaggaaggaaggaagggtgggcaagaagaagaaaggaaaggaaggagggaatggtcacaaactgaggaaatacatctctttaaaaagataattaaaacacatagtagggtttaatacacaaaaccaaaatcaagtaaatataaatggacatttcttttactctgggacagtcttggacacaccactgaggcctccttgaagtagagtgcctggcttttggagctgtcataaccagaatttgtaatgcaatcataaaatggaatcagtttttcttcagtttaaattttgcaagttcttatttttcaaatgaataacttgtaatagatattttctaaatttatcaaacggttaaaaaaaaaagtctgggttaaaaataaaccagagtctgacttgccagtgtaattcatctacaaattggcctaaaggcagggtatggactaatataaattacaggtcctctttcatctaaatgatctcttttccttagagacctaacattttggtaaagtttatcctagctggctgtgctttagccagtacatttccaattcacatttaattaaccatcttctcctctgggcttatatcattttgcttttgtatttatgcattttattcaatatatgtttactgagtgcctagtttctatcaggaactatgctaaggatgatgtagtgaactttagaccaggtagaattcttgcagggcagaaagactttgaataaacaagtgtgctcagtgattaaattgagatgtacagaaacaacatgcaggatatcccttgctattgaacttgtcccattaaggtgagttatataattacatgtgggcacaactgtccttcttattactagatcgtaagctcttcaaaggcaagaactatcctttatttgtaaactcactctttctttcccattatttcacaatataattattatttctcagtaaatacttgaattgaacttggaaaatgtgggactttggtttaggaaacatgctgatatggtttggctatgtctccaccaaatctcatcttgaattgtagttcccataatcctcacatgtcgtgggagggacctggtggggggtaactgaatcatgggggcagctactttcatactgtccctgtgatagtgtgtgagttctcatgagatctgatagttttataaaggagtttcccactttgcttagcattcctctctcctgctgccatgtgaagaagggaatgcttgcttcctcttctgccatgattatcagtttactgaggcctccccagccatacagaactgtgagtcaattaagcttgtttcctttataaattacccagtcttaggcagtcctttatagcaatatgagaacagactaagatacatgctctagtttgaactcttccattgactagttatctcactttggacaagtcacaagtgctcatttaagggctgagaacattttcattgttgcataaatatttgaaggccaatggcctttgcttctcttctgaaacactgttttctatgtttgtgtataatgtgataaagctttgtataacatttacgcacctcatttttcctggtcataatggacaaggtatgaacttcagagtaaaacttctgggttcccaaaccaactctgaccattattagctatgaacttgggcaagtcacttaacctctctgtgcctctgtttcctcatttataaaataagctttcacaccaatctcatagaattgttgtgaaaataacataagctcatttctgtgaagtacttagcacattacctggcacataattatgctcaacaatgtctatttatgcatttacctgtctgtctattgtcatccctctccctatttccattgtaatttccagaggctgacatttaaaaattctgtagtgcttatgaacagagactcaataaaggtcagtttatttcaactgaatgtcaggattccatattggtcctaaacttattttctcaaattatattttgggcaaggctttctgcttctgggctagttgctaaataagatcaccaccatcaccaacatatctacagtatattgactacttacaaagtgtctcaagcatatgtactcattttatcccagtaaccatatatagtaaacattgaggtgacaatttaagatatagaaataggtttagaaagattctgtagttttcccatggtcacagcattagcaggagtgacaccaggaataaattaaggtccatataacattggagccatacaggaaaacctgtgcaaaatgacatctcatttttgtgtaagactttggttttttgaaaatactgttatagccttcatttctctacatcttcacaatagccccatatggtaggcagagcaggggagaaaactaaggtccattaccatgaaacaatgtgtctaaggtcaaacagctggtaagtgatattgttgaaaccagaattcaaacctcagtgttcagtcccagatttttacactatttcatcctgctttcctgctcagtacattccccttatttcatttctaggtatgaatatatgacatcttgtcactctctttgccatcaaaaactgggcaaaagttgaggtgcatttagtgaacctagaacataggtttttaagtttggtgtcagcacaaaatttgcatttgccttctctgttcttatttacagatcctaaggaaaggactgatcacgattttgagaggtctgatggaaatggttttctaaacttgaaaggcttaaatgaatataaaatttttgccttaattatattttctcatacaagtccagaagcatctgcagtttcttgcagccacaagcaagaggtttgaatttatgtatactccatttcttctggctgtggaacagcttcaatcatagcagctggagctaccatttattgatcatctactattaatgtgccaagaaacttacagaattagaagtaatttttgtaatagtcctgaaagtcccaatgttattattcccatttctggggtaaagaaattgaggttcagagaaactaagtaattgctcaaggtcatgcagctattaaatagcaaagctgcaattcaaatttaggtcagtcagattccaaatcctgatgcttcccacttcaccatgttacttatctcaaaaaaaaaaaaaaaaaaaataaataaataaataaaagtaatacaaatgaaacttctacctttcttttggtgatgtaagtactttaaatattaatctctgagtcaaacttgatggaggaggtgggtcggcaggggaggtgggcagtgggagaggtggggcggccgggtgggtggtggtgggaaacaaattctaattttataaaatccccatgttggtgagaaggccaagcagaaatgcagttgtcaattacatcggggtggagtttttcaccatctgatagtgagtattcatttaggcctgctgggctaaatgaaatgtggtattatacactcaagtgccaaagtgccttcgtgagacctttcaaagaaatcttctttatttcagatctcacgcataagccaataaaacataaattgcaaactacctgtgaattggtttctgaaaaattggtgttgggtccgagacatccaagtcggagcccaggaactgacactgaaaaacacatctgagaggtttcacctggtgcaaatttattaggacacaaccaacaataaaatattttcttttctgcagaaaggtcatttatttcatcctcagaatatgttcctttggtgtaatttgtacagcaaagggtatgcatcactttatgtgcaatttcctaaacaatcatccgttagtaaagaaaagctgaaaatcaattatctgatattttttcctctcttgtctacaacttccaattgaagacaaccgctttgcttgtcctttttttttttttttttctttttctgagacagagtctcgctctatcgcccaggctggaatgcagtggcgcgatcttggctcactgcaagctccgcctcccgggttcacgccattctcctgcctcagcctctagagtagctgggactacaggcgcccgccaccacgcccggctaatttttgtacttttagtagagacggggtttcaccgtgttagccaggatggtctccatctcctgacctcgtgatccaaccgcctcagcctcccaaagtgctgggattacaggtgtgagccaccgcgcctggcttttttttttttttttttttttgagacagtctcgctctgttgctcaggctggagtgcagtggcacaatctcggctcactgtaaccccggcatcccaaagtgctgggattaaaggcgtgagccaccgcgcctggccgcttgtccttctttaaacagctaatgtgtaggaagtttatagggcaatgggaaaacttactgcctatttgcatccaatctattaggtggtctttgtctatgaggtaggcagcacatcagaaacagcacctcgttccacttggaacaaattaaagtcaacacaacctaaagaggaccttgatgcaatgcccatatccttctccactggtatggttactgtgccatggcaggcagcccccctttcagttccagaaagcacccaggccattcaagagggagtattcaataagtctcaattacacagctacaatacagactcttgttgagacccagtagaattcagttgagtggatgagtaggagctttatacacctggatgtcatttatacctaccactcatgttctagcccacttttcagacatcctcatgactttccctatccattgcctttttgctgttcacatgcaaagtccctgttgctttataaagagtgctataaggataaattgaaaggactgatagtcctctgctgccttggtccaatgaaaggtcttttggaaattgcgttgctaaattttgatggcaccaaacaaagagaaatgtttctgaaaatgaaattgtgctgttaaacatctgcattccaaatagctccctaacaagtaaaaatacaactgcttttgctttaaattaggttctgactaaaatatgtgctcttacgatctaggaccacgtcaaccattgggtttggtccatgactgatttggcattcaatccacagtttcttttttgttacattactgatctctgctgtatgcttctactggatcagaaaagagctggccccttttcaaaagcaatctaaagcaatcaattctagtctgcaataacttttgaagctgccaggtacattcaaattacagaaaatttaaaaagctgtttacacttttttcttaaagccaagctccttaactgcgaatgaagaaatccacagaagaacagtattcacaataaaacagctttgtctctggccaaaaaaaagacagccatagtgatgataaagtctatgttcagttttacatttcagttctctgaaaatcagttctatgactccaaagtgttcagatctcctttaatcctagtatcactcatactgggaattaatttattctaaggatataaggtcttagacaaattatttaatgcttacaagtgcctgagaatattattgtcacaaatacaatgacactttttgaaaaaatagtagggttcgaagaaatgaaactaagttgaagacgtgagtgtcatgtgtcagaggtggtaggccagagggtgaggtatctgctaccaaactatagggcctgcctgtagaggggagagacacttctacatatgctgtaggctgggcacatcctcataatatgcaaatattaagcagaatttatcagagcaacaaactctaagaccttcattaaatcaacattcaaaatgagaattattctcaaaaaccttcttttataagagtatgccaatcttatgtttcagtctcctgcaatcaaatgcagtcaggataaaggaaagctattgtcaaaatgttgaaatatttgagttttatgaaactaatgctcatctttttccagaaatacatcccagaacttctgaggtctggcctgtatgagggaccatgcaagtttggaggttttaggggacactcctgtgcattttgctaattctttcaagttacttaattgccatccttacccactagcagatatagaggtgtttgtttaaccacttttctgagtttcaagtgacatattacaagttttctcagggtctccattagctttgaaaggtaatgtcactttttggcattttcaattctcaaaggtagcaaactacgcaaagttgaaacctgtctgttcataaagctaagaactaaatataggaaaacaatttgggtgtattcatttgttcaacaaatattaattgcatacctactataatccagtgctttgccttcaaaaggcctcagtttacagcattgtatcagctagatattgtccctgccctgatggtgatttcagactaatgggaacgaccttgaataaataacctcagagataataatttaactacaactttgatagcatgaataaaagggaagtgttagaggctatgggggtatataagagaggttttagggatgggttccttgagaaagtgacatttcggctgagaaagctgatgtctatgaaagtaaaatctattccactctagatcaacttggcaaataaaatcagaatatgttaaattaatttacaacctgtaatatatacagctctacaggaagaaatacattccaaaatgcaaatagctaaaatttgcagcctcaaaaatatatgatttaatactatttaaaaactgatgccatccagaactaagtcaaatccttatattttaattaaagtcctttactacaaaaaagaataaagcaagaaagcaagcaataaagaaagcaaaaaaaaaaaaaaaaaaaggaaggaaggggaagggaagggaaaggaaaggaatgaaggaagggaaggaatgaaggaagggaaggaatgaaggaacagagggaggaagggagggagggaggaaaaggtagacaaccattttaacatggcttcagaagtaatacaaagaagtttataccattgctggcactggtaacaacattgtgctggaggataatcttaaaaacaaaacacaacgactctctgattttgatagtaaggtcatgccccaagtgggaactgctacaatatttgagcaagtaggttgacaatactgattgatctccaaggaattctggatcagacatcaaaactgaggtgacccttgtaaagtaatatatacatgctgatgatttacgttttccaacagtttacgggtgttttatgtcattactacctacactgctagcaatatcacctttttcactcatggagtacacaaaagctctgaggaaggagaaattgatttgcatctcagctgcatcatcaatcagctgtgggacctcaggcaagtcacttaacctctttcagcctcatctaacttcatctgtgatatgaggataatgatgtttacctcttaggatagttgtaagaattaaattaggtaatgattgtcatgaacttggcaccatgcctatctagtacattgcaagggctcaaattttagggtaatatcgatgatgattatgatgaaaatgactttcagtctatggtatttacagggctggattaagaaatttaatcacctcaacccctgaaaagatactagccccaccaatataattcaacataaatttttattattttaattcacagcataacatgcatatccatattcatgtagcaattcaaatagcttctttcaagatttttctgattgtgaaattttgatgtatttaccaataggaacttttctcattttgggggggcccatgctttgccacttctctgagtgcacgcttagtttgcctaatgggtaattcaaattccccaacataaattaggagatgttaaaaagtaaaaccagagaaaataaataatctggttaaatgctatcacaactggaggatagctgttatagcttcctaatggataactatttaatttctctagcttcatctctccctgttccccaatcttctactgcaagcccagtgtcttttggacttgatttaattctgttcctcccaaccattttcaatgctcacagaacttcatgtttgcttgtcatgccataaaagagctcctactcagggaatgactattgactcataaagtattcctcccttacttccaactcacagtttggcctcacttagagattccctttaccaagaccacagagcctcatgctagtcacatggattaacttcctttcctggcttcctatgtttgacccattttcttggctctcacaagctctcttcctctggtgggccatcatctctagtactaagccacaagccagcaaccacattaaatggccagcatggctccccgggagccaagtctaggaaaacagccagtcttcccactctaaagtaggtctgtggctatgtacctcttctgggttcaagggatgcagaacatggctgactatagcagaaacagaggagaaaaagataagcttgatgaatttgctgagtggaatctctacaaattgagtattcttgctcttatcctcatacctatcaatttctaaactcaatccaaggggatgccttctctccctcttccctcactcctatatacacactacacaaatatatgcatatatgtatgtataatcttgacagaatttcatttgtgagattttattgtaattaacatgattgagtctgacattctttatcaggataactttcacttttattatgtgttttatatgtgcacattctatgtgaacatgggtaagtttattcaactctacaagcttcagttttttaatgtataaaattacgttatgggctacgggtagatgcagtatctaccccatagagatgttgtgaggtcatacatatgaggtatctggcctacttcttaacacagctaataaaagagaacccaggatccaagttcacgtggttcaaccccagagcagagcctatgtacttagctcaatagtgtacactcaataagagttggatgtcattactaggattgttgtaattatcatattcattgtagaaaagttagaaaattcacataagcaaagagaaaaattactcatatctccattgttagagatgacaatttttaatattttttattgtcttcctagactttttctatgtgtatatatttttttctgcaaaaagtactatcagattctacttcttatttttaatctgctttcacatttaatatattgttaagatttttttcacataataaatactcttctcagtagaatttgtagaaaaaaatagtctaaatgactatataatttggtacctctgactaggtctcccatctctgatagtggtcttaaacttacatattccttgtatcttcttatccttgttaatagcctctgaggcttgggggcaattaccctgttcactgacttaaataagaatttattaggcagaatccacaacagaagtaagatcctagaaatgaaggaaagtttctctccaacataccactattaaggaagaaacagtgctttacaaaatatcattatagcacagtgactatggatttcactgagagctggcaatttaacaaaaccaatatggcagcttgtcatggatggaagacagaaagatcaaacaaaaagagaagtaaactttattaagacacttggaaatatgaaaatataaaactcattgaaagtataggtctagtgaagtatcacaatgcttagcatacaacttggtaccaaaaaaaaataagagagatatttatttgttaattcacaaatcattatttggaagcacagtttgagacaggtatcaaatctgtacagttcgaagccagcacccacatgaatctaactccaccttcgtgcaattgtccacagacgtttacccaactaacatgctctcttttctttaacatctaccgagattccaaccccaagcctatttccttgatgaactctattcttagaaggcaacttgttcactctcttctctgaaaatgtttatacctaactggatctaaaacttagcttaatattttataacttatttttttttctgggacataaaaaagaggagtttccaataaattaattttccaaatagtttaaaattgtcctagctaatccctttgtaaccttaaaaagttccttaacaactatgagcctccgtttcttcacatataaagtggtgatattagtccgggcacggtggctcaagcctgtaatcccagcactttgggaggccaaggcgggagtatcacgaagtcaggagatcaagaccaacctggctaacatgctgaaatacaaaaaaattagttggtgtggtggcagtcacctgtaatcccagctacacgggaggctgaggcaggagaatcgcttgagtccaggaggcagaggttgcagtgagccaagatggcgccactgcactccagcctgggtgacagagtgagacttcatctcaaaataacaataataataataataaaataaagtggtaatacatactttgaagtacacatatgaaaattaaataatacatgataatccttaacatgtagtagtagttatcattttactagtcataaatgtggatttgctcactgggatcattcataacaaacatctcttattgtaataaattacattacagtgatgtctgcacagactataatggtttattttcatttatttcattaaatattcaagagctctatatcttgagcatgtacatttacatattataaagggttttagcgtttcttttctcctctgtatcacgacactgtttcagctattacttatttccctagccttctctttgtacttctatcaagctgaagggatggagggttacgggctgatcatctaaattataaaacttgttggaactgtgttaaaagcaaaagtaataggatgaagggggcctacacttatgaagcattaatgtgccagcaactattataaccattatttcgtcatatcctcaacataacattttgaagtagaccgtgttcatcatttccatcttatagttaaagctgagatctagaaaggttaattacttgcaactttttattcttatagttgatgcagtggatattcaacaaatgcttattggtatttgttcatctattttttctctttatttttaagaaaatcctagagcagagaattttaagacggtgatctctcctgctttcagttccattttggcacaagtcttatgtcaacatctcacctccctttgatgcaatgatatacactttttccaatttaagaaggagtctggactctgtggtgtcctttccttggtctatcaagatcatcccttaggaagcagagctgaattctggaacctggaattccagcatctccccatggaagtagccctcattaaaataatcccctttagaaaagagtcttatttttactcatagagcattgttgctacatgtacttcttagacctgaagattacaagctagattttagcaacatgtgaatagttttgcttttttgctctccagaaaataaagtacagaaaaataatcatgacgactttaatttcttcagtatcagtaaatctcctggccatacgtccatctaagagccacactggttacttagagattaggcttgtgtgtgcatggggactagtatgtttgctgaactgtttgaacccaattacagaaagtcacccagtaagtaaacacagccagaaatatggtcacagagaaaacgtagagaaaaagtaatgaagtattttgcaggagagtctggtttatttgctaattggtagtatctaaagaaggcaatattgaagaatgcaggcacaccaggagtatttctcagccaataatctaaaattgcttttaacacaaaaccccaccagttgccttaatctctgagttctactgtccacactgccccagtcttttactggacagacacataacgcctaggtctgcatgcactgtatttttttaaattgaattcaaatctcctctagggaaataagtgatcactagacaaatgtcagtggtgatgcaacatcttagtagcaatcattgtgctggttaagtataacttctcatacagagatgtaagaggtcagaaagagagaaaaaagatactacatacttacctagagtctatgaatcaggccatataccagaaaacttaatgcatatatctccagaaaagtaggtattctgatccattttacagatcagttttaccagtaagggcacaggctcaaagatctcgagtaatatctcaaggacacctggccagtaaacagtagaatcaggactgaaacaggtatctcctgactctaatgtcggcactcttcttgcttcattgcagggaaacaaaatcactgatgcttggccatgacataacttcagggtaattagcatatgttaggaggtaggtgcaaaactgaaagataccaaaataaaatcaaaagtatggggctagtgttaaagggccactcttgcaatcaagtagaaagcattatggctccatgagagagatgggaaatagggaatggttgaggatataagcagtgggatcagcatgattgaaggagagctacgtggaagaacagtacattctatccagatgaataaaaaattgaagagtatcttcaaatatttctgagtagtttaaggctaagggaaatccaacaacttctaagctaggtccccaacctcaaaggaacctataactgctaaggatcgtaagtgggggattcaggctttgaggtctctattccattgcatagtagctgtgagatcattacttctctgagtttcaatttcctcattattgggggttctcataatagtattcttgaagtgttgttctctcttaagatatatattaatacctagttgcaccactggagcctaatatataatagtggtggtggtggtagctgtggttgtgaaattcaaattggtggtggtagtagttgtggttgtgaaattcatattgccttaactaataaaagaaaaaaatggtggaaatggcaaggtaatagactgaaataaataggcatgcctatttttgttggcattgtttacataaaccagttcctgtcagacaggtgggtcttaaccttggctgcacatgagaatctgtttaaaaacataaaaaatggcactccctccccagagattatgatttaattattctagagatatacccaggttttctgtagttctgaaaattccccactatgtcccatatgcaacaagggttgagaatcactgcataacaagacaatgctgcccaagggcgactttaccttaaggcttctcagccctagataaacccactgctagaggtaaggaataaagtaaaaaacactttttgaatggcctgtgttttgcctttgggcattggtagtgaagtatcaatcaggtagaatctggaggcacagagccacagaatttctgtacccctttttaataatgtctagtgactgccttactaacctgtgtgtagatgcactataacaaagcacaatttcaaattagcagtttttacaaataacatgctgtaactctgaaggaataacaattttagtggaggagatatgacatttggcatcaaaagaaaaggattcacattctttaattcagttacttagttcatatccattctaccaaattctaacatatacaatgtcctaacctggacttttctttttttttttaattttatttagggtacttttctataagcacccttgggccagaggcctggtgcgtttgtgatgggtcatctggctgttctgttatttgaagctcacccaggagactgctcactctggaggcagcaccctgaagagctctgagtatcactaacaatcagactctagatcccaactggggagaaatgtgaattccacccacttgtttctccaatttaccagcaccagaaaggaatgcccacctacatttaaaaagtaagtactaatacagcaggagtgtaatctagggcccctgttggaaggagctatggttcaaagctgagcttattttttaaactattgccatttatttcccctcttttgacagaatatgggtgttatatttttaataatttgtgaatcagaggtggagtggagagtacagtaaataccaaataaactgtcttttgggtatctgttgaaatggcacaataataatttggtccaaggtaaagcctttactgccttggggtcaatattataatatctacctattaggtttattatgaagactaaatgtggacatgtatataaagcatttagcacaatacattaccccaaaccatagctattatgattagcttattataactactttttcagtaaacaccttttaaactcaacacatatataggcaacaggctcagggaaaagaaagagtttgggaacaccaacaccaaacatatttattgggtctaaaatagtgaaataggacttggcgccaacaccgataatatcaacatgctaataataaagccacacaaaaagctcaatcaggtaatcctgtgaatttggaatgtgtgctcattccagctgaatttgatgcttcagatcccttcctgataatacatgcagcgtcccaggcaccagggatgacacaatgccctgccctgtaggatcttttcagtctagtgaagaaggcagtcttaccaaaaaataatgacaatacagtgcaacaaaaacaatgagaaagtttagtggcaagtaatgtgggaacatgggtacagaggaaataactgtctggagaagagaaagctttgcagagatgataacccatttagggatttgatgaatcgatagacattcaccaggaagagaagagagagctggggcaaaagttagaatgaacaaatgcttatcacactgaattcttgcccagggccaacatgtaaaggtttcaagcttaattatttatgattgctattataattagatattacaaagttatatttattacaaagtttataatatatccccccaacctaagggaaaagccctgaattatgctgtcagctgttttcatcaaagcaagtcactagccttctcttgttattcactggttgaatgtatttgttaaatatttgctatttgtcaagaactctgccagaaactggggatgtagctgaagaaaggagaagcattccttgtcttcgaggagcttgaaatctagtggaaacatcagatgtttaacacacacggagcatttggagaagtgttcaacaggggatgggcaggaaatgcttttatacctgattttgtgcttcaaaaaatggcaatagtaataattttgttacctaatttccagggcgattggtacaggttatgacaatactttaaagcatggtaaaatatagaaaaatttaaggtgaaggtattattgttgtcactcttcttacatccacctaattgaatttatttaaaatagcctaaaatttacatttttttcctaatatagacattcatcagtaaaaaattgtcttgaaatattatttcttccacatgaagtactgaataccaactatttatattttcatgagaaatcagcataattattcttcctgtctagttatctagttatgtcctcttgaagaaagaaaatgatgccacctgttgagtgatgtgcccagattcatgcagagtgaggacagaattgaaagatccctactttatgttcgaaagaatatagcctatcaaatatttatttaaagtcagagaagaatgaagaaataaagacaacatcaatatcagtttgggaaacaaataccaacacagagtccagtttgaagcctctttgaaaagggaggaggtaaagtgaccgagccaacagatgctggaaccagactgagtccacaacttgcctccactgtttactaactatatgaccttgtgtgtaaaatgtctgtactaatttttctgatatctaacattggggtgataatagttcctactatgagggcttttggaaaggttcaataaattcatagaggtaaaggttttagagtagtgtactcagggctcactacatactatctactattattgttgttaactctcatgactacccttaaacctacacctcttctaatggaagaaaactggagaaagtagaaccaactcagagctctcatatttacttcttgatggagatggttgaaagctcagtgaagtgcaaccagacattgagaaacttgtcttttccacctattaaaggcaacagatttgtcaatttcaaactctcttctatctgaaaacaaaagacttccttcatctaacttaatcacagtaacttatctgtccgaagtcctccctagctatcccccagtgactcttttccaactaacgttccctgtctgaagaatatagatatccaggttattactcaagttaccaaaatttcagagctaaaaattacttgatagctgaaccctcatcagaaaggcaatttcacatttttactgcattttgcatttccatcattatttcttctaccgtatggaaggccaggttggggacaatttggattatagagggtaaaacacatgatatttcttttgtacatttaataaaagctgaagtgaaaaaaaagagagattgaagccttattatattactttttaatcctttgcaatgcaatactaatgctatgtatgtaatatttgagatccctaaccagagctcactttggctgagggtccaatcgcattagaaattaccttgagagaagtactgcaaatgcaaactcatgaaaataagagaaaagaaagaaaagaaatgtcagccagatcatttgttttcccatagatcatctttccaaatgtgggccagcaggaacaaattttatgctgacctgggaaaattactgcagcaatttgtatgtgaaacatggatttggaaattttgaaaccggtatatttgcagaatgtgaaagtaacattttggaataaagcaaaagtcctgtacacgagtaaatactaagcccttaacaaagcatattcaaggctgatttttaagttatgatatttaagctttttaggatattgaccctacttctaaactcccaaactactaataattttctaccctattagattttgcaacaggttacagaattataataaaaaccttcttcatttttaactggactgatagtggtggtgtaatatcccaagagaaagagtcacatgaagattcttatctcctacagtgagaatcaaatattgaagtgaagatggtgtcacaatctatgtttcttttcttttctttttttttaacctgaggtttcaaaatccttctctggtactttgtaatgacagagttggattacctgtgaggcttcatggtatagagcaagtgttagcaaattgcaacttgtaggccaaatccttctcacttcctgtttttgcaaataaagatttattggaacatggccaggtcatttgtctatttattgctgataattgcttttctgctacatcagcagacttgaatagtagtatccgagactgtctggcctacaaagccaaaaatatttacaatttgaccctttgtttaaaaagtttgctaccctttggtataaagggaaaggcagtgggttaacaagcagtaaagaaaagagtacttctgaaggtgttttctcttctatttatcaaagcagtcatcagaaacctgtagtattttatttttataaataaaaactactatgtgtttacatattatttcatagctgtgaaattttttctgaaactaattaccaaggtgaattccaacactctttccttcaaggctctcagttaagtcatatagtgcaaagtattctttgatactctcaaatggatctgaccattcctttctatggctaactcacatttattcctgtattagagagtatttcatttgtttatttatttataggtcttcccttcactctagcctataagcgcctccaaacttagcatagtgtcttaattaattttgcatcttgaatcttatatatgcctggtatacagcaggtatcagtacatgtttatgaaagttagctgggtaaaaaagtggtaagcgtaaatcttgagaaattaacttgctgaaggtcactcagctagcatgtgattaagctgggatttgaacctagatctgaaactaattcaagtattcaagtgctctttccatttatcttactgactgtaatctggagactgcagttttcttttttgttttgaaatggagtcttgctgtgtcggcaggctgcagtgcagtggcacgatcttggctccctgcaaccttcgcctccctggttcaagcaattctcctgcctcagcctcccgagtagctgggattacaggcacatgccaccacacccagctaatttttgtatttttagcagaggcggggtttcaccatgttggccaggatggtctcaatctcctgacctcgtgatccactgtccttggcctcccaagagactgcagttttcattttgattctactattgaaaatttgggtttcactgtctttatctgtaaagtaagtatgttgcattatgaaatgcctttcaagacctctttccctaatgttcaatgtatctaggatagtcgtttcactaaataattgcagataatatttaaaaagtaattatggctattttgtggttcatctcagggctaaaaaggtcacatacagccatctaataaaaacaccatctcagtgtgggggtcaatcacttctctggtagatggctgttaatgagttttgaatgatatggaaagtgtcacccagctgtgcacagacagaagcttggcagtaattggttagggtgctgctgaataaataaatgcattggggtgggggtgaaggctagagcaaatgacttcttagatgtgtgaccacttgagaatattaacatatgtaatacattgtatatcgagatttctatcatgcccacaacgtaagccatttacttggattttccattgctgaccagttctacttataatttttgttaagccagtagtttcctcctggttaattctgcccattgatatttggtttaccctctagagggaaatgaaatcaatctcaaccctctcccttgactatctccactataggttctggaaaagcagaatgtttttgatttctagtctttctcgcagcaatgtgtggtcatatgtttgaattctggccaatgaactaaaagcagaattctgtgacatggaggaaaaatctggaaaagcttctgtggtcatgacaaataaaacagacattattgatgcctccccacaacccactcctagcaccctatgctgaaatagtacatgatgttcagagatgcagagcccattttgtgacaatgaaatggccaagaggtttacagagatgtcagccctgatataatggcagtttacctccaaagttcataatatgtgagaaaaataatgtttatttgtcactcttaggcacattgctgcttgtagcctagatcatcactatctgatacagattgcataagggtttatgagtctttacagccaaaaatatctgggtttaaatccccattctgacaatttgtgatctttggtgagtaattatatctctaagatgaggtatgttaatctaaaatttggaacaacaataacattcacaagcttgttatgaggattaaaacagataacacaggtgagagtactatggaaagcatgtgacacatagtaaatgctcaacaaatatcatatagtgtcactcttattattacttatcattcttatcattacttataatatttgagccatgtgccaagccctgtacctaaggtaaataatttatttagcatagataaattattttcttttctagtactatttaacaaacttattaagtagaaataattacattcatttactaaagaagaaaaataaagctcaaggacgttaagtaatttgccaaaggtcaggcagttaggaaatgatagaattcaaattttattctagatctcactctaaattctacatatttgctttcaagtctatgtttttcttctatccaagaagaaagatattccatgggatgtttataggtatgctaggaagagtaatattcagggatctctggaataaataacttaggtttgttagctgcagaatttctcaaacccttaatatgctaatgcatgtaggtaagctatgacaggggattctaataatgaatgttttccatttttatggcacacatggtgtatgggttgaattaagtaccccaaaatgatatattgaagtcctacctcctagtacctgttgtgactgtgaccttacttggaaatagagtctttgtaaatgtagtcaattttaagaggtcattagagtgagccctaatccaaaataactgctgtccttaaaagaagggaaaatttgtacacacacagggatatcaccatatgaagacaaagaaacagagattaagatgatgtgtctacaagccaaggaatgccaaggattgcaagcaaaccaccaaaagttaggagagaagcatggaacagagcttcctcatagtcctcagaagaaaccaaccttgccaacccaccttaatgttgaacttctagcctctaaaactgtgagacaaaacattaccattgcttaagccaccaatttggggtactttgttttagaagcctaacaaagtaatacacatggaaaaacactttttggaaaagtttttcaattagattacctcccggttttaactttttgacaacctcaagttgttttagccattcctcgtgtggcaggctaagtgcatgatctcaatattgacccaaattattataaatatgattttcatcttattagtaaagccagaagtaggggtgctggggacagaatattgatgggtcagaaaatatttcccaaaggcatggtgtctaaagcaggatgtactatggccaccccctgcccccaccttcttttttgagttttgacttgaactttagtaaccagatgaagttctgcaactttgtaaggtctggggtttgaaaatggcatcctttcttttatattttatttcaaccctttggaaaaagggtctgaataatcagattttattagtaaaatatcactgcttaaaagccgtcatgagaaatatgcaaagctatgatatatctacattgtgaatgacacacccttggatgtgaaacttctatgctttgcacggtcatgtacagtaggtctaacatgacccatgtgccatagtgactataaatacaggcatccttcacaggtagttgacatacttttatcttcataaattctgaacagtcttaactaacaaaaggccctactaattgttgtagaagaagaaatacttatcaacaaatatacaccaatgtggtcacttttggcagagaggattgtttgagaccaggagtttaagaccagcctgggcaacacagtgagactctgcctctaaaatatatatatatatcgctaagatgaatctttattctggctttaaaaaaatccaggctaggccgggcgcggtggctcacgcctgtaatcccagcactttgggaggccgagatgggcagatcacgaggtcaggagatggagaccatcctagctaacacggtgaaaccccgtctctactaaaaatacaaaaaaattagcggggcgtggtggtgggcgcctgtagtcccagctgctcgggaggctgaggcaggagaatggcgtgaacccgggaggcggagcttgcagtgagccgagattgcgccaaggcactccagcctgggcgacagagagagacttcgtccccccccccaaaaaaaaaaaaaaaaaatccaggctaaaatgacgaggaccatacttttcaacaggtttttaacctgaagaggttaacaggaatgtcccaggggcttcatgaacctcttgaaattacatttaaaatgtttgtgttcatttgcatttttccagaaataggctccacatattttatcacatatgcaaaggagtaagtatcacaaaatgtatttaaaaccactgttctacagcatagagctttgaggccttactcatccacatctatgtaagagaatatacctaggaggacatattgagaacctacacctgaccacagatgttccttcagctaaccaccatgaagacacggagtggtcttccattcatgccattgtcaatactgggttattgaaccctcctaagaaactggagagaatggaatgagttgatacatttagcatatagttatacagttagcatatagtaatcattcaataaatgtttcctaatgttgttatccctcattggggtgattcctaatgaatatggctctacttataacctgccatgttttgcactgcaggtataatctattattccttttcacttttcatacttattaaaatttggctgaacaaatggtattaatggaatatttgctaaataatttgttcttcatctaggcttctagatactctaaaatctgtctttgaattaatctaggccatcagaaagcaatctatcagaccaaatcaatgttttcctattcctatccctccccttttcaatgtaaaaaaatgctttttagagagtcatggtttggcatcagcctatctacctgtattacaggattttattttttggagagcactgtacagtctattatacagaactttagatgtgaggacaaacaggaaatatttttctgtactttaaattccaggaaaaatatgtttctccagatgaaaaaaaaagtttatttcaaatcttacaggaattgtaaataataacacttatcatggtttcttttttcatttgattccaaaattaacccagaattaaagttttaattgacttttagtaaatacaggggatctctgtggcatatattatataaaaggtgctcccctgacttcatctgtttttcagcccaggtcctctcatatttctgactatttcccctaattttattcttatttttcttcatgcattatattcatatttataaaacaaattaaaatcctcctcaaataagaggcaaatatgcatacatactcacgtaaactttatataaataaataatgctcggaacctaactaccttggcaagttaattaatctctctgaactttatgtcttttaccttaaaaaatattaatggtacattcttcatgggtctgtgacatatataacagcatttgatttattgatatacagtattttaactgagcgcctggaacatagtggatactccataagtctggtccctttattgtccttttagagaacttgtaattttgacaaatttgtagtcagcagaaatattaatttgccagtaatcttaggaaagtggtgattccaattcttggcatgaggtgaagacttaaaaggaccttgcttcagcagatttaggttgaaacactaattagaacagactgtaacaatggaggagaagtagaatggacgcactatgctccatatataaatccatatagtaattaaaatatagtcatagctctcaagaatgacagctcttggccaagaagattcctgggctgaaatattaggattgctagattcagatgggatcttaaacaaatttcttgaggtaaatagtatccatctttgtgcctaaaccacatgatattttctcatagtccttgcctttggaaaggtttattgattcatagaacctttttaaacaaatgaggcaatgcagtctaaggaaaaaggaagatgggttcccaccaaccaaaagaagaccttctcccgctcttgctccacagcatggcatgaagtagatgtgtttttctcctactagctgaaaaagtgccaaactagaagtcctaaaaccttgatttccattatagctctaccacattctggctcatgaaccttgggaaagacaaggagtttccttataaataggggtaataatacacacaccacaaggttgctgtggagattaaatgaggtattatgtatgaagcccttgacacactattaagtgactctatgtgtgaagaggggaacgatagaaagaataaaatgcatagtgaaaccaagtgaaatgatgaagttgtttttgtaattttgtaatatatcaacttggctaggctgaactacatttcccagaattttgtttcctgtatgtttccagctagggtgagccacaaaaaaagattcctgcgggagatttgtgggtgtaagtgaaggagctgccattttgtaatatacacattgttgcttatctgctggctcaattcattggcgcaagtagtggttaggccaaggcactaagatatttttaatgtcttaaaataactttgtggtaatattccccgaaattctgggaaggggtaatatgccacctggcaactgtttattaaaacagacaatgtggaactttatgaaagagaaaagcaggacttgtaaaaatgaatggcagacagtgggtgctcacaaattatctttatttttgtcttaagtttctaaatctcagggacagctaaagagaacacatagaagagttttacttctttcttctgttctctggatcctactctcttccttacaacacatattactcttctgtcttcagaattttcaagttctcccattacactagatatttttccatgggcacttaaatgtgttcaaatatctgttccactttcaatatattttctctccagatatcattgtgtctccctcctatttgcaaacaaacctctcaaaaagagttttctctactctctccattttatcacctctcacttgcttctcaacttactgccaactgttttttaccgcttgccttaaggctaccaaagatatctacaatacctaaatccaatagacagttttaggatttggttagcaagacaatttgaaagacttagagacgcatcatacttcaaataccccaaactgaactcgccttcttccacctaaacttggactcttcctgcagtgttccctcccttggtgaatgacactgccattcactcagctgcacaaactatacatctgaaagtcattcttgacattcctctccctcatctccacacatgcatcagtcaccaagtcctgttgtgtctatctccaaaatatttttttaattcacccacacctccacgtctctaatgagattaccttaaatcaagttacagttatggctttttaactattgtctccttttattcaacagccatagtattctaaaatataaatctgctcaataactttgaaatggtgatcactgctatttaaatatcatttcagattcttaatgttatcctcaaggtcatgtttggtatgtttttgtcatcatttttatcttgtcttcttggctctgtgttcttctgtcaccctgactgtgttctgtcttctctcagaatgcaaagcctgattcctctgtttgtaacagcattttcccacaacttcatcatttattttacctaaccaacttctactaatcattaacattctcactcaggtttaatttatgttagatcttcctcaacctccctgattggtcagatagctgatataagatccccccactctcattcctctcctccatagcacttatcaaaatcataaccaaataattaaatgctcaaataacctctaggaggacagagggtgtgcctggtttgtttcttacttcattagcacctaacacaatgtaagttctcaaaaaatctgaattaatgaaggtgttgatttaatcattattccaattccacaatacagtatttttaagtaaatatttccttctttggcatctgagtaaaatatcataacatcaaaaataatccaatgtataaaaatgtaccaaagtggaagatttcagtagtcaactctgggttaaactactcaatgcattataagtattgagtagacatttgttaattgtgtgaattataaaggtgtattagactgcttacatataatgttttagcaataaatttgcattagtaaatttaaactaaaaaattctacttgcctgcatatcgtctccttttctcctactatgttcagctttaatttcctaattttgagaaggaaattgcacctttttttctcaaaacattttcctcctggcagaataactttgttgtcagggatgagaaaaatgctatttgctaaaaatatgaatatttcttattaaagtagataaactatagaaaattgctctcactgactccttagaagtgttgcctttagaagtacagaatcagagaattaaactcgagaccttagaaccatctgtcaaaccctagatctaccactttacatcacaccagccacctctgcaacccagagtcagctccctaaagagttgtgaagctggttattgtacagttaggctcactacatcaatttgagtcaaatgcggtttgactaggttgtcaatacttcatgtgaaaagttcataccatttccaaagagaagtattaagggagtattgaagacctgaaagtagagacaaaaacagaaagatggagaagtttcccaacatcagagggtatgggacatttaaaaaaggacattaccttctttgcctccttttaataaccaatttttgaacatttactatatagcaagcatgacttctctcctgaacaaggtaatgtcttatgggaatgagtggtaaatgcataagccctactttagttcacagtgtatagttctcctaccccagaaaataggatcatataagatgatacaagcatgagtaggatgttctggcaacagagaacctgtgaatgcttcttagaggtgttgctacttgtgctaggatttgaaggacaagtagatgagccaagtgatgaagagatgacaggatcacaggaagggaggaaagagattatatgaaggcaaaacggacatccgctattgctgtagatgtaatatttgtatccctgcaaaatttatatgttgaaatcctaaccaccaagatgatgatattaggaagtgggacctttgggaggtgactggatcatgagggtagagctctcatgaatggaattagtgccattataaaagagtccccagagaagtgcctttccccttctgccaagtgaagacacagcaagaaggtgctcaaggcagaccttcacctgacgccaaatcagctggtagcttgatcttggattccccagcctccagaactgtgagagataaacttttgttgttataagcttcttagtttatgatattttattatggcagcccaaaactaagaactatggttatagctttagagagtcattagtacaattagagcatgagaagaggtaagatgaagaatcagaaattttaaaaaaagatcacaaaggaccttcctctcaaagccactaaagatttgaagtaaatgagacattgtataaaaatcgtgccaaaagatagattagaagggttagtgtatcctgaagggacagaacatgacttgcacctgattttcccagcatcttgcatagtgtccaaatgtgtcactgttcaataaatatttactgaatgttatacctgagttacatcaaacagaatcctgttgaattatcactaagtgaaaactagattgtcaatacttcatgtgaaaatttcacattatttccaaatagaaggattaagggagcactgagaacctgaaagtagaagcaaaagcagaaagagaagtttcacaacatcaaagggtatgggacatgaaaagaaaagggttaaagcacctaagataaatgcttcagactcagtttttgtttgtttttggttttggtggggaaagcagtccactttatccatttctatagcaggaaattgtaattaccacaaatgtacataataaagaccagctttttctaggcactgaacaacatgctttgatgcactactattcattcacaaacatttactgagtatccaccatatgtgaggcattgttctaagccctgtggatacaatctgaatcacgaagcttatatgctagcaagaaaactgagaacaaacaaagaacctgtataagacaatcccaagctaagaggcagcaaaacatagttgttaagagcatggcatttggaaacaagactatctggccttaaatgcttacatgatgacttgctagctgtgtgactttgggtaagttacataatggctgtgtgccttattctcttacctgtaaaatgagatcaatagtaattatctatctgatttataatcatgattaaatgagttaaaatatataaagagcttagagaagagtctggaaagtagtaaatattattaataaatagtattattgatgttttcttattctaattattattatcaataacttctacaaagaacgctcaaaggaggatcaagggaaagaggatcagataatgccagggtagagaatgaacatagaaagaggaaatttagacagagggacctggaaaagtatttttaaaaagatgacatttcagcaagtgacataaatgaagtgcaagaatgagtcatgtgaatatttggaggggactattccagagagagaagagaaattgccagaaagttcaagggctattgggtagaaatcagcttggtttgatgtgctcaagaatgagtaagagagttgcacgatgagaaatgagtgagcaaagaatgtaggtggagtaagaggcgaggtaggagaggtgagcaaaaagtaattgatttggagcctcatgaggaatcagattttacctgagactgagagaaagccaccaaagggctatgagccgagacagcacagtctggatgtcttcttaaaaagatagctctggctgcctgtagacagcaaactacagagggatagaagacataggaggcaattcctgttgtctcatttaatccacacatcaacatgtgagatatacattactgttcctattttacagaaaacaccatgagccttggaaacataatgtatcaaaaggcacacagatgttttgactccaagtccatgtatgtcttcctctcctcaggaaagccttcaggaacctcgctgaccaggtcataccatcctattacatgttttcaccgcagcattttcctctccttcatagaacctatcacagtttaattttacatggttgggtgattatgtattttatgtttaagagcaatggcagtgcttgtgtccccaaggcacataaagcaggtgctcaggattacttgttgaatgaacaaataaattgtactgctaaaagtagagggggcagaatgagaggtctgtgaacaaatatggtaataacatgagtaaattaaaaactgaatttcacacagtaacaacaaagacccactattcttgactacctgttgtttcttttctaaatataagtattatttttcaaattattactagtgaaagtaagaaaaatatttattttccaaggcaaataaaaacaaattatttttaaatctttttttaatgaaggcattaaatgaaacatgtagtaggtaagagtctcaaatttcttaatgtacaggagggttattgtaataattttctagaagttggccacatctagaattaaaacattggtatatatacctacctggaaacagacaaaaatgaaataaaagatttctacatatacttttatagtactattataatactacaatgacaattacccatattttaattgtgctttccaatctacaaaaatctgctccgtatagtatctcattgctcattcagaaggtactcaacatgtcagccattatttaaacacatacatgtgtgcaggcacacacacatactcatgcacactttctaaatcatttctgcagctatgtcctttgcagtggccttgataaaagctgactgtggcattttattaaatgcagccctcattaagacttggcattgtttgaagccactatcagatgatgctgagctcagtaagggcacctgttcttataacttctgtcttcatcaaacagcaagtcccagtatttttttttttttttttttttagagctgagactaaaagcaaacctactttcattggtatatgaaaccgatttccatgccttcattttctttttttgtgccaggtaataagtagataaaaatgattctctgttttcaactctaacacctctgaaattaagccctggggaagctagtgataactctgaggtggtaacttctctctaggttatttggaaaaataactctattaaccacccaggaacaaagacttggctattatcacacatacatattaaatggctgctgggacacagtgaagaggtgagacatagtgtcaggaaatgttctgttccagctcccacaaataggacatactcagttttataactgaatgacttatgtgtaataccattagaacaaaaaggtaataatcattttgctgtataataactaattaaatccaacagcaacctatcagatgttattatcctccaaatcccatttctacatacataaagaaattgagggacatatgaattaagcaacttatccaaggccatgcaactagaaaataaaaaagctgagatttcaacccagatcatttctcttacattgttctttacttgtcagttttatgggggagagatacagcatgtcaggttgtgtggagacatgagcatatgagtatatataacaacaggcagaagaattagaacttaaacccaggtgtatctgaccccagaatttgacctccatggccaagaaaatgattccattttcaatacaataatatgcttccctagactgaataagcctttaaacatattctttttctggagtattacaaattttctccaagttggattgaggaacaaatatattccaaagaaatggtaaaactgagaaatgaatcaatatgctgttgttctaatctgtaactccctggttgtgctgtatttcttaacaaatctcattgaagcagatttacctttaatcttaacaccccatctctgctagacgaattaactcttttggttcactgcagaattactgaggaattggttggcttaaaattcattaatgttgccctgaaaatataaaagagttaatacatttcccgaaatatttgctgttattagcaaaggttacgtggcctgaaaattattgtctagggtgtctggaatttagtttttccaagtgaaaaaaagttcaacgactttcagagagtttatgaaactaaggagaaacaattctcatattttaggaaatccccaagcttccttacaaatgattcttcctaaagagatgtcaaaaacagtgcttattacactttgggcttctactctaatttatttagcccttcctatcaatgagtgagggataaaatgtcatcctttcttcttaagcatattagagcttcctatggctccctacactaagataatagatcatcctactattaatctattaagataacagattatcctattatgctttctccacagtaatacacttggttctaaatcttggcaattcagttcatcgaactctgataatttacattttacagtaaatttcctgatatatttgatgagttaattcttaagactagagaaaaaaatagcttctaaaactcttacacaaagaaaatgcaattggtagcttagtaatgcaatctattctagtttctaaatgtgtaattttaccccatcaccccaaaactattaatgggatgcaatcaatcgtgcaggtgaacaggtatcttttcaatgaaaggaaatgaaataaatatgcctctgaagggacaaatactaggaaaatatgagaagatgagagagaaaatgccttatagccacattatctcaattttttttaaagaaatccaattctaaaaaaaatgtgattataggggtagaaggcttgaaaagtaaaggtttgaagaagacaatcaagggaatagaaaagaaaactggttaaattcaaataaattattaaatcagatttgagggccaaattcctacttatacttccaaggctcaaataaaatctcacatcctcccaaattagctacgagggaaattgcccaccaactataaataactggaaaacaagaaaaaatatatgattcaacaattttcagtcatttgatgtccctatcatccatgagagaaaggaaataaataaggtgagctccacaattgccccagcttactgcctggaggcagttttcaggaaagagaaagaaatacgggactcaaacagagtctagtttctccaatgcactgaagacagaaattgttttgggtagccatggcaggtagaatttgtggtcagaataccagggttgaaggataagaaggactatcatgaacagacagagagtcagagaggtacaagtgtggattatgtaatcagttcctgattatcacccataattaggaaaaaaatgaattaatagagaaatgacagagataataaaataggtaagaatgtttaagaagctaattttaaaaatgtgctttacatatgtaaaaatgtatacaaaaacataaacaggatgaagagtatgagagaaatggaagatttttaatgaaccaaatgaaacatataaagataaaaaaagatacccaaaatgaaaaatacactagatgggatcaaccacagattaagatgctgcaaaagaagaaaccagttaactcgaagaaatagtgacggaaactgtttaaaacacagagattttaaaacactggaacaaaatgaacagagtgccagtgatatgctgaatgataccaagtacagtcctagaaagtgggagggaaaataaaaacactatttaaagaaataatgaccaatagttttccacatttgataactataaattcacagatctaagaagctcaaaagccccagtcagaatgaacataaagaaaaccatacatcatgatcaaattgctgaaaaccaaagacaaagtgaaaaatttcaaaagcagccagaaaagaaaaagcttactttccataaagaacaaaggatgacagcaacccctcctcataaataactattcagatcatatggcagtgacatctttaaagtcctgaaagaaaaggactgtcaatctagaaatctataacctgcaaaaatatcatttaaaaaggacaaaatcttataatattcattgccagcaaatctgtaccacaataaaggtcaaaggaagatttgtgggcaaagaaaaataacgacagaggaaacgtatatctatacacagaatttatagctacaacaaagaaatgaagaacatcagaaatgatcaatatccaggtacttatatttttgttgcatttttaatctctttaagatataaatgactatttaaagcaaaaatgatagtaatctattatatgacttacatagagaaataaaattgtgcacaagaggtatgtgcagagttaaaagcatattattgtgagtttctcacattatatgtgaagtggtataatattatttaaagatagactgtgataaattgtataaaccctagtgaaaccacataaaattaaaagaaatataggtaataagccaatagttgatctaaaatggaatcacaaaaaggctcaactcaaaagcaatcagggaaaatgggagaaaagaacagaggttagcagtagaaagcaaatagcaagataacatatttaaattttagcatattaataattatatcaaatgtaagtagtctaaactcttcaattaaaaggtagagattgatggattgaataaaaaagcaaactagaaaccaaacttaaatataaagatacagtataaacaccacaacagttgaaattcttcaaggatataggctttatctgattcaacttgtatttctcacgcccagttcagtactagtactcagaatctactaaaagttactccttgaaagagtaaatgccttcataaagcagtctaatggtaactctaagaaatccctggtgaattaatcacttcctccaaattaataggttcataagaagagttgttataacagctgcttttttaaaaatcagggttttaattcagaagacttcacatgtctggcaagtgtttgttctatggggaatttatctacctcacctgaaaaccagaattcaaataatcctcttttttttttaataattttttttttattattatacttcaagttttagggtacatgtgcacaatgtgcaggttagttacatatgtatacatgtgacatgctggtgcgctgcacccactaactcgtcatctagcattaggtatgtctcccaatgctatccctccccactccccccacctcacaacagtccccagagtgtgatgttccccttcctgtgtccatgtgttctcattgttcaattcccacctatgagtgagaatgtgcggtgtttggttttttgttcttgcgatagtttactgagaatgatgatttccaatttcatccatgcccctacaaaggacatgaactcatcatttttgatggctgcatagtattccatggtgtatatgtgccatattttcttaatccaatctatcattgttggacatttgggttggttccaagtctttgctattgtgaatagtgctgcaataaacatacatgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgatcgccattctaactggtgtgatatgatatctcattgtggttttgatttgcatttctctgatagccagtgatggtgaggattttttcatgtgttttttggctgcataaatgtcttcttttgagaagtgtctgttcatgtccttcgcccactttttgatggggttgttggtttttttcttgtaaatttgtttgagttcattgtagattctggatattagccctttgtcagatgagtaggttgtgaaaattttctcccattttctgggtttcctgttcactctgatggtagtttcttttgctgtgcagaagctctttagtttaattagatcccatttgtcaattttgtcttctgttgccattgcttttggtgttttagacatgaagtccttgcccatgcctatgtcctgaatggtaatgcctaggttttcttctagggtttttatggttttaggtctaacgtttaagtctttaatccatcttgaactgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcgttatttctgagggctctgttctgttccatgatctatatctctgttttggtaccagtaccatgctgttttggttactgtagccttgtagtatagtttgaagtcaggtagcatgatgcctccagctttgttctttaggcttaggattgacttggtgatgagggctcttttttggttccatatgaactttaaagaagttttttccaattctgtgaagaaagtcattggtagcttgatggggatggcattgaatctataaattaccttgggcagtatggcaattttcacgatattgattcttcctacccatgagcatggaatgttcttccatttgtttgtatcctcttttatttcattgagaagtggtttgtagttctccttgaagaggtccttcacatcccttgtaagttggattcctaggtattttatcctctttgaagcaattgtgaatgggagttcactcatgatttggctctctgtttgtctgttatttgtgtataagaatgcttgtgatttttgtacattgattttgtatcctgagactttgctgaagttgcttatcagcttaaggagattttgggctgagacgatggggttttctagatatacaatcatgtcatctgcaaacagggacagtttgacttcctcttttcctaactgaataccctttatttccttctcctgcctaattgccctagccagaacttccaacactatgtcgaataggagtggtgagagaggacatccctgtcttgtgccagttttcaaagggaatgcttccagtttttgcccattcagtatgatattggctgtgggtttgtcatagatacctcttattattttgagatacgtcccatcaataccaaatttattgagagtttttagcatgaagcgttgttgaattttgtcaaaggccttttctgcatctattgagataatcatgtggtttttgtctttggttccgtttatatgctggattacatttattgatttgtgtatattgaaggagccttgcatcccagggatgaagctcacttgatcatggtggataagctttttgatggtgctgctggattcggtttgccagtattttattgaggatttttgcatcaatgatcatcaaggatattggtctaaaattctcttttttggttgtgtctctgcctggctttggtatcaggatgatgctggcctcataaaatgagttagggaggattccctctttttctattgattggaatagtttcagaaggaatggtaccagtttctccttgtacctctggtagaattcggctgtgaatccatctggtcctggactctttttggttggtaagctattgattattgccacaatttcagatccttttattggtctattcagagattcaacttcttcctggtttagtcttgggagagtgtatgtgccgaggaatttatccatttcttctagattttctagtttatttgcgtagaggtgtttgtagtattctctgatggtagtttgtatttctgtgggatcggtggtgatatcccctttattattttttattgcatctatttgattcttctctctttttttttaattagtcttgctagcggtctatcaattttgttgatcttttcaaaaaaccagctcctggattcattaattttttgaagggttttttatgtctctatttccttcagttctgctctgatttcagttatttcttgccttctgctagcttttgaatgtgtttgctcttgcttttctagttcttttaattgtgatgttagggtgtcaattttggatctttcctgctttctcttgtgggcattgagtgctataaatttccctctacacactgctttgagtgtgtcccagagattctggtatgttgtgtctttgttctctttggtttcaaagaacatctttatttctgccttcctttcgttatgtacccagtagtcattcaggagcaggttgttcagtttccatgtagttgaaaagaccaaatctatgtctgattggtgtacttgaaagtgacggggagaatggaaccaagttggaaaacactctgcaggatattatccaggagaacttccccaatctagcaaggcaggccaacattcagattcaggaaatacagagaatgccacagagatactcctcgagaagagcaactccaagacacataactgtcagattcaccaaagttgaaatgaaggaaaaaatgtgaagagcagccagagagaaaggttgggttatccacaaggggaagcccatcagactaacagcggatctctcggcagaaactctacaagccagaagagagtgggggccaatattcaacattcttaaagaaaagaattttcaacccagaatttcatatccagccaaactaagcttcataagtgaaggagaaataaaatactttacggacaagcaaatgctgagagattttgtcaccaccaggcctgccctacaagagctcctgaaggaagcactaaacatggaaaggaacaactggtaccagccgctgcaaaatcatgccaaaatgtaaagaccatcgagactaggaagaaactgcatcaactaacgagcaaaatcaccagctaacatcataatgacaggatcaaattcacacataacaatattaacttaaaatgtaaatggactaaatgctccaattaaaagacacagactggcaaattggatagagtcaagacccatcagtgtgttgtattcaggaaacccatctcacatgcagagacacacataggctcaaaataaaaggatggaggaagatctaccaagcaaatggaaaacaaaaaaaggcagaggttgcaatcctagtctctgataaaacagactttaaaccaacaaagatcaaaagagataaagaaggccattacataatggtaaagggatcaattcaacaagaagagctaactatcctaaatatatatgcacccaatacaggagcacccagattcataaagcaagtcctgagcgccctacaaagagacttagactcccacacattaataatgggagactttaacaccccactgtcaacattagacagatcaacgagacagaaagtcaacaaggatacccaggaattgaactcatctctgcaccaagtggacctaataggcatctctacagaactctccaccccagatcaacagaatatacatttttttcagcaccacaccacacctattccaaaattgaccacatagttggaagtaaagctctcctcagcaaatgtaaaagaatagaaattataacaaactatctctcagaccacagtgcaatcaaactagaactcaggattaagaaactcactcaaaactgctcaactacatggaaactaaacaacctgctcaaataatcttctaagtcgaggaccagcaaagtttttcaacagaggaggacaaaatagtaaatatttcaggctttgcaagccatgtgatctttgcagtaactactcaattctgccactgtagcacgaaagcagccacagatgatacagaaatgaatggcatggctgtgttccagtgaaactttatttacaaaaaccagcactgggacagacttggcccatgaactgtagttgtcaagtcccattcaagcaggatgattgtttgaagtctcgacggctgtgtgctagggtttgaatatttgtttcatctgaaattcatattggaacttaatccctaatataacaatattaagagctgaggcctttgagagatgattggatcatacatagattaatggattaatgggttagtgaagtaatgggttatcatgggaatggattatttatcacaagatgagtctgttaaaaaagtgagtttggctctcagtgtacccctcttgccatgtgatgccttcctctatgctatgacacagcaagtggacctcaccagaagctgaccagatgcagccacctgatgttggatttctcatcctccaggaccttaacgaataaatttattttctttatcaattatccagtctcagatattcagttatagtgacagaaaatggactaagacactgtgttatctattccgtaaatgatacatttatcaccactctagaaagctttgatcagagcccgtaatagatgcacacatctctttatttatacttaccctgtacctacattttctagttaatgcaaatagaaaaggcaagatctcagacactgacaggtaatttactttctatatctaagatctccaatgctgttttgtgcttttattgtattgtcacagtctatgcagccagtgactttgaaaacaattctaaactataaaagtgcctgatgttaccactatcagctcttctcatttttcaatgggacagaaggtttggtcaattgtatttattcacaacatgtaatatatgttctttttatatgctcaatctactttttcaaaatatcttattttagcttttttttcccagcatatcacaactttctacctcacattcttataattctctcatcttcttaaaattactaataaaaacaatgtattctatgtttgcctattcttcatggctttctatataaatattctcccaaggtaaggatttgagatttcaagataaacggtcactaaaaatagcatgtgctcaaaccatctactagatcaagtaaacatgtcctctatttaaagcaaattgctcattcagagaaaagggtacaattataaaggaagatcacgtatttggtgttaacatgtggtctaagttagatattaggagttcaggctttagatgcatcctggttgtatttattagtggcaatgtaacactaagtgagttatttatcttttatgattctgtcttattatctattaaatgtgaacacaaggtatacctcattaaagatgatgtgagatcaaatgagataatgcatgaaagtttagtagagttctgctttataataagtactcaataaatattgtgttaatttttaattttatgtgtttgaaacccaataaatattcatcaagtaacagacagaaaaagtatatttgtatatagtctagaactagtgtcttaccaattatttttatttccagagtccagtatactgcataataactagtagctactcaaaatattttttttgaaattgaagttaattacttctccacatgaggtaacgtattcacaatgtaatggctttgccttgttaaatcacgtatccatcccattagccaagagtataatttgaaattttcaatttgattgctccaaaatttacatttttatactgcaatatggccgtgttttatacattaccttatataacttagataagtttatttaaatacacaaatctgtgagtttaggtattattaacttagaaatgaaaaaaaaatagagagctccagactccttatcccagccaccacagttggtttggaacttaggtttgttatgctttggaactcattttttaaaccactgtgctactctgtctcttcaaaaaaaagtataagttcctgtaagttattcatgacttcaacaagaatgggaagaaaatgttaatatttctcatgcattaaaatacttaatttattagatctcatgacaacagtttgagacagatgtgatcatttctacttttcagatgaggcaactgaggcttagagaggctaacttgttcaatgtcatacaaagcttttcttggggggagatggggcgggcagacatacacacaaggaatagcttcatttactttaactgttttgttgaaagttggcccctgaagtaacttggcacttggctctctattcaataaaaggcttcatgccacagacatggttggagcattaaaaatatgcccttctgaaattttgtaatgtgacataaagattgctggttggaactgctgtataaaacccttcactgagaaaccccagggtcagatacgctaacagggaacacagtttgaggatcataagaaaggatatgaaatatgtattgagtgctgaccatgtgccaggagcatgcagatacatttgatattcacaacaatatatggggtaaactttatcccttcaccttactaatggggaaactgacattcacagaagctatttcacttgttctaggtccctctgctgctaaacaataaaaccagcttttgaatctgtttccactaaaacaccacaaatgaacaacataaataattataatgctgaagagagagggtatttacctcttcttcctgagatgagaatgttatatcttacaaggaagaggatatcccctctttcttggcaattatgcacttcctcatatgcatattacaactgtttgacatatacaatccattcatagactcgaatatataaccgtttcacagatctgagctgcctctcacctaaaagtggtatagggggaagttgtattttttttcaactttattaggtacttaaaatccttatgaaaatttgaaatattattcatttaaaagtggaaaaataaactatgtaattacacctttaaaatccaccatttccaaggaatctcctagttttccccaatttgaaataaaggaagtggcatggtaatagtaggaagtttggggtcagacagataggtagactaggtctaagttctagcacactagcaactaattaaatgattttagaaatcacttatccacataggattttggggagagttgactgatgctgaaagtgaggtgcctaccacagtgtgtggtgtacagtagggcctcagaaagcatcaaatcctttttaccactatgagaaacacaagacaggtttcttcttttattagcattaataacatatgtgtgtattctctcccacaagagtactatttctggaaagcagtgtctgactctttaccacctattaggtctctgcgttataggttcgttataggcgttcaagaaattattggtgaactgaaagtatagggagtaggttcctgagccagactgaaaggaaccaaagttcaaagcaaaatactgaatgctgatagttagcacatactaataaagaccactataatcgtacatgtgtgggcaggtggtgggaggagggcatctaggggtctattttatcaaaggttatatgttggagaaatgtgcccaccacattctcagtcactcttcacactttccattctggcttttttataaatccagttgcctacttatgtccaaaggaccaaagtctttttgtcgctttagatctaaagaggtcagtgagatgtgaataatgtttctactggttctttttcagcctttggtttactttactaaaaagaaaagacaagctgcgattttaatatggcactatttcactatttataaataagaagtcagataacacaaatctctttataaaccaaaagaaaaaaaatacatgtagtatacaaaatcttttttttttttttttgatagcctctgtcacccaggctagggtacaacagtggcacaaccatggtttactgcagcctcaaccacccaggctcaggggatcctcctcccacctcaacctcccaagtagctgaagttacaggtgtgcaccaccaagcctggctaattttttgtatagacggggttttgcccttttgcccaggctggtctcaaactcctgggctcaaaagatctactcacttcagcctcccaaactgctggagttacagctgtgagccaccacgcctggccacaaaatcttttctaccagcacagcaaacttgcttattctattggtcagaatcgacatactactaagatcaattaacattttaaaatgtaagattaaacatggcctaccaaacctcttccctcccaaaaaagattaaacattattcctatacttctcatggtgagctcaactggttagttaacaaaaaagtcctgatataatctatgaaaattttctacttttagaaaacttttgtaaacgtactttaaatttctatgagaaaataatatctcctgcatggtatataaggaagatttatttcatttcctctcagctagtctctaattttactttattaaaaagataacccacttcacggaaaagggcagtcattttgaaaaatcataatattctgaaatggctgtattttagtatgtgattttaaaaaattgcatgttcagatcttcttgttaggtgtcagacctttggcatttactttcaaggattttaagcggtaatttgtgtaaagtatatttacatttaaattaatctgaaaaatgcaaatgaagacataccaaacagtataaaacttacgacttacatttagattcatattgtacataggtgcattaaagtattgtttggtaatgatggaatccaatccaattagaatttttaaaattcagaaagcatctgaagtgtgttaataaattcacagctttataatattaacatcacaatttcagtgttgctttttatttcacaaaataattatgctggaccgcatatgcagattctaattatacacaacaaagaaagacttaaattggacctcctgaaaaggcccatttgcttataaaaagctgtgatgatttgccatcacacgaaatttgtatttaataaataaagacagaatgtgtaaattagctttcagtgtctttgccctacagcaaatccaaaattatggaaatataaaaattatagctttaacttcccatgaactatctgtgcattgcttcaatttgtggttgcttagaaacattataggcaaaggaattgattctttccagatgctactagtcaaaccacattttctgtttttgatttaaggctattctgtttaatagtgttataaatatacatttctctaaaaagtcacaaatgacaaatcaagttctgttagtagtgcatctcgggaatctattccttcttaacatggaaaaagtattttctgtgttcagcttccattagcttaactaaaggtaaacaatgttgaatgttattactgtcatttattcccaagatttagtccactagttcccatctaagtttgtgattcagtagcttggtagcactgagacattcacattaatttatcaaatgctcattgagagagacaatcaccttaccaaatacctaaaaatatagcaagagatgaaaccacgagagttactggcatatgtgaataatgaacttaactaataactacagactgtacttgggtggatactttagaaaaataactgaaggaaagagagacagagagaggcaagagaagagaggaatgagatggaagcaactgagtcctaaatgtgaacttttttcagtttgtggaggaaacaaatgcaaggccaacgttcaaactccagacgactatctggatgatctcaacaatgttacttaatttctctaaactttgttttttccaattaagaaacagtcaaaaaaaaaaaaaaacaaaacaaaaaaaaaacccaccaggcccggcacggtggctcacgcctgtaatcccagcactttgggaggccaaggcaggtagatcacctaagctcaggagttcgagaccagcctggccaacaagatgaaaccccgtctctactaaaaatagaaaaattagccgggcatgatggcacgtgcctggaatcccagctactcaggaggctgacgcaggagaatcgcttgaacctgggaagcagaggttgcagtgagccaagattgtgccattgcactccagcctgggtgacagagcaagactctgtctaaaaagaaaaaaaaaagaaaagaaataccagttagggtgcttgtggggaaaaactgaaataatgactagtgaaggaggaaacttgcttatcaaatactgtcagaaagtaaataatcgttgaattatcacattgttgaaacatcaaagatccttatttttaacttttagtttctaggagttgttgattatttttaagatgttcttaaaatcccccaaattcctttcaacttctgtttttctctaaagtttgaacaaaatatgtatactttcactaaatttctaataatgaagatcaaaggtaacactggatctaatctcacaaaatagatctaaaatataaacataaggatgataattttctcatttctgctttgtaaaaatgtatatgaaaagttattttgagcttcttgatactttacatgaacacatttgctctgcgttgagaggttcctcctgcttttttcacaggcagaaaaattatttgctttaatgaaaacccaccaaactgagtcaaatcccaaatagcttgcttgatatgttccttccaaaattatttgtttcatggggaaaaggatatctctaggacccattccttatagtccttcctgggttttaagcctccacatgcctgaaatcaagctcagggaactttttccccaaaccagtttctccaactattctcctaactcaatgccacagtaatccacccaatttgaacacttcaggataattattgattatttctcaccataacccataatgttcaactgtctctctgctttaattgattttatgttctaaagcaagcttgttcaactcgcagcccacaggctgcatgcagtccaggatggctttgaatgcagtccaacatgaatttgtaaactttcttaaaatataatgagattttttaatctgtgattttttttagcccatcagctgtcattaatgttagtgtattttatgtgtggcccaagacaattcttcttcttccagtgtggcccagggagaccaaaagattggacacccttgttctaaagaatacctgaaattgtcaccttgttgggcattcttactaccactagcttgattcatatctcatcaactctggcaacaccttccaaacttatctctctgcctacagtcccttcccagcttcatttttccccctcaaactaagtaacttgtaactacatacaactatatcaaaacctttgctggacacataaacactagagtctaaaagcccaagcttcttctcatgacacttagtctttcccatcttcaccaaacatcatatggattctcatctactgtcctctctcatgcaccccctactccaatcacagagaactgtgtattaacccctaaatacaatatgtattttataatttcctgtctctacaaatgtgcttgagtctcagattttaatggactattgcccagtttctccagctggtagacttatattcaatacccaaatttaaagttactacctcgagaaactctgtctttaaaaagctgtctccaaagcaagaatacccattattttcaaattacccacagcacatcttccatattctcattataacacttttcatagtggactgttattaactgattatgtgaataattctccaaagagactgagttctttaaaagaagggttcttgtcttattaatctttgtttaattagtgcttggaactatatctagcacatgatacaagacatatgatttctgagtgaatgaatgcatgaattaactgctataattattgcgctgtttttgttcaccaactggttctttgaaaacaatatatataaaacttaccaactgacaatgctgctgagtctgataacatggcacaccatgttaatgtcattttataatacagactttacatttagttttttataccttaatttatcttctataaatgtgcaataaaacttatttaataaaacattaaaaatcagggtttttaaaatgtggatatctatctttttgtctacagatagactgaatattaaaattttgatcatctgactttatccgttttagtattaacctaaaggttgcctttggaagagcaactggaatatttttttttttaattacagtgttagctggccatattttaatactgattgttattgaggctagatccttgctacctaaaacaacatctctacctctgctttgtcatttatacatttgcttttccattatgttacacacatttatcttagattatcatacatactttgtaagcagaatatgccttctttggttgttgaacacattattgcagagcctttcttttgtataacttattaattaaatcctgttcaatgacttgtttgtgattattttcataatttccatttcatacaaacttgacccatttgcctcttaaataagcttattgtactatgttgatgtcttcatttttttccacgtaataagatgttgataaaatataaggtcaggaagagaaatagccatgttaatgtgttcacaaagtattcactctaagtttgcttaaattatcatcaatcttttctttggcagctaagaaattcacttccatagagctttaattatctctctctctctctttttaattcttaatttttattattagcatgacttaaaaacacaaatcactatttgacaaatgtcttattacccatattagtttttgctatgtaaaggagattgaggataggcttgttatttatcccaactcagattctatggatgaaggcagggaggtgaagggatgaaatattaaaaataaattttaggaaaatcattctagaaatgtaggatcacattgaccttaaaggataaacaggaacttaaaaataatgacatcactaaagatagactagggtttaaaggactgagaaattcaattttgaatccttactaaattaagatctactcttgtgtccatatggaaggtacttatattctagaaaaagccaagtctaaaaacttttcatgaacccaagaaatacgaaacccaagtatagtgatgtggttagtattcttgatttttatttttgatttataatccttctctttataaaaacaccttgaagcttcacattataaaagccaaaaacctaatggaaaattaaaaaaaaaacaactcatttcagcacaggaggtagctagagtggcaaccatttactatgaaaattggcaattaaaaagaattaaacatcttctcctacacaaactgagcatcagagtcatctaaaatcttcgtctgtgaggaaaattttttcagaaaattttcatctgataaatgtagattaatgacagaattagaaaatcaccaaatggcaaattatgttgaaaaaatgttaaaaggcaacaatcatcaatagattgtaaaagatattatgtgaaaagactaatggggaaatttgtaatgtaagggtcaggctgacaaaacctgtaccaatgataaatttcaacatcactaaaattatgattaccagatatacatattttctgatttaatgtaatacaaattacatgcaccatctgtgaagtatccatgctaaagaagttgaatccaaatataatccaggctttatacttattttttagtttatagaaaatatgaagaatagaaaaacattttatacaccaaaagaaaacaattctataaggcaactgtcttagttttcaagagtcattggtatcattaaattttaaaaaaaggaaggacctattctagattaaagggaatttaaaagaaagcaccaccaccatgaaaggcaaaatgttgaccctgtttgggcccaaatttaaacaaaccaaccataaaatgacatttttgaaataataaggggaatttgacttatattcaaatgtattagataatagtaaagacaaattggtaactttctaggtgattatatagaaaatatctatttgtatggttatatacattagtattataaaatgtagtaattgatattagaactctaaaatattaaaataaaaacataaaaagaaagaagaagaacaagtttaagcaagtttgacaaaatgacgattatagaatctgagggtacattacatcgtatctactattgtattgacttctatatcacaaaagtctgagaatgtttatgataaaaaggttcaaaatacaaggtgaaatatttaaaacatatatattttaatgtttaactaatttgaacagaaagtatgggaaatcttgtgaagccaaaaataaatccagaggtggaactaaatactgaagccaccagcttcactggggacatctgccattcacaatcacctaaacagttaatctaaatgaccttataggaacaagagacttagcctagggctcacacaagttgaagagtcagaataaagattcctacagagagctgaaagcccaaatcctcattctatcactgaaagggcctactaggaaaatacctattccactggctatagactgaatgtttatgttcttctgcctccaaattcatatattgaagccgtaacactgactgtggctgtatttggagatggggcccctaagaaagtaattaggattaaatgaggtcataagggtagggctgtgatttattaggattagtgtccctaaaagaagagacatcagggggctggtttgctctttctcttgctctctgtctttccttctctggatgcactgcatacacacatcaaggaaaggtcatatgaggacacagtgagaaggcagccatatacaagccaagaaaaggttcctcaccagcaacctaatttgctggcaccttgatcttgaatttcccattctccagaattgtgagaaaataaatttctattatttaagccattcagtctgtaatatttagtcatagcagcctgagcagactaatataaccagaaaaaagatgatgaggatatttatcaatcttgggtctgacactcaatggggggaaaaatctcgcctgagaatttgtaatcacaacttggcccttttttaagatttggaactcaaattcacactgtgtgttctaaaaaccaccaatataagagttcaggccaggcgcggtggctcacacctgtaatctcagcagtttgggtggctgaggtgggcggattacgaggtcaagagatcaagtccatcctgcccaacatggtgaaaccctgtctgtactaaaaatacaaaaaatacaaaaaaaaaaaattagttgggcgtggtggcgcacactggtattcacagatactcaggaggctgaggaagaaaaaatcgtttgaacccgggagacggaagttgcagtgaaccaagatcgcgccacttcactccagcctggcaacagaggaagactccatctcaaaaacatctcaaaaacaaaaacaaaaacaaacataaacaaacaataacaaaaaaaaaaagagtgtaaagttgtccccaggtgtctggaagaaacaaatacacattatttcttttgaaactcaccttcaacccaagtctcaaagaattcccatagataaatacccagaagacataaactctaaataaatggggaaacaataaatccagccacaaaattttcaagaaagtgaatcatcatgattgagaatcagcaaaagaaaataacaaagtaaaaagctcaaacaattcaaagtgtaggataaataatatacaatatgttctaatatgttcaagacgtaaaggagaaaatgaaaggcataattaaggacaaaagactactaaaaacagagagctgatgtgaacaaagaaccaaataaaatttccagaaattaaaaaaaagtagctattgaaaatagcctttaaggaattaaacagcaggttagacacacctgaatagagcaccagggagtgaaaactagatctcaggaaatttctctggaagacaccacagaggataagaagatgagaaatgagatgaagttaagaaaagtggaggatggaacaaagtgattcaagatgtagaaacataggtagctcaaaaaaatacttttgagataattagaaaagaaatggtattattaaacaaatgcacacagagacaaggacaatacggtctgaggctcaggcactatttccctcttcatctgagtataaaccgtaacattattgaaagtatcttgccagtacacttttaatgagagtttcagtaatggaaaataggaaaagaggtattactaaaaaaaaaaacaagtttgctaagaattttctataacttaaatatacaagtccattgatttaggtagcacaataagccccaacagcatttatcataagaaatcaaacctagacttactatagtaaagctgcagaacaccaaacatacagaacagactttaaaatcaacccaaaaggaaaggtagattacctaaagtaacacaactaaatatggagtaagatggaatctataagagagtagagttacattttcaaggaacaccaaaaaaacaaaactagaattttgttgccatgaaaaaataagtatttcttcagaaaaaaagaataaaataaaaacatttttggacaaacaatgcacattttatgaccattactgaaatttcaaaatagatgctcatggaaacctgtaagtaataaaagaggaaaggttggagatactagaagaaacagaaagtacaattctgagtagcataagtgggagtcttgatctaattgacataaatccctactaatcagctagagaatgcactttcttttcaaatatacatggaacatttacaaaaatttaccctatactaggccatagttcaagcctcaacaaatgtcaaagagtctatgccatagaaacaatgttgttgaccacaaaataatgagaaatcaggaataaagaaatagctttgaaaacatatatatttttaaattttaaaagtccatttctaaataacacaggagttaaagaagaaaactaaacagcaataatactgaatattacaatatgtggaatgctgctaaaatgattgaaagaagaaaacttatagccttaagtatttacattagaaaaggaagaaaaagtatgaaaaccaataagcaaagtctccaaagtaagatgttagggggaaaaaaataaaagaaagttgggaagaagactgtaaaaaacagaacaaatatttcaaaagtagaaaataaatacaatagagaaaatcagcaaggcccaatttagtgttttcataacaaataaaattttaaaaattctggaaagatctctcaagaaaaagaagagtaccaggaacatcattttgcataattccaagagctacatttcatatcatatgctacataaatggtgtatttatgaatatattaatggactgtgatccatggaatctgattcatatagaataatacattgttaacagtgtcccttaaagttatgcgaaaggaaggaattggggaatgtaaaaataatattaggaatgaaaagggagacatatcaagataggtaacagaaaatttgaaacgataataagataatactttacaaagcttttctctaccaaatttgaaaattaaaaaaaatgacaaatttcctgacaatcataacttattaaactttgctcaagaataaagagaaaacctgaataatcatataaatattaaaacagtgaataaaaagttttaaaatattcttacaaggaaatactagacccagatagttttacagacaagttcttccatttaaccaagaggtgaaaaatttcacacttaaacatttctgtagaatgaggaaaagaggtacactcaccagttcaatttcagaatagtataatgtcaatactaaaattaggcaatctcattgtactcatagatgcaaaaacacttactaaattttaccatactaaatctagctatatacatgttcttcattttataatataaattcatcacaagcaagttgactttatttcagaatgtaaactgggtttaatattagaaaatgtattaataattcagttcattaatatgaagacaaatttatactttgtttcaatttagtagtgataaaatatgtaaaacatctaactgaatgacagctgatagaagttcaataaactatttcctcctccctcctaaaatgctaatgaaccagtgtatcattttctgtggttataaacaacgaactctgattaactaaatcagaaagagtctttatcagaaggaatgtgggaaagctttagataaaataaccagatatggaaaaagcagctgctgctagaatgattaaattccaactgaacttagattgtctatctgcctcctgtaagggggaagcatctgcctgaaggcataggtttcagcctctgggattccttcagcttctggagcatggggacacctgtctggatttacagtcatatcaaaattaccatcagtgggagacaggtgattcccaagaggaaaatggagtacaatgaggaaaagaaaaatgaatgttgggcagacagaaagacaataaatatccaccctaacatgtttggctagaagcagtcctgacatggaaggaaataaacaagctcccacaaatcagctttcctgctagaaatcagtttaaccctccctaatctagttcttcgtcactggattaatgtctacagtggtgccagttctttctcctcaaaccagtttttttttctcagtgtttagagaaataggtaaaaccaccagacagctgtcatcaaactagtaccttctttgtacagatgatcaaataggtatcaggccagtttctgctaatgggaacacctttccaactacctccccagtcttattccagcataaaatctttacttattgctgatgaaaaaaattacccaagattatactatcattttaaaattggactgaagtagaaaacaatcaagaggctcctgtcgaatgagacgttaaatgataaaatatgttggggctcctggcctttgtctactcattcaaggtagtgatcagttatccattgcaagcctatgccaggctgtagatgagagtatttgtctcagaagttttgttttatcataaccatttgtccttaaataccaatttggctttctataaggaatttagcacatttacagaaatctcagtgctctttagttatggcatcattaaaaattaaaactcatatatcacctgaaagaagtctactggctttaaatacacaaaaaatactcaatctctctcctaccactaatgctatataattgataccatattagttgcacctcctctccagtctaggcgacagagcgagactccgtcacaaaaaaaaaaaagttcccatatccagatgctactctactgcttgaattcagtcttccatatgactctaggactatagatagcatctcatttatttcccttcctctcatcttaacctccttccatctgtcctccacattgctgccagaatagcatttgtaccatgaaactctgaccatggtgcttcctgcctggtattcatccatttttcccttggcttttggcatactccttaattcacaaaagaaggccctttgtgatctgaccccgacttaccttctcaatactctttcacttgtctacatttcagcaaagctgttgtcttagcatggttcattttcctattatctactcataaatatcatgtgttagcacggcgtccattcccccgagaagattttctggattatatggttaggttttcttcagctctgacacaccccaagctaagatgacgcctaatatttatttctctgttccctgctgtccatgcatttacctagtaccttctccttgagttgaagtggtgattggcatctaaataatataatatagcaaaggtgatgggatgtcaccctctttattaggttacattaaatggcaaaaaagatgggatatcatgcccatgattaccttacattatataagacacacttcttagaagattggagagagactctcatgttggccttaaagaagcaacagccatgttgtgaactgcctatggagagggctgcatggcagggtactgtgggcagactctagtagctaaggcatcttccagccaacagccaataagaagctgaggctctcagccatacccccacaaggaaatacattctgttaacaatccaagtaagctggaattagatctgtccttggcttagcctcttgtaagactgcagccctggattccagccagtgagacaatgaagcagagagtcctgctatgctgtgcttgggcttgaccaaaggaaactgtgaaataataaacatggtttgtttcaagggactgttcgtggaaatgtgttacgcagcatagaaaatgaatgcattaacagcccaagatgcttttcattgggctcctactgcacttttcacatacctccatcaagcagctgaaacttttatactcaaataaattgtttcccaacagataaaaaatttcaagagcagttactgtgtctttttttctagcatctagtataggaagctctcgatgacgctttttttttttttgcaatgagaaaataatttttaaaaagaacaaaagtaaatgtggaaagctggaagtgtatttattgaaagcattttatcattgaacatagagctatttcaacgttaataatctataagcctacatcttaaaaatttaaatataggaaaaccaaacagggctattatttaatgagggcctattatatacttggtgctgaactaataaatatggaaaatgcaactttaaaagactcttacataatttctcatggttcatatggaaaaatttgagctttatccaagcaacattagttaaatgtataaatcttcaaataaatgttgtcgaagatagttgggatagtaagctttgcaaaattaagctgccctagagatgtttaagctcacacttcagtccctcctattagaatgataataaaaggaattcaaatactgaactgcgtaacctttgaggtcccttttagttcaaagatttcatgatccttaaaactgcaatttggaaaacattattttgtggcaggctaatgaattatagccaatgacatgataactatattaaatatatatatattagaaagataactccgaaatgcattctcacgaaccctacatattcctttaaataaagtatctgcccaaaaaacctaagacatgttgttccagtaaaactggaactgggtgctgattttcctctatatgtgctgcaatgactccagaagccacaaggtggcagagtgttggtactgtgtttctaattcacaagacttcacaacaggagttcatgatacattcaaaggcaactttaactgagattttgaattcttccatctgtttccatgtgccaggtgcaggggttggatggagaaactgagatgtatatttggaggctcttgaaaaaggagatgacaagatataaaatcatgtgtatttaaagaaaaactctttgttggcataactcccaatttgcctctgacctcaaaattatcacagctcaacctgatcactgacttctccaatcatttctgtaacatttacccttccacacttaaactggtacaaattcgcgaatctaacactcccatttagatctctaaatcatctaaagcagtaaaatttttttaatctctttaaagagttttaaaaaaaatcaaagaggcatactcttgtctttatttccatacattgctacaagtcacagccccaaatgaatattatttcagttctatgaacagggtaaagaacttgttctcatgctttgacctcaggctttagagatttctaatatgtaacatacttccattaaactcattcatcttcctctgaaatgtagttttctccagagctcatgatctctttgatagtatttgaattgaaacatactacaaggttatttttctttccacagatatttagagtactgtcacatcataatcagccaaataaatagtatgcataaggtggtgcctcctttggggaattattaatagtagattccaattctagagaaccaggaccctgttgtagtaaacattgtatctccagggcctggaatagtgcctagctcataatagacatttgagtgatactgatcaaataatcaacctaacctgcctacttattaaactgaaaagattgtatataccttgagtccaatgggagcctacaattaagacttgcaaatagtaattgctcgataaatcttaaatgaacaataaagagacctgtatgcacgcataattttgtgtttcctatttagaagggaaattgctatagaagctcaatcaatcaagacacagttatttgttactactgaataacattttaattctgtaagttacctcaaaggtaaccaatgcgtacccctaaggagttaactgtggaggagacaaatcacaagaggtaataagcgaaggactcagaatagcacgtttctttaaccaatttagggattttttacatctatttttattacttttaaagtaatgcatgtgaatatatgtatttgtatttccatgcaagctgtctagaaaagcttagactctcccagcccagccaatttttttaactcttaacactcctctgggaattgtccttactttattttttagggtgtctctttacccttatatgagtatacctctaattttttatttgtcaactttagtatctattgatttctatacatgaaaaatgaagatttagttactcacactactctcctactatatccttttggtatgtttgatatttataatattatttgagtcctgttaactctgtaactaatttcttaaaaatctctctcttatttcaatatttgacagtcttcctcaactccacaatctgtaaaatgtcaatattagtcatcattcttccttccacatcccctcttctgtcagctaaatatttacttctataattttaagattgttgatatttatattttgtcatacaaccataacaatattttctacattttgttacacaatattgctaaaagttgaaaatcaataaatggccatcatattataattgttttgtaaatactgttagtgccaggtcaggtaatatgttgatgcatttttttctttgcaaatccaatgtcacgaaccttggatcactcatgagagaatgtttctcacatcgaggtcaaatagatttttttccttcacaaaccatgcattttaaaatgcatcaaaatttgttttatatttgtatcgtcttgcatagtttgctttgtaggcctgaaaaatatagtacttcaccagccttcctagagtttttcctacgctatttgcctttattgcctttattgtcatatttttagttatttacagactcttgattatatcatttattctgtgaagtcactgcttttgtaagcttcctttagaagattctgaacctcttttatttaaattgattactctccaggccatttgtactcatgtcgttttggaactccccaccacctcttccttgctcttctgagtaagaagtggtggaagcagttgagtcccaggtcatcccccatcaccacactggggcagcgtccccaggcttccagtagctcccaggtgggcgctagagtccatgcatttacctagtaccttccccttgagttgaagtggtgattgacatctaaataatataatacagcaaaggtgatggatgtcaccctttttattaggttacattaaagttgtacataaattacctctctcctggaatagttctcatttgtacccaaaagtataaaatttttaagaaattggttatatagaatttataattataatcattataattattaagaaattagttatacagaaaaatattacaatctcctcacaaaaaaataaatagccaactatggtcagtgttcagctttgttgcctagcccctgaggcatctttaatatagaaacatgtctaaacataactgctcaatagtaggccttttgctaggtgtggttgggcatgcaaaagctaaatgagagacaatactcctgttccaagaagtgtacagtacccaaatgccacaaagatcaaatgttagagttacatttatcaatctaactttatcaacataatttgtatgttatattatggctttatatctataatatccctttgccttacgtatacttcaagtatcttttcaggtttactcagaagaccacgggatatggattacctgaaagtaaataaagctacaaaaacagttcttcagatttttctacttctacattctgatgaagtgtcaatgttatgagaagggctggctaatatctatgactggaaccttgttgccttgtcaaagaccatgcacatactctccaaagccaattgtagggagggaaaactttagtgtggagatgatttcttccagcaaaaatgtctcatgtgtttcttagagttaatgctcccccttttctatcagttttctatcttcttgttgttctacactgcaccattataggtgcaaccatacactggggacgtataataacaaacagcctcactgacaaacatatattcgacttatcctacagatacacagaattccaataataacagcagagaagttattactggagggaagtaccataagtagagggcggatggccgtgtcattaattaccaagaggctacagatcctattgcgtgatctaaactaaatctttcatattgtcaatctcaaagaatctatcaaaaaaaaacccacatctattccatctctaataattttccaaattgcctacagggggaaaattaaaagggtggtctaataacaagaacctcccactagtctttggtttgccattttttattgtgtatgttttgtgatgatgtaatgaggtgggctggatgggctgttttctggaattgggtagtagaaaagagggcagctatttcattttaatttatagattcctaatttattcaaatttcacaaatttaaacattttagattacaattatttcagtaccctgtgtttctagaaatgtcatgttttagagaagcccatctctggctacgagatgaagcagcaaatgggagaaaacctcaaaagagaggagcatgtgataaatgtgataaaaaaggaaacgaggaagaagagaataaagaagaaaaagtggatgtcaggaattggaagtagaaacatgcagaagccatttatctctgctactaaagaaataattatttataatcataaaaaatcatgtaactcttgctctgcttaaatttgtattcctttgttcactgactacattgaaattcttggatgtcactctgagactctcagagtatccagttttctccctgaatatttagcttagagattgagtttgctttcctccactaaaggatatactttaatttgcaggctttcatatagactgggttgttgcttctaaaagcctttatgtcaactccctgcattttattttctgcaaagtattagagagcaccatatctatagctaatctctacagctaatgttgctaggaggattaatttgaaaagaactcgctaacatttctgaggtttcctcagcaaagtccaatataaagggtatttcattgtatttattatgttgttgtattacttaaagtttgtaaccagagtaaatgagatttccagacttgggtactttgcacagccttgtaaagtacatataaatgtgaaattactagtgatcaagggaagaggggaggactctgatgtttttaaacttctgttcttcagttaaaactccataaaaacctgtcccaagtcaataccaaaatgctgaattcagatatttttgtacctgtaatataaataaaaatatattacatggtatatattgttttgtattaattgtatgcttaattttctttttgggccttaacaataattttgtttacactggaataaaattgaaataaatttagagttgatttatattcatagcctttgcatttgaagcatgacaatatcttgttttcattttattgcttcaaagtttccaagacaactggatttatcctccagaataatttcacacttttttatttaaatcaattaaatcaatgtgaaacataaccaagattatattaatatttgtctcttttgaactggtaagcatctagcctttgtcaacagaaataaaattctatttcataattcctacagtaagaaatgcagctagctctggcaggaacatcaaactcaactcatgaacatttttaaacacttcagattatctatgggcttacttcaaattcatgaggtaacaatatgcaaataattatctcttggaatgtgatggttcaaaaatgctaacaacagttattccaacttgattatgacttagcagtatcatttaggtatatatgttcaatatgaatattcagtttgatacactgtttttaatattgccttaagtggtataatcatctttggatgccatatgtactattgcataatccatcccagttacaaaggaatgcttccctaaatgttttaccaaaaattttatgagctacttttctacagcctttacatccaattctctaattaatcaacactctaagaagattaaaccttaaaactaagctgtgaaacaaaaatatcaaggaatactacggtaacataacttagtgaattatgagttcccctgataatagagtccactggtaattatttattaaatgtcaactgcacaaaaggcactattttgttgtaggaaggggctataaaatgtaatgactaccaccatttgttgagtaccgactccatgccagacactttactgtactatcttcttttatatgttagtgtggttaggcttgaatgccaggttagaaaaatctagagttaatcctgtaaactgttggcaacctttaaagggtttgtaggggagaggtcaggaaaaactgtatgagtttcgaatggcaaggagaccgcaggtggtaaacaggaatgacctaaacctgagcagcatctatggaatgtgaagcctgggcccaaagggggagcacttggataaattatagagtctggtgatcacctggtcttagaggctgtgagaaagagaagttaaagctaaaattccactgtggggaatttatttcataaatacatttgtgcacatatgaagtagtgggtttgtattagtcagaaaacaataggtgataccatggtaaccataaaatctcagcggcttaccatgtggacagtttatctgtcactcatagaagtcagatgctggtgcggcagcagggcagcagcgctccttcctcttgtaatgataccatctgaaaggtgatttctaaggggtctggcaggtggagagaatgttggagagttgcagacaacagttttaagagtcaggcctgaaactgcttatgctaattctcttcctatctcattgattaactgagacacgtgtccccatcctacctacacacaaggttgaaagttgagggatacacctatattcagtgaatgttaatgtcactaggtttagttgtaagaggacattattagaaacccaaatactcatcagtaggaaactacttaataagttatgctacattcatacagggaaagctctaaaaacaagtgctgatatgggaagatcttgacgatatattattaagtgacaaaaaattaaaatgcagacaagtatgtacgttatcctttatataaaaaatatgaaatatttgattggatgataaagaatgtctgaaaggatacataagaaaccaatgacaatgtttactcatttggggaagaggttggatgaggtagaccatcctttgagacagcttagttctatttttaccaataacccaacccaaacaaatggttttgatatttcatctttccaacaaccagtctttatattacatttcaatattaagtatcaaacaatcgatattttaccataacctaatgaacaatgaattcaagcataactgaaagttaatgaactccaagacaagacaagggtggcatgctagtagagatgtgaatttgtctgaatacttcctgagcatttaatagtatcactacagctgattgtattccgagacttcttaatggaaagcaaacaaaactagatgctgattattttccctcgaattgtttcttcctaaaaaccaaatttaaatttagcttgggattttctgttaatgttaaaaaaaaaaaaaagccaaagcagctgtttgcagtttagtatgctagaatttggctcacagtggattttaaattttgccagctaagggggtacaaagagaaccataagtgccaccagcgttagttttccattccatgggaatctgagtgggtcactggaaatgaagaaacagcttcacttatccagtcatcctctctgaatctcagctttcttatctatacaatagggatttggtatctacctaatggagtctttgtgaagaatcaattatgacacaatgtatctgtcacagatttgtacactagtaagtgctaaatatgactttttccagggaagctttcctttacaccttaaatgagacctggatctcctgttcttttgctcccattgtgcccctgtacttcttcttccaatacttagttgttcgctttttgttttccccgctagcgtgcagagcctcgcacactactatgttctaaatgcctactacaaagccagagacgtagtgcaatatttcagttttgaattaaactgatgattgcaaacattctccatccctctctttgattcatactctattcacaaggtcagcattaaatactagaacccctcaaagcaaaaatgacatccatgacattcatatgccaatggtcttagaggtgtaggttagtatttgtcttgtaggttggccatattatattttactgatcatacttacgatgttcaaggaatgtgattttcactgaggtcaaatccattttggtctattcttgtaataataaagtatttgcaagcatgtattgaacacttactatgtatcagacgttgtttttggcagtttacatgtaattcttgcaacaactccattgggtagattctattattgttctcattttacagagaagaaaatagagacaggtaaaatatcttaggtaaaacatcttgtccaagtttttgtagttacacctttgaaattataacgtttacttatcaaattctaaacttagttactatagacagagctaggattctaatttgggcagtttgggttcaggagccatgttcttcacccttcggctgggcttctttgtaatgataaacttttttaacatagcataaatatagttgaaaatatataatagaattgcctattaaatttgcttcaaaatgaacattttaaaaaaagtatggatgcaaataaaaagacattggtactcatgcatttctggtggcataaggtgacattaaatttttggtaaataacttaataacgtgtgagctataatgtgtattcactaagaaaatggcctagaaatcagacgggatcgcctttgaatcactgtagttaaggaggctaaatatataaatatctttcaccattgatctccattctgagcatttactttaaagaaataacacaaaacatgaagaaaaacttgtatagcaaagatgcatatggtatcatttatttatatataaacttatcttttggaaacattcttattagaagatatatgtatataaaacatatatagaagagtatataaaatatgtgcagtttaaaaagtagttatgaagtatcactctaaatcctttctgtctgtctacagctaagcactactctaacttttgtaatagttatgttcttgtttttctttatagattttgccatccttcattctttgacaatatagtacagtttacctattttgaactatatagaaacagaatcacacaaaatgtgacttgcctatttctcttaccattacattgtgagatgcagctatctagttttgtgtagcagtagtttcaataatgtttaatacaggaagctacatatttggctttctagctaccttatttttgctcttaatttgcccaaactgttttgtgtttatttttttctttcttttagatgactttttaaaattatatagtttatttttgtttccctttttaaaagtggtcacccttgaaattataacgtttacttatcaaattctaaacttagtcaattttactctcctacttcttattaatgtatacacatcattaatacattattgtcatcatatttttactctgttcaattttttttgttgtttgtttagacagagtctcactttgtcactcaggctggagtgcagaggcgtgatcttggctaactgcaacctccacctcctgggttcaagcaattctcctgcctcagcctcccgagtagctgtgattacaggcatgcatcaacacgcccagctatttttagtagagacagggtttcactatgttggccaggctggtctcgaactcctgatctcaagcgatccacccgcctcagcctcccaaagtgctgggattataggcatgagccactgcacctggtctcaattttttaaccacacaaagcaatgtttttcttttataaaatatatgttcatttagattaattcagatacatggcactctaggatcactttccttctgcctatggggcatttttttagaacattctttagagaagttctgctggtgccaaagtctttcagtttttttttttttccctgaaaatatctttatttagccttcatttttaaagacaaaagttatagcatgacagttattttctcaatatatattgagatatacactgccctctctgcatccctccctctcagccaccttaccactcttctattaagatggctctttctcattttcaccatgctatgtctgggtgcagacttttaaaaaaatctgtttacaattcttgtttctccttgaatctctgtatttgcgcattttatcaattctagaaacctcttgcctacttactttttcttttttttattttattgagatggagtcttgctctgtcacccaggctggagtgcaatggcgtgatctcagctacctctgcctcctgggttcaagcgattctcctgcctcagcctcctaagtagctgggattacaggtgtgcaccagcacgcccagctaatttttgtattttcagtagagatggggtttcacccagttggttaggctggtctcaaactcctgacctcgtgatccatccactttggcctcccaaagtgctgagattacaggcgtgagtcacagcacctagcccttctcttttcaaatgttgcctctgccacatgctgtttatcccctccttctgtaatgcctgttggatactcaccagtcctcacctagctcaatgtcctctcacttctcatatttcccatctttttgcctctgtgaattctggataaattttctggactagttgattcattgtttcttcagctttgactaatttgctgttacacttctcaacttgtttttaatttcaatttgtttattttattaaagttctctttatttttttttcaagtcagctgggcggtttttacaatttcctgtactgtttattcaagttcgtctttaattattttaaacaataagtattttataatccatatcccacaattccaatatgaagtctttgtgggttgatttcaaagcttaaattcatttggttgcaaatgctgtcagggcagaaggggccttagtgcgacaccaaccctctggaatcctgtcttcacttaggtttctttcttcttttgcttttttcctttttggagacagggtctcattctgtcacccaggctggagtgcagtgttgtgatctcggctcactgcagtcttgacttccaaagcttaaacaatcctcccacctccagcctcttgagtagctgggactacagatgcacaccaccacacctttctaatttttgtatgttttctaaaggcagggttttgccatgttgcccaggctagaggtttctgcctgacaatgcttaactatcttgttagttgtctggtactttgaaggaattaattttttagttaactagatttaatcattccgcagtgtatatgtacctcaaaataccatgttgtacatgataaaagcatacaatgttgtcaatttcaaataaataaataaaagttttgttcgtttaaaaatatattgtatccaacatttgtagttgtagtcaaagggatggttggtccaagaaacatagtccactatttgtcagaaacagaagtccttgttttgaaaggtttaataattcagctgcccaagggcaatgggctaaactaatctttcacatattttcccctattatgtttatagaaacattacgaggcatcaaacaataagaagtctaataaaaggtagcctgctcttagattttgacctggaaattaggagttttgagtgttcttttaggccactgacattctactatgtgatgttagaacttatttacttattgcttttcccatttgtaatttaaaatttaaaaaaatcctttacttatagctccacttttcccataaatcaaatctcagctaaatgaagagtttccaggaaggactttgaagctactctatatattcaaagtactgtactaggtttatacgggctacatagttttatagttaattttcattgcaaaaatgagagacgttaccagcaaaagtccttaaccatatcttcagaggaagttttcataaaagatactttaaaaaaaaatatatggtgcaattgtttttgtttttgtttttccataagaaacatcatgtaccagacagcacaacataattttcttttgtttcgtgcatgggcactgaatgagaacccttctactcaattgtgacaaattcattcaagctcaagcctcaatcttttagatgttttgcaagtgtctgtgatttatgtgcatacgtcaaagagaaagcacacttcacagaaattagggacagaaaaacttcactaagctctcctgcctaagaggtacaactaggcctctttcctggtgcagatgagatgagagacttggtgaaaacaagctttcttgtgagtcatccttaataccattgggaaaataggcatcgcattccagtggactgggcagctaacaaccctcacccccacaaaatggaaaatctgtaaagttcttttgattcccacaaccagagatattcctcttctcattcaactcttttattttgtgacggtgcaacatcttttctgagaatagcttaaggtttgggacccaaaggtcctaaatttaagggggtggaaaaggtttaatagtaaatgtcacgtgcatgaatgtcctttatcctgtatttattcataaaataataatagttatcatttattgaatactccctatgcagtatgcattatctcacttctatcattacagtgtctttcctgttaagtaccttgattcttaacgaatgaatgaaaaaatttaaagataaggaaaacaggaaaaagacctcaaggaggataaatggctagcaagagtaaagggaaatttgaactaagactgatacgactacaaagcccttgcttccaagtattatacactctgcctctctttaaacttcttaagggagaaattttttaaaaatcagaaaaaggaaatgggaattatactgactaatacaattatcacttcattctaaattataaacttctatctgagacaatgctatgtgctcaccaaattgttttattgtcttcctggacccacagatgatgaattctcttagccttgtttgcagttattttggcaccattcattgcgttccggccaatggaatgccagtagagatgacgcgggccatgtccaggcctcctcatgaaaccacttgtgcaattctccatgctctctctctattttttggcaatcttagaagtcaactgatgaaagtggtagtgacaaaaatggaaggagcagaggtttctgcatgactatgtggtcaacagccctatcgccaactcagttgaacattgacgtgagagctataagtctttattgcactgtcactgatgtttgttgtgttaccacagttagcttgcatcacctcacatactgctttttaaccatgagaaagtacattcataaaagccactaatgtcatgctgacatttccagtttcttctctacttttaaggattcaagcttattcctagattgtgtaagttgtaataactactggtctagtttaggagaaaaggcttttgtcagtctgtggaaattaacaatattttcatcaggaacacatgaaccataatttgttttgatgcaaaaatcaattatacatgaactctttcttcataatgctttatttttataatagtggattctgtctaaggacagattggactgtgggaatctaagtgatactgttatttaaagcagcttagttctgaaaggcttccttgtacttttgctacaattcttttaacaagttgatatacagcgctttggcaacatataacaatattcgaaaaacaaatatgattgtgacaagatgactgtaatggattcatcagatcacctgcagagggagtgctggccaagtgttatgtctgaaagctcttaaaaagggagtgtgtggacagcatcagaggtagtgcaagaacaaggaggaaaccagaaagcaaaattgtcaagaaacaggagaaagagaagacgatattagtagtactataaagaataaagtagagctcatactggtatctaaggttttggaagtaatcatcaaaattaatggtgaccaggaaggcagaaaggactactgttcttcatccacttgtaccctgaaaactgggtaccttataagaatgagtattttttaagacccacatctcagccttaatataggatttgcaataaatgcatttgcaatattcatttccttattaaaacctctgttcatgttaagaaggtgttaaacaatccagtagtgtaggtgatatccccaagtattttagatggacagcaaaggtaaataaaccaaaataaaccacacactccagtgtgaaacaaaataaaccattcagtgaaaaaaagagttggtgatgggtttacacaattcttactgtgtaaaataaactatcatatgatctgtgttgtaacatcagttgcagtattctggctcagcccaatttatgaagcacaagatgtattctatacccggaattactgtggactcaaaacactctcagtaaaggagcagcttaaagagcagattttaattttctatttgggcttcgactgtgaattcattttcagaactctatgacactttctcagttatagctttatattttcactttttagtatgcatagtatatataagaaaattttagggttggtgttcaaaaaatgaaggaatcattaacaattaattatcttaattgtgtctttcatgaggtacacacatctcttagtctaaacaaatatcagaaacttcttaagacagatcatcatacaaaaatagggactgaaaatgccgggaatgcctttccctctgtatcctcttcactaccctgctagtgttccttcttctatatgtcacctttaaccctcctgagaagctatctctggcctcttcaggggtctcctttttaatctcatagccctttgtagacactttcattcacagtgtctcaaattgcattatatgcttgtttctctcctcctccactaaatggtggactcctacaggataggagccatgatggcactaaaaaatatttatttattcatttatttatgtgagaaagagtctcgctctgtcacccaggctggagtgcagtggtgtgatcttggctcactgcaacctctgcctcctgagttcaagcgattatcctgcctcagcctcacgagtagctgggactaccaccacatctggctaatttttgtattttttagtagagatggggtttcactgggttggccaggctagtctcaaaccccttacctcgggttatccacccatctcagcctcccaaagtattgggattacaggtgtgagccactgtgcctgacccatgatagcattttgacactcattaaaagtttgctccatgaacataagacattggactatttttgtttgtttgttttttggttctacaaaaatccaaggggcttgcctatgcttgaatttgggtctgatcgataaacccaaaacctttgttcagcacgtctggcccactacgtttggctgtacgtatgtctactgatgctacctaacctgtttgtcaatatatcgactgctagaaatattttgttccttgcctgtgaaggcaagtctgatttcttcaactatggtagatcctcaacagctcagttaatacatgtttgaaaattctgctgtgtttacctactggggggacactaaaacaaatacggcatctttcccacactcaaggagcttataaatggcttgggaaggcaggaaatttaaatgtaaaaatataagcccccagttaggagagtaagattatgaccaataattttaggtttgtctagtgctttataatttcaaaagagcattcatatgtatattctcattcagtattaactatcccttgatatattacatctacccaaagtaggcatatttcataaagtaaacatgttatttatcggctaaataagttaggtgtcattcctgtcttacaaaagaagaaacagaggtgcattaagattaactagaccatatagctcactggtgaagtaaacctaagactggaagtaaagactgctggctcaaatctagttctcttttcactttgtcaatttcctgctcattttagggcttcaatgctaatttgtttgtctctccaacacgtcttcttaggctcctatgcccactctaacaggaaaaccctccttaccaaattctttattgacagttatccaaacgcttaaatatcacaattgctttatcaccaaaagtgcagaccagaattggaaactaagtttccttttctcaaatgatacctcaccctttccctttcttgttcaaattattggtttccattagcacacagtaaaaaaaaatacagactagacagcagatttagacattgctttttttgtatgtttaaggatttttccctaatattttgattatagttgtgtatttttttctaaataacagatattagtctgagtatcaagactatagaattctcattctgaattactaactttccctctaccctgtctactgcaataacatcagcagcatcatcgtcatcatcaccatcaccaacttcctcctcctcctcctcctccccctttctgccaacatagttaacattcattgagcacataacatgtatcaaacacatggttgattccttcatttaatcttcataatagccctatcgggttagtatttctgtttcattttatggttgagaaaactgaactctggagagattaaacagctttcctagtgtcagacagcaggcaagttatttatcaggtaaaactgcaaagacctgcatagaccagcttcccccatagaagatgcatagtatattaaagaagactgtaagttcttcaagggcagaaccttgcagactctcttaccacatgccctcaaaaccccctgtacttttcctgcatggaaaagtattattatacacttttcacaacttattatacttatttttgtaatcatttgtttaatgtctttcctccacccccaacccctggactgtctcttcaatgcggacaagggctgtttctatattgcttacttctgtttgcccaggggttagcagagtgcctaacgtggtaggcactctataaatacccattaaataaataactctcctttggccctattgtcaaagcagcttcattgaggatttctttagtacatttaattaatattttagtactcaatgtaaatatctatggagctcacttctggcagaagacaaaagtacactggacccagcaaaagagttattctgggtggtgaccctaaataactttactacactctagctacagatacacttttgaagagaactgagtcatctttttagcagcgatgtcatcttggctcaccgaaagctccgcctcctggcttcatgccattctcttgcctcagcctcccgagtagctgggactacaggcgcctgccaccacaccaggctaattgtatttttagtagagacagggtttcacgtcactttttagcatattttatttgcacgtttgacatgtttgaagcagatgaacttccataaagtatagaaactgatatgaatttcaagaacataaattgtacttttctaaggagtaacctatacattttgaaaattatgtttttaatgtcaaaaatgaaatgcagccttgttttttctcagttcattggagttttcagataagccatgcctctctctaatccaatggcttaatcaaaaattaaatacctgaaaatgttttccatcaagagaaattttgaaactgtaggaaagaaggaataatgaaagaaaagctttatgtaggcagaataactaagaggcattatgttagcctaaccagtaggctagtattttaagaggaataaaatgtatctatattatttatccctctcaatcctctaccacagtgagggcagttattgttaaagaacaagttcaaggtcattgaatggttaagatctggagtcaagatttgtctctaggtttgatgggaaatttaaggctgattgatattaagtggcaacatagattatattgctgataaataacagagataaattcaaattttgctctttgtggtacaaatccagggctttttccactactggcactgcctttccattcacatcatttcatgattagtccttcatgtcaaaaaaaaaaaatgtaaaaaggttggcaataaaaaaaaattaactcggccaggtgcggggctcacgcctgtaattttacccagcactttgagaggccgaggcgggcggaccacgagctcaggagataaagaccaccccggctcacacggtgaaaccccgtctctactaaaaatacaagaaattagcccagtgaggtggcgggcgcctgtagtctcagctactcgggaggctgaggcaggagaatggcgtgaagccgggaggcggagcttgcagtgagccaaggtcgtgccactgcactccagcctgggcgacagagcgaaactccgtctcaaaaaaaaaaaaaaaaaaaattaactcagaattcattatgtatcttacatgttgtattaatagcataagctttatataacagaaaaggaagaattccattcccccactccaattctctctctctctctctctggctagaggatggagtggtataaagtgttctcagactgtgtttttttttaatatctgatatttcaccattctcaagttcatttccagaagatatcctctatcagtaggaacagatggttcagttgattgctaatagaacatggagataattgttagtaggttaacatttaaaatacagtccatttgggagtcactcaaaaactgctgtggtagtgacaaagctattcatggcatgtaggcaagatatcatgtggttatcactctgtattccagagcaccaaattcataccctgcctcaaagatttgtaccaaagaccaaataaaatgaagtattgacaatgctgtgaagtctttaaacggtccccagtttccctgacagccaatcaattgccattactgtttattttatctccatgtcttttgtatcctttacattcccactgccaccaccctcattcaagccatgattggctccagccaaatcttttgtgctagactaccaactgttctcattccctccaacctctattattttctatcactgttatatgttccttcctgattaacctccctaaaaaaaacagctataagcatgcacttgtgggctcaaaatccttcaatgacgcctactagcttacccaataaaattcacatagttaaatgtccaaactcttcaactctaacttctactcttcaatctatttctcactcatttgattcgggtgtctgtcccatactttagccagaattattgacttgctgtttcccatacatcacctttgctttcacatctccctgacctcctaaatattggtcttctgttgaaaataaccttgataactcacagttcctattcctgcatactggaatcctaccttcttttcaaagccaagtccaaagccacctcttccattcatccttttccaacatttttaacagaagataatccctcttctgcatttttatctaatatttttatatcactcttatcctttcttttttcactccatctacttttgccatactccaatccagtctccaaatttcaaattgtattattgctttaccgtgtttataagccttattgacttcccactgctctgaggaagagcaaaaaccttgatgtctatccttgctggcctatagtattctacatgatatatcttggtatgccgctctcatctaacattctccttgctgctctcatcttctcatgtattcatcttttaataagacatgtccttttttgtcttagggcctttatacatgctgtttcctctgtctagacacctccttcccatctccaccttttcctacctagttcatttctactcagccttcaaaactcgactcaaatactacctctttgagaaggctttcctcaatccctagacaaagttagcaccctcacctaccttttcattgcagtacgtgccacagtcatatgtttgttttctcaactagtatggaaggatggaaactctgtttgtcttatttcctattggacccacattgcctaacacagtgcctacacctatagtagctattaggtaaatacgtgtctagtaatttaaatataagtagaatatatactagatatctatgtacaggatgattgaaagttttgtgtttgtcttatttcctatctttctcaccatgctgtaaactccctgatttacttttgtacctgaaacaactcaaccagctataattaatatgtgcaaaggaaatatgtgttgaacaacagaaaaatgaaggaaggaaagaatgtagaaataaacagactagtaaaatgcaaggtaatagtctaacttttcatataatttccaaatcctcatgccttttaggatattttaacatttctagataggaaaaataacctaatgtcacttactttttatagaccaatagcctagtgtttattgactgttgatgtttattgagggacaaaggaaggaaggaaacaaacactattataatagggaaaagggacaatgttgatatgtaacacccaggttcaaaggaaatgaatatcctctttattcttgtaataaggaagaggggggagaataattcataaatagggacaggcaaaggacaaaatgaatgaaaacagtccttgcaggaaaaaagaaacaattgtttcaatatctttcaattacaaaaagagatcaaaatatttatctgttttatgttagcaattttcaatttagtaatacaaggactgccttgcagctgtagtattctttccacagccaaccttagtatctccatccttatttcctttcctcaatgtcaatgagcccctggaagaccaagcaccatacattcacatactctttacttcctattatctctgcctgacatgctctatgtcttgggcaagtcacttctgtcttccgtaccatgaaggagacatagtcttgtgtctacaattcctttcatgtagaatattgtatgattggaagtcttgccttcctataagttttggtccatgactgctggtgctttgatttcatacattccatatttaatatctaacctattgaaagccagaaatgttcaaagtgcaaggcattaaaggataaaacaatgatcttaaagacaaaatctttgcccctcagaggtacattctagtggaaagagacagacaataaaaagatgaatgaaatatgtgaaataatagagactagaaagtactaagggggaaaaaaagctaaagaaggggactaggaatgtggtgggaatgttactgaacaagtacgcaggaaggcctcactaagaaggtgatatataaaaactcaattcacaattttctagttgtctgcccttgtctcctgtgaattgcttgtaacttagttcagttacatatttgaggatcccttacttctttgccttaaatctaactgtctctgctcatctctatcgccataaccttggttccatctctgccatctcttgccaagatcatgagcaatagcccccttcttggtcacagttttgttattcactctatactcccatcttcccttcttttctgccaagagtcattttctttacaagcaactctagtgctacctgaagtctgaaaactccccatttattttgtccattgatctctgaaaactccccctactgccctagctgtcaccacacttaacccctgattacctgaatatgcccattccttaacttcatacctacccacaaacacaggtctctcttctctgtctgcccttgccctgcctatctacccagcaaactaatacctgacctttttttgttgttgtttttcttgtttttgtttgtttgttcatttgtttgagacagggtctccttctgttggccaggctggagtgcagtggcataaacagggctcactgcagccttgacctcctgggctcaaatggtcctcttgcatcagcctgccaagtacctgcaagtacaggtgtacaccaccatacgatgttaatttttgtattttgtgtattttatttcactttgtttgtagagatggggtttcaccatattggccaggctggttttgaactcttgggctaaaggaatccactcaccttggcttcccaaagtgctgggattacaggcatgagccaccacatccaacctaccttccttttaaggctgttcaaagaattcctcttggcctgcctttttcaattctggagggagcagaattcttgctcctccattctctctgtatttttcacatacctctctgccacatttattccgttgtattgtgattatcaatttccctgtttttcaatatccttccagagtacattccttattcattcatactttgaacttggtaaaccctcaatgaaatggacagggacagagagaaagagaagaggtggaaggtgagagagggaaaaggagactgtcagtcagttttcaaagatgggcagctcacagataggagaaatcattgcttcctaaaagctgtgaattagaagaaaccttaaagtggcccaaattctaaaactttaggcctcatcattaacctattattcaagccctgaccttttgtcccagttatcataactgggcttccgcacctcagtccccacctggtgccccagttctgataactcaccttctgtcttgctcttctctgcctgaatctctcttttggagacatgcctaatatgtcaggctccccaaacctggaagtctgtctcgcttttgtttcccccacccctcccatttctccctttttaatctctgccccgcctatgaacccaggcaggtggccagggccctgctaatccctgacagacttccatgattctgacttctgagcattacatgctcctgggttcttttgttgcctttcacggccttcctactgtggccactatctctcccatcctccatgccatctgactgtttggatgaccacctgctctctaaggccatacattttggatttcattctttgcctgttcccctggcctgcttcccaaaaacctctggacctaggtcaggttatgttgttgttactgtttctttctatttttagttcctagacctaccttccttccaaccctgctctgataggactggtgacactttaatgaaaaaaagagggccttgacaaatcactggatttgtccagttgactttaacatatcttatagcatttggatacatgggatatttatttgcagtgctagtgtaacactctgatttcacagataaggcactgaaactcaaaaggtaaagtgactttttcaaggttgcaccgatagcctgtggtagaatgacatctagagcccaggcttcctgtgtcacagtcaagaactgtcctttccccatattcaatcatcactgtagacctactttttacaaattagagtgtattgcaaaacaaggatcatagaatcacttgtagctatcttgaagaaatgagggtattaacctatagccagcacctttacaagttaaacagatcctactagattatcctttttcaaggacctagatgtatgtgaagaactaggaggagacaacagctttaatttatcccagatagaacaatattttaaaatttttattcagggtgccaatgagctcggaaaagatgacctggagattcagagaaattaaccaattaaaagaaggaaataaatcagacattagttattaatgaatcaaccaacgggggcagaagtggtattccaaaggagacatacctgagaccaatgtctttataaaaaataatgtaatctgtggccaagaagaagaaatgaaatatatgcccaatatttttgtctagtgaaatgacaacttgcacatgttatatatatatatatatattattatactttaagttctagggtacatgtgcacaacgtgcagatttgttacatatgtatacatgtgccatgttggtgtgctgcacccattaactcatcattgcacatgttatttaagacaattaaccagccacttgcttgggactcagggttgcattaaacaacgtcttcatcttgatgagcttaaagtcaatcgggggttatggctatgtgcacaaataattataattcaaggtagaaattatatagataaaaatgcaatgaaattattgcagaagtgacttcttcctaccaagttggactagcaagagcttcatggaagcaagcacatctgtgattgcacaggtagccctgacctaatgagccatgataaaatcttgagggtcaccctgtaggccactgctctttgaccacttatatccaggcagtcaccatttcaatttcaagacctaaaacattttacaactcagcattttcccttgtgctgctgtcttagttcagggccgcctctttctctgtagatgtctacagcaaggcccttgctcatcttgcatctacagtctcaccttccttccattcatcctccacactgctgacagaacgatcctgctgctaatctgatcacatcactctaaagtttaaaatcctccgatgactcaccatttacaaaggccttcaatgatctggccactgtttactgctcaagtctcatctcctgctcttcctttccttgcacattatgttctagcaatattgaattccttgcacttccccccaagaaagcgctcctcttttatatcaccatgattctgctctgagtgcttctctattctgctctgcaaaccagagtactaagcagagtgcatgattaacagaccagccatttagcaattaggatgaatcacatgcacttcaggacttagaagggccctttataccagaggttctctctcctccacaggatctcctaccaacagcatgcaaccctaatcagcagcaagagtggaatcctaaacttttgtgtggctctttgtttgaaggcttttgtcaagtaggagtggtattgtcagcagggaaatgatgaaagccggttatagggaaggtaacatgataataaaaaagaaaattaacattccttaaatacatacaacatgttgcacacattcaatacaatactttctacatgtaccacacttaatacttacaacaagttaaaaatctttgttccattttaaagataaagacaataagctttatgtaaactgattgtttctccattacttagttagtgactagggaggaaaggatctcattctaagtatttttttcttcctaccaccttatcagggcaagcattgtaaccatgtctccaaatttctttctgaatcattccagatcaatatgtttaatttagttttagtgcaattatctatttttttctgattatctgaaaatggttcatttgtatgttataaacgtagcacaattcctccctcccttcaccgggaaggccagagaggcaaagacagagcacagaccatacaagcagcttctaatctctcccttcttgatatggagattagaattgtgacttttagaactcatattgactcaagaggctattcaatgtaatgtcatccttttagagaaaaaataaatagaaatatcatacagtacatgaatgacaaagctaggactggaaggtaactcctaggcaagaagagctaattactgactgaaccctgatggctgagcattctcatatgttgcttctggtaatcttaacaacaaacatgtgaagtgggtattgttatctctacattacaatggagaaagtgaggctcagagaggttaaatgactcatgccaagtggctcagagtgattaaatgacactccaagtcacatacctggttaggcatgatagatcaaggattaaaactcaggactcacactgtcaagctgatggcttcaaccccactccccatgagcatttcaatcttcattttcaaatatccacagatatttgaaatatagcacaattccttccaggaccaatagaggggcttgtatgagaagtgaaggccttgtgactggaaagtcatcagtcaatttagacagcttctttggtggcttattccaaaaaaaagaaaaagtgtatagaaaacacctatcaatgactctactatataaacaatcattttttaaaaaccacataaactttttttttttttttttttttttgagatgaagtttcgcttttgtcgcccagctggagtgcaatggtgtgatctgagctcactgcaacctctgcctcctaggttcaagcgattcttctacttcagcctcccgagtagctggaattacaggtgcccaccaccatgcccggctaatttttgtatttttagtagagatgggctttcaccatgttggccagcctggtctcgatctgctgatctcaggtgatccacctgcttcagcctcccaaactgctggaattacaggcatgagccaccgcacccagccaagttaataaatttttaagagcttatggatcttatgttaatgttattaaaatattgttacttattgtcttttatgtagaatatcattttcctgttcattgtgctttaaaaacagtgactgctaatttctaaaaataaaatcaaataaaaaccacataccctgctccatacatctaaacaaaccagagctatgcagtgaaaaggcagaacacagcttttcagtaaacagaggtagaatttcaccatgtggaaaaacatacaccctgctaaagactgcagaattttacttctatcatttagaagactccaagggcaagaaaaatacatgaaatgctgattccaaaaatccttgacaaaacagcagtctagaaattaatatttaccacattttcagtgttcctgacacaacagctccttatatgctgatgtttatgaatacaaatttgctggcactgtggacatatattatcttttcagaaaataacaaggtaggcaggtgccttcctacttctggttactagagctaaaaaactaccacaaatgggcagcaacatttatgacaagtaaaattgaaatcaatggaccacataaatcttagttgtacactgatttaattaactataatgagaaagtgggcaatgactctgttactatttaagactatttagaagacatctgtggtactttttttttttgcctcaattcacacttggattaacgtaggagaaataagtaagaggtggatggtagtaagctagggttcaattgttaatagaatgaaacacattttcattttgtaaggtgcagagaacataagatcatgtccagtagtcctaaacaaagcaactatagtatcatagtattacacaacacatagtattgcatttcaagtatcattatcatgccacagttattgcttactatttcctttacttaagcttacaaatcctagaaaataaaaatgaacaaaccatagactgactttattccttgctatagattttggggacattctacatttattttctagctgagttattcttttgttcaacataccctgattgtgccaaatactatgtactggattttacagtctgacagaggagtgcaagttctacactattgacatacagatggaaatgccataatggaggagtgtgcgaacccaagctcctacatctgcaatctttagcaccctatagctgggcttagctaaagtctgccccataacagatggtaatactgataatggcaatagtgatggtgatgatgattatgagaatgtgatgatgatatcagcaaaaattgaaactctactatgcatgttatagttcataaaaatgttcataaaaatgaacaaaccatagactgactttattccttgctatagattttggggacattctacatttattttctagctgagttattcttttgttcaacataccctgattgtgccaaatactatgtacttgattttacagtgtgacagaggagtgcaagttctacactattgacatatagatggaaatgccataatggaggagtgtgcgaacccaagttaaatgtttgttcacttactcagaacaacctgaagaagcaattaatattaatctccactttagacaaagcaacctaggcttggtaaggttaagagatttgcccaaagtaatacaactactaagtgacagagttagggtacaaaaagatagatccaaccaatatggacataagacaaacagtattgtaaactgccacatgccctaggtgagggagctgagcaccagccacccttccttactggctgttcccagtttgctctggtggcaagctaagcacctgccttaaggctccatggttttgagctttaagttttcctcattctgctacattccagttcccagaatagagttttgccttggctgactctagtggcctctgttctgaggactgcaggcccagcatctgggatttaccggaaacctccaagataacttcctggaatgtatacttctctaagattcctccagttattatctgaaaacccaatggaaaattcttttattcatcttggtaacaatgacacctattattatctgaattataatatatttcttagtatgcatgccttctggtacagacaatttgaaagctagaaataagtctttcaatcctactgacacaatgcctgacactgaataatgatgaatgaatgacctagttaggctcatagactcagaagtcactgtctcattcactggatctatttcttgctgtcagatgtctcagcctggatccattctcacatccagagcccacctaggtctattccagtcctctatctctccttatctatatgtctcatgataaaaccatcatgtctccacctgaatctgctgatatgaaagaacagcagaaagcacggagtcaaatgaactactagtttagaagtggtatttcaattgggttttaagaaataattaatgatcttcccaaggaaagaggaggcataaacaaaggcagaagatatttgagttgctgttgcatttgaagaatgccaggcagccttgagaggttaaaatacagagacaacacttttgtggtagcacaagggtagataccaaagagatccagaaatgtgatgtgtcctcactgtaaactcacctgcaagacacatgaagcattcatgggaatatgaaataaatacagtcaaatctccaacctacctgttcccagactgctttttgttttgagggcctttcatacttagtaaaatccctgcagggttcagtcacaggttctcagaacacactcaatcacctgctgacatcagctatcaaatgggacattacttgaaaataaggaatatgattatccctgatgagggcagctcagtgaacctttcctctgcacttatccatccttctccctgacagatatggtaatgcagatttttttttcttcagtataattatcaattcagacattctgactcctccaggaggaaactagctgagagctggctgggaaccttcaatttcattcaagggtatagaacaactattatgtgctgagttctttttatcataatagcaacacaaacttcaaaggcaaaacccaagccaattcgacaaaacacccatctcttatatatgcagaaaacaattatatgcaatttgtactatgttcttcaatttctcatcttttaatctataagatagatcatgctattgtatacattctaggtcacttaactgttcagtttcctcgtctgtaacacaagaataacaatattaaccttttaagactattgtgaagattaaataagtgagcatatctaaattaattaacatagtatctggcaaatgtttactgttatcattttattataatcattattatcaataaagtattcaggatagtctgactacactgaactgtgataaactacttgcttgtcacagaagacaagatttacaggcaggtaggtgaatctgaactttctatttttactattgctgcataaccataaaagaaatggcttatctcctatttttgtgctgtagggattcaatccacaaactgcctgagggacgaacttggaccatcttaataatatacatagtaaattccattccggtttgttttgaaatgggtattatattcggactgaacgttttcctccctagattttatctgaacggcttacatgagtatcctttggtcactctgtttaaagcacatattcaaatgcagtatataatcaagactgatctatctaatgacacttggagaaaataaaacagatataaaagcagtcctaatattatgcgactatttacaaacaatctcccaactcaggatgctgctgcaaagtagcttcttgccacttccaggttttaatgccttaattaattatggaatgatgtttaattatgtattttattatgcatagcaaatataaattacatacctgattgttcacaattgtattaaaaatatgtatcctttatccttgaaagtgaaagacctttttcaagatggataaagctgtttggggaacagagtatgggtggaattaattgtccccacattaatcatttattttataaaaatgtgaaggtcgttctccactttaagacacttcctgaattcctctagcaaggtctggcagccaaatttcaatatgcaaagcagaggattatgcaatgtgcactattattcccctaaaggcaaacagcttttatttaataaagatgttattctaagaagatttactgtggtattgtcacatatcagaacttgttctggaaatgtgattcttattagtaagaacagatgacctttctctatgggtagaagaactatggatgtcattgcatgcacctgctaattttcctagaatcacagggtgttaagaatcacaatgcaaaatccacagacaccatttattaagcattctttctgggaacaaactattgcattaaacacatgatattattatcatattgagtgaaccattatgaacattatgtacaaagcactaatatagaagttttctattcatcttatataatcttcatttttccccaattttatagaagtatgcctcagtaaagcatttttctgaagattatgccgctagatgaaacaactgccagactacaaaggccaagttttttcattatcaatgaatgcatattgtcataattctaagaattaggattcgtgattccaaagtggagatttgtcataggtgtggccagcgccagtgaaacacatggggcttcttcccagaccctcaggcttgactcacttttttgatagtcaagatggtaatcagtgggcaaaacacttgggccagacagaaatggacttctggctccactggttgtgtgaccttttacaggtcattttgttgctccaaaactcactttctcatctatacagcactgataatagtacctacttcatatatgcattgagaggattaaataagttaatcacatgttgagtgctttgcctagggtgccacgtatcataagccatcaataaatattagctgttattgctgttatttttttcctccttctctaataattttaattactattttgggtttttgcaaactaatcattggcttctttccagttctttctcctttcatcttaatctcaaattctaaatgtgtagaacctaaaacatcaaaagattaataaaactcccttctccattttgtgctccagccttgataccaatatcctttcatgaccctatattcataattttttgttctatttagtttcttcacaagatctgtcaaaaataaagtccacaatattacttctgagtaacttagagagagagaaagagactaacattcaatgcttcttaagaatttccccaaccaaaaagaaactgaatgtcacattttccatccaagaaaaatcagtgtttccagagatgtgtgctgagatgtctatggatgtacagcaaaactgattttttttccttgtttcccacttaagcaaaatgaaactgtcttcttcaagcacagtaatttaaaacaacagtaaccaactccaaagagcatgaattagaatgaaagttcactgggagcaaggatgctctgaataactgactactctgacaaaataacatattctgctagataagaaggcaatatcacctaacgattaaaaacatgtggtttgggataagacattttgagatttaagatcctggtctatcacttaactgtgtgatcttagcaaagtcattgaagctcctgaagcttgagtttccatatacataaaacagtcaaattgttccaactcatgcacttctgctaaagattaaatgagataatataaagcattacattaacacaagatctcacacagtatatgtgctcaattaaaagattgttattatcaacattattataccaatatcaacttcataaccattacagtaaataacagaaataatggaatgaaactaataaaataatgccaaatattgaattttgtgttttcttggggaattgaaaagaatggattgcaattagtttataattattgaaatatgaatttggattcgacgaatactgataaagtagccacacaaaagcctatttaatatttgagaaaacagtcacagaaatgcagattccatgattaggcagctagttggtgaacagcaagaatgtgaagacagcaacatagtgtccagcacacagtaagggctctgtgattagttactgaataaatggatggatggagatatgctgtggtttagcggaaacactgaatttagactttctgattgtgaacactttgcttggatttcttaattcacacttattatatgatctatgaaagtcattttaaatgaaattcaacttcccctcctataaaacagtgataatagtatctgtccacagaattaatgtgaggttgaaatgcaacaagacatggaaagtatctagcattatgcctggtacatattaagtgctcaatacatgcgaatttccttcccttttctccttgtactaaagtccatctctttcccaaactatcacagccttctttaaatcatacatagtccctcatcggtactttcctttctccccagtacaatcatctatttgccttccaggtcagtttgaaaatccaaggctcttgatgacttcgtctgagtctacagccatttgctagggtgccacaaacacatacccaaccctgacccatgcccatcttctctgcccaccttgcccctttagttctttaagatgtcatctcacagcctatcctcagctcttcatttctcactggatgcctctgccttcttcaaaacaatgacagaattcatgaagacgtgttttttttccccaccattttatgtattattttcctggcttttaaacagcattagaatctcactttattcaggaagcctttctggatgaaacttataaaactgaacttctttttgtacactgtaacacctgggaatggacttcctatctccctatcccttaacccgattatactcttacagtatctctcaacgctaaattatacactttacatgtaatataaataaattccttgctgtctattaatatactgagttaagagccaaactcaatgtccaagtttcttataactaatcttaagataatatgagtttgctctttgaccataaccatttagagcgtagtgattggttcatatttcaaaagcactttaaaaggagtttgcatatggtgctaccatacggcagcacaattccttatttgtatgttgggctcttattcatctctgtgttgctaatactttccatacatcctggcacatagtaagacttacaagatccagaatacaacgttattttctagtttagttctatgaacacataggggctgaaaagtcccaatgtgaagtgacagtggaaaagatgataaaaagaagagcaacaatactagtccagaataatagttggatgatatatgaaggactttatatacaccatttaatttcgtccttataccaaaaccatgaaggaggtatcattatttttagagatgaaagaaatgaagtacagagtcatgaaataacttactcaaaattaaataataaacaaagtcctgagtttgaaatcctggtggagtccatgcttttaaccattattgcactgtattttcttgtccaaatggtttttgaattagttataccatgtctaccttctgttcatgcaattaggtgctgctacctccttactacagcatgcaaggctttccccaatctggtcctatccttccttcccagatgcaactgttagttccctcctctataccctattctcaacctagaataaatacgcttaggttccctaaaatgctcttatcccgttgctttccctgttttctcaccctggaatgctgtcctaccctcttctgcctatcaaaatcctttttcttctttataatcagttaattttccatattttccttggaatattctctatttttagactggaatgatgtattccctctttagtatatgcaaaacttttggtttgacttggagacacaaattgcttgcctgcctcttacattaaaatgtaaactccttaagggcaaatgttctctcttatctgtcctggtatacttaatgctctacacattgcttggtagacacaactcaaagttttgtgaatatatgaaaaaatacagaaaagagaaggcgagagggagaaaaaagaggggaggaatagggagacaggcagagagagagagagatattatatattactcaatttggtgggcttgtgtaagatcactggtgcttaattaactcaaacttgtgcttactttgaaattaaaatccatttaaagttctatacatgttttcaaaacacgttttgtattcaataatatctccccaatatctatccttatgcctgggagaaattacacaaactaatataatagcattttaccttcataaacatttatgagctgcaatattaggcaatcacaccaagtgcttacagaagtaaaatctatttattctggacatcatttagaacatcctgaacatactgtctcatatacaaaacaaccctgaaaagcccttccattaaaaacacgtttgagaaatgccgataattttatgatcatttctctttcaagacagacacacagaaagaagggaaaaaagtcctccgaactagacaataaattatatcttcaaaacatccctctataagatccccacccccagaccagtgcagatttgcagggaaggctctgtgcccctttagtgcgagtaccatctcaagtgtgaggtaatcccattatattcatcgcaattagcctgtgtcctgagcctcctgctgacaaaaggctacccattttgctcctaattaagagcagaaaattcttcccaaactaccttcattattacacactgcgtgcttggctctatcaggcaataccttcacattctggaagaatcaactacctctttttaaattggagataaccacaccagtgttaattatgtcaattaaaaccttttcctacactcagcagatgaaactcatttcactagaacaacactggggctacaggaaagagaaaccttcgttacaatgaaaggtaattagagagatcatgtttgccttaaaaacaaacacacagaataaacagaaacaggagaaaaatcttgttcaaccaaaagaaaattatcacgtaaaccttcttagtaaagtatacggttactttaaaaataaaaaatctgaaatggtgaaacaagtaaaactcagccaggttctcctttgaccataatatagctgaaaacggaggaaatatgcaagactgcaagagccgcactttatgttagacagcaacctgcttagataaccaactctgtgaagagacaagtccctttcttcccccactctgaatggaaaacagtggaatttgaaatacgatattcctaaggatatttactgcattaacagtcactgagaaccacaggtcacttttactcactctgaccctagtagaaaacagctggttcactttatttcccccaacacccaccagcatcatcaaatgcctaaggcattgtgttattcaagcaaaatttcaggaggaaaaaatgtatcacgagggtgcttccaaccaatcaggcctttagaatgagatttaatttgccgcttgtatttcactgcctcagcacagtgaccaatgcttgttttcttttttttttttttttttttttttttttttttttttgagacggagtcttgctctgtcgcccaggctggagtgcagtggcgggatctcggctcactgcaagctccgcctcccgggttcacgccattctcctgcctcagcctcccaagtagctgggactacaggcgtgcgccaccacgcccggctaattttttgtatttttagtagagacggggtttcaccgttttagccaggatggtctcgatctcctgacctcgtgatctgcccgcctcggcctcccaaagtgctgggattacaggcgtgagccaccgcgcccggccccaatgcttgttttctgttactcatccgtagaaacctaatcctcaatgcagtggtattaggaggtggagctcttgaagtccttagggtggagcctcatgaatgggattggtactcttataagttagttcccagaacactcccttccccttcaaccttgtaaggttatagtgagaagacagctgtctatgaaccaggaagtgagctctcaccagatatggaatctgcttgtaccttgatgtcagactttccagtttctagaattgtgaagaaataaatattgttgaagctacccagtttatggtattttgttacagcagcccaaactgattaagacaggcttttatggtatatttatgtctgcaattgtcaaaacaggatcccagagcagcaagcggggccagtaaacttgttaagaatgcaaattcttccccattgcagaccttctgaatttgaaactctctgggtagagtgcaacaatgtgtgttttatcaagacttccaggtgatttccatgcacactaaagtttgagaatactgtaaacgtctcctaaagcgtctccttgtctgtactcttgctcatttctaatacactctccacattctgctaccagataagtttttctaaaatctgaatctgatcttatcaacctctctctcaccttaaaacccatcagtgacactgttattccatcctccatcaaataattcgtactatttagataacaaaccaaaccttttaccatctggccccagctgacctaagcaaagtcacatcttcccattcccttgtgtacctgctctgctcaggccaagatgaatttcctgcagcttcatgaaaaagccatgctctttgaggaatctgtgctttgctctttttctctgctcggaatgaatccctcaccgcttctgcctgtcaaacttcttatgttaagtattttcgagcatcatcccctctccgaggcctcctgtggctccactcctttctgtctacttctcctgttgtgcctacaaattgtgttgagtctagagacctctataacgcacaactttgaaaaatacacttgaattgtcatgctatatggtcgtccactcaaacatatctctccctcactaggcgcttgaactcttcagagttgaggaaggtacttgggcaaattatgtctcttttatttttagatacttaaatgagaatacattatgcatctatcattcattctaattactacttattatagtgaatgaataaatgaattgactctggagcacttactgtatgcagcactgttatgctcgtgatttacctctagtatccctattttacagattagaaaaagaacaatagcaacaaaactgagcctcagagatcttaattatgatgttttaatagcctaccgcagttctgggcacattggtcatgctctttaaaatttatttgattgtaagctatagcaatggtgtcaatcctcttgaaaaattttctgtctgaataagggtatgaagttgaccataaagtctctctccttaatgcatatttaattctggtttagatttgccaatcaaaatttataaagacagttggaaactaacttatctttataactcattacgcacattcaattttcccaattttattcatgattgggcacagctaaatcattacagcagttatcatagttgaagttgttttagtttagaccctcaaattaatatatactaaggaagaatttaattagctgaaacctaaattgtcattattaatttactagttatattacaataccttgtaaaacatttatgttccagtaaatggagtacctactttccagtgaccacatggcatagctaatttagtatacaactaaatatttaattactaatcttagtaaagctaaaggtacttagttgaaattaaattgtattacttgcaacaaaatgcttaaacatcatgactctagacctacccaaagtcacttctcctgctttcttgttacaaaatcttatcaaagtagtaatggaagttgaaagatttataagtatttctgaaacattctcagaataactgtaaagggtagatggaactattgtaaattagtcagcacattttatggcaaggtcaaatggggaaggtctgaacattttttcattaatgttaatattcagaagggtacagagttttcatttggtatgatgaaaattctagaaatggatagtggtgatggttgtacaacattgcaaatgtatttaatgcccataattcttcacttaaacatgattaaaatggcaaattttatattatgtttatattttatcgcaataaaaataatacattcaggtttgataactaaatgatattttgtctcacttagtacactaagatacttaatagttcgacttaaattcaactgtgtccatgtcatgcctggcacttgtctactgtaactgatgtgttaaaaaataaaatcccaaccaacctactttatctttttatcatctaagatggactacttcacagacttatgaagtatttactcaatcaataatggaaatgtataaaatccctaaacacatcatattcatcacactatgttgcaattgctcctttattgttgtcttcctcatacactgttgaatgttgagtactgaataggccatgttcaccatcacatcccagcttctcagcatactgtgaggtagctcttaaatgaattcatttatagattgtttagattatcttttaattactcaaagttagtgtccagtttctttaaaaaaatagttcagaaagacatgttctttgctcaactagtgattcaattacataaattataaataggtgtgacatgaaaacatacataggcaatacacattcaagaacatacaatgttaatcataaatgcaacagtaagccatcttctgctatttgaatgtacttacctccattaaacattaaacagtccataaatgcagaaaaacacattgaagtatctatataattgagcaacaaatagtgatgctggacactgacttattttcaaaagcagaactggtgctttagggagacagaagtctattatactaattagaggccattgccctacctccacagatgatgctctcttgggtagatatcaaagcagacactcttgaatagatgcttttcaagttaatgactcaacaatcaaatgacagtaatcctagtatctctggtaagatcaactgcttaaatcagagtcaccttccaaaagtactgctcagtgacagtgaaactcaaggttgctatattagggcagaaatgtgcttgcccatccatgctgatattgtggagcatgtgattacaaagttgttcaaaatagtcctactacaggtcaaaatcagaggcagagaatgacatgaaatagttggccaattagctgagaagctccaaagaattgtatgcaccccataatatctttcttaatgacttgtcacattatattcatttaaaaaaaaacttaggtaatacctgttattcaaaaatatttactcaattcttataatagtgcctatgagacaggcactattattctcattttatagatgaggaagcacacgaggtttaagtaacttgctcaaagttccacagctagtaaatggcagtgctgggatttgaaacaaggaaacctggatctagaaaccatgttcttaaatactctacttttatgtatcaatatattttaatagaagtattaaaaataagaacagtttctttaaggcattttttggggtgggtagaaggacattatggacattcacatgtgcttcctaagaatgtaatcaaagcacgtgtgttttattctaatcttggagaacagggctcagtgaatgaatgatataccaggtggtgtgcaatcaggcatgatcacagagctcaagaatgttaagattcagcaaataagcaaagagggtctgggcaagacagaataaataagagggaaaaactggcatattgtttacactgtttaagcagtatagagtttgctaagtgtttgccttaattgtgtatgcttctttttagatttttccaatctatacctaaacttccctaggatagggaccatagctggatcatttctgtatccatgcatcattgtaagtcccagcacagtattattaatattactgtgcaaataagtattttttaataccaaggggcaaatgagtatttgttgaattgttaattgacttcaaaggctgcagatgatttatttacctgaattttattttcctggggtcagtctacagtcaacctggaaagatagagaagatatgactttcaaattgttcaggacaactacataggtgattttaagaaactggagaatggaaagcattatttaatctggattgtattggaatttgctttctaaaaggcatagtgtagctgataactgctaacaagcattattcatcatactacattttatcctgcttttttcaaaacactcactaaagaaatgactactgctaaaggaaattcttacttgtgtattacaaaagccattttcataaagcctttgtaaattctacatatacataaagaaaaacatcaactttaataaaataatggatatttgaactaaacatgatattcaaaatgttatacttgggaagttaacggaatgctatatgctgagataacaagagacaaaatcatcctacaacatcccctatccttcataaattaaatctgagaacattaaaaacagtcataacaatgaaaaggattacttatggaaagaaaacagaaaagagaaagtggttagtgaagatatttgcctctgaagatctcaaaactgtgcatcctagagcagaggtaataaaaattgttatttctaagaaatagatccaaagtgactccattcaattcacagcaggaacattcaaagtagcaattaatgcaaccactggtgtggaattgttttccaaatgccatcctgttgggtgacttttttgttgttgttgttgttttttaatggaagcagggcactgaagacatggtaaagtcacatcaattatataactgaaaatttcatgaaagattatcaataccaccactcaaaaatatgaatataaccaataatacttttggttaaatgaaagaggaacttagcaggtactgtttaccaaagacattaatggtagtgcttgaaactcctcaatatttgatcatgagaaataaatgtaggggcgtacatcttagtggcgcatgaagccaatgaggccgaagtttggaattgcgaatatctaggttcaaatccccaaaacttggccatcaatattggggagatattggaccaaaaaaattcctaaacctcatattacctggggactcagcttactcatttgaaaggcatgagaagttactgtagcatcatggttaagaatttggactcaggtccagatagcttgggttgaaatcctggcattaggacatgctaactgtgcatctttggacatattaattgacctttctttgcctcatctgtaaaaatgtggatataatagtactttgcatatagggccattgtgaatattgctaaattagaacacataaaatcatagagtagtgactggcccatagtaaagacacaataaatgttcattaatgttattattattatctacgaaaggaaggtcctttctagttttgaacttcaatgtaacattgcatgggactcttttctcttttttcccaagacttgaaataaagcaacaaacgtcaagtgatacatttatcagctggaagataagcatcttgagtcattcagcacataatacttcctttcaaaggagaagtgatatgtcttaactggcactcacgaaacagggaatccctctcttaaaagttgggtggtatattttgaaagagagaatgtatgggaaaggctgggagcagggggacaatattttataaggaggatctagaaaattatttaaaaggaaataaaaacctagaactctctcagagtcattatactaacaattccaactagttaaagaaagatgttcttcttagtcattttctgcctctagccaaagacagagatataattacacacctcctcattttataaaaccagggtgacagagaaagttcattcggaagcccagggggatagtagagtaagaggcatcattggtgaagaggtaaagcagaactatttttcattctttctagaactaggcagaatatttaaatgaatggtaggaagaaaggaaaaagggaatgaaggaaggaaagaagagagggagggaggaaagaaaggaggtacggaagaaaaagtttttacaataggtagattcttcacatgcagttttaattgaatcataaacccatgaaaaggtggttatcaccatttttaatacatgagagcactaataatcaaagaggtgcagtcatttgctcaaggtcacccaaccagtcttgaagccaggtctacagtctttcactgccttactgttcttgggtggtgtgccaataagaggattcacaaaatgggtaaaggacagaagtcaacgaagatgacaaagaacttttacaggaatcttggggaaaaaaatatataggaaagtcagtcctatgccaggataatgtccaaataggaaaggaacaagaaaaagacttatttttctcaatcttcttaaactttcccaagcactgtccctccttcaactcccctaaccccaatatactttttttcctttccacagaaaatacatttttacccctcccatgctagggaatcaccaaaatgtctgtcaaatcacatagatctgcactgctaacaagcacaggaataccacggacctcaatacctctaacagtacttgttttgtcatttcttgctgcaaaccctggtgaaaagttaccagcccttctgatagtaggaactttctccaagactagcttgtgaggaacagtgaatggtatgatagggaaaatcaatcaattgtttgtaaatcagtgtgacctaatgtaacaagtaggtgtggaagagaagaaaagtattttgtgagttatatgtattttttgttttatcaagtttgttgggtgaatagtttgcattcattttgcctcctctgtagcttagacaactataaagacaaccaaagctatcctccaaaagcatttcattcattccccttaccctctacttctcctttttaaaaaatatattaccattttaaataacctctcatagctccttcaaaagattgagtggtgttaactctgctgaatccatgtgtttatcagaacttacatattttgaataaaaaagaacactatttctacccggtgttgataggctggccttgggcactaaaaaccactccttattagacatcatcatatatatctacaatggtgggaggtggtataacaagcccttagcttgggctgccataacaaaataccaggtattaggtggcttaaacaaaagaaatttattttatcacagttctggagactgggaagtataagatcaaggttctatcagggtatggtttccagtgagctctctttccctggtttgcagacagctgccttttctctgtgtcctcacacagtggagacaaagatgaagaaatctgtctcttccgcttcttacaatgccaccaagcctatcagattcagaccccaccattatggcctcatttaaccttaattaccacctagaagtcctatctccaaatacagtcacactgaggacaagagcttcaacatatgaatttggggaggtcacaattcagtctgtagcaggtgggatggagattctctaaataactggaattttaggattgagagtgttcaaacaataaacatttcatcctcaactataagcttgtaatgatatggcatgtgggataaggcagctggaaaattttagtttgatgtcattgttggtggctgaagaagactctggctttatgctagttactgtttgttttacttcagtgttagtggcatggagggtgagaaaggaagagaaccaaagcctcaaacgcaatgctataaaatgcctcataattcctctttctccaaagaaaaaaggcatttgaaaaagaagagcccctgagcatttttcatcttgctctcactttgaaggtggacagagtctcctttacattcttcttactaatggtcaaggaagttccagaccttttgtgtatagtcatttggcataaatgttctgtttcatctagtgctaggcgttttgctaggtgctgagaatacaaagacaaatgagtacaaatctttccctttaaggattctgcagtcttatagaaaatcagaattagaatcaaaaaatgtttgagtggggaggaatctgcttgcagatgaactcaggcccatgaaagcttggacacttaaccaaggtggcacaggttgtggggcagagccagttaacacccaggcctactgacctctaatctggtcttaattcctatacttaatacagctgagagtgtcccatccaagtgaatcatccaaccagggttcatttaggaccttatagatgctaggtgtccagaccaaataggacagaatttataatggtttaataattaaagatttaataagatatttgaggaaataagactacctcagatataagcaaatactacgaggcattttttaaagcgggatggcttctctaatagcctcattcctgcaatacatgtgcaaataaaacatgcagattatctgattatcaaatttatctttacaatgataatcatgcttaaattaatcttgctgtgttggagaatgtctcctttcatcttcattttccaacgtaatatcactcaacaatatcaggtagaggaatatcattctaaagttatattaagaaaaaaatgcaattaaagttttgtaaactagactgaaacaaggctatctggatacctggtttctgaaggaccataactgagaagtcaggtctcatttccagcttatctcttctccatatcagaggtccatccaactgaaggtaggtttaaagaagaacataaaatatgagttggggctagggtcacaggctgtagattcagtaaacctgttcctgaatgctggctccaccacttgtgacctatggcaaaatcccataacatcttataccttagttcatctatgaaatgcagctaatagccaggcacagtggttcacacctgtaatcccagtactttgggagtccaaggcaggtagatcacaaggtcaggagatcgagaccatcctggccaacatggtgaaaccccatctctactagaaatacaaaaaaaattagctgagcttggtggtgggtgcctgtaatcccagctactcaggaggctgaggcagtagaattgcttgaaccagggagtcggaggttgtagtgagccgagatcgtgccacttcactccagcctggcaacagagggagactccatctcaaaaaaaaaaaagaaaagaaaaaaaaaagagaaggaaatgcagctaataagagtacctcagaaggctgtagtaagaattaaatgagatggtatgtgtaaaatacatgtaataatgctcgagtaaactgcttaatagtcattcctacaactagtcacaattttacagtggttttgtgaccaactatcttgccctccagcctactcctgccttccttcactttggccatttctctgatcctgccctttgtctactttccctgaccttataacagttgtgctttttgctctgccagggtgggcagcagttctgggacctcagaacaggtgctactgtccattttgctgcttgattcaccttccaggtgacagaggagaactgcagcagggctgcgttcagcatggacaaacacctgtcctctctgtcaccacagctaggcagacactggcgctgagtcatgctgctgctcacaactgaggagctttgagagactcacaagcctctaagaaagggatctaagaggacaatctgttcatccttctctccaggtcagaccactcttcaatctactatgaggcaaaaatagaaataaaatgatcactgaggactggtgaatcttcaatatcaggacactacttatgcctgagataaatttcagattttgcatttaatttttaaaatttatttttcacaggaaaaataaacttagtatctaactcatcataaacctacatgattttataaacatagtataatatgtattacacataacatatatatacacacacaatatatagtatacgcaaacatacagaagcagagtattatctaccagtgaggagatcaaggtctagaatcatacaggatgtctaatcatagtcacctactggtgatatgttttctctctaaaaactagtagtaataatctcactgggtctttatattcacagttctcagctcatagaacaaattcaataaatattaaccattgttgtttagacatataaatatatagtgggagtctggaaggcttcttaagttttctcttctgcaatctaaatggttccagtttgattatatcttttaattcatttcataatgttaattttcatttttttcctttatcatttaccttcctaaattcagaataggacacataatatttgttgagtctgactggcacaagtcaaaatatatgatatatctcagtgttccatataatactctgtatgaaaactattattaatattaccagataaataaaaataatttgatagcaagtataatattttaaacactttatttatattaactcattttatcctcaaagtaaatcattcattcttcaccattatgtcatatattattaattctaagaataaatatttttcactttttaacacctgtgaaatcaagatgcatcttgcaattcatgatgtgttatggtttcattggcaatcttttttttagtaatagatgaaataatgacacatctcaaaattgatgacaacttcaaatcaattaaatatcatacgaaagacaactatgtgtcaagcattcttttagaccctagaaatatgttgaataagattgagaaatcattcatttcaaatctactgaggattgtagaaaaatgaagataattacaacaaatgcacaagttgctgtgggagctgatgatagatccatcctgggctttagaggccaagaaaagtttcctagtgatggtgatgtcacctaaggctagagtggaataagtgatggatacagccaggctgtgattagctggttagccaaacagattaagcaaaatcctggaagctagagagagcatgggccatttagggatttgaaagtagttcagaattctggatttaaagtgctgatagaagaggtacaaggtatgatgacagagaggaaagcagaggccatatcatgatgggttttgtagattatattaatggtttgaacactgtcttgaggacattggagatctactgaagcataaatgttacttctatttgacagatgagaaaactgaggccagagaaaccaagtgactgacttcaggctggatagcaaagagcaaggctaatttaatcccctccctctaaatccttgcctgaaacctggtgccccttatattctactaagatcaccaggacataattctctttccttggtcctactgccagcaaatgtattactagtttatcctccattttagtttttgttgaattaatgtgtttggtttagacaagggggagagtagaactagtgtgctggtttttaaaaagttttccaaggtgggccaggcatgggggctcacacctataatcccagcactatgggaggctgaaatggattgcttgagtccaggagttcgagaccagcctgggcaacatggtgaaagcccatctctactaaaaacgcaaaaaattagtcagctgtggtggcacatgtctgcagtcccagctactcaggaagctgagacacgagaattgcttgaacccaagaggcagaggtttcagtgagctgagatcacatcactgtactctagtctgggccacagagtgaggccctgtcaaaaaaattcaaaaaaagttttccaaggtgagtatggcctaatgtcaggatatgtggggttggttacatcactcataggttataaactgccaagctcatctacaggtgtgtctgttagattatgaatattgatactagtctttcctaaatgcatcatgaaagtacttttcataatgtgcactaaaaagataaatataaaaattaaaacaaaacaaatgaaataagcaatatattgctgacggggaagtgaaggttcacaagttttggtattttaatactcttgtatattactacgtaaccagaaattgcactttcaatttatcttaaagattcttcaactggccttttagagtaagacaatctggagattgtctaattaagagatttaagttgaaacgtgacaacaggcatacaagtaagatactaacttctgaattacttacacagggtcaaaacaaagaagaaaggaataattatttgaatggaggtattctatcccagccaggcaatctggatttcacattatcacttttaaaataattttattcagagaatttgttggtacaaatgaacttttaaatgaaagaataacaaagaatctcttatgtagcttatttagaaaaatgtcaatgtgaatcacctaacatctttgacttttttcaaaaagagagcacatgtacaattgccaggcatttaggtcctttttgattaaagacatttttggattctataggaataagcaatgagtacaaatgccaacgttaaggttaaaatgatatgacaattaaaagctattcaaatagaataataggtgtcccagcatggtggctcatgcctgtaatcccagcactttgggaggccaaggtgggcagatcacttgagctcaggagttcgagaccactttggggaacatggggaaacctcatctctacaaaaaaatacaaaaattagccgggcatattgacacacacatgtgttcccagctactcggaaggctgcggtgggaggatcacctgagtctggagaggttgagactgcagtttaagcagtgattgtgccactgtactccagtctgagctacagtgagactccatctcaaaaaaaaaaaaaaaaagaataataggtgacaaaacaagtttgctacacttaaccaatgatagaggacaaagaatgtaaaatctttaacaacatgaaagaaaactgtttattcaatatagtttatgtatagtcttatctgaaataaagaggttgagttacacaatcagtaactttgattctgtaaacattatcactttgaaattctaatataaaagagagggacaagataagaaaagatgagtaaccttattcagacaagacagattagtggatctagaagaatgatgagtggaaggaagaaggcgctagagacacaaggagtcagttttggaataccttgggctgacttggtgcaaatcccaacactgagacttaccactaatcctgtgaccttgggctagctactcttctctctaggattcaggaaaaataatttctatttaatagggctgttgtgataattagattaaattttatgtataaagaagctaatgtataagctgtatggagattactatcattaatattattattgttgtgagcattatgatggtcattttgtgatgctactgagttctagtgacattagctgaggcaaaacagtagacaagacaactagtaataagtcacactgagtgtttaggatggcatttagtcttgcatgttcctaattattaagagcttttcaattaaccccaaccttgaggaaaatacttttcagtgttaaaatagaagtgaagggctatggtgagttcaggttgttttattagagtgtgaagaaataaactgtcacctactgaaaaaaaaaaaaaaaaaaagaaaagcccagaatttatagagggtactaaaaatcacaatcattgtccattgtaaagatatatctccccaaatgctaaaatatgatctttcacaattaagtatactggtcattttctaaacaaaattcaataataatcttattttatacatcttcttccatctgttgataaaccatggcaacatatcgttagtagcactttacatgccccactgttttgcaactatatgatctttgatattataggaatacattatgtaaattaattcagcttgttgtattatttgttaactgtcttctcagctaaagtacatactgaacccttagaaaaaaattaatttaaaattatagttttaaataagctatgttataaaattaggtatacaaaataaatgaactatttccattcaccaggcatcgactgagtgcctacattttttgaggcaacacaccttttaatttatttcaggaactctgtgaatacaaattccattaaaaaataccaagatgttatttcatgttgcttatcatgacctaatgttcaaaattaactcctcctagctctcttcctagcacaaaggcagtagagttgttatttcctttggtctttgtcactcagagagcaaaccttcagttctctaatgtagatttcctgatgtaaatgtatcttactctctgagtaaggtaattaaataatttgaacccttaaaatcaaacttggtttcttctggcttgttttaaacattagccatcacagaaatggatgggacagattgaaagccccttactagctccttaagaagcagaagctcagattactttgttgtatcaatgtctttttaggttctatacactgaattttatagagctgctatttcctacatttgggtccaggcttgaaataagtgcttctgggagattcaactttctttgcatactaatttggcataagacattatctcccagtggctgtcagagccatttatggtctctgacagttctctcatccatacaacttataatttttataggaagaaaggacttttctaaaacatttgttccaataaaagacccacttacaagtctctttcctgcaaaattacttgaaagtcaaaacaaaacacaacctcaaaagccaactgttcaatatatatgatactagttgacacataatagttaggcttgtaatctttttatctgggctatatagagtggagaagagaccaattccagcccaatcctcccctccctcatccaccaaaagtgttattaaataacaagtcagttacgttctaaaattgtcagatctggacattataagaggctctaaagtcagaaccccagtgatattttctcttctaaagctaaaaaaattcgtatcttggttcatcactggattcttgttcattttatcatttccactctgaaggaatgaatagcaagttatagtgaaggcatctttctaggtgagagaaaacactgtgccacaggccaggagagccatctctgggtcaatctcatgagtttacataaagcagtaaagatactgggctgaagatcatatcctcagaggaatatgaaaaatctgtttcacaagattttgttacctttggaagtttccccaatgcctaccgcattggatattgattccctaaatatgacagtttggacagtgccccagaaagcactggagaattagagatgtaagctatcatcttctgttatctccaagcatgtaatataccttaggacttacaggccattttaatttctcagggaaatataactaattaggtaagtctacacagagattctctggaaatgactggtcatgctgaatacaagaaatgcaaatctattctttaaatggccacaactacctgattataaatataattcttgctcattgtgaacacttttgaaacgatggcttagtgataagataccaagcacccctgtagagtctggtcaacgttactgagagtcccagatatatgttcctaggacacacactgtaacacatgtactagagaaaggctcaggtatttataacgcccacttcagaaccaaagatcacaataataaaaataatgcagtacagcaacaagtttactagagagctctctgaacaagcataaactgcagctgctcaattgctttcatcctatgtaatttaaaggaatcttaagtctctgtgaagacactgtatcagttgatgatttcaccacgcattttgaatagccaatgatcttgcttaacccttaatgctcccctcccaagcaagctaggctctaagtgttaccccttttcatagtggcaaggaccacattcacagtgagaggcaggttctcactccaagcaaataaagactgcgtctgtactcagaccaatggtccagagcaggcagttggcaaaccggaaaggtaattttcaaccccactcattccataccttctctgatttcgccttcctggcattgtgcacgaacctgcgacccagcttcttagcataccagatagaggcaaacatagcgatgccaatggaaggaattcacaatgaagctgccgcacaatcaacttcccacctcggctcagagacgaacagaatcaggctggagctgtcacttgcaggctgttgctttctcagttcctctcatgctggttagctgagggagagggtgggaggagggaggggttgggggagaaaaggcagtcctgtttggccagtctgcaggtatatttacatcctgccagcaggaggtccgggtgaggcaggcgctgcctttgtagccagctcacacacatccagttggctaagtatttgtctgcagttcttcggcaccggcaccgtcgccaccaaactccatgtgtgtcaggaggaagggaagctgcagtcaagtccggaggcagctcacctccctctctaggcttgggcagttacaatcctcgctttggcttccctctatcttgacagtacgtgctggcggcagtggccacataaagacagatccacatacagcctcgcaggtaaatcagccaatacaggaattgccaggcatggggaagagagctgccaggcaaggggagaggcagaaccaccatgaatctgcccctgcaggcacaaacaggtgtccctggaacccaatcccactcatatcctccaagaggactaagaggactatcagggctgttagggtgactggaaacacaagcatccttctcttttctcctccccagctccatttggtccaaggaatatcacttctctgcccaccagccagccttatccacaacttacaaggtaaacactttatttctttagagaatggcctgggaccaagggcaaagtgagcaggatgaagtctcctcccaaatgcctgagtgaaggtccgtagttttagaagtcattagttgtacctgtaaaagaactgaggcctctattacaggacgattttttgacatagttactggaggatggacaggggttcaaatcgagtgttaaactaaaaagagcaaactactctttttaaaaaaaataaaaaataaaaaataaaaaaacccaggttttcttgtagtgacatccagtgttcagtggatgactgaaatatcacctttggggaggtagatttatggcagcttttaaatcatgctcctttgaagaattttcacatttgattctaacattaactacttccattatcttattagagtttagactattatgtgaggcacctttaagataaggtcaatgctaagagacaactgtttcttccaatgagagataaggttttagccctttgccagtcctaccagaggacaaaaataaactgctcatgatggcaaggaaagcctgccttccagtggcacacaaactagactcaatatagtaaatgttttccagctgatctgacagaagtgccctatgagcaatgaagaatcaaagaatgtcaacacacttgcagacacttggaaaagaacttccttctcttaacaaagtcacttgaggtctatcccttaagagagtttcatctgtggaatcaacaacaacaacaacaacaaaagtatattgtaaaggatgttgaataccctcataggcaattggaggtagaacaagacagtgtaagacaggacattggtagtcagaacccatgttcatgttactcacactaaggtaactcctgtgcctagaacagtgcttagcacaacacatttaatctacgtttattcaaggaatgaatgatcttgtttctgaccctgactttgcttctaatttatttatttgttttctctgggttcgatgtgcctcatctgtaaattaagagaattgggcagatatttttaaagttcctttcctgccctatgagtctatgatcattattgtgggtcttcaaatgatattgaacagaaatctcgagtgctcaccggatacataggctgtggtgaaatgattcagtgtcccaaaaagtcaacagtggtacccctggggtagcccagcttcttctacctcctttgacatgccttgctgccaaccagggtttggtttttccattagctatttcttttgctctatgctcctacaagcactcctttcctttaatttccttttgacactctaaggcaacccctgtgcaaatttatccatattataccctgtactctctggaggaaaagtgccacagaaatccaacgaataaatatacatggtaactcctgcttagttttcaaagagctactcagcaggaccgtagcttactctaatattgctgtgatgtaaaggtatttattatttctgcacacaagttgttccaagccatgttgtagttaaaagtgtattcaactaaaagactaaagtagataaaaagaacggggataaacaatcatccctaagttaatgattagaaaattttgtttttaacaccttagacagaatcagacaataaagaggtgagacaaaatgccttgaactttcaaaccactgatatcatagagagaatcaaaggatgttaatttactctgatgggactgacattataattttttatatctttctataatttttgcattctcttcatgagttaaaacttcatggatcactaaaactaaggcttggagagatctttgatgtttgatcaatttgtttactggttttgcctttatgttgaacctttagtgaccttttttacacacctgaccaagaggctttataaatttttttatagtacaagatccttataaaataaattggccctgccagctaagatttaacttatgacagtaataactattgtttcttaaataggcagttggaggtagaaaacacagtgcagttaggactcgtgttcatgttatgcaaatgctcagtaaacagtagatactcaaaatatatttgtcaaatgcatctatgacaaaatagaaaaatccacaaactgagaaagaccagaagactcaatagaagaatggccataaaattctcagtagcaaaagttgcttgaaagatggatataatgtcaactgaatgaagtcattgccatatttatacaaccatcttccctggctctctgtgggcagatgtgtctgctgtaaaggtggcagcttcctacagttaatcctactagtctctaaccattgctctgctgattgagataaataacatttgcagctctgctgtataagtaaaacaaatttttcagacattttccatctgtatataatcagtacctggacagaccttttcctttataattttatttttaaagcctctcctatgacggaaacctaccagtgcagctgagtttgagatgcaacagtaatccatttaagcagctttgggttcatgcctcaacacacacactatgtgagcctcctctgaattctcaaggtaaatacaatgtttaaatcaagccattaactatcatacattttctgcctagcacatgaatgatttttgtttaaaaataatctatttatatcagagataattatttttaaaaacagagccaaaattcaatccaaggaattaatatctggtggcctgaaaagctatgtaatttcagtgttgaatatagaccaaacaaaataactattgagacataagtaagttaatgtaaaaaattaattgtacaaagattttgattggtttgtttgcatatttgatatgtatatttgatagtcctttggctaatgtctgatgttagtaaattattattattattattattattactattttgagacaagaccttgttctgtcacccaggatggagtgcagtgttacgatcatagctcactgcagccttgaactcctgggctcaagtaatcttcctccctcagcctccagggtaggtaggacagtaggcacataccatcatgcttggctaatttttaaattttttctctttctagagatgaggtcttgctatattgcccaggctggtcttgaactcctggcctcaagtgatcctcgtaccttgggttctccaagcgattagctgattattaaacaaaagggtggaatatatagtacgtagaatattttggtaaagaatatgtacataatatttaacttcaattcagaggaatgccaagatcttgatattagttacttctatacaaactagtagaaaggggaagattaaaacagttatattttgctctaagtatatatgtatcatgtgactcatctacataacatattctcattagtacttgtgtgactgaaaatgtaaacaatgcttttccacaaaaatgtattgagtattactacatgtcaaaccttaagggcctataaatgaataaagtacaatctttttctcaaagagccctatatagctggggacacatatctatgaataaataaatctcaggtgtaagaaaggggtccagtttcagttttctgtatatggctagccagttttcccaacaccatttattaaataggggatcctttccccattgcttgtttttgtcaggtttgtcaaagatcagaaggttgtagatgtgtggtgttatttctgaggcctgtgttctgtcccattggtctatatatctgttttggtaccagtaccatgctgttttggttactgtagtcttatagtatagtttgaaatcaggtaatgtgatgcctccagctttgttctttttggctgggattttctcggctatacaggctcttttttcattctatatgaaatttaaagtagtttttttctgattctgtgaagaaagtcaatgatagcttgatggggatagcattgaatctataaattactttgggcagtatggccattttcacgatattgattcttcctgtccatgaccatggaatgtttttccatttgtttgtgttctcttatttccttgagcagtggtttgtttttctccttgaaggggtcctttatacaccatagaatactatacatccataaaaaggatgaattcatgcagggacatggatgaaggtggaaaccatcattcttagcaaagtaacacaggaacagaaaaccaaataccacatgttctcactcataagtgggagttgaacaatgagaacacatggacccagggaggggaacatcacacactgaggcctgtcagtgggtgcgggaggctaggggagggatagcattaggaaaaatacctaatgtagatgacaagttgatgggtgcagcaaaccaccacggcacatgtatacctatctaacaaacttgcacacctatctaacaaacttgcacattctgcacatgtatcccagaacttaagtataattaaaaaaaaagaaagaaagaaagaaagaaagaaagaaatttcagtgaagaatggccttgttacaaatgtatgatgctcagggataaaattactgattttcggtatttatatgatataaactcactaataaatattagctggaaaaagtgcaataattagtgctaatgtatattaaaaagcaaagcaaaggaatagctacatgtctttgcatgttttatcactatggacaataggaaaaaattgtcactatgaatttatatgtatatcacagtcaatgctacaaactggcccggctgcagatggatatatttctgcaccgaagaaatacccagttatagataagtgtgaaaaaaagattccaaataataaacccactaactctaattataaatgaacaaagcctatatctttttctcctcttaaaatcatcaaaactcattcttcaacagttgaatgtataatgtgcctcttctttcatatgtttaatcataacatacttggcatcagaaatgtaaagaacctaatgtaacatttaccttccatccagatttaataaatgttaatattttgtcatatttgattcagattaattttttaagaaataagttcttcataatataggtaaaatctccaccctacctcctcaaattcatttcaaaataattttcaataaacactcttgtagctctctctttaagtacatacaagtttctttagagcaggtccttcaaaatgtaattggtggatcacagaatatgtccagctttaatgctattcattacaaattgttctccagttgccattattagtaatttaaatgagtagtatatattagtagtttataagagatcagtattctatataacacagtgtaatcagacattcatgtttccgaaacataatatataatgttaactctttgtagtcttgatatgcattttcttgattactggtgagacttaagatgttttcatacatttattggttatttgaacttccttctgttcataccccttgcccatttttaaatagggttatatttttcttattgacttgtgaagtacttgatgtatactgaacactaatcttttattatgggttttgaaaatatctgtttccaatctctgacttgtcttagttttattcatgttttgtcatacagagccttcataaaaattaaaaggactgaagtttttcagtgttttatgtttacatttttatcatttttttctctcttctaagtttataaatattttattttctttctaagcaatttaaatgttttgcttttcatcaataagtctccaaagttttttttttttttaatttacagtgaaaggaacaagatcttgtccttttcagggacatgaatggagctgaaagcctttatcatcagccaattaatgcaggaacagaaaacccaacactgcatgttctcacttataagtgggagctgaatgatgagaacacatggacacatggttggggcagggtaaacaacatacactggggcctatcgggtgtgggcagggaaagggggagcatcaggaagaacagctcattggtgctgggcttatatctaggtgatgggttggtgatctgcgcagcaaaacaccatggctcatgtttccctatgtaacaaacctgcacatcctgcacatgtacccaataacttaaaaggtgataaaataaaatattaaaataacaattaaaaatagtaatttatggtggaaggtaggaatctatatttttcccatatgtatggccagttttatttatttatttacttatttatttacttgcttacttcattagctgatatataataatgcttttccttttccttactgatttctaatgtccctgagttatatatctagataatatgtatgtgcatataattgtttcctggctttttaacaattatcctatttttatttacctgtgccagtactacattatgtatgctttatagtaaatactgttacttgaagggtgattcatccttttcacttgatctaacttttcaagttaattttcataaatttgtacaatagagcacttttatagtatctgcaaaatgtcatgttattattgtatacttttttttttttttttctttgagacagagtttcactcttgtcgtccagattggaatgcaatggcaatctcggctcactgcaacctccgcttcccaggttgaagcgattctcctgcctccgcctcccgaatagctgggattacaggcacgtgccaccacgccgagctaatttttgtatttttagtagagacagggttccattatgttggccaggctgatctcaaactcctgacctcaggcagaccaggtaatccgcctgcctcggcttcccaaagtactgggattacaggcgtgagccactgcacttagcctattgtacgctattttaattttatcttgctatagtagttacattccccaccaaatcagtcattattattatcaccattatcattttttgttatagtttactcacaataactatcagttaacttctttatttttagaatcctaacccctctttctggattaaattttcttcttacagataaatacattttaatagtctttctgcaaaaatcaatgatgtttaaacatacccaatcatttatattttccctgaactgaatgatagtagactagactttgaatgagagtatagaaacagatttgtaaatcgacaatgattttccctcagagctttgaagatattaacctgctgcctatttgctgcctgttacaagaaatatgtctttcttaatatggtttgcataaatacttttttttgcctttcttgaacttcggttttactataatattttcttttttaaaaaatgtacatggaactcattctgtttctttaatctgattatttataaaataagtctcagtcatggccgggcgcggtggctcacgcctgtaatcccagcactttgggaggccgaggcgggtggatcactagctcaggagatcgagaccatcctggctaacatggtgaaaccccgtctctactaaaaatacaaaaaattagccgggtgtggtagcgggcgcctgtagtcccagctgctcgggaggctgaggcaggagaatggcgtgaacccgggaggcggagcttgcagtgagccgagatggtgtcactgcactccaggctgggcgacagagtgagacttcgcctcaaaaaaaaaaaaaaaaaaaaaaaatacgtctcagtcattaactcttcaaatatttattttccctcactctcattattctcttaaattctgttatgttttttctggaccattttattctacccgtactattgcttcatagagctcatatttttttctccttcctcctctgtgctgctttcagggtatatcctcagatctaattactattttctaatttctatttttaccttaaatttcaatttattgttttttacctacctacagagtatccatttttaatcaattgtttataccatttttatttttagacattctatatatatttttaaatctatcatgttctgtttttattatgatttttcttcctttatcatgattttaatttaacacatacttagtttgtagtctttatctgatatttttattccctaattttcctgaacgtctaatctcactggtttcactcatggtgagtattttctgcatcgtattgtacatttttattctgagattatctttagaaagattatagtttctgtgggagtccctgcgaccttcagttgtgcaactgttgctacagaataattttgcacatccctcttctagttgtccagagatttcactagcccaagagcagtttcatatcaattttttttttttttgacttggagctatactctccccacaaaatagggttgggtttaaatttactctttttttttctttttccactcctaatagaaacatgcatccttgttgctaccctgggctggtgaataaagtttttaaaaagtcctttcacaaatgagaatccttttatgttttcagttttatgcaacagtctcagtttcatttcccttcctttggtgatcctaacgtcaagtgtcctgccctgaatgtccatcaaaaccctacactctcaccctaaatgcctttattgagtcccatacacccctgggataccatagtcagttcaggatctcactgctgtggccatcattatacacaaacacaaacaagtccacgtggcatccctctaaattaacccaaaatcaaactagatcatttaactagcctgcaaatgaggctttagagtttaataagtatgtgtggtaacaacatgtataagatttattgttaagtgtttcctgcaagagatttggggaaatcaactaattaaaatgttagtcaaaagtcaccatattataatagttaattagctaaactacgctgtaagacagaccaccaccatcattattgtgaccttggaaaagttatgctaactttataaaatgggggtaataacggaaactatgtaacagtattgataataggagcaaatgagataatacatatacactatttggagtagttctggcacatagcctgagtgcaataaaaatactgcttttatttttattcatattccaatctttaaggaagacaaaatcacaatagtctagacagacagtacatgctcaatattatgaaaagaagccgaaaagaatgatttctaaaagctctttataattctgtttaatcatcctgtgaggaaagtctaccttctttctgcttcagtgttttctccccttttatgccattagcaaagaaaacaaatcagttgcaaacttgtaaaaatatttcataaatttaaagtcttccaggttcccatgtgtctcttttctgagacaaataaatatcttcttgagccttatgagtagttttttctttctttttcttttctaagttttatttatttatttatttatttagagaatctttccagagcctcaaaagaaggcttgcaggacctcttgtaagaacaaaaactcaaatgggtcctaaacttatatagtagatctgaattaatatgctgtgatttaccacccatgtgttcatgtgttcaaaattaaattttcttacagcagaaaaatagactgataatggcagtaactatcaaaaggaacgtagagctgggaagacatagctcctcacgagcaatgtagaaaaatatcaagccagcagtcaagaaggaatatctaatggaacattagaactttgacttgtgagcacaaacaacaatgcataaataaggccatttttttgaaacagctacacagtgctaaagatgcctaatttaataatttagtaactgagaatgcaattcaatatctttaaattcacatgctcttccaaagcatgcaaaaaacacagacatttaaacaccactcacctaacctgactgctttggaatgggaactttcttttaagtaaaattcagttagcctggtattctagctatctcaacaacagaattattttcataattcatggaggtgaagtgctagttttggaagcaatagtcttagttttaatttcatttccatcagttgtcacatctctgggtattgaactacataatcaattccttatgagctcaaataatgtattagtccatgacatttatgagcaataattaatgagtaatacaataatctcttaaatccggtggccatttttgatgaagttgtatttttgccataccatccctttggatcttcacaaaattattttctgtttccccaatgtgctctataaatttgtacctttgaacatgctgtttctgctgtctgcagccctatccaccttactttctgctccttgtcattttatatgtgacaaatcttgacaaattttctgagatgtggctaaataaatgtctatgaaaatttttccagataaccaccagacagagccagtaactctcttctatgtcccttattgtactttgtacataactcagatttagttcttattatatttacttgtaattactttgagcttatgtttccctccgaacgcctatgaaacactcaagaaaagtaacataccttatttattttcgtatcctcggagacctacatagtcctccacacgtggtaggtaataataactatcttttgaataatttaatagttgtttgcttaatgaatgaacaaatgaatgaagcatatcacttgaatacaacagcttcacactcctatgagaagaaaggaaggcactatacagagacctatctagcatttgttattaccctctatttgcatttttaccttatactcatcttcataccataagagacaagtcattgtaacaagtgttcaaagtgcttcagaaaacaccatttctaaaggtaaatcactgacacttattgatacatggacctataagctgtcacattttttttactttgtaattcctactctttcacagtaacaagtgatcttttgcaaaatacaataaataaaaccaatttatacagtaataaataaaatccctttttatttccttaaaaatgagatccactaatgaaaacatacaaatcatttcattttccatcctgccacctacataaaacagaaagagcagctgctgaaatcttcaatgccaatatcaattacagatagtgttgctgaaaatattcctgatattaactgcaacctctctccagcttaaaaaatatacaaagttttaaaaaaggtgtaatagcatcatcttgttatatacttcatggctaactagatagaaaaggggagactgaattgttagttgtattctatatgtcagctatttttatgttaagcatctttatatgaagttaaaagtgccttgactttaagatgcacaaagtattttgtccactaaagtacttaacatgcatttccttagtattggtctaacatcagccatttttaaaatgtttacatactatctttattgttgtttacttatgttattttaaaatttaatttgactcactttttatttaaataaatttattttaaaagggaacttattgccatccgaataaacacaagggtttgttttcataaataaataaccatataaataacacaataaaaataaaatactaatcacattaagaagtaaaataaaaacaagtaattttaaagtctaattgaaaagatgatggttgatactgaagttacaatttttaagtaattacattaaaattaaagtataagtatgtttttaaagatgttttccatctaccatcttatgtatatcatacttcaagaaatactctcaactaatttaatcctcacaaaaaatacctgagtcagataatatcaaattcctttcacaaatttaggaaactaaatttcagaggaattgattaacttattcaaggtcatttgcctagaggaattaagctttgaatcctggtttgcttctcacttgcttccagattttcaaaccctgtctgactctcaacatccttatctttaagccatggcgtaacagtacaagaaatgtcatgtggtagcttatgacaaaaaaaataaataaaagcagcaagttctatgagttcagagaacattagcccatgagttggattggtgaagacaggcttactgtgagaaagaaaatttgatttagtacttagaaaacagatcagaacaagaagtacttttttttttttttttccagaagaaacagcaggagcaaaagcaagaaggttggaaaacatgagatgtgtttgaggagaaaaataaggcagaaaacactgtacccataattagacaatgtcaataaatgtttaatcatgacaaacatggtcagatttagagatcagggagaatgatgaaggtggtagaaataatgggggccttaattagggggatgatggtagaaataaaggcaaagaccaataaaagaaacattatttcttaatgtcctagactgagttcaaatccctggcccattctcttagtaaaatacactccttttcacaatgtttatcatgttgacaataatctatttaatacatctatttttcatggtttccttgtagggcattccatgaaagcagaggccatgcctgtttattcatcattgtagcctccgtgcctaacaacatgcctggtgcataataagtgttccaaaaaaaaaaaagagttatttaattcatgcttgaaagaagaaataacatagggaacagaatgtgtataactgatctgtaatccaaacctcagcatcacgcaatatacccatgtaacaaacctgcacatgtaccctttaatctaaataaaatttgaaattattttttaaaaatctgtaaaatttgactgctgctttataggctgagaaaaaaaagtcaagcagctaaagagttgagcccaggggacttcaagttatctgtaagacgaaggaaaaattttcatttgcatggcctcttctttcattataaatgtttgtatttcttcccttgtctcttcaatccttttaccttctaatattataggctgcatctaaactttcgttaaattaatgtcttagaaatttaattatctcattaaatttctcatggtccacaatttccatttaaggcttctatattttctttgtaaactcttctaaagcagataattattttttcttgtttttgaaatggagaagtgttgtcaattattttattttttctaattcattgtttgcccttgggagcttatgctgtgcctagggggacatccacattcatgtaaaaaatgaaagcgttcatgatatgctaagttttagatatattcagattttaatgcccctggaaaactcgggagtatatatgtctaataagcaatgtgataaagtaatccctcctccacttatttatttattcaacaaatcctaatttgaatgttacgatgcaccaacctgtttataagcaatggggtcgtaacaatgaacaaaacagacaacaatccctacctcatggagcttacattgtattgcagaaaagagatagtacaaaagataaatagaaaaatgtagtctcttcaatagtgatacaagctaaagagaaaaataaagcagataaatggaataaaaggtgttgggaatggttaaatttttctgataagttgattaaggtaaagctcagtaagattaaggaagtgacagcaagccaggaagatatctggggaaagagtatgtgaaggccttaagaagggactgtttgaactcacagatctatcacattctagatatggttttttgaaaaagtagatgaatctagatgaatgaatagaggtatattcatgtgaaatatggtgaatggtcattttcatcttcaagtaaaattgtaattgttcctgtattaaataaactgaaaggttaacaaaaaaaaaaagaaggaagaaggaggaggaggagatgaggaagaggaggaggagaaaaggaagaggaagaggaggaggaggacgacgatgaagactagggctaccatttgacaacagtaaggagaacagcatggctaaaacagaatgaggaggaaaatggtacaaaataagattggagagctagacaggtaggtgaaggaagaagtgtggaaagcagatcttgtaagcctcataagctactgtgggcaatctggcttttgctatgaatgagacaggaagcaatctaagagcaataccatgatatgactaatgttttaataggattactcctgctgtcttaaaaattttgactctaggggatcaaggcttggagcagggagaacagttaagaattattacagttatcaaattcaaaaggaatagtaacttggaaaaactaattaatatgaaaatttttaaaaagtggttgggttctggacatagtttgaaggtagatccaacagattgtatgctacactgaatgtagcctgtgagaaaaagaggagtggcacagatgactccaaacattttgacctgataaaccagaaaggtcatctcatcaccagctcaaaggaaagctgtggatggagcaggttttgtaagaaacataagaagttaggttctgacaacctggtatggtggtgtgcacctgtaattccagctactcaggttggggcatgagctcaggagtttgagttcagcctctacaatgtagcaagaccccatctccaaataaataaataaaagtttaaaaaagaattacaaatggatcgtatactcagaaaaatatatttaaaaaatacagaaaagataaatatttaagattataggtattccaatcaccctgatttgattatatgaacgtatcagattatcacacgtaccccaaaaatatgtatatctactatgtataaattttcaaaaaaaaataaatttaaaaaaagaagttaggttctggacatgttaacttggagatatcttttagacatctgactgaagacatcaagtaagccactggatatataagtccagagtttgaggaagatatcaaaatagaaatggtatgtaaagccttgatcactggctgaagtagagaaaaagcttaaagatcaagtccttgagcatttcattgtttacaattatctatttaatacatgattttcttactgaactgtaaatcctatgaaatcaatatactgaaagagggataagaaagttgaggttctatgtaatggaactggttataaagaattttcctagagtttaagcttggtagaaaaggtagtaaggctagaagagaaatgggaaccagataaaagatgataggatcaataattataagaccaggtaaggcccaaaagtttgttggagttaaggttccaacaagtatttcaggtttatattgtagatattttgcttcgtgtggttaagatgactaccaaatctaacatttatcaagttttaaaatatgaatcaagtacttaactacttatcttatttaattttcaaagaattcagtgtggtaactcctatttttgttcccattttacacgtaagtaaactaaaagaaatgaagtaccttgttgggggttgacactcaaccaacaatggcacattccgcatgcaagccaaaatctaactcagaatctctgctcttaaccacaagtaggggcagaatgcctatcatatggtctctgttttccttggaggagggtctgtagcctctgtgaacctgttagctatgttgaggatcagaagccgttcttcttattttctgtactcatttcctttgttgttttctttggtatttggtgcagtctttgcaaaattctattctgccacagaggagttgaagaaagtcaaataaaggctttattcatgacaggctagatcatataaggagatagttctacctgaggttgcctcagggaaaaaataattcaggaggactgagttagggtacttttatccagtgtcccatctgcacagtctcataaaaagatgactaaagaagataattagccaattagcagtatgaattgaaaagctgaatctccagaggaagatgataaggtacaaaggaaggaggaagaagaaggcaaaaatttaggagctattctcatggaaggaatgactgtcctctgagaagaaatagatatattcttactacccatggaactcaggaaattgtctagcctctgatactttcaaaaatgtaaatgtagaatagaacaatcgctttgggaatgttaaatactgcaaccacttcagaaatgtttgggagtttctgaaaaagctaaacatatgcctaaaatatgagccagcaagtccactccaaagcatttaagcaagagaaataaaagcatatgttcattcaaaattatacccaaattttataatagctgtattttcaatatcccaaaactggaataaaaaaccaatgttccttaagagggaataaatatattgtattgtatttataaaatgaaatactgctcagcaataaaaagaaccatattatttacatgagcaaaagcatggacaaatctccaaataatccagctgagaaaataagccaaataaaaaagcacattttgcatgattccatttatataaagtactggaagatgcaaacaaatttatagtgacagaaagcttataagtggttgatcaatgataggatgagagaaggaaggctttacacaagagcaaaagggaactttaggggatgatggatgtattcattctcttgtttgtggtgatgattttacaggtgtagatatatgtcaagatctatcagattgcacttgaaatatgtgcaattttatgccaattattcttcaataaggacacttagcatctaaaacttgaaaacgttttgctttcttaaaaaggtggaataaaaaatgacttcataataaagaaatataaaataataaagaaaacagggggaaactaaaataatttgtcaaacatttctatttccttttttattctatttcagcctaacttctgttcttctattcctcacctacagcaattttcctaatgaaatttcacacctgtccatttctgacaccatttaacgtttagtaataatgcaagtgttaacaatgtattttgggtatatgtttctgtgtggcctgcattgcaagtagattcataaagaatttcagaaatcccaattctatttttcttttccattttattcagtttggttttggtgtagaaaaagacttaagcagtgtacctaattttaatttccaaaattgattttctactctattttctgctgcttgcttaggaaacaaaatttaccaagtctatctcctaaatgattaacctcagcaacctttggcaagcaaactattctaagagaccctgggactgtgttatgctccctctctttgcccaaatgcatttttaaaaaaagttagaaatcaaaggaaaaatgtggaagtgaaaaagaagccaagtggttaaaaaaaaatagaaagaaagtatcactaaggatcatacatacaacacatactagacttttattctacttttcattgggcatttaaaaaggcatagccgctatttgaaaatatattcaagggcttaacagcaaatccaaattaggactccacatccaggaacatttgggaattcaactgtatcatctaagaaagtcttttctgatggggaagggctgcttcagattcaggaatacaggccaaaaagatcaatttgtttcctgtcggcacagctcaaattgcattcttgacttcacagcactgagatctttccagcacatccattaaaggaatttggctcacattaaggttgtgtgtaagacctaacatccatgaaaatgagcataaccctcatcaagcaagtatggaacactggattctgagcaggagggccttcatgtcgctttgcatgaaaagcctgttgacaatcttatggtgactatattcaggcattttgataaggcaacttacattccctcagctcattcactgaagctgcatggaccaaatttttaataaatgtatttagaagcatggataagtagttacccatgatatgaatcatgacaagtagctatgcaaggaagtaatgccttagaatcagatacgtttggcccagacatatggtggaagaatgccctagttttcaccctaaatagacttgtgtttctttttctacaaatgttctaggagcctatctcatataattcccataatgatgataaataacattaattaattatttgatatgtgcaaggcattgtgctaagtgctttacaggaagttcatacctcatcacaactttgtgaagtcatgaactaactttatccttttgctacagatctcctaactggtcactgctttggtccttgggctttaaaaacaccacatacattatcttctcaggtctcattctttgctctaacctattcctgaaattctctttcccaaatattcatatggtcactccttcaagtcttcactaaagtgacacattttcaatgaatctgttcctttggatgtgctcttatttttaaacattgcacttatcagcttctaacagcgtatttcacttatttattttgtttcttctcttcccatcctcactagaatgcaagttctgtgaagggagaaattttagccttttttgctcattagatagaaggatgcttgatgtattgtagatgctcatcaaatatttggaagtggtaaaaggaagtgatgtggttttaagtaacaaccacttgttataagttagtatttaaaaaaaaggtacagcaacattttaaaataaattattgtttttagtttaaggttagccaagagttatgctaataagccatattcagacaattttatccaaacttactttgcaaaacaacaggttaagcaatttaactaagtgggcaataattctgagtttattaacaggtattaggtacaaaaaccatatgtgacctcctaaagtttctaatcttgttgagaacagaaaacataaaacctgaaataattcaaagacaatatatcaaatagttatcatttattcattcatataaaaagtactatctccatatgcaaggaattctgggctagatgcaggaggtgtagaaatgaataagacatagttcctgacttcagggagttgacagtctggtaagagattggatatactacaaaataaaacttgtttagtggaataacaactcgataaatggaataaaatgtgctaaaattcagtaaaaatacaaaatgttttgagaattcatagagggagaaattacaaagacagtatattacaaagtgctaaactaaatataatcaaatgccaaactgtatggcagagacactaaaatgctattgcctgttactcctgcaattgaaatacaccagggattttagtaagctttcatgcagaaaataacatatgccaagactcatatttctcttatttccctgtgaaaaggcattgaacattaaacagagtgcgaccctgaatgatgtttccagctgtttctgagagcaatttcataacctcagttttattcttctctctcacgttttttcaaacgaactaaagagaaagcctattgttaattttccaaagttatatttataattaaattcgtgcaaaattgattaaatacaacaaatctcataaataccaatttttacattgcatgtaaactattatcttctaaaaatgaagcaatacatagaatacatctatattttaatatttgtcttattttttctaattttttaactgttgctgattattatagaaaatctgaacacatacaacataaaaataaaattcatctgcaagcctgttatctacgtaaatgatagtaaattggtatattgctttctgtatacaggtacagatatagacgcagatgtagatataaatgtagagactggcatagctactaattataattttcctaatctattagtgtaagaaattgtacaccatctaatgtgcttcagagctatgatttcctgtggctgaataatattccatctcatgaatgtgtcaactattacaaacaatactgtgataaaataagtatacaaaatgctgatttggtttcctgattattattcctggaataagaattaatgactaaaatggtaaaaatatttttgagacttctgctaagtgttgccaaattgccttccaaaacattaaaatgaagtaaatcctgttcagaagtatccaagtgatcatcgtcctccagtcttgtcacctggaatattgtcatattcttttcctaatctttgccaaattgatagcttaaaatcagtacccattggtattttatttatattatcttaaatgctgttagaatgttattaatttatttgaatttgttgtaatttttgtgaattgtttaggatgttggtgatttttgaattgatctgttaagagctctttagagtttaaatataataactttttttatttgtggcttttctactttttctattttaaacatagtattttgaagttcttatgtagtcaaatctattcattctttgtgaattcttctgttgcatttacgattagaatgtccttcaaagccaagatcagttaagtatgaagttttcatgattttatttttacattagcctatcaatatctttgtaattaagttggtatttaattataaaaattactggtaatatttattgagtgaatactttgtcaagcagtacacgaaattctttacatgaattatctcctacttagtcctcataaacaccttatgaggtaataacaatccccatttttcatgtgaagaaactaaagttcagagagatagaattacatatccaaggttatacacctagtaaatgatggagtcagagtttgaactccagcagtccctaagcctgcactcttaactactctttttttttgctaatatgacatggatctaacaatttttcagcacattgtcaattttatgaacactatgttttgaataatctatcagtttcctctttgattcgcatttcttccttcatcatatatgacattaccatacatactaagctctattccacacgtagccattctattggtctgtcagccagttcttgcaccagcagtataccattttaattgttgtatctttgtaatgttaattaatatataataggacaaatagcccacttactgttataccttttgacaaataatatcacttctctatttattatcccaagtaaacattataatcctttcattagttaaaataatttattatttggccatcaataaattgtattaagtattagaaatttttaggtgtatgtacttatggggtacataataggttgtttctgaaaaaattaatactagaaaatttaactttttttcaacttttatattttatattctggaatatgggctgccccataattttgccattaagttgaacgacatttgacaagagttggtaagattttgtagttttattcatctatatcctgcatagctatattagagttatttctaggtaggttgtgttttctgttagtgttataaatctaatttaaaattatattttccattttttgaagtagttagaagtatacatcttttaatacttctatttggcccatatcttgagtttttgacaaaaatacagcaatttaaccttctccctgagatgtaccttattctatttcatgttataattaagttgtcagaaatttcaaataatgttaaagcataataggtatgacaactgtccttactttttccaacttcaatggagattcttttagtctttcaacaataagtatgacagagattgttagcttggagtagcttttctacactatgtcaaatagtgtccttctattttaggttttctgagaaattttgtcaggaatgagttttaaattttatcaaataggattaatatgttttagaatgatacttttttatttttttgatcttcagattctatgttttatggtaatagatttctaattaaaacatctttgccttccagggagtaaactctatttattctaatagatgattcatcaattgactattgcgttgtgtaggatgcattttatttaggatctattcatctttatgaacgagggtaggccatagaattatttttgttcttatcatttttgacatctgggtaatattacttcatcaagtgaagttaatattgcttcatcaagcaaacaaatgaacaaagaaccaatcatatttgaaggatgttctagatacagcattccaagaatgaagatctaaaatttgtactatacacagagttagctcaggtatcacacatctctctcatgttcaaattcactttcttggtggtgccctgttcttagcttttctattagaaaaattatcattataatcagttgattaatacatccatgaattacaacctttttaacactattacttcaaacattaataaatgaatttgggtcagtcaattattaaatatgagtgcatgtgcatgcatgtgtgtggtaattttatttaagtctcagagtagcctaattcacttattcaataaattttatgaagtatatattatatgctaaccatttctctagtgctgatgaggaataagacaggtgaggttcttgcccttgtggagctctttcttagcccatataaataaaaaatgtgaagctgatcaagtaaagcagtttgcctaaatccacattctaagtgaataaattactgcactgaactaccctataagagactcattgaaacattttttaagaagcagcttttgcatatgtgtaacatactttaatcagttcgacctaagggcaggaaaatacatgaaatggcccctgaaaatttcttcagctatatttctggtagttcacaaactctcttaatttagtgaaactgcattaggaagactatgaaaaaaataagaaaattataacaatatgaattttaatccctaaaggttaagtaggagttattgctattacttgtcaagctcaccttcttccaagcctataccatgtgccactatctcattttagcattgtacaaacttttcaaggaagatgttatcactattttatacataagaaaatggaggcttagaatttaagataagatggccaatgaatgccacacatggaacaattaacacagaacacaaatccaggttagtctgtttctataggtattatttttgcctctctgctatgtcttttctatatgcatgtcttatgattagattagttgtaagagtgtagtgtgaaaaatatgttctttttaaaaatttattttaaattatgctttccgataattttaaataaatgaccagaaatagggaaaagttaattaacctgtcaatcaatcatgtataggcagtaatacaaaaatgtttttaaaaattgatataaaataattggatcaatattttcaggacttcattgaagacttgataaatgttcaagataggctttgggtgagaatttagaagtaatataaagagtgaagaacacaaaattaaaagttaactggcagggcttcagcacaactgtattgaatcaatgtatactgaattttttttttcagaatggagaaaggtgccagtttatagtttttttcctgtggtagatagagcaattagttctgggagggcagcaactacattttatgtattgtgtttctaacacctggcacaacacttgccacatagtagccattcagtaaatgcctggataaatgaatgggtgaatgagtctctgtagtcctaaaaaaaaatcagttcagatgataggaaaagacatcagaaagacaggagatcaagatccttggcgaaatgtcatcaacgttaagtagattcttgacttctctatgactcacttttgtcatctgtgaaatgaaaagactgaactaaatgatcccacgagtccttattaagtatataactattataattctataatttataattaataatttcagtttcttactaagccttcttacccatcaaagaggaaaaggtcccatttatcaaaatggttcccaagcagtcagggactttaaccacaaattaaacaatttacaatcttcctggaagttcatgcaagaggtcctatatctcttttatccttagacattctatttgatgactatatatactaacatttttttaaaaaccttttttccaacaactacctaataatgcaaataaacatataaaataactgaaattaattgataaacacagtgaccactgtgcttttaagcatgtacataaatctagttttcttggtagaagaaacattgcccagcctctactactaaaatacttgtccaaaaactaagaaatgaacctatgttaagaaacaaacccttcatgtttcacagggctgtaaagtcacaatttatcacattttcacactcagagtaaaatataagtattaagagggatgccagtttagttccaaagaaatgaaaagacaataggagtggcttattactctctctgttttttaatggtgaacaggaaatgactacatcatcactcacgagggttgaaaatacaaaaattcaataacatgtctaacttcagttagacttcagctgagcaaaactattagtggccaacgtaacaactggtcccagtcttttaaggaaaggtttcagaacctacaaagagtttaataggctactacagatatcacacactgatctttttgcaatgaagaatgatttttgagttttaccaaatttttaacaacgtaagagctagctttcggaagtgtcaagtgcataaatgggagtaggtatttattatataaaatccaattctatttgttacaaggcagtcttcaaagagatgcaatattagagcagaaaagaaatctctgagccagcacctttgacttagggaaaaaaacaatctggatctgagagaggttcagccccttgctcaatgtcacgccaaggagtagagccagttcacagaatttgctttcctactttccagtgcttaattcttttctcttaccaggcagtgtcttttcctcagacagaggcttgtttactacagtattcctcatgggatgtatcctctgagaagccagctgctctgaataaaaataagtcagaaatgagagggtcagagtagggcccatcctcctcaggaatatcagagaagtttgaagagtgggagaaaggagaagagagaaagtgatgctatctcaagaaaaggcctcttgtaggttggtcatatctgagccctctgtgctaaggactgcactcctaatactcttgttgtctggaaaccacaattggcagacagtgcctgagctcaacaccgcttgagacaagagaaggggaggatgaggtagtattgatggactattatttctttgtagatgaaactgcccccactatctgggtgcattgtactttaattacctgattatgatacccaaattaactatgcattcactgagggaagggactatgcccaactcatctctgtatcctcagggtctatcgtgtttgatgtacaatgaatgctggatgaaacaaggaatgtgtgaatgatgcatgttgtacctggaagaaaatccctaatcttgaacacacccgtgggttttcaatattatctgtgtccctgaaaataagaggcatacaataccagacttgatcgacctattatactcttttctttagtagactaagagagaaagggagaagggggaatgtaatccatgtcctcttgccctccacttcgggcataaactgaagttcacctttagtgaatgaattagcaattatgtatacagcaacatacatcaaatatgcaaaatttcaatctaattttactctaaaatattcaaaaatggttacccttgcaatgagttggtcatacagagataatttgtattgggaactaaattgaccgattcgacagacattactgagaagctactatatattaagggctgtgctctgtgctctgggagcatatatgaatattacaagatcctagtctcaagttttgcatattggcatcaggtacacaagcatatcaacagagaataatatgtataatggcagctgctacaacagaggtatgaacaaacaactacagggataaagaggaggcaacaaatgatgctgggtacattcagcttcagacttaagcttctcagtgtggtggtttgccagacagtaaacatgagtactaaccctagctttgtaagaatctagttatgtgatagagcacagagaattaatatccctatatctcaatctcttcagagtttggactttggcatcacatttaagacctggcttaaatggttctatgatttaactatctgttttgactttaggtaatttttttcagtagtgtagagtttagcttttttatcttttcagagcaaaaattatgagtttgcctgcatcaagaggtgaaatgtactgatcatagttcttagcacataataattgctcaataaatgttaactataattattaatattaaattaagataaaaagcttatagtggacttgaataagcttcttctgaatgaaattcaacataaatagatatgaataagagaaaaatgtacacatgtatatagatatacacatatctacatacaaatatgtagtaattaatgttatgttgggaatactttctcccaactcttaagcaaaaatctcaagacaatgcataggaaagggacctcggaatcacatgaatgaccctaaatataaacaaaaaaatccgttataggtcatgacatatttatgattcattgccaaaactgacagaatattccaggttgaacactgttggcccttggaaagtcatagtatgtagaacattaagtcgtactatgtagactatcacagtaaatttaattcaaataataaaccgtcacacacttgattcacttccattatcatggctccacagcaggacatgctgcctgctttggtaactcagagttcttttgtgcaacgaactgtgattacttcataaaggtcaattctcttaaatccctggaaaccatggcatgccaacccaccaagatcacagaagcaattaaaagtgtttaaccgggaaagttgccaggaccagatggcttctgccagtgggtttttgtttttattttaaactgcttaacattaggcaagtggcatttatttgcctcatatctacttactagtggatcttcttcatatttgtaaaagaatgcacattcatcatagagattctcatgttacgtgcaccatgagagacaatgagagtgggccatagagacaatgatagagactttccccatcctcaagcttcattatggcttaaatcagtttaaagtttgccatttatactctaataatatttatgcatgtgaaatctcgcttctataaagggttattcaagaatttttggaattatagtacataggaaaattcatgtattaggaaataacacttttaacaaaataatcatttttatggtacaaaactactctgtgttcttaatatttatagtttaagctaccccaaaccaccacttattcagagtacctctctgacataaatagcagatagacttatttgactgagataaatattttgcctaaatgtatacttaaatcctaccaagacagggtggccatagatcaaatcctagctctgatattttattaataaattgagttttagcaaaccatttatctcataaagcttttgactcttcacttttttaaggggaggctattattatctataattaaaataatttgatgttgccatactactcagattgaatacagaaataaggttgagaaaaagacccagatatatatggaatttagtgtatgataaagttgacatctcaaatcagttataaaaaaaggaatttttaaataaataatattgagacaactgtatagctatttcaaaaaggacaaaactagatcagtacctcacaccataccctaaaataatctccaaatgcatcatagaattggatgttaaataaaggaaaatgtacaagtattagaagaaaagaggaaaacatgattatgaataattttctaataacctaagagaaaagaaagcttttgtaactatgatgcaaacatatgtgctcaatattaaggacatttttcccctaaagatgaataacaaactaaaatgtatttgcagcttatatcacaaacacaaagatctgatcactttaatatagaaagagcctccagaagtctgcaagaaaaccgctaaaagcccaagagaacaatgagcagaagacacaaacgactacatatagaaaaacagaaagacaaatggctcccaaacatatgaaaagatgttcggcatcactgataagagaaacaaaattccactgagatactctttcatgctacaggttggtaaaaattctaatttgataacacgctctgttggcaagaagcagcaggaattctcacatatttctagtgggggtactaagtattagaatacctatgagagtacttttagcaatatctaacaaaagtacatatgactctttcctataattcagaaatcccgtttacaggattctactctatagccatacctctgtaaatacaaaacagcgtatccacaatgttatttgtgacagtatttgttaggataaagtgaataagtaaaaatactaagaaaacaaaaattttagtgtaacagaaaggagtcacaaatataaaagcaagaaattttaagggaacattatgcaatattagatttgaattagaaatatcaatatctacttatgacttttaaaatatatataaatttcctatctttgctcactaaaaggcctaggaatcagtgataccccaatagcaacgaccgtatctagcacaaagatcttggtgtctatttatcattttctactaaaaggagctaggacatcttgtgaaatggctgactctgtatcttgggcagcaaaagttccagaacaagaaagtcaatttgaagggattcccctaggaaaatctgataacaatttgagtatcaaaaagaatgataacgcttttttaaaaattgagaatcatttgtcattattagaattgatttttacaccaacttcttattctaaaagttgctagttaagagaaaagcagtaagtcatagaaataacattttaagataatgaaagaaaacttatttatagaaaaaatgccatgtagaagaaatgacagaattagaagaagcaagctagagagagtaaacgtggcaaaacgctaataattggtgaataaggtgaagcgtgtaaagggatttgtttacttttttttaaacttttctatacgtttttaattattcaaaataaaagttgggagaaaaggccagtggcataggagaaagttggggagacccttttacattaaaacacaccaaacaaataagaaccaaatgaatgcatgaaccataattgaattttgctttatgaaaaaaattgggataaataatttgggtgaatagtaggggaatttgaatagggactagctattaaataatgttagaaagtaactgttaatcatctcttgtgtggtaacaccattatagttttatagaagatgagtattaaaattactatgtctgcaacttactttcaaattgttctgtgaagataatctggctatctacttagggaaagatacatcaaaagactgataattcaataggtagatagataacacatatttggcatactgctaacaattattgaatccaggaaatatgaacatttattgtattattctttcaacattccattcagtttgaaaattaccataataaattgctggaaaaatacaaattaaaaacaatacctactttgcagttttataatggaattaaacatgaataacctaaaaaacaaagtgcacaatacctgatggtgagcagattctccataaatgttattttactcttttcatctttcatactacattttataacacagaaatcaattaatataaggaggagattgggtatgccttattgggttgagtggataactttgggtttagtgcacatgtgattaagtatgttggattaccataaaatggtcccttgacttccatgtgtgttaattggatcttgttggctagttctgaatttcccagaggaagaaaggaatgcaaattttcccactctctgttctagtccttccattcaaactcagccaagtgagaaacaacagtaatcctccctgtgcatgttccctccacacaccaaacctcccacatgtatacccatgctgcaatgatttaacacaccagttgaggactccaaataccacattcttatatctttgcctttaactcccttactcccctgcagccagaactgctgttagtgtttgagatgagtgccttttaacactttcaattttgtccataactgggtccttatcatgggatttaaccaagacatgctttagatcttagctctttctttaaagcaccatgtttctcaaacttacttaggtaaaaaaaatcaaatttaccaagtaggtactagaatatttgtaaaatacacaaaattttagagtttaatatacaaaccaagttccagtttctcctttgttattccattttgctttaaatgttttaatccttgctatttagcctttcataactattccattttgctctagagcagggagactcattgactaatgtaaggaattagtaggaaattagaatcaggtagtaaattcctagttcacctccaagcaccaagtgaagtgacatttcctttgtgaatcttcccaaacactcagacagggaccaaaccagtctatcccagtacttagcatattactagacaacagtcaaggactcattaaataatgactaatctctaataatatttatcatatcatggtataactatttctaatatcagtctatcttcaatggacctaaaattggaaggttttattctggtatagttaaatgatgaataggtttaggaagattaatctggcaaggattaggaagaggaatgagtttgaggaagaacacactgaaggaatagagaaagttgactataagtcactatatgaaatgccacagaaaattcctttagacctagggaccaaatcaaagatcagaaacaatctatacctatccataaaacattaggctgatggcacaggaaagcccagagtcttatttgtatggccttggaattaaagttaaaattcaggaaatcatttaaacctttaaagcctcagcaaaaagtaagacatggtaggagagctatttcagtagcaacaaatccttgcagtagacatttgcatcacatattggtggcaacttctttgttctcattctgtatattgtagtaaatcaacattactatcattaaatatttatccagtacttctgctagattgctgtagcaaaatgattttctaacttatcttcctatctaattatagacaaaatagataatatgaatataaagaggcatgaacacacaacaaataacattaatattgaaatatttgcagccttattaaatagtcacatgggtagaactctatggaaagacaaaaaatataggaaatacagcctcataaaaatcaaatgaaatagagtcatgggttgctgaacaacagagatacattctaagaaatgtgtgttaggtgatttcggtgttgtacgaacatcggaatgtaattacataaacctagatggtatagcccaatacacattgagactatgtaatatagcctattgtttctaggctgtaaacctgtacagcatgttactgtactgaatactgtaggcaattataacacaatggtaagtatttgtgtgtctaaacatatctaaacatagacaaggtatagtaaaagtgtgatataatcttataggacaattgtcatatatgtgatcaatcattgttgactgaaatgttgttatgtggtacatgactgtataaagcacaagtgttggtaaacatagttgaatctaaatcaggaaagataagaggaaaatggaaatactagaaaagaaggtgatagaattggtaaggataagccaagatggatttcaaagaagaggtgaggatagaatggatttcatttaagttgctttcatctgctcatttaatttaccagatgttcataagaactttttcctatttcagccatgttaggtactaaagatctagaaataaataagtcattgttcctgttgtctaggggttcgtagtataatggggaagaatggcatgtcaactaacaattgtcatttactgagataagtgcttggggaggagtttgcagtcagggaagacttcaataaatatatatttgaggctgagtaaaagttggaaagcaagaaatcaaagaacatcattccagtaaaagtaagtatgcaacgtacctatgtaagagatacaattgcataaatggtaaggaccattctccctggcagaggtaaatatatgcacaaataaatgcttgcagactgaatgataaaggaagtttgagatggctcgagtgtgtacaaagaagtgataaaaaaaggtagatgagtaactttatggagggcaaattggaaagaacattttgtggtatgttggtgattttgtattttattctgtaagtactgggcaaagtttctaagaacagacaattagacaaacaatgtagaatgtattaatatatgtattttcaggacaaagatgggcattcctggcactaagacagacagggaaatcaggacagggagccctccctatttttcttatacactgtgctgacttatacactgtgtttccctttttgcttgagctaaaatccccaataaactgcctttctcaagaccatctcaaactcttggtctatttctcttcactgagggccaagaacccatcagctagtaacattctggcaacccagatggaactggggttcccagacccctgacttaatggacaattctccatagtagtagacaagaagccccctgagcactttctgtggtgtctctgctacctagtgagttctctgacagctcagagattacaagggcaccccttgagcaatgctgttcaccccttccctttcctccttatttgtaattgctgctctgatatctccttactctacttttccccttttcctttccttctcctgtagccccctctgtccttctccaacaaccctttctcttttactttctacttatttggctgaaatttaatagccattggctcctgggttctttctgttctggtctggtcagttatggctgaaatctgacagcctttagctctggaatactctcctatttggagagcaagagttgtttgaggaaaggaaaaggggaaaaggagtgaaaggggattccgtagcagcaattttaaatgaggaggaaagggaaggggtgaacagccaatttgaaatctgagctctcaattaggttgtcacagtaaggaattccttcatctgctgatgactttgttttggaaattggtttctttttgttctggtctgtcctcccttcctcaactccctcactctttctatccttaccccctactttcttgtaaaactctctatcttcctcctttctcctcctgctttgaatctgctgttaccaagctactggtgttaagataaaactcactgttgcaaagttacttaaaagattttgtttttcttatacagttcagccagttctggctaaaatagtagcattagaaactgatttaaaattaaggaaaaaaaaagaaagataaaagaggttttaaaaatcacaactgtcatgaaaatgacattacccaaattccggtccccaaatttccttgaattacctattggagcaaatcaagtgtagccatgtgaaaaggtcccagtttcgtcagaaatatttagaataagctatctttcctaaaatgattagttcgtattgctatcttatggctacaatcccaacataaaagcgattggatctcagtgtgcctgtatacatgtttaaatatgtttatgtgtatatacatataatatgtattgtgtctagcatgctacctattggctcatacataaaccagcactcaaaaattaagtcaaaatgcttttcaagttcacatgaatctttaggatataaaactggttttaaaaatctttggtgagataaatattaaaatgttttcagaaatatcagcatacagttgtgtctcgataagtttaatatttgcctctgctaaatgtttaatatgtcagattttggcacagactttataagactataaacccagccaaaacagggtaatttttgtttgtgtaatccttttaacaaataagactaatttaaaatttgtagttcaataaaaacaattaaatctgaattattggcaaaatgtatttaacttcaaggatcttatttagatgttcacctaatgttcatacttaagcccatctcaaactcttggtctacttctatttattgagggtcaaaaactaggtgttgacaacatatttggggtatacttaatcaagggcaggttgtgagaatatgaccataccagcaactgaaaatatatttctgataaatatttatagatatatatacttctgataaatatttatcctcaaatcttgctaattcgagagattatcacttaattttttcacaaataaaatatttatcattatagttacacaatgaattatcactaaacctcattcttgcaacacaagaataaacgttacaacatgtaaaatacttcaagtaagccagaaaaattgcccaacatagagtggcagtaatgccaaagctagaaggaacttagagtgtgtctagtctaatctccttaatttacaaatgggagatagatatggagagttgtcatatgacttgtctaaagttcattcacctcgtatttggtagtaccaaagctttaaattttcttttctgactcctgattcaatgcttgttctgcaacagttgactgacaccattcaatgaagggggggtttctctaagaatgtggctctggtgaatccttgtccactaggattgcattgcagtcccctcattttgaggccactaaagcctagctctcacacaaattgcctaggtgaatctaacagcatttttacctcctgatacaaaaagatggttctgcagaatgacatgaagcttcttggagggaagtgtgcaggtgtctcttcttaagacattgttcctggagaaggcagattatcctaacagagactaagtgtatgctctaaactactatcttgatgtcattgacagaaactatacaataaatgggtattgcatggaagaatgccatcactcttacttggtaatgtcatgtgagcagaaaatagtaagaattagctctattagaagtattctaaagccattttctccagaggtaattgaaaaaaaatctagctagctagcatatccagccagatttgcttttgaaaacactttcaaaagaaactctctgaaaagtaagtgatttccctgtttcctttatatgttgtagaaatggcactaaatactttaagtcagagtaaaagaaggaatctgctgatacctggaaacacggaattaacataagtttttaaattcattgttattctaagcatcctcaatatttatgccttaaaagcaattatttctccaaaggttaatcagagtattaatctttatatctaggtaaaactcatttatgttattcactattggtgagctatggattttcagctgtgtttctcagagaggtggtaaaagtagttcattctcctatttatgtcatcctgccacaatgagcatgcagttgttcaattcataccttccatgtggggtatgactctgaaaacctcctctttcatacttatttgtttctctcaacatcacctttctcacaatcccatttctgatcccttgtatcaagtgggatctcctctgactctgaatatccacagccctctccttattataaacagtgccaggatggggaagaaagggacaaacatgtatgtgttccttcattgctgcaagcagtatgtgacccagtttacagatgcacccaacaaaagattaattttcattaaataattttaatgctatctaatttaatcctcacaacaatgatttgatgatattattaaaaactgtacatactatgacacttcgcatttctctggaagcctttctgttttattattgtgactcctctaaggatgatttgtgtgtaaggagaattaagaggccccagggctgttttctggcacttgcttgaatttcactttttgccaatgagtgtgttgaagccaactcctatagacaatatattctctttatcatgtgagataggattcccattctatacatgaggcaacaggctcagataaataaatttgtccaaattaacacagccaattggtagcagattctgaatacaaatatgggttttctcttagttgctgttactgctgctactactaccagtagtagtagcactattattttacaactatgatcttatgccacagtaaattgtttaagtccaatttttaaatcataatcttcttgaagagtggggccatggcctttttatatttgtcaaattcaagtgaatataatagaatcaaagggaggtcatattaacttctaaccaaacacttgcccttattgaaaaatgcttttgtctaactcttacctcctttgtgataagatacagactatcaaaaccaaaactgaagtgaaatgaaaaacaatccatcagccaggtctcttgttataattcactcttcatttctgtaatttaaaaatgacatttgctatgaccataaaatctgctagatgttaccaaaaatatagaagcatgagctgatagcacatgttgagctccaacgagttgtaaccaataggttattttgttcttggctggcacagcctggcttctgtgtccaagataagacatgtgacgtctgtctttccttctccaaaaccatgttgtagcagtgtatctcattaaaaaaaatattacaacacatttttcttttctgatatgtgatgttctaaaatgtttctgtcttccaaagggtatcaataagcatttggggagaaatactaacattttttgcggtcaaatagacgtagtttagaaagaaaaaaagcaaattacctactgtgacactggccatatctctggaaggctttctattttattatggggactcctctaagggtgatttgtgtctcaggggaataaagtggtcccagggctgttttctggcacttgttcaaattttactctttgccagtgggtgtgttgaagcagtctcctatagacaagtgagagacaattgttttgcaacctagttgttaacatgttggtagcttgtgggagtattcacaccatagatatcatgctacaaatcagggacccccaattttttgagagcctgtttagagagcatcactgcatttaactctggtaaattgtatacaaacaactagtgtaaaattataaagagataggaatgcactggggcacaatgtctggttgtgcaagctgttgtgtgcccaaagaaacccacctggggataagtgaaaacagaaatgcaattcacactctggtgcccaagctgtgtgctgtggcatggtactgtgacctcctaggggaggttatatttttccattttgcaaaaatgtgccttgtgagttatcgatggttctgtttaagtccgattgtatacatccctacactgatgctccccaggccaccatctgcagtgtaacaactgctgattacatgaggtatataattctttatgcaccctgtacttcaaataacaagaaataataagataataaaattctagttattatctactctctaagaacatatgtatttattttatacatgagtaccctgttgttcagagaagttaggaaacttgttcaaaatcacataactaataaaagagcagcagttcaactcacatctatctgactctaacatctccccaaatggcttgtgtgctgaccttcacttgacatgactggaaattatttctttagagtacaagttacaggaaaaggttttaaatctataataaacaaacaaatacttacaaaatagactgcattttttcaaaacaaatatttcataattttcctcttttaatcatttcaactgcattctttacttatttatggagaacaaaatccaagctcagaaaaattagagattaagaaatccaagctcagaaaattagagttcattaatactgaaaagctatgacattcaaccaatcaaacaccaataacaagcaacacttgtgcagaattttacagtttacaaatgttaattgttcaagaaaaaataaagcaagagtgatgctatgtgatttctgaagctaggtcataagatggatatgaattctgtttggctgtctcccaggaggcttgcctttggaattcaacctttatgttgtgagaagtccaggccacatggagaagccatgtgtagctgttccagactatagtcctagtaaagaaatcagcagagagccagcaccaactgccaaacatttgaatgaatgaaccagcagatgattccagcctctttgtgtcttcccactgagggcttagacattcagagtgcagacatatcatccctgctgtgtcttatctgaatgcctggccacagaagcatgagagataataaatgtttgttttaatacactaagatttggggaaatacactaatacaccatgcagaatagataacaaatacagtaatctttagacagaccgcaggaaacactagcagacacactaaaatcgtgcctgaaatatagtggacactgaacaaataattgttgaatgaataaaagaagcccaatataaaaataatgtaggcttctatagtctgagtagaaccacaacttttactgaccaatatctctttttgtcttttccttttaaataatggcaactttgggctggagggagtgactcgtgcctgtaatcccagctctttgggaggctgaagtgggtggataacctgaggcctggagttcgagaccagcctggacaacatggagaagccctgtctctactaaaaatacaaaaattggccaggcatggtggtacatgcctgtaatcccagctactcaggaggctgaggcaggagaattgcttgaacccaggaggcagaggttgcagtgagccaattttgtgtcattgtactccaacctgggcaacaagagagaaaatctgtctcaagaaaaataaataaataaataatgatggcaacttcctctccaaaaccattaagaaaacaatcccagaatgagaaagccctgcaaataactcagagtaaagtactgaaaaatctccacggattagagtgcaaatgcatacgcctattttgttttgcttgttttattccacatgagagcctattcaaataatattttctaacccttcagtgaagagaacttaaaagtgaattaactcatttgtaatcttgggagaatatgaacattgtcatgttaaatagagacatacgagaatcagaggatagatgagagtatgtgctgaagttaaacaagtttcacattctgattctatccctttttagccaggtggcagtattagtggcagttaacattaaaaaatatattttatcatgtttcaggtacaattttatgtgtattacatgtattcactactttagttctcacagaaattgtataaaccattattagccctatattataaatgaggaatccgaggcacagagaggtcaagaaactccaaagtcacacagctagtaaatgcaaagataagacaagagctcatgctcttagcctctctaaacctctatgtacttaataaaagaggttaatagatgcacactgttaacagtgcattgttcattattacaaatttcttaggaggcagcatgtcacagtggctcaatttgtttaatataaaaaagcttaatagcaatgcctgttagagtcttatataaatgagatgatacttataatgtgtttacagtagtgtttgaaacacagtacacaataaacaattatttttctatccacattgctcaaatatagttttaaaaaataaaatcatactatacattttctttgtagccttcttttatgccctatgataatccatgttaattaaaatgtatccatcaatttcatcggcagcatataattctaatgcatgattatactataattaaaccaatccctatttgtagggatgcaggttgtttacattttttctagtgtaaataatactacatatgaacatccttatgcataaatctcttcatagtttacctttggataaatccctgagagtagaacttctggatgagaagataataatctaattttgataacagaaggaaaccctgtagagtaaatgatctactcaaaatcttacagaaccagagttaatgccgggactagaaagaatggtctttaaaacacagttatataactatgtatatttttttcaacacaaagtgtcaaaagagattaaggcctgtcagctagtaaaaatctaggcttaagctgaacccagatttcctgaatcccaaaactagaatctttgacgtataaaagatgatttgtgtaaggcatcttctttgcataacaataaaatcagaataactggcttaggtgctttgccacataaatgaagagttttaataggcataggtgttacattatttgtgacctggtaaaatactactcctttagtccattataattctaagaaataagaaccatggtacataaaatgacaatcttgctggaaaatcttcactgtactgtttgctcataacagaggaaaagtgacttctttaataatgatgacatatatttctaagcctcatacatcatttaaacacccattactctttgcccttcatcaatattttaggaacactataaaacttggattgttcttggaaataattctttcatttttgcagtaatttgtttcactaccagtaaaattagataaatacccttaactggtacaaactatttctcttaggtttgagtcaagagaagccaaaatgagtcctcagatggtgacgtgaaggctctgtctaatataccttttctgagttggatttcttctttcctttattccatcttactcttgttcagatataattcaataaaatcatattatttctaatcaattaattttcttattcctctaatatatattctgagggcctaccaaggcctaaaaataaaactttaagacaatatgtttccttcctgcaagaaattcttaatccaacagatgatttgtccttaaattatttttgaaatataatcccttacaaatttaaactaggcttaagtagatagccatatattataatggaaaagtagaacacatgcaaaaggaacagtaggaacatatgttaaccaaagacaggcattagaaaaaaatatatttttaattgatgccatgaaaaatttaaaatttacaattatttggagcttcagtataataggtaggaagacttagtttaaaggaaactacattatgaccattcaacctactaaaaaatataataaactgaaatgttgttccataattgccataaagagaagcaattatttatctcagggagaagcaagatattggcacttaagggacaaaaatagcaaacattagtttgctgttaaaatgtatcctccttttctcattcctttactagtatcttagaactttatttcccttgtttcttaaatatgtatatttcataaaaactcagactcttaagaaatgttttgcttacattcttctcgtcatattatttcatggtcatgctgtgcagaatgacagtgattttaaataggccttcattacactccttagcaacctgaaaacaatatggaaatctattattttaatttcttttaatcttgagaaccccaaaatctttaagttgtttcctttacccatgagtcgttagccatcattatactgttttgccttatctaaaaaggcaaacgagtgagtgactttctgaggctcatgagaggtgtcagtatgtatggagctgcagtaatcccccacgttttagggataagactgtttaatccttgagagttgcatcagcgaaacaggcagtgaatgagattagccatctttatgtagaagaaaatatacttcccaaatcagataagaagagctggccctgtagataattccttcacagaatatggaatctagtttcagaaagatataactaaaacataagttttacaaaaaaagaaaaaaagaaagaaaaaaatggtatacactgtgctaatcccattattggtatgaagaaatgcctgggttttggagtcagaatttctgggctcaaaatccagctcttcttcttactgtgagactgaaatatttatctagtctctttggcccatcagtattcgttttttgtttgtttgtttgcttgtttggtttttgtttcttgggggttttctttttttttttttttttgagatggggtctcactctgctgctcaggctggagtgcaatcgcatgatctcacctcccgggttcaagcgattctcctgtctcagcctcctgagtagctgggactacaggcatacgccactatgcctggttgatttttgtatttttagtagagacgggatttcacgatgttggccaggctgatctggaactccttacctcaggtggtctgcccacctcggcctcccaaagtgctgggattacaggtgtgagccactgtgcctggcccagtaatctcatttataaataaggataataataactccctctagaattgagactcaaaagagataatataggaaaatacatagaacaaggcctaggatactgttagcgctcaatgaacagtacctgctattattaatattttgtctatcatatggatgtttactattcctgtggtttctagttgtctttttttatttggtattttattccttaacagattattttcaaacaccatatcatgtttatcttgccctattttttgctttatccctgattatctttcaactctgcatcattagatctcttctgctgagtcttcttttacccagaggcctcttgcccagagttctatcagaggccatctgaggtaaatgttgctatttcctctcttgtcttgcttggccttatcacctgtaaaatgagaaaatagtagtacttatctcacagaacactgaagagaattatatgaggtaattcatgtgaagggccatacgtagtatcacacatataattacccagtggatggtagtcaacatcatttttacccacaatgtcttcagaagtggcttctactaaaaagccttctctcatttttctccaaactatccctaaacctcagtccacccttccaactctggctttgtttctagctctgtgccctctgctcccaaaacacccaataagtcaaatatagcattttctgcattctatcaaaattgcttatgtttctctttcccccatgaaactgcaacaactttgagagccagtaaaatgtcgtactgcaacttccttgcctcagtgtgtagtaacatgaatgctccacccaaatgcattgaattgtttttacaaaactcaggatcagacagggacttcaacaaactcatctaggtctgtcctcaaagttttatgtgcatattcagcagtccctttctccgatatctttacttcagcaaacttttctattacattgcattaaattatctatttttctttacctttatttataaaagatatctatttccagcatacttctaatattttctctttaagctgagcaacaaaatatagataaatacatttctgcaggtaatgcaagctatctattctcctgaaaagagaattgcaacaaaacaaaacaaaacaagaatcttctttttaaaaagctaaataagcaaaaaagaataaatgcataggtaacccagataagaattctttaaagcagctgcttgccaagcaaacattggttctttatttctataatatagcctcatggaagtaatctttcaccaagaatgtcttggtattctcataacttgttagtgtcaaaggatccaggcaaaacaactagttagaaatccatgatcaaaaatgttgcaggtgcaggacttaaaaagggcctatagtatgagaacatttttgaaaacattgattatgtcagttaataataataaaaccttgagcaagctccttaactttgtattgcctcatctgtaaaagggtggtaacacgatctcccacagaactgttgagaggttacacaagatcattaatgagaaagtactttgtaaatgttgaagaataaatctaatataatgcctaagcatggtaaaaccctgaattttggtagttccaaacaacagcacactgcttcatattatttgggcccatgtctttctatttttccccaaagatgaagtcctttgagagcccaaatattatcttattcctagtttgcttcccaaagtttatgacttagtaagtgaaaataataggtgttttaagactgctgaatgtctgaataaatgaagatgaatggaatgaatgaacaatgggtaacaaaaaattaaatgagtaaattccttctctgatttggggaaaatatttgccaaaatattttagtggaggagaaaaatgttgactatggttgtcaaatagagaactgttcaaacattaggccagagaatatataataaacttatagagacaaaagcattcaatgtaaaactcactcaattctttggactcatataacctggaaacaaatggtcattattcattaaggaatacataaagaacgacatctgcatgtgatgattaaattacaattaaactgcctgggcacggtggctcacacctgtaatcccagcactttgggaggccgaggcgggctcatcacctgaggtcaggagttcaagaccagcctggccaacctagtgaaaccccgtctctacaaaaatacaaaaattaggcaggcatgatggcgggtgcctgtaatcccagctacttgggaggctaaggcagaagaatcccttgagcccgggagatggggttgcagtgagcctggatcatgccattgcactccagcctgtgcaacagagccagactccgcctcaaaaaaaaaaaaaaaaaaaattaaaccctgcttacattagtctctgtaagcagaaagaaacttaatgctggacaaatgaggaagctgaaactactttttgcactgtcgttctgatacaattaatagcataaaaaaccacacattaagtaagaagaggacctgagctcctccaaacactcttaattgaaataaggtatcgttacgagtttatccaaaaacctttttaaatctgtaggaagagggtggatggaggggaggaaaagcagttaggtacttttgaattgcaaaatgaagaaaataatattaccttcagaattatgtaaatcatctgaaagaggtagaagggtttccaggtcaacaagacctgaatgccgcctaattgagttcattaatggatctaaggaaagaatatacctatgcaatggagagttcgttggccagtgaggcaaccaactcttgccagaggcaaggagtctctgagacagtgtctggcagtgcatgtcatagctctattccctctattctattggccttaccaatagatctttatgagagtataggcatctggcaattacattctttatgttgctagagggacagcaggagtcagaccatgaggtcattagacttcagaccaagtatggtcaccaggtatattcaccaatatccacttcctctctactgtggggtacaagagatggttgcacctcacctccttaaacttaggtatagcaatttaggtatagcaagtaaatagatatttactttagccaatgaatgtgagtttaagcaacatatgtcacttcttggtggatgattgtaaaagctagtgtaagatccttcattattcctttccccttgctgaaacaatttcatgaagtacaccctctatcatcttgagctcctaagtgaagatgtcttagagccagatactcaccactcactgtggacacaacgtttgagagataaatccatcttagaatttaaggatactgagattttgtggttatctgaactggattaagctagcctactcagacacaggtaagctgagggttatcatttggctccctttataatttctgtactaagggataatgaactggttagagtatatggacatttagtcagcttagaaacttttttgcattaaaattaataaactctagtaagtatctattcatctccagcagtatcttgtaagctttactattatgaagcaatatccccaatttcgactggctctgggatgttggcaaattaagagtttttgaacttgcaaaataaaaagcttgatcctggagcttgataagttcaaaaaggaaactctcccatttgaataatctttcaagtcacgtggctctttctgaccacatctaacccatgtccacatctgtttattagaagagttaacagtagtcactgatgttttaaatttgaataacctactggggtcttaatattctatgcattttaaatggcaaactgagtctctaacactttattgtacatctactatacaccagaccacaaatgcttttatacaaatacaacttcataattttcataaaagccatgtaaggtaaatttaatccatcctcaatttagagatgatacacctgtggcttgcttaagtaattgattgcacagctaacatggagccagaatttcaattcaggtattctaggtccagaggtctttacacagtaaagaatttaattggatgttcctaaatcagctaaaagagcctcctgtatgcaatgatttggtaaaaatgtccctatttaccccttctctatggtacttagtttgatatactttgaatatataatatttctatttttgattttattcattagcaataacaaacaatacccaataatgagactaaataacataattcctacagagccaaagtgagtcatgtgtaacaatttataagaaacccccaaataactctaaaggatgataattgaataagcatttgacacaaatttactgaactcattccaaaatggttttccctgactctgtggtcattgaactaatcaatataatcttgcttaaataagtagtcaatatgtatggctctcagaagacaggtctataatatttctgctttaagacagatatggcactacagaagagacaggatcaaagcaattgtgaatatagattccacatcatttgcctgtgtttttcggtgccatctggttcctccaaacttgataaaggttttgtgagaagtaaatacatcaacagcagaaacagcagaccatatgaaggtcctactgtagtgtaggcatataattgggtactcattaaatgttaattctcttcctgtttcttttattattttgtgttaatctggttaggttaggtttgttgtaagaatgcagtaaacctgaaatctcagtagcttaataatacaaaggctagttctcactcattgcaggttagggcactctgatctatatagtcattcaaggatctagactaacacaccacattttgtagctataccatctaaaacatgaggtctccttgatcccggtgtcaggaaagagaatggtagagggaaggcaacctgacatttctgtgcttcgatctgggagagacacatatgcctttttccacaatctattggtcagaactaattatatacccctgtcacctataaggggacctagtaatgtggagtggcagatggggatagcctcattgtctttgtcatgccttccctatctctataaatgaggtagatctcaataaagggttgagtgacaaaagtattatctgtgagtaggccctctaagagacctttagcaaggctcaagcaccttaaatttttgaagattatgatccataagttcatctgtcccaaacagatttaacacagagtgggttaggttttggttagacttggttggaataaatcatcatttttctcctctgattaaattatccaaagttggagccctctttgagctgaccacctaggccaaatgaagttactgattctgctttttctttaggttcttcctagtagtacaagtttaagtcccaaagttgcagggtgatgtgaaccacatattaattatttacatgtttatgcgagtgacaagatgatttccttctattggaaataggtgtgaaaatctgcctcaaatgacactttttactctcagaaacagaaaagaaggtgaaaagtctttcgagcaaatgcaggaaaaagtcctatgaatgttcttggagtaatgtatgtatcagccactaataaatttcctcatcattggcttaaaaaatcagctaccccaagacaagggagtgaaatatctttctaattatacatgcattcaatagctcaatagttatttgatactcctgtatcaaacattgaacatataaagatattcaagaccctggctctgagtatgttgctagcaaaaaaatgtgcctcttgataaattgaagatataatgcatgtataagacattctagaaggaggatatagattcttcttactctgacctgagaaggccaacaaaaataatggtaagacatctactacccaaaattggaagtgagtgtaataggaaaacttacatagaaactttgttttcaggagaaatgtctagcggtcatagttaacttattttacctagttgcttaggcaaccaaaaaccaaaagaaaaactatgggaaaaggtacagaatgattaatcaacaattattagtctttttttcagagtctgtgtttatctgaaagttataatttgtttacttggttctaaatatatgagtaccgatgacaaactcatcttgtaattcaagataaaccataaactcagtgtttataaaattatcattaatgtaaaaatacttaacacagtgcctagcttaaataaaatgcttgataaaatttagccactataaatattgtttcataagaattaatatttattggcataaaaatctcaaaaagaatagagtaacagaaaaatctctctgggtatatagctgatggtcatcaaggggaaagagtcagatgtatttttgttgccaaagttctaaaataatataaagtttactcacttcagaatgtcctaataacttaggtattttatgaaaactttttaattcaatcctttctaaataaaggtattgtgaaagatactgtaagttctgtaagatacagtaacatactactccagcctttaggatgctcaaaagctagtaagaatgttaagagaaatacagagataactatactgaggttcagccagaagataattaagaaaaaccatggggattgtgtaaaggacacagctgggaaaaatgaggaaggcttcaccaaggaagtaccactaaaatggcattgaaaaacaggaggatttcaacaggtgaagaaaaaggtgaagaaccagttggggcgaaagtgggagtacattccatgtgaacaaatacggaaggaaaaagcacctaatgtatttcaggaagataatcccattttattggagacaaagtattcatggatcagaggtagaattggatcaaattagagatgaatttgaatgacagagtaaaaaataattgtaaagctcaagacatactatctttaatctttgtgttctctttctctcactttactgaaagaaacttccagcattgcccctcagaatcctgctttaggtgttgataacaaccaaaggaaactcaaattgggagaaagaggcagtttagtttttagaattagaaaacaacctgttgaaagtcaaagagaagatcagagaaaaaagagttgtatcataccaatagacgtggaaagacaatagagaaacaggaggccccaagtgcccagtgacttcactggaaaggaatcctgggaggtggtaggagaataaagttcgggtaaggatggtaagatgacctccagatcttgttggaattggggaaggccttagttgatggccatggtcaaagtcatcttgctgcatgggagctttgccaactgagccaagttagcctctttgctgttgggtataggttttccaagctgtgactcatccaacagaaggatccccttccttagccctgagatttgtatgtattcctatttaaactgctctcttatgtgtgaccagcaccctgcattttccatagttaaggacacttgcaagacagcttactctgcttccccatcaccacctcactgcttctgagccagaaaatgggctagaatccaaaggagtggtggctatgtaaaagatgcctttcacaccaagtaagcttaaagggactagattcctatacgaggtgaagaaagatgactgcagattttcaaaagacctggtaaaactaataaatactgtagtttatctgtaacttttaaaggtctgtgactgtacacctaaataaatgttaaatatttgtagaattgatccaataaactaaatgtcacctggggcataaagatgtgctgcctctcttcaagagtattcaggtaaggtatattcactggaatattcaaagatgagatctaactcaccacaactgctcaagtgttcataatagtatcagtgcttaaggctcagaaatactgaataatttcacataatattgtaaacctaatagataatagagaggactcaaattagttgttctgtctctcttttttttctttctataatacagattcatcccctgcatggctttatgtttgggacttaagggataaagtcacttcaaagtttatgatagtataaaacaaacggcactgcagtatttttccttttattaggtattatctgtctttagtctcagcactgattatttatgttccgaaggataatggtggttcatctttcttctacattttagtataggcaactttatttgtacactaactgctttttgaccattatcacttatttttcttcctaaaccatctactattcctatttaaaaatgtgtttctgaaatatatcccactaaacactccattccctgcttccagtgaaaggaacacacagtcccttaggactcaaaaatatcctatagctctccatagtctacaaagtaaaggttatacccttcccattgatataccatgttctcctcaacctgtccccattttattatacaaacctagctcctaataatttatgtcagttggccttcatttcaaccaaagcaaaacgctggctccaggatctcacattatatgcctttatgatgcttgtattcgtattattccttctttctagattgatttacatggacttttccatgcatccaaatgcaacatgacctttaatgttcacctcaaaatttaattcctccatgaaacccttcctaatcatccatattcaaagtatcttttctatgtaaaatttcatatattctatcatgtcttggaattatttttgccggaggactataagaaagaagatgatatggtagaggagaaatagggaagaaaaaggagaaaaaagaggcagaaaaagttaaaaagagaggaagaggaggaagaggaagtaccaaaagaaaaatagaaaaaaagaagatattttcagaagtgtttgaatgaatgctattaagaatgattatttaaaaggtaatcattaacaaatatcgagaaatcaggacattcagtggttagcaagaacacaagctcattcccagctctatgatttaacagatctttgatgctgggaaaggaaagttccttagccctcagctttctcatctgtaaaatggaaataatagcagctatcttacagcactgttgtgaggattaagtaagattgtattactaaagtgcctaagacatctggttaatagtttcaagttccacaaatggaaatgctttaatacagttggaggtatgcttttacaagttcctttaaaccagaaaggttttagcttggattcagtagaaaagatgaaattcccagcttctaaattccattattgtaaaagtaccaaggtctggacagctggcagggctgattgaacaatatccttatgtgaaaagctcaggaaaactgagccctggtttaataacttactggcctctgtttaatcataggtcttgatgactctcagcggagatttaatttttggtccctggaaataggctattgatgtcttgacagaaacaagcagaataacaactagctgttggtcaacaggaatacacacacacacatatatgagcaaaaaaaaaaaaaaaaaacccgacagatttaataattagatctaaatgtgttttggtaaaagcaatgagaattgcctgagaaggataagaaacatatgaacctatgagtacatcaaaacccaatggaaccaaatggtgcccagttttcttgttttgacatcctctattttctagagttctggagagtaggaataatgacaactaaaaaatcccattctaacagatctgaatggttgcgtgtgtgtgtgtgtgtgtgtgtgcatatgtgtgttaccatatttaattctcactagctctccagtgcattatcttcatatgggatattgtgaaattgaggataaagaggttaagacatttacctaggtcatctcagagttagtggtagagctagagtatgaaatcaagaaggatgccagaaccactccccaacataaaatctaaataataggaagaggtagaatgtcagagcacattgccaaagtcaggggaaatcggaagccaggtatggtgatatggtttggctgtgtccccacccaaatttcatcttgaattcccacgtattgtgggacggacctggtgggagataagtgaatcaggggcaggtctttctcgtgctgttctcttgacagtgagtaagtctcataagatctgatggttattataagggggagttttcctgcacaaactctatttgcctgccgccatccacgtaagatgtgacttgctcctccttgccttctgccatgattgtggggcctcgccagccaggtagaactgtaagtcaaattaaacctcttccttctgtaaattgcccagtcttgggtatgtctttatcagcaacgtgcaaacagactaatacatacagttaccaagatggacgcattttctaggacagagaaggaagataattgtatgaccacatccttgtttgttctaactgggtttctaatatggtgaacacagctgccattaagaaaccaattttaagaagtattctatagaccattttagatggtcaaagcaagtggcagttctgctcatagctgatagtgcctacctcaaagttctaaacacatttccaacttccacttgcagtcaagttccatggtttttaaaaattacagaaatcttttttcttgctacattcctctctaaaatgctcacactgtgaatgttaaacatgtgttttacctaatacactttccctggtggtgtggcccggtcattgattaagctcctttcccaagatccacattcacatttcaatcttttgactttatctcctataaaaggaaagtgtgttactttcccattgcattgtagagattgttgctaaaaataacaaggattgttacattctagaggcttttaaaaagacattttaagtaaacatgaggtaaaaaattatgaccgaacagaatttataaaatagagtgttgatttaattttatacatgagagatataaatttaagacttttcaggctgaaatatgttacacttaagaagagaggcaccaactgttctagtatgaataaaagggtttttaaaattattttaccccatagaatctatgttctgaagaatttttctgccaagctaactgcatataatcagtgatgatttgatttgtttaactacattcaagtatatgtggaataatcaagacaagcttctaatcagtccaagcaaatcattgtcagtagagtgggtgatataactccagctttctttctttagaatgcacaggcttttgtagagccaatgttctactggattaggctttctgatatatttaaagtagcacaattaaggactgaggctttgtagcaggtaaattagagtttgaatactgattctatcatctaatgtctgtgagaccttacacaatatatttagcttctctaaacctcaggttcctcagctgtataataaagaaaataatcacatataactcacagaagtaatgtgaagagtagaataatgaatgtaaaatgcgtagtgcaacacctagcatatttagtaagtgttagttgctgtttttgtcatcctcatcatcatcctaaccacaatcaccatcattattattatgtcatctttatgattactggattcaagaagtgtagcaggcttggaaactttaggttgagaagtactgttttaaatggagtgtcttgtgattttgcacttaagttccaatagacagttttaaccatcagaccaaaggaattatatataattcccaggggataccaactttttaaaggcatgcttatataataatatcatatttctaatggtcaggttcctgatgttttgataaaaggaacagtttttctatgatcttaaaatgaaatggccattgggtatgggaaagaagagtgtagaataatggtggacaatatgagataagatgggatgacaagacatgatttacagtcacgtttccttttctacctgaagtgtccatcagcttggggacatggtgtatgtccatcagcttggggacatggtgtgatggtggatttatcaggtcagattcaaatatcatccagctgattactactgactcattgggtagttttacttttggcagaggctcagattcttgataaattttaccacctgcttgaaaataatttgccatcaccaagcagtgaaattagttttgctaagcagaacaaagacaatgatcagtctctgcttatctaaatataagtagtggtgggttttgtaattggtgtgtttggcaactctcctcctagtcacccataaactctctccacccattccacccccttcccatcctctccaaccagcccctgcctgaatcataataatagctcctattttgggagcatttttatgcatcacacattgctcaggtccttggatactgtagtagtcagaaaaatgacccctcaaggtgttcatctctacataaacagtgagcaggcactggagtcactcaaacttgattcaaatcccaactccaccactcacatagctctgagatggcctggtgagcaagattacacaggctcatttaggatgtgatggggctttcaactgtaaaatgaggataataatctctacttttataggtccctgataatgtatacaaagtgcttagaacaatggctggcatataataggcactcaaaaaaaggatgttaaaaaaactagtgatacttcacatctcttcaataattttatcaggaacatgccatctgaaaggttcatttttgctgaggtaagtatcttggccccaggtagaattaatgaggaatttttaagagctttgtcatagtgtaacatagatagatccatgaatggattcagttgatgtaagtgaggtggtttaaaagcagacagggtaggcagtagggacaagtgtcatggcacataaaagacagagaagacttatatgctcaaaattatctgcctcttatatgtttcaatacccatcattaaagactgacaacttatctgtatattctcccttcaatctctttgcaggatccctttacaaaaggcaaacatttcttgtgtgtggtcaagaaaaagcaaagataatacatgtgcttcttagctcttaatcggaaagaatatgctgcccatgcctttggcttgaaccactgtgcacctgctgactgggggaagagaaagaaaggaggtgaaaagtgctctcaacatgagggtgaaaacaaatactacttttgtctaggacatactttttacctgaaagtagaatgttaaaatctaagactttcttcccctgagagtagctgcttagagactggccagagacccagggccttgggccactcccagcagagaggagcatgttcatgaaaactgacccaggcagatggagaagatagagtcaggactatgtcaggtagtgggctgtagcctgggctggtgatctgtgtgagcaaaattccaaggggtccggaagtagtaatgactgatagataaacatggtttcaggaaagaggaccagaggaaagcatttattatagccaggggtgagcttcagctgtactaggcagtgagtagcagaccctaaagcatgactagaagaagcaagagctatgcaaagccacaggatctaagtgttggatgaggtgtacagaggaatccctgaaaatacctgggagccaagttgacttgctgcaacatcttccaaaaggagcctccctgccccaattttaccaattttcagtttctcgttttaaaacccatcagtgactttgcattgtcccaagaatcattctcaaattatttagcttttcacatttttctcttatcactttcctgtgcttcaaacaccatgggaaatgacatagagacagaagcatacacacatgctcacacctacacacaagctcacccacatacacacacccatttaaacataaaccagttgtgtcgctcatttgctcaaaatttctaacatttttcatttgaattaccatcgtacttatataatctgtccctaaaaccatctgtgacctcatttcctactacttgctctcatcttggtcattcttgctatttctctgacacaggaactactactgcctcaaagtccttgtgctttggggttcctgtgcctagatatttgattaacctgctctctcattttcctcaagtctcagctcaacatatcacctaagagttagggaagcacgatctgactgctctgacataaatgtgtcatactattcagagcacaagtataaaccatcatttcccctttttttgccttattttccttcaagacattcaaaactaccttcaaatttataacattttacatgtatgtctcctcttcataagaaaaaggactgggtcttattcattttatcaccaggtcattagttacctgaacagccactgctatgccttcaataaatatttgttgaataaacaaaagaataaatgatgtcacctcagttatcatctattttgggaaaactctggttgccctcaaactgtatatcattctcttctctgtgcttccataataacttatgcttatccctgcattaacactaaccatatgaacactgggcagaaatgacctctaattatgtggcctccctactattctccaagctctgtgaagtcatggattcagctttgctcactgaagcaaatgtggtacacaataggtgatccacgtatgtttgaagaataaatgaagggcggtaaacgggcacaatgtcagaggaacatgttgattccactgaaccacagaatgaatgcttctcaatttctccccacttgtggtggctttcaggtccagagcagggctgagtttccacgtgggactcaggtaaaagatgggaccaagaaggtcattatatcctgtcttcttgagtaccaccaggcatctaagctggagtgagctaagctgaactgagcagctgtgtgtaggtggagagaatattctggttcatcataggcaataagttcactaaaagttcctgggtggatgaaggcatcaaagttcagaatgtaccaccatcgtgaacctcaaagttaattatcttttcatccagtttcatgtttacttaattgccaggaaagaaacctgctttgaatgaggttcagaactcgctgatgaacaatgactactgcattctgagaaatgtgttatcatatagcttggggtgagctctgtgtgttttcagagagacaaagcatctgagttagagtgcttagttcccaaccactgctactggttgttatattttgtgcctgctacatgaatggactacagatagatggctttaaccttagaaatcaatgatcataacttttatggtgtgcatatgtcatgccaggcactgtactaaattccttagaatctgattaatggaggcaagattgttgaactgattgttgctttttccaacaagaacatttttattcagcaactgcattattgtaatataaggagaaagtaaaagactttttattgaaaaatgtccaaagcccatccaggggaaaacttttatatatataaaaaataatccttaaaatttatttagtattacatgatttccaaagcatttttatttatgttatcttattttgtttcctcacggttcacggttcactggaataaaaaggaagccccatgtgaaatgtgactttaattagcctcatactgtattttaaattttcagagcagtatctggacatggtaaaaaactgacaatttttgaatgaaggaatatacttcattctatttacttaatatgaagtaggaagtgaaatatgccataatcaggaaattacagagaataataggttaagaggtagccaggaatttaggtttgccttttcccttcattatctgaccaattctctggtctcgcataagaacttaaactctgactcccactggcctcactaattaaacaaatagataatggcgtttaactctgtcatgtagattaacaaacatggaaaatgtttagcacaaggtttgcacatataagatgttcaattaatattagtgtcccttcctccctcttcccataggagagatacaaataaattgttatgggatttcagaggaatttagatattcaattttattatatgaaatctgaggttgttaagacattaaataatttgcctgaagtcacttagctaagtaagtaggagagctggagcttgttctgagctctcccaatattagattattgctactacaactgtaccctatggaccctatagtcccagagttgggactctacttgaagcatcctaaatgtgagtatatatcccactatccaatcagaaagacaatcttttttctaagagagataggggatgaggattagagattcataaggccattagactctcctgggaacatactgttacctccaaaggagatccctgcggaaacctctgaaatattaattcaagcaaaattataagcttatttgtcctctgcatggctcacataatacaaattagaattctcatgtcatgagtttgggaaccatggaattcatataaaacatgtttattattttgcataatgaagtatgtcaacctccatggaaattaaaataactaatcatctcttatcaatgacattcacatgccgttatacctccactgaatgtcagttcttttcatgcctggcacagatccgcattaccttgatctgacagtaggcagccacataggtttcaaggaaggagacattaaaaggtatccactgattgagctatggcttgtaaccaactggcaatcaagatacacgatacactagaggacagaacccaggcactcatggtaagaaagcaaatgactaccaagtacacatgaaagggcaataattttctacatgacagctttccacagattgtttccaaagggagacttgctcattggagtggaaactgggatagtcaccgcctatctatccatgtagtgtgttttctggcacaaaaacgaaaagagataactagtgataggcaacaatgagtagtttataaagtattttggcatgatagtcaacatttcctaggtttgggctaaattctcagaaatgcctacattgtgtttctattttaatccatgatgagtaagaaactgagatgcaaagacactatgtaataagtacttacttattcagtcaatccaatgacagggagctgactggatgccaggcgaagcatgtgggttcaggggaagcagatgaataagtcacaatcaccgtcctaatggaacccatcttctaactgagatgtcaccaccacccccaccaccaacaacaaaattcttaccacattctaaggttctcttaagaaaacagccacagatacaaatatcatcaattataatcacctaaataatatgctaaaactacaactcaaaaccaaaaaataaaaacaaaacaaaaacactgggtgtaaatagaagttttggctgaaacagcaaagcagtaatcttgtgccaaaagaaaccctactttaaaaaaatgatatctatgaagtgctgaggcagccattgcctacaaatcttacttcctagcattcttagagcattacagagttttcaaaacactctcttatatattatctttcttaatccccacatgtcaggtattattttctttacaatatcaaaaaacttatttgtaacaaaatcaattacaaataaactgatttgtacaaggtaacagagaaagtaaatactgagactggggttggatgcaggtatgtgaggtgtgagggccaggtacagtgcttttgtccaatacactgaaggatgagttgcttagacacatagggtcaaagctgcacctagaacctacagtttatgcttcttagccccaggctgctggattcttacctattgtttaattcttagtaacttgtttaaacataaaggatgttcttttgcaataattttaacatcttccaaacataattaagtggttaagagctgaagtagggaatatcaaatctgatgtgaaattccagctctgagacactacctagataatttacttaaactttttgaaactcacttttctcctctataaaactgaattgtaatgtctgcttcatagggctgttacaaggattagatgagatattaagtgcctaacataatccctgataatggcagatttcagattgaagagctatttaataaacaacatggtagtaacaatttagtagctcaaatttgcacaggactcagaaacttcacactttttacaaccctatcccatgacctttactctaaagaggtgctaacacataagtattgtgctatatatattacaagtgggaagctctgcataatctacagattcataacaatgccaaaactgctatactaaactaaaagatacttgccatcttaatggatatcttggatgaaaatgctttactggctcaaatataatgcaaagattaacagtttttactttacttaaaagtcttagcttgacactaaatataaatatttgccaggttagcagatcaaagcagatacttacatttttttcactgttctctctttctgtctctctctgtttctctctctatatattccttcctctctctctctctctctcacatgcacacacatgcatatatgctcacacatagattaagcacttaattttaaattatatctgcttgtctggcataggaggtaagattgtagacactagagtcaggttacttccgtctaaatccattctatgcccctgagaagttgtctgatcatgggcaagattatccattcactcattcatttatctattcatttatttaaaataattactgatgatctacatgtcaagaattgtattatttttctggagatacggagatgaaaaaaatagacaagatccatgctctcaaggagaatacattcaggaaggaaagacacaagtaaaaataaacaaacaaagcaatatcaggttgtgataaagaaaataaaataaacatggtcgtatgatagagcgagttggaaaggtaccattagacagggtggttataaaaaacatgttggaggaagaacattctcctgtgagctcaattctctcctgattagatagctggaagggataaatgacagttgtcacccaggcatgctacagactctatttacacacagatgatgtctcagccaaggttatttggttgcaagaaaaaaaaaaaaaaagcaaacaacaaatggctttgactaaattaaggaaaaaataaatctactgctggagaatttgatagcttaaagaatcaatgaaaacattataaaactaggttcaaccacaggcaagtaaatcacctggggtcttgatagaagaaactgcctaacatctatctattcagagcattttctcatccttgcattctctataatctggctaggaagtgtaatctagctttcgtcacctaaattcactttgcctaaggcaggataggacaccagcatttcagagctccagagcatctaggaagtgtccctgttttgaattggagacaaaaaagtagaagatatgtgaaggcatcaatgccctcaaatctcaaggtccaaggtacactgggatcagaaaccagatagataatttaaaaagtaatggatcccaacacagtgtagtataaatattgagatcatgtctcatgctaaccaatttttctatgcagagagaaactcaccctaaaacagttcaaaaattcttatttccttatccaggtgatattttatatggcaattcacaaatatattgtcaaggaccctacaataattctcacttatatgaaaaaaagttgattatatgttgaatttggctcacctgactttaaacaatatggtttttgacaagtgcacataccccatcccctgaactcagtttcctttgttgtttgactcataataggttgtcaaacagaaggtagtaatagaaggatgtggatttttctactcttatacttcttcccacccaactactccaatatggggaatataagcttccaaatataaaacttatattttaagcttttaattatgaagaacttcaaattatacaaacggtcacttatttcctaagtagattctgaaatgtttacataagaaatagtaggccaggctcagtggctcatgcctgtaatcccagcactttgggaggccaaggcaggtggatcacctgaggtcagtagttcgagaccagcctggccaacatggcgaaaacccgtcttgactaaaaatacaaatattagccaggcatagtggtgcatgcctgtagtcctagatactccagaggctgaggcaggaaaattgcttgaacccgggaagatggacggtggagtgagctgagatcgtgctaatgcactccagcctgggtgacagagccgagactccgtctaaaaaaaagaagaaaaaatttattacccattatggaattagaatacaaatactttgcttacatcgttgagattttgtgagaaacagtcaggtatatgcagcttactgtaaactttccagtacaatgcaaatataaagtagattattctctataatgaaaaaaaatggattaatgttctctaaattacattttagttccaaaattatcttcaatggtatgatataattatctgatcaagccaccaaaagagtaatttgttaaaggaaaataaatgatatagtagaaaaaccatgtgaataagggtagaggatttttttttaagctttaaatatactgatgcccagaagacttctagtttcacatcctgctttttcccccaagcaatgctgtgaaccttgggctgtacaccccactttgcagtttcatctgtaaaatgaggacatacaattactccatttcagattccttttctttgcctttcttttcttttctttttttcttttctttttccttccttccttccttcctttctttctcactctctctgtctttctctctttctctctttctcctttctttccttccttccttcctttctctctctctctctttctctctctttctctctctctctctccttccttccttccttccttccttccttccttccttccttccttccttccttccttccttccttccttccttccttccttctttctttctttctttctttctttctttctttctttctttctttctttctttctttctttctttctttctttctttctttctttctttctttctttctttctttctttctttctttctttctttctttctttctatacagagtctcatgctgtcacccaggctaagtgcagtgtctcaatctcggctcactgcagcctccatctcccaggtacaagcgattctcgttattcagcttcccaagtagctgggactacagggtcccgccaccatacctggctaattttttgtattttttagtagagatggtgtttcaccatgttgaccaggctaatttcgaactcctggcctgacatgatccacctgcctcagcctcccaaagtgctggcattacaggagaaccatttcacgacagcccaggttattttcttaaaattctctgaacactttctagtgagtgtttacttatttcactatgtaggtctacagattatccagccctttaaggatcttactttttaaaatggaaggcatagaagtaggcaaatatgcaaggggagaaaaagaaaacaaaaatcaaaactaataaaaatctggacaataaagtaaatgcatcatcactcatatttccagaggaaatgctacatggagaagaaggtcagggataagtgcctaattagaatagacagaaaggaaaagaaaaatagagaactaacaaaaactgactatgctaagtgggactgaagagattctcttgtaatacattctaaaaatcttcctggaagtggtgtttctaataatgatttgaaggatagcagtaaatgttagtggtatagaacagaggtgtaatctgttggaaaagtgagagcaagaggtaatacaatttcttatggaataaacctttgcattggtctcttttggtagactaagaaaacgctcgaagataagaaaactgctttattcatgtctgaatacccaatactatttcatagggttgtctgggggtcaaattagttactatgtgtgaaagacctaatagtgagcttggcagagtagacacataataaatgtccctagattacattttggggaaaggttgatgcataaagatcagaacaaatgagtgaagatgatttgaagcaggtgaattcaatgtcaaaattaaactgtttctaacacagcctgctaaccaggacccctcagtcctccagtggaagggtagtctgctgcatgtttcttaggaccaagcttcttggctttccatagagtgtgccacagacattttcataggaacaggtgagttgagagacctctgtggccaagctaccctcatttccaacaaggcaatctgttcttgccacatgttccagctccagggctagattgcctggtaagttaaaatgatagatggtccttaagaaaagtctgagtcagcaagttcaacagtatatgcatttgtcttagaattttaataaaaacccagacctactcaaaaactagacctcagtgaagaaagtgaaatattaccctgtaagcatcactgcatcattcttaacttcataacagatttgaatgacgactttacattttgtggcttctcaatgtttattccttcttagcttcacaagcactgtgtacagagatttctatgttcttttccctacactgcactctgatgaattggagtgtgactttgaaaatctgtcatgtccatcactgaaatacggatgtagatatttttcccaacacagctttaatattattgttgaaaataataacaaaaatagctgttaccatttgctgagcaattactatagaccaaactgtacatgtgttatctcatttaggaactatgaagaagtaatattactctaattttacacctaagaaaactaaagctcagagatgtacaccaaagcccaagttttaaactcattttttttgacatttaagcccctgtctttctactatcctcttctacaaaggggtgaaatgtttcaacaacttacttaaacattaacttccatcagataaatcacatacatgattatttgtattaataatgccaaatcctacctaactactaagtgtttggcttattagaacccattctgggtattactaattctcaattattaatggcatcccttttattatcaaacgctgttaccactagatattttagttcagcatgtaaaaccttattacttatttatcaaagatacaatttaagccctacttcaaagataaaacctgagattgtgctgacctaattgccaacattctttttcatcttcagagttttttccctaaaacctaaagttgattaataagtaaagtaagaaattgtgtaatttttttttctaggcatttaaactaaccttcttaaaaagccatttttaacattgaaaccttcatgtggcaccagtgcttgttagaaatacaagtaatgacccagaggattatatatagacaatggaagctgacagtttgacctttagctgataaaaagtcaatgtgttgactccatgttttagcagcaacatctataattgactctaaaacttgatggctctttgactgaatcatctatttgcaaataagttcaaatatacccttcccccaacagaaacttgcatacaactatatataacacaaatatttgctcgtattgctatgtaatattatgaatagtgtgttttccattcactcttttatattcttttacgtcaaattagttcaaattgccaatggataggagcactggacttggattcatgagaactagcttcgttggtgcctttctaaatgatacttaatctttctatacctcagttatgaccctggtgatatagtagtattaaaatgtatcctatttatttcaaacaatcagtagttctgtagcaatgcaacaatggtaggcgacccttcccacaaatttggtataaggtatcataatataataagtgaaatgtaaattttagcttttaaattaaaagtagcattctatgagcgtatactgtatactagctattgcatcaagtacttacatatattatatgtaacatctcatttgtcttcacaagaatcctaagagataagtgctttctccatttttgtagttaggcaatctgagacttaacaaggttaagtaatatatttgggactacagacctagtaaaaatcactgcaagtattgaatgagagacacttaattttaattccagttctataatttactagttaaatggctttgagcaagtgtttaaatgtctctcaacaacatcaggttcctaatttgcaaaataaggatgccaacatctgccttatagaattattgaaggaattaaatgtgataagatgtttctaggctagaattaatatgttcagcaataaaaatggtaatcattattaccattatttaatagtagcaatagtaaaaagaaatgtgacatcttcatacaccttagaatacagcttgcatttatcaaggacatatggggaacaagaaatctcttgggtatattttcaagattagaatgaaaaacaaaaaaatgtaagatgtattttatagttcaatctcatacatcttagcttaactttctgggttgtagtaggccgaagaaagttcccctaaaaatgtccacattcctgaaggttataaattcctgaaacctgtaactgtgttaccttatatgacagaagtggctttgcagatgtgattaaattaaggaccttgagatggcgagtttacgctgggttacacagtttgctctaatgttatgacagaggctcagttcttttttttttttttgagacggagtctagctctgtcgcccaggctggagtgcagtggcgggatctcggctcactgcaagctccgcctcccgggttcaagccattctcctgcctcagcctcccaagtagctgggactacaggcgcccgccactgcgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccctcagttcttaaaagagtcagtaaaagatatgtgaggacggaagcacagtcggagagaaatttaaggatgctatgcttcggagagaaatttaaagatgctatgcttctggttttaaagatggacaaagaggccataagccaaggaacattctagaaacttcatctaaaagctggaaaaggcaaggaaactgattcttccctcaaggcttcagaacatagcccttcagataccttgattttagtccagtaagggccattttggactctgacatcccaaactgtaagataataaatttgtgttgctttataccatgaagcttgtggtaactttttaaagtaacaatacaaaaccaataaaggagtggtgggtattatagagcgaataatatttatatgtgtagtatctgaaaaaaagaagaggaaaatgtaagaatttgttggaacctcaagaactgcccagaagagatgataagtcagcagactactggcaatgactctgcttcctcagccagtctatcttcagtggggacagacaaccatggggcaaccatggcttaaaggtattagttggctaaggtcattctacttcccttgctctaattttctgctcattgtataatccttttattatagcttagtttccaaagtagacatttctactgaaaagataaatttgccaataaaattttcttccagcttagcacctctatttctcactgcagattaattagttggcatcaagtttctatatactcattcactcatatcgtcaatgaatattcatagagcactgtcaggtacagtgctattacagatacagaaataaatcaaatataattcctaccttcaaggagttcacagtttaagggagaaacagttaaaagagtcataaattagcagtcacagttcagcatggtaaatgctaaaatataaataaataatgtgtgaccaaagtgccaggagagtagctaactaatatttgtgggaatctgggaaggctttgaagagaagtgatgagatttactgagatttaaaaacttattaaacagtttaacatgaagtgctactttaaacatgatgacttctggatatacagataaaattgagcccttacttttgtaaaactgagtactagatgctgataaataaaaactgggcatccttgtcttgttccaattcacaaggggaatgctttcagcttttgcccattcagtatgatgttggctgcaggtttatcatatatgaaccttattattttgagttatattcctttgatgcctagtccgttgagagtttttcatcacgaagggatgctggattttattcaaagttttttctatgtctattgagatgatcataagctttttgcatttaattccgtttatgtggtgaatacatttattgacttgcatatgttgaaccagccttgaatcccaggaataaagcctgctttatcacggtgtattaactttttgatgtgctgctggattcagtttgctagtttgttgaggattgttgcatcctttaaaataatctcagatctaaaaatgtgaaactttattaagtgattctttttctgctctagtttatgcttagcaaacaaggtgacaatatttgatttctttgatagagacacagtgtactttttatatagcagtcaaaataatccttttcaaaatataaatcacatcattttcctcccctgatcaaagttttccactgggttctcatctcattctgaatgaaaccaccagttcttactttgtcttatgatacacacatgtgctgcctgctctacctattttaacttccacagtacctttataacctcacttcctactactttgtcttcttcatatgccacactgatcttttttgctgtttcttgaacataataagcatagtttggcctcaaggcgtttttattacctgttgtctttcattggtatattctctctccaatatattgtgcatgattaacacatttttaagcctttgctcaaatgctatcttttctttctttacctttttttttttttttctcttttttagacagagtctcgctgttgccaggctggagtgcagtggcgcaatctcagctcactgcaacctccgtctcccgggttcaagccattctcctgcctcagcctcccaagtagctgggactacaggtgccccccaccatgcctggctaatttttgtattagtagagacagggtttcaccgtgttggccaggctggtctcggactcctgacctcaggtgatccactcgcctcggcctcccaaagtgctgggattacaagcatgagacaccgtgcctggccattatattgcttttttatttatttacttatttaatagcacttaccatcatctgacatttatattatttctttatttgtttattgtctgtctactctcacttgaatgtaaactttgttaagacaggaaattgttctgttttattcatcattgtaccttcagtacctttgtgaagtagatgctcagtaaatggttattgttgactgaacacaggaatatggactatatggacttctataaatgactgaccgtcttactaccaatgtataaaaattaggcacaaaatgtggaaataaatattttaaatacatagctgagcgcaaacacaagaattggaaatctctgggtgaaagaaatgtagcagacacctgaaggcagatcaatcaacttataagctagtgctaatatatatgaactaaataaaccgtaataactcaaaactggagttttaatgctcacctgaggataagagatatatcatacatttgaaactgtgaccttgcataaagtctgaattctggaaaatgtctcctttagataaagggaattagaaaacctgtgaccttgtcctaagaagcaacaaataagatggcctctactttaaatttaaaaagtctttcaaggaaattacaatcctcaagcaaatttctcctgtgaatatgtattccaaacttactgttcccatttagtatgagatctcttatattgataaattaatgtaaaaaactacttttctggacaagtgaaacctttggaatgttcagctgaagcaattatgcaattattccctagtgatatttctccaacccatggcaagtgaaattaccactgataaaacagtttctatcaaagttgaactcacaataagaagtcataaactacatgataaagtgctccaccaggaggaagagtcagcccacccaacaaatagaaagactaaattacaaagaatttgaaaataaaaatggaataatttgacactaagtacaaaatctatatgtttaaaatgacaaaatagtgggtgaattgagaagcaatttttttcacatctgaaagagaattggtaaattaaaaattgtgcagaatacaaaatacaaacaaaatgtgatctaatatatgaaaaatattgtgatttccaagacagaataagaagcccaatttatatctaatcagaaggagataattgagaaagggaaagagatattattaaaaacttcaatggttgaaaaatttaaaaattaagaaaataaattaaaccttatatatgaagaagcacaccaaattcaaagcaacaaaaacaaaaataaattcactcctaggtgccttttagcaaaactgcagacagccaaaaataaaaatgaaatcttaaaaacaatcagaaagtagtaagagttcacttattattattattattattattattattatgttaatcagaaaataattaaaaacagtaaattagaataaggtaaagttgccattctggaagtcaaaagaagtattagttattatattatcaaaattggaaaggaaaatataacatttgatgagtaactatgtgccagttactgagctagatgattttaaatttttattcctaacatatgtcatttattacccaagaattctcaagatcatattcaccacattttatacaagtaaaagtgagtttagaaacaataatcttgcccaatcatgctatcaataaatgaaagcgccagaaattcctaagggtttggctccaaattacactaaatagatataagaactcaaaacaagacagaacagaacaacatagttgtactactaaccttgtatgattttaaataagtaatatagtttatttttttcatttgtaaaatgagaataacaatagtactaacctcatagaattgttgtgaggaatagtatccaaatgtatgtaatatataatacaacttggaacatatttagtattttttaaatgctaattggttgtgttatttacaattaattatgatatttaacagtcattcgttgaaggaagacaatgttttattcatcttttattctctatggccttacataatgggaattgtattgagtaaattattattaagttaccaggataactgttttttgtttgtttgtttgtttgtttgtttgttttaggagtggaggagcagagagtttaataggctcaaatgaagggagaagggagaaggaagaaactcccccatacagggacagagggaggagggctccaaagccgaaagaggagacccctaccaggataacttcttacatggaacatatccttccctaatgtttggaattttagggataaggaaatatcaactagactccagaaggagaaaatatatctgttcctgagaaggtttcctctggatgagaaaaatagataataataatatataaaatgagtttgatgagagtgctgggaaaatgataatgcataaagagaggattatagtgctcagcttacatcaagtttcttgacaccaagtgtggaatttttttttctaattttgtctttcataatattttattcttaaggtacagtaaaatgttattctattcttacttcaatttaatataggactaatcaaatatgaatgcatgtatgaataataaaaatgaacacaatatttgataaccccacttactcttaattcagttgaaatggcaacttttctttggaccacaaattgaatgaatatcttcttcaggcactactgaaaattaatgataatatttatacttcaggttatatcagagttcatatatattttgactcttctacagcatctgaaataatgcctatacttaggttccacaaaaatttccattaagtgattcaacttaatatattaataaccacttaagtgctgagtactatactaattgtcaacaatattagggcctaaataatccactgcttatttgaatgctaacatcaaaaacaatcttaaatgataaagtaaccactgaggagtctaatggtgctcctgagtgctggataactggctggttctttatatactctgcctcagtgctttcaagacttgcttgatgataaaactcatttggcatatatgttaaaatgctggttctcagggccctgcttggagcttctgattcaatacaactaaaagggccttagaatgtagatttaaaacaatatatctgatttggtaaaatttggtacaaactgtattaatcctcacaacaaccctttgaggtagggtgaatttgttgagactaagaacaattaggtaacacgctcgaggtcacatacctagcaaacaacagagctgggacttaaacttagttttgaattcctcaaaggctacaagtctactaccctattttgtttttgctcagccaaggcgagcaaagtttaggattatttctcctcctttttacatataagcaacagaccacatggcatttccaaaagcaataggcatttctcagtaaagccatgaaaatataacaacttgtcccctcccaataaggacacctgagcaccttttgtggcatgctgagctttcttcagcttttctgcatgcaagtctctgcctgtccacagatttctgagtaaacaatgtaaatatttaccaagaacttctaggaacatagagagcacttcaggcaaaatagaactgacagtacctttaaaaaaatcagatttgaaagaatctgaggaaattaaaggctactataactctgtcctgtgtgtttccactttcttatcttacttatttgtatttattctgcaactgacttgaagctccttttgaacaagagttgtttctcaaccatctttggatttctaggactttgaaaaattcaaatgactaccacaagatatattataatcaaactataaaacataaaaaagacaggatcctgaaagcaaaagagaaaatacacaaataacatataaaggagtttcaatacagctaccagcagacttcttagtagaaactttataggccaagagaaaatcagataatatagcaaagtgctgagtaaaaaaaaaagacaaccaagaataatgggtaaagaaaatgtggcacgtatacaccatggaatactacacagccataaaaaagaatgagatcacgtcctttgcagggacatggataaagctggaagccatcattctcagcaaactgacacaggaacagaaaaccaaacacctcatgttcctactcataagtgggagttgaatgatgagaacacatggacacagggaggggaacaatacacactggggcctgttggggttgggggactaggggagggagaggattaggacaaatacctaactcatgcggggcttaaaacctagattacaggttaacaggtgcagcaaatcaccatggcacatgtatacctgcacaaacctgcacattctgcacatgtatcccagaacttaaagtaaaataataataaaataaataaattaaaagaaattgaagaggacacaaaaaatgaaaaatattccatgtgtatggattagaagaaccaatattgttaaaatgtccatactacccaaagcaatctacaaattcagtgaaattcctataaaaataccaatgacattcttcacagaaatagaaaaaagacaatcctaaaatttaaacagaatcacaaaagacccagaatagccaaaactatcctgagtataaagaaaaataactggaggaatcacattacccgacttcaaattatactacagggctattgtaaccaaaaaagcatggtattggcataaaaacagagaaatagaccaatggaacagtacagagaacccagaaacaaatccacacatatacagtaaactcatttttgacaaaggtgccaagaacatacattgaggaaaaggatttcttcaataaaggtgttgggaaaactggatatccatatgcagaagaatgaaacttgacccatctcttgcttcatacaaaaatcaaatgaaaatgaactaaagacttaaatctaagacctgatactatgaaagcatcacaagaaaacattgaaaaaaaccatccaggacattggtccaggccccccaaaaaaaaaaatcttgaataatacccctcaagcacaagcaaccaaagcaaaaatgcacaaatgggaatcacatctagttaaaaagcaacacagcaaaggaaacaatcaaaaaagtgaagagataaaccacaaaatgggagaaatcatttgccagttacctgtctgacaagggattatagccataatatatagggagctcaaacaactctatagaaaaaaaatctaataatcttatttaaaaattggcaaaatatacgaatagacatttctcaaaagaagccatgcacatgacaaacaggcctatggaaacgtgctcaacatcaccgatcatcagagaaatgcaagtcaaaactacaaagagatattatctcactcaagttaaaatggcttttatccaaaagtcaggtaataacgaatgctggtggggatgtggagaaaaggaaactgttgtaaactgctgttgggaatgtaaattagtacaaccactatggagagcagtttggaagttcctttaaaaactaaaaatacagctaccacacgatctagcaatcccactcctgggtatatacctaaaagaaaggaaatcagtatatcaaaggaacatctgcactcccatattgttgcagcactgtttacaatagctaagatttggaagcaacctaagtgtccatcaacacatggatggataaagaaaatgtagtacttatatacaatagaggtcattctggaactggaggtcattatgttaactgaaatctcaagccaggcacagaaagataaacatcacatgttctcacttattttgggatctaaaaatcataacaattgaactcatggatttagggagtaggagaatgattaccaaagcctgagaaaggtagttggggcaggggtgggggtgaggaggagaggtggggatgtttaaagtatgccaaagttgtatagttagagtgaataagaatactgtttgacagcacatcaggggtactagaattaacgatcatttaattgtacatttctaaataacaaaaagagcttaactgtttgtaacacaaaggataaatccttgaagggatgaatactgaattttccatgatgtgattattacacattgcatgcctgtaccaaaatatttcatgtaccttataaatatatacacctactgtgtacccagaaaaactaaaaataaaaaaattaattaaagatctgttataactgtaacattttaaaataagtctcatggtaattagaaagcaaaaacatgatagacacacaaaaaaattaaaaaataaggaatcaaaacataccactagcagaaatcacttagccacaaagcaagacaacgagagaggaagaaaggaaccaaatacctacaaaacaacaagaaaataattcatacaatggcagtgaggagtccttatctaccagttattacttaaatataaatagattaaattatccaaccaaattacgtagattggctgaatgaacttaaatacacacacacacacacacacacacacacacacacacacaccccaaatatatgcagcctacgaaaccccactttaagtaattgtaagaacacacatagactaaaagtgaaggaatggaaaaagatattttatgcatatgaaaatcaaaagaaaggaagaattacacatatatcagataaaatagactttaagtaaaaaaatcataaaaagagataaaggttattatataatgataaggggttcaattcagcaagaacatacaacaattataaatacatattcatctgacatccaagcacctaaacatataacataaatatggatagatctgaatggagagccagactaaaattaataatagtaggagactttatcaccccacttttaacaatggagagattattcagacagaaaatcagcacgggaacattgaactcaaactatactctagatcaaatggacctaaaagacatatacagaatattttctctaacagctgcaggatatacatcttttttaagtgcacatagagcattttccaaaatagatcatgtgtgagggtacagaacaaatcataaaagattttaaaagactaaaatcatatcaagtgtcttttccaacaacaatggaatgaaactagaaatcaataatgggagaaactttggaaaattcacaaataaacatgaaaattaaacaaacgtgttcttgaacaatgagttaattaaaaaattaaaataaaaattaaaatatctgttgagacaaatgaaaatgagagcacaatatacaaaaaccgacagaatactgcaaaattggttttaagaggcaagtttatagcaataaatgtctacatcaaaaaaaaagatctcaaataaataacctaatacacctcaatgaacaagaaaagaagaaaaaactaagcccaaagttaataaaaggacggaaatagaaagattagagtagaaataaataaaatagagtctagagaaacactggaaatgagcagtaaaactaagttgttttttgaaaaaaatatataaaattgacaaacttttagctagactaagtataataaaaacacagaagactcagataaagtcaaacatgaaaaagaagatattataactgatataaatacaaaggatcataggagactattatgaactattatatatggacaaattggataacctagaaggaatggataaattcttacctacatacaacctaccaagactaaaccatgaagaaagagaaaacctgaatagatcaaaaacaaggagattgaatcagtataaagtcttccattaaagaaagcccagaatctgatgcctttagtgtctaattctattatatatttattgaagaattaatgccaattcttctcaaacacttccaaaaaattgaagaggagataatacttccaaattcatttcatgaggacagcatcaccctgataccaaagccaaacaagaacatgatatataaaaaaaagaaaaaaagaaactacagaacaatattcctgatgaacgtagatgcaataatcctcaacataatattagcaatgtaaattcagcagtacattaaaaagtttatttgctatgatcaactggtcttgatcatgtacttattactgtgatcatgacttaaaactatgaaactactagaagaaaacctaggggaaaagattcgcatgtaccctaaaacttaaagtataaaaaaaaaaaggataaaagtaaaaaaataaaaaataaataaataaataaataaataaatattctatcctaaaaaaaaaaaaaaagattcgcaacattggtttgagcaataatttggggatatggccctaaaagcacaggaaaaaaaagcaaaaatagaaaaatgggactgcatcaaactaaaaagcttcagcacagcaaaggaaataatcaaggaagaggcaacctacatgaatgagagaaaatattttcaaactatatatctgttaaggaattaatattcaaaatatataagaaactcaaataactcaacggaaagaaaaccaccaaattaaaaaatgggcagaggatctgaacagacatttctgaagagaagacatacaaatggccaagaagaatatgaaaatattttcaatatcactaatcatcagggaaatgcaagtaaaaaaacaatgagatatcatctcacacttattagaatggctatcatcaaaaagacaaagataataaacgctggcaaggatgtggaaaaaagggagcacttacacactgttgatgggaatataaattaatgcaaccattatgaaaaagagtatatagagcttcttcaaaaaactgaaaatagaactatatcatataattcagtaattcaactattgggtatatagccagagtaaataaagtcagtatgttgaagatatagctgcactcccatgtatgttgcagccttattcaaaatagccaaaatatggaatcaacctaaatgttcatcaatggatgaacggataaagaaaatgtggtatatgtacataacgaaatgctatttagccacaaagaaaaaggaaatactgtcatttgccacaacatggatgaacctgaaagacatttggttaagtgaaataagccagtcacagaaagacaaatatagcatgatcttactcctatgtgaaatctaaaaatttgatctcatagaagtagagagtagaaaggtgtttaccaggagttggggtggttggtgggaggaggagttgtggagatgttgtcaaaggatacaaaattttactcagaataaataatttcaagagacatcatcactcacgagggttgaaaatacaaaaattcaataacatgtctaacttcagttagacttcagctgagcaaaactattagtggccaacgtaacaactggtcccagtcttttaaggaaaggtttcagaacctacaaagagtttaataggctactacagatatcacacactgatctttttgcaatgaagaatgatttttgagttttaccaaatttttaacaacgtgcaagacagagctgggattgacagagaaactaaaaaagagaagagggaagaagaaaatacatagaaaataatttagctaatgagtgttcatagacagttaatataaagaaaatgccgaatgatatacctagacacaaaatatatttacatccaaaatgttctcttcaatataaacatttcccagggccccaatatattcaccttaagaaaacaaaaagcaaacaaacttcctcatcaattcctctaacagatctcacaactgaagtatgatgcgtgcctcggaagctctcaaaactgtcagcatctgctttgctgaggcccatttcatttgatcatttatttgacagaggaatagctccagttttgcagttttccttaaattgctgagatttttccccccaattaaatcacccagtgacagcagcaattttattaggctactttttaaacttggtcagaaggcagaaagataacaagctaaggcgtgcaacaatataaatcatgttaagaaccatcactcagtagctctggatccaaatcaaagctatgaaatacagaatgacattggatgctgaagtgaaaaataccaaccacatttctctgaggttcagacattaatactcagacacattttatataacagtctgctcagtagattagtaaaacagagaccataaagcctggaaatcctcctacccacattaagctaattgagttggagacatccaattcatcatatttgcaggctgatttataagcaactcaccctgccctggagcagaaagtgaaatgttatgagttagctactcttaaaatttcaaacccagcaattctgaacctgtcaataccttaacggtacagagacaagaagaagaattcagttcaggtgcatttctgtgaccctgatgaaaaaataaatacccagtgcacattttatgactgatatttctatgaagagtctagccacatattggaaactccctgtgatagaattctatggaaagtgtatcatcattttagcaagttgatggggcaatttgaaatcagttctttgctagaatgcaacttccatcaagcataaagaaaacagccttatgacagttaaaacccaaattcaaagagacaagatattattgctcttggcttgaatagatggtgaaagcttatggcactaactaataaacagaaaactgccttgtaagaatacatcaaaaatactgaggagaatggaatcagaagcagttctgcatttagagaaccctcctgaagcaaatgtaccctaaaatccttctcatctaggggaacctgttgatctttcctgctgagggctgctgtggaattgggcaggcctcacagacacaatagattgggaggcctcctcctattttttccaaaatttacaaaagatttattctcaaggacaagcattccttaaccagccagtaactgtgggacagaaaaataggaatcatagtttctcagaaatgaaagaaaacttgaaattcattccatccagaaattcctaaccttaagtctatgttccataggaagtccatagatgcccttcaagtaattcatatcatttctgaagttttatgcaatatttttgtgggtatagttttgtgggtatagtttttatctagggaaaggggtcatagtttttcaaatcaatttctcaaagtaatttatgtgtggaaaaaggttgaaaatactattcaacattctctttcctgaatcatctctacaatatctcattgaagattttctaccttttgcttgaatacctccaatgacaggaagctcactaccttatgaggcaggtcattctctctttggaccaagttatttaaaacaaaaattttttaacttacataaactctgtttttctttcattgtttactctaaaggtcttgatgtctacaaaaattgtatggacaagttctttgttttaaacaatttaaagatgaactaccatgtcattgtgagctgagtctattctccaaggaccacatcactcatagcctttgatgttcccatttgacatggttttaatagccttgccagcctatttacccctctctggaagcaccccaatctgctgccattctctctgaaatatggtcctcagatcctaatgatacattctagcatagtgtagaattgtcatctctttgttcttggcatgcaactccattaatgtagcctaaaattacattggttgtttggaagtcccacatactgacaactccttgaactaaatgtgtgctgacattcccctctgcgcccccacccaccacccaaccctcactgcccagctcctttttctttatcatgtgtttctcttacttttccattgaccattctagaaagtgggaatgagaaaaagagggtggaatggaaaatagggactagggaaatagaagttgaggtggaggtagccacacaggaatttgagtgtggaagaaggggttctttaagcgtagatggtaaaattcaagccaacaaaggataacctccttaatcttaattacttcccacaatgtgcttctattatcatcagtatataaatgtggaaattaggtttaggagcattcagtgaattctcaaatggcacatttctgatgccatgcctagctcttatcccacacactgccctgcagctctgggaaagcatcccatagagaaataatagcattgctacgatgtacattagtctttgagatgtaaatcatttacattttctttttacaaaactatctcatcagaatttacacaagtacacaaatggacagaagagttaaataatgatgagacttatttttactgaatcaatctgatgcacacagtttagttggagagatttgggatgaagagagaggttggtctagcgtcaacaacctagatttggccctttactaaagctgaaaattggcataaacaaataataactcagtgataacaattttcaataacatcccctagaaattgaaataagtgaacctctgtgatctgctgagttgagaacacctgttgtttacttttcttgggaaacagagacataaactcaggtctaggaatccaagacccggattcctgtctcagctatagtgttagctaggtggctgccttgggaaagtctcataacagctgtgattcttagttgctttatttgtaaaattaagtaattacaatatgttattcctaatgcctctgctgagatgtaagtctagtgattctatgaggcttcctattggatattgcgttatctgattatttaaggaatttattgctgaacttaaaagcctcttgcctgggtctgtgcagcgcattatctaaactaaagcaaggtatcatcttgtatgagaaggggctccattttctaattcatataaatatgttgaatgagtagcggcagctcagctttaattgtttataagagaagtaaaacctacttttggaaatgatatttcaaatagttttaaattgcttgtttataattaaaagcaggtaatatgtcttatagtccactgagaaaataaactaccatcagaaacaagtttttaaattaaatttctttgggctgggcatggtggctcaagcctgcaatcccagcactttgggaggccaaggtgggcagatcacctgaggtcaggagttcaagaccagcctggccaacatgatgaaaccccgtctctagtctctactaaaaatacaaaaatgagttgggcgtggtggcacatgcctgtagtcccagctacttgggaagctgaagcaggcgaatcacttgaatccaggaggcagagactgcagtgagcagagatcatgccactgcactccagcctgggcgacagagcgagactctgtctcaaaaacgaacaaacaaaaaaaaaaaaagaaaagaaaagaaaaaatttattcacatgtaatatgaagcagtgaaactagaaaatctctaaagcaccagtcctgaaaccagaaaatctctggaacaccagtctagagtaacttcaattactgtaatttcaagttaactttgtctcattacttctgtatgtgccctattgcttaatgggccttaaggtcaaggtgggaggtggggagttgttctgttctatgtaaaggaacttcagtaactgtctcttgaatgcattttaaatgaacttacctgtgacccaaaattggccacaaactctaacatactcagtgttctgccaattcagaaggaacaaatcatctgccttcagagtgactttggtgagtcagctggactggaagaatgtatcctgggagctgcattaggattaaatctgattgctagacactggcaattcctctctgagttggagaaaatcaattcaaccttctctaccatgttttcttgtacaacattctgtcttatataagattacataagtttcctttgtatataccaatagacgcatttaaaaattgccttctggactatttttatacttattaaacaagatgaaataagtgttttgctgtatagcttctgtccactaaatgatccttgcacatcctgattatctttaaaggttatgcatatgttccaatatcttccatcactagcctcaaaagaaagccatttctttatgctttagtaaattcttgtttggaccactcaaaatgtccccaactcatttgctacaatttgagctaaccaacatgacattcacttttgcagaagagataataatttgaataacacacccttacttagctgagataggaatgttctacagtgtaaaactattctctgaaggacatcaaggatgaggatttaacaatttccaatcattactgagagctcaaagagttaactaatcttaaatttagatttgttcttagatacatacacactttctatttttttaatgtgaaataattaccatttactgagcaactactaggcgccaagtactacagactttccacgtattatctcaagtaatctttacagcatggaatgtgaattccatactattatttccaagaggttagaagttaatagatttactaatagacacagctagaaagcaactaagctacattgtaaacacaagtaagtctgattctaaagcccatctgctttccactatatgctattacttttctggattagctgggaaagagttaaaaattcaacagcactaacagtctcagaattaatttttgcagagtttggaaaaatttccgattatctttgctaagaaaaaagaattgaaaacatgctcaccaaaaggttacaattccagactgtttagaaatatgggagggatgtagaagttacgtatcattttagggtaccactaacaatatcatctttaaccacagtaacaataagtgccttatattgatgagcagcctctgtgagtgttagtacattatttctaattgttacagaaagttttggcaatagtgaaatcttagttttgagaaaaatttctgtgtaactgggttaactctagaaatatctgcagctacatataatcactattaacacttatctagaattttctataaacacttatttttaaaacttattatgattttaataacctaatatttcttagaaaaaattcatcatcattattgttattaatactatgtacataaaagaagtagaaaatttgaatttcatcacacaaactcatctttcaaaacccatagagagaaccccttccatgggtgtccagtcttttggcttccttgggccacattggaagaagaagaattgtcttgggccacacataaaatacactaactctaatgatagctgaggagcttaaaaaaaaactgcaaaaaatatcataatgctttaagaaagtttacgaatctgtgctgggtccattcaaagctgtcctgagtcacaggtggcccatcactgcaggttagacaagcttgccttaacccttgatgactttggttctaaaaagaattcttatattttgagatgctggttcagtcctatgcctaacattcctttcttcccgcttttcaatatctggcctaaatagccagaattattgggggtatgctgtttgtaccctttccagttaaagataattgaggaaaggaatgctttatttgcatggaatttcgatcaggagattttgtgcctacattcagaatgcgtctgtcaaggccatatttcaaccatttcctctcaccagggactagtcctggaacacaatgtgctgtgcacaagtcacaaatctctgccaaacctttatgtttttattaactaagagcttctaatttagcttcacaaatctgtttcttcctcaagactagatgcttccaggatgatcatctcagctacttccaccatctagtggcaagagatagaaatgaaaggattttacacttttaaagattattgcctaaaatatcaagaatcagaatagttttctaatcagtggtattattaaaaacattatgtctagaaaggaaaaataaacacattattttcagttgctggtcagggcctcatgactgttggggtcaaatgtaactcatagggtatttcttttttttttttttttaaattaatcaaatacgtattttaaaacatctgctatttggtcaacaccatcttaggcattgtagaggaactacaaatttctgtatttaaaagacatgactcccttttagtagaagttcataacttagttatgaaaatagaagctccaagctactaagggctaaatgttgtggtaaatttctcactgcttcatgttatcctcggtaggtacctctctctccccaaagcccatatatggtggtggtggacctgtgtttcagtcctctgtgttcttctcccctctcctgagcaatcccatccattttcacaactccaactacactgaaaacgtcaaagtttccattttctagatcagatctttatttcaaactgactgttaaacacttctacctgggtataacataaatacttcaaaatcagttactccaacataaactcagaaattatcccactccctcccctgccattctaaaatctgctcttcctctggcattcttggtttcatttcatgatacatcctctactctggggtcaaattttaaaaattgtaaattatcttctatttctctctcttttctaccttctatatgtaatatgtctcaatgtcctgatgatatctctttttaaataagccttctaatctatccttcccttcaaccccaatacctctgctttacatcaaagcttatctatcttttacatttcacctgatgctcttgaatctgatgtcatacctttccaattattccttccactgtaccacatgacatgaataacggtctaatttgcatatcaggtcatgtcattctcctttttaaaaattctgtagtcacccctcattacctacaaggtgaagtccagtctctacataaggtccttcattacctgttcatgcccatctctcttgctttatgggatgtttgggcccactctatgcccctttccttaattcttacattatgcgtcagtatcctagccaactacttggcaattctcagaacttttccatactgttacacaactgctagagtatagggcaaccttgacttttctcccttatttcatacttccttcaagtaaaaaatgatctcgtgtataattttttttctctgacaacacccatcctaacctctccagctccaaaaaattaaacagtttttctacgtcttgagagacctcttctttcacactttctttattgtacgctccaaaagtatatgtgcccaaccaaaatataattttatattaaagaaataattctatgacaaaatatgtctgggaaatactttgtactaatcatatttccatcttagatgtttatatttcatattattatagtaaaggctctgagaaatccttcaataagttaatggatttaactcctcaaatgtgtttaagcactcattcatacctttattttaataatgctgacaaaattccaccaaacatactttgggagatgctagtctagtttcattttagattccaataagggagtaaaatgaaaagcaaaacaaaacaaaaataagatgcagtccaggtcttgggagcttacacatttactaagagcaagaaaaacagcaaacctagaggaaagaacattatatagcagtccttcctgatcttaggttgcacttttcatgcagtttcagctaccagaggtcaactatgacctgaaaacaggtgagtacactacaagatattttgagagacagagagagagcacattcacataacttttattaaagtatattgttataattatattttattagttattgtggttaatcccttactgagcctaatttataaatttaattatgtgataacatacttatgaaaacataagaaaaaacatagtataaataggatttggtactatctgcagtttcatgcatccactgggggtgtttttttttttttttttttttgagacggagtcttgctctgtcgcccaggctggagtgcagtggcgcaatctcggctcactgcaagctccgcctcccgggttcacgccattctcctgcctcagcctcccgagtagctgggactacaggcatccgccaccacgcccggctaattttttgtatttttagtagagacggggtttcaccgttttagccgggatgatctcgatctcctgacctcatgatccacccgcctcggcctcccaaagtgctgggattacaggcgtgagccaccgctcccggccccactgggggtcttaaaatgcatcccccacagataagtggggactactgtatagttcaacaaataatttttagaacaatagaataaggcatattttaaaatgatgactatgtgggatgcactaactccttgtgccataggatcttatgaccagtcggggttggccaagagttaacaggaaaggctttatgtaggaagagggtttttattgtacttttggctaaaacatactttcctatgattgtgctctggcaactctagtaagaaaatagtataaaaatacacattgttatcctttgtctatagtttttttattggcttcttcatgcttcagctctcctcctataatttctcaaatgtgcattgcctacagattctcaaatgtcttctatatatactcaacaagtgcccagttgtctcagggtattgaagtttacccaaacctcacatactcctaatttccagcaaagcttcccagaactgtttattccagtccctgtgaaaattcgaagacacacaataatatttatctgattaaagtaattcacaccaatttataaaaggaggctttaatcttccttgtaattagttactgaacctaagaatctaagccggttttgactgcaagacacatttcttttttaatacaccctaggaaatactgccaattttaactgcaagatgccattgatcttaagacacatccagatttcagatatgttaatatgtgataaaatatgaagtttagaatttatgaaattttgtataagtgatgattaggtaaggaagaagaggacagcagttaactccctccctttctctctctctctctctctctctctctctctctctctctctcgctaataaatactcctacagggcactctggtaggtgcttgggccccatagttttaagtttgaggagttcaaatttcagtttcggaataataataagtaacaaataattaattatgaatcaagagaataatctaggtactgaaaatcatttcactgctctttgtttccccattacttagtgctatagtaggcactcagttaatatttattgaactgacctaaagtgagaagacctaaactgaaaagaaaattcttgtggtttattataggccaatttcttttatgaaagattctaggtagcatctgaagagaatgcatccccaccttgaggaaaggaaaacaaattcccttgaattcaccactaaattgcatttctctttccaatcccacacttcacactggccaaagcactctaatgaaaacaggctaagaaagcccatcctatcacttaggcagctggtgtgcaccaaagacagatgaatcttagaaccaaggcttcaagtaatacacgacgatggagaaaatgatactcaaacctgtgacagtgagattattcagctaatgattcagagcccactcaatgtgacatttaaactgttatccagcaatctcacactctgtttaggcatgccatatgtaaattctccattaatactagagtcacattgttttctcagtaggattctgggggaagcatctgattatgtgttttgcctccttttcttccttttagtgtttgacccaagaataccagacagataaaagaaggcaaagaagttgaaaatatgacagttctaatggagaccttgtacctttttagcagttccctgattctaacaggcttcctttatgagaaaataacccattagattttaatcattgcaagtttttcaacagttgaactgtgataataacaacttgattaggaaatgtatcctattgctataaaaatgctagtgcttgaatctgatatcacagtactgtgctggagctcactcgtactagctcatgagagcctcatgtgcctccatttccacatatttaaaaagtagctttaggttggtagcctgaaatcagccaggctgggaatatttacatcacaaaattggccaaccttaaaacggactttttttttcccctagaaaaatggtacacatttattcctattactattggtgttgaaggagagatacacagagtgtctttactaagacaatctaaaagcatatcttgagctataaaatcccagatcatactgaatggacaaaagttggaagcattccccttgaaaaccagaacaagacaaggatgccctctatcaccattccttttcaacacagtcctggaaatcctagacaaagcaatcaggcaagagaaagaggtaaaaggcatccaaataggaagagaagggatcaaactattcctgcttgcagatgatatgatgctatacctagaaaaccccttagtctctacccaaaagctccatgatctgataaacaacttcagcaaagtttcaggatacaaaaccagtgtccaaaagcagaagtattcctatctaccaacaacatccaagctgagagcaaaatcgagaactcaatctcatttacaatagccacaaaaagaataaaatacctatgaatacagctaaccatggaggtaaaagatctctacaacacggatgacaaaaaaattgctcaaggaaatccaagatgattcaaacaaattgaaaacattctgtgctcatggataggaagaatcaacattgttaaaatggccatactccctaaagcaatttacacagtcagtgctattcctatcaaactgccaatgacattcttcaaagaattagagaagaacaattaaaattcacatagaaccaaaacagagcccaaagagccaaggcaatcctaagcaaaaatatcaaagctgtgagtatcacattcttggacttcaaactgtactacagggctatagtaaccaaaacagcctaatactggtagaaaaacagacacaaagaccaagggaacagaacagagagcccagcaataatgctgcacaccgacgattatctgatcttcaataaagtggaaaaaaaccggcaatggggaaaggactccctagtcaataaatggtgctgggacaactggctagtcacatacagaagattgaaactgaaccccttccttataccacgtacaaaaaaatcaactcaagatggattaaagacttaaatacaaaacctaaaactataaacacccagaaagataacttaggaaatactattctggaaagaacctggtaaagatttcatgatgaagatgtcaaacacaattctgacaaaaacaaaatttgacaaacgggacctaattaaacttaagagcttctacacaacaaaagaaactatcaacagagtaaatagacaacctacagaattggagaaaatttttgcaaactatgcatccaataagggtctaatattcagaatccattaacaagccaaaaaacaatcctttaaaaaaagtgggaaaaggacatgagcagacacttttcaaaagaagatatatatgcagccaagaagcatatgaaaaaatgttcaacatcactaatcatttgagtaatgcaaatcaaaaccacaaagagataccgtcttacaccagttagaatggcttttataaaacgtcaaaaaataacagatgttggtgaggttgcagtgaaaagggaatgcttatacagtgctggtaggaataccattatttcagctattgtggaaagcagtttgacaatttctcaaataacttaaaacagaactgtcattcgaccaagcaatctcattattggacatatactcaaaggaatataaattgttctgccgttaagacacacgcaaaggtatgttccttgcagcactattcacaatagcaaaggcaaggaatcaacctaaatgcccatcaacagtagctgggttcaggaaaatgtggtacatatacactacaaaatactgcacagccataaaaacttcgggaggccaaggcgggaggatcacgaggtcaggagatctgtagtcccagctactcaggaggctgaggcaggagaatcacttgaacctgggaggtagaggttgcagggagccaagattgtgccactgcactccagcctgggtgacagagggaaacttcgtttcaaaaaagaaaagaaaaaaaagaaagtaaaggataaagaatgagatcatattctttgcagtaacatagatggagccgaaggccattatcctaagcatactaacacaggaacagaaaaccaaatactgcatattctcacttacaggtgggacctaaacaatgagtacatatggatacaaacaagggaacaacagacactgagacctacttgaaaatgatgggtggaaggagggtgaggattgaaaaactacctatttgatactatgcttattacctagtgatgaaataatctgcacaccaaacctccatgatatgcagtttacctatataacaaacctgcacatgtaccactgtacctataatacaagtttaagataaataaataaataaataaaaactcaaacacatcttgtttagcataaacaacacctcgagaaggtcatgatgaaaaaaatcctggtcccaaaatagctacctcacagccccagtgtagaaatccttgatgagcttccctttccctcctcttcacaataccttggggccataccacagaactggtggttccaaaaaggagaaaaatctattaggaccatggtgttttatcccaggggcctgctattcatagttggctgttcttaaaactgacatgaggtgccctcaataaaaggctaggaaattagttagaagtgacataaatataacagaaaatctaggctaagagaaacccattgaagttgaatacagttaattttaagattcctggaaggcaaaggataaaggaaaaataggaaaaattcctttgtttatatgagatctgagctttagaaaaagcatactttcccctcaactctgatatacattttccaaatgagacagtgagtagcataataaatgatggtgcaatcaccaaaacagcagatgttcagataattatattatcatgtatatgctgaagacttaatatacaaaacaaagctcccatggtgctttcattgttctgttcattttttttttttttttttttttttactgtaaccgggctagcatccctcataattataatagcactaattataaaatttggactctccctattccatttttgaatcccagaagtaacacaaggaatctcactactttcaggcatgatcctactcataagacaaaagatgcacttatttcaaatatttcatctatcattattagttgacttaaatataatactaataatcaccatattatcaattctagtagaaggatataaaatgctagccttgattatcctacctacttagcctaaagttctttgggaggtatgctctagaggtgattaaggaggaaaggttgggaagggagaaaggtggcgaattttgtgtatctgtgtgttgggggttgtggcatggacagggtctcactttgttgcccaggctgtagtgcagtggcgtgatcatggcttactccagcctcaacttcctgggctcaaatgatcctctcacctcagactcctccatacctgcaactacacttgcatgccacctcgcttggctaatttgttaaattttttgcagagacaaggtcttgccttgttacccaggctggtcttgaagtcctgggatcagcggtcctcccacctcagcttcccaaaatgctgagactacaggtgcgggccactgtgcttgatctatggaggttcttatagggagtttttcaaccagtttgaaagaataaaactgaaatgtaagtaccttcaatgcagttcagtctctcggccctgccctttctcaattttcagtggtttgtaaacagagtaaggatcagcaattgttagaaaatattaaagagtactgtctaactctaggaatcagcaagattctatactgaacacagaattctgattcctaaacaggaccttaaagacaattttgtttacccttctgcggaagaaggagtcttttctacaaaacctctgacgagtcattatccattgctgaaagatttctagggatagggaacttctgtctcatgaagtagtctataatttttctgagtagctataaatgtcaggagctgtggtgttaaaatgttcccaaatataatatacattcctgtcagttatgcacagtggatctgcttctgccttccgcatgacatcgatgtcgtgtttttcagatgacagctctggaggtaaaaaaggtttagtcccatgtcccccaattcttaatcttttcttctccaggttaaacatactcatttccaccagtcatccaaatacttgcaaagaaattgcggagatttgcacaatgaatcccagaagcataatattaatatttacatatttttagttactatataatatttactggaatttgataattggtctaatatttttatgtattggtagtagctatagctaatttatttgctaatacatttttagcataccaatatgtttgaaatgttccaaaatttgaaacgtaaggttaagcataagttaacctctcttagatgtttttgcaggtataataagatccagagaacacgggagacacttttatgtctttattttttattgtagcacagctgtgtagaagtgctggcaaaatgaatgttctcggtgatgaaagaaatttttgtttagcaataattactaaggagttaattggtaggtgcttttattttttccatttcaattctgttatttcagccatattctgattttttctttttaaactttaatcaacctttataagctttttatcccaaacacaaaatccagtagcgccagttcagccaaaaaaaaaaaaaaaaaaaaaaaaaaaaaaaatcagagtaatttgcacagccaaggggcatagaaaagtatttttctcatttaattataccttcttcttgtcgaaatataatttatcaagcaattgtttaaaattaaattttaaaaagtagaaagtgttgggaaaagtatgacaatgaattgaaataaatctagtaaacaattttctctaggataaaatagaggaattgattagacaattcacacattttcctttatagtttagacagtaaagcaatcattagatgtgatcatgttatatttgttccctttgttggaccacgagtactgacaaacagagagcatctgagcaaaaccttgatgtacttggggtttaaaaatatgtggttagcttattttccctttcagtgtttcactcttggcgctttctttactccattctcagcaactaaaatgatttttccagatattcaaacaattgcaataaaaatatgtcccaaaaatacaaggtgggcctccaatgcacaagaaagaccctttggcaacccgtgtcctctatcatgttttaaaagagcctcatttaatcgggccagcaaacatctccattagcaattaagaccaactactgtcaccaactataaagtcggaagagcaatataactgaccttcagaggagaaatatgagactgcaagacatatccatggacattttctatttgagagaggttcttttctgatacatgcacgagttctgggcctcttacttcgtgggttagtcgaggtaaggaatgatcatgtggagcgtcctcatcttgatatcgatacttctaggagaaaagaaaagaaaggacaagtatgtatatatcagtgtttgtaaaggatatagactgaacttcatattctaacttcatcaataggacacagtgtgcacctactgttgacttcaccaaatgggctttgctgcagactcttctggcggtcaccatagaccaggtcaaatgcaagcagaactgagttaaccacgaatattgaccaatgtccagacttgtttctgcctgataatatactctctttgtttatgagctacagaaaggtgataacaaatgagacagaacatttactttattcaagtaagtgaggaggtaaccctcctgaccagagtagctaagtatgtgttaaaaattctaggttatggatggagaagaaaaaaagtactgagcaagaagaaaacagaattccaatatatcccatttagaaaacttaattttccttcagaatttgtgagtgatttaagttccttttgaaatgaggaaaaaattttgtcacccacattatttgtattagactcaaagagaagacaagcttatctttctttacttcacccgctaggagaaggagtattgatttgggttagtcagattccaggacaaaagatcacaatttttagaagcagagctagctcttttaaagaactttaaaaatcaaggcaagttatctgcctatattgtatggctccctgaggggacagaggtaaatacttcttctctcttgttcccttttcctcttttcttaaccatcttgcttacacatgactgtaccagtaaagattattgtttgagtcttccaaacagatataaggaagttggcagagaaaaaaaaaggttcagggttaggaatgctctgagggaactcagccctcttcttggggtctatctccatttttggcctcagcctgggtctccatcctatttctgtgtctttttctagtttgtaccccttttcccttggatctgtccctttagagttccattgttcaaggctgttgtcctacctgggaaagaagaaagggaaccctctacatctgacctcttaatcagataataaagtgttagtttgctttactttgcctatgttccttgtgcataacacagggatattgggaacagggatctaaacattgtcataacaccatcacaggcttaattgtgatgtctaacttcttcccagtgtcccattattgttatcatcaatggttaattttttcatatacatatatatataaaacttctaggacatcagctctcagactgactcatagtggaaaagtaacaagaaccactccagggatggtaattcaatctgttgttcactcttcctcagaagcagattatcaatacttacacttatactttctggggcaaggtaggctttcttcaatgtcccaagtaatatctctctcaacaaaaataacaatgccataactgcagtttccaaagaactctcacaaacttgttccattgcaatcattcttggccattttacctatgagaaaactaacactccaagaagttaaggtacttgtcaagagtcaccttaactgacgggcataagcgccaagaccctatccagatcattgcagtctgaatcctctttcagttatcatcagcctctcctctaccccataaagagatgaagtccaagtctgaaaactgaattggctgcttagtagaaaaaaaaaaatcactgagaatacacgacacaatgaggttagaacatttctgtgaactgcaaataccatgcttttgtttatctaaccttatgaataatttgggaatgtaatctgcctcagaaacatggatcaaatttaacattcacttttgatcagttacgcccattatgagtggaatagtgtcacacttgcgcccattttagtttctctggctttcaacccattaactcccacgtctgctccacatttttgattctctcataaaggcactaccatctatgttgtcatctgagccagaaaagtaggagtcaatcagactccatcctgtcttttgcctgctgccatctgccaatttaataagttgatgagtctgcttgatttatatcctaaataatacttgagtccacactctccttattcttcccatacccccaccaacactgtccatgttcaggatcccataagttctcagctgggctatagaaacagcctctgagctggctagcctgtctgtggggttgcccgtttcccataaattctctacactgatccaggggactttgtgaatcacatgctgataaagtcctccttgaaaacttccaatggctcacactgcccacaggacagaatacaagctttcttacactgccataaccctactactatatatgctgaacccccattacttctgaattacttttttttttatgagacggactccagctcttgtcaccccaggctggagtgcagtggcacgatctcagctcactgcaacctctgcttcccgagttcgagcaattctcctgcctcagcctcccgagtagctgggactacaggcgggcaccaccacgcctggctattttttttatttttagtagagccggggtttcaccatcttagccaggctggtctcgaactcttaccgcaggtgatccgtccacctcagcctcccaaagtgctaggattacaggcgtgagccaccgcacccagccctgaattacttttgttctcaacattctcactccaataattataaaataaatataaacaaactattgagtctcatttttaagcttcttttaaaatttgtggtaaaatacacataaaattttgaccattttaaccatttttaagtatacggttcagtagtgttacttatattcactttgttgtgcaacagatctccagaacttcttcatgtgcatgttcccataactccctagagtctccaattacaactcttgtcatgctatatggttgtgtattttctgtgtttttccacggaactgtaaaatcttgtaaggactgggaccacattggtattgtttattctcacatctccagtctttagtcatatgcacaacacatatgctcaataagtgtttgttgaatatagccatgagctaccattacacaaatggatgaaatagatatcacttgcttaagccacaatactattttggctactggatgaaaactttttcactataaaatgctgtgaactcaggttcaagtaaaaaggacaatcacatcatttgcttgacacaatctaaaaggacatcaggctattaagtactacatatctttctcctcatcattcatttcagtatatgctaagaatatgaactgaaaagaacaacccttgacttcaagaagaccataaattactgagttatacttgtgcacagataagctaccatacctcgtgataaactcagttctgtgggagcagaaatgggcaagcatttgtggctggctggctgcagcttctcagtttgaaacagggtctggaataccataaagaggtaaaagatattccagccaaaggcacaacatgtgaagagacatgtggtaagaggggatgatgtttgagggaacagtgaggtcttaaagtggattgtagcagatgctattgtgtccccatccaaattcatggaaatcttttttacccattgaaggctcatatctgcatacttttcaggaacattacccttaggtgattgaagcctcctctcttggatgtccacaggagtcatatttgaaccccaactctcatacctcacggtgagacaaatcccgtgatgtgaattacactacaaagtatccagcgagattagcttaaatttagactgtacctgaacctatatttctgcacagttcctttgtgcttcccttactccctatgttttttttttttcttggaactgccctccataaatcatgcacacatgaaatctcatcttaggtctgcttctagtgagctgatgtaagacttggatgaagcttgggatgtaaggtacagtgtggcaggaggagactggaaggcagattggtgtccactgtagacaatagggagtcatccaagagaccgtggacctaaataatactctgcccagtgccaaccagacattcccgtgtttttttttctttgagtcttcagcctatgactaagcaagaaatgacaagaactgatgagaaagtcacatctttaactcaaactcaagcttccaaaggaatcaccctgatatgatatagcagaatttctctgcttgtattcaaatctttatttcctttggctgaacaaaggtactgatttataacactaggattaatattaacaccaacattaatgctaatcctaacactaatgcaatattacaaccaataataataccagctacagttaatgtacctggagccatattaaatgctttatatccatcatcaccatatgagacataggtgttattctctttatcttagactcagataattaggtatttttctaagcttacatacctggaaagtggcaaaccaggtttcaaatacatgttaatttcactctagagaaagagcacttagtcttctaagttagttaggactcaaaggtctttagaggacaactttatcttcaggaaataaaatttttaggaaatattcttacaccctgactaagaatcaaccctaacattctgggtaattctgagtcaaacttttcattccaaggcttgtctggtaggtactaatgtcattctgggcacctttgaggatttctctattgcctacaaaatgagggccattggcagaaggcctctgtattgcagtctgtgctttcttctttttctctcctcagcttggtctgttgaaggggacttgagtaaaagaaactttgtaattctgtgaggaaagtcatcggtagcttgatggggatggcactgaatctataaattaccttgggcagtatggccattttcacgatattgattcttcctaaccatgagcatggaaggtacgttaaagttcatttggaaccaaagaggagcccacattgccaagacaatcctaagccaaaagaacaaagctggaggcatcatgctacctaacttcaaactatactacaaggctacagtaaccaaaacagcatggtaggtatagaccaatggaacagaacagagccctcagaaataataccacacatctacaaccatctgatctttgacaaatctgacaaaaacaagaaatggggaaaggatgccctatttaataaatggtgctgggaaaactggctagccatatatagaaagctgaaacgggaatccttccttacatcttataccaaaattaattcaagatggattaaagacttaaatgttagacctaaaaccataaaaaccctagaagaaaacttaggcaataccactcaggacataggcatgggcaagaacttcatgtctaaaacaccataagcaatggcaacaaaagccaaaattgacaaatgggatctaattaaactaaacagctcctgcacagcaaaagaaactaccatcagagtgaacaggcaacctacagaatgggagaaaatttttacaatctacccatctgacaaagggctaatatccagaatccacaaagaacttaaacaaatttacaagaaaaaaaaaaaaaaaccccatcaaaaagtgggcaaaggatatgaacagacacttctcaaaagaagacatttatgcagccaacagacacatgaaaaaatgctcatcatcactggccatcagagaaatgcaaatcagaaccacaatgagataccatctcactcagttagaatggcgatcattaaaagtcaggaaacaacaggtgctggagacgatgtggagaaataggaacacttttacactgttggtgggaccgtaaactacttccaccattgtggaagtcagtgtggcgattcctcaaggatctagaactagaaataccatttgacccagccatcccattactgggtacatacccaaaggattataaatcatgctgctataaagacacatgcacacgtatgtttattgaggcactattcacaataccaaagacttggaaccaacccaaacatccatcaatgatagactggattaagaaaatgtggcacatatacaccatggaatactatgcagccataaaaaaggatgagttcatgtactttgtagggacatggatgaagctggaaaccatcattctgagcaaactatcacaaggacagaaaaccaaacactgcatgttctcactcataggtgggaattgaacaatgagaacacttggacacagggtggggaacatcacacaccgggacctgtcatgtggtggagggagaggggagggatagcattaggagatatacctaatgtaaatgacgagttaatgggtgtagcacaccaacatggcacatgtatacatatgtaacaaacctgcatgttgtgcacatgtaccctagaacttgaagtattataataataataataataataataataaagaaactttgtaaacagattatatttcctgtttcagctctaaggggagtagaggcaggataggtgctcaagacagggatgcctggtatactacttatgtctccctatcttagttcattttgcccctgacttctggaattctatccccgtccccgttctgaagcttaaccctgcccccaaccccagattccttcatcaagcaaacttttttaggtccttgattatcagatttagtgttgcctcctcagaagcattctctgacttcaaaggttggaaatctgtatctcttttatgctcccatagtgttctgcacaggattttgtcaatgaataagaactttatactgtaatgacctctccatgtgcctatctcccctagtagcccacaaatgcctcaagagcagaggtagagtcatgttcatctctgaatctccaatgcccaaccgacaaatgacacataaaaagagatcagtaaatgtaagtttaactgaattaaactgtaattatctgagcaataacatgatccgcataatcagaaagccctcccagctgagcttgcacgcagttatactcatactcattttctaccacagtcccccctacacagacagaaaaaggctaaggaagtctgaccaggctctgctcagtacattctgctgatgcttgtgtgagtcagaacaaaccatcctgagtttcccagaatttaaaaacggaatcttacatgtgcctgatctgtcactggaggttctctggtgcaatttggaagatggcattttgctggcacagtgcatgataactgatccagaaattggaaatatttcaaggtttcataaacaaaaatctgagtttacctctgttgcttcataaaaagtgctctacttcccccttgtagcaggagttggcacagtactgatgagagagagagagagagagagagaaagagagagagggggaaggaacaaatcaaaagctggagagctagaacatgtttgtgtgcacatgaataggtggcatattatcatacctaatagtgaatactatccatgaacgctttgctaagaatgtcacagaaattatcccacttaaggctgatagtagcattatgaagcaggtataaaattaagtaataattacagttccttacacaaagcctgacattaaaaaacttgttagtttcactgtctctgttaactatactgacaaaccatgttctctgtgtcaagttttatctgtccctctgtaatccaagttctttgagggtaagaaccctgacatgtatctttgtatcctgcagagtggtcaggctagaatgctacatacatagtgtgtgtccaataggcctgtgttgactgattgagtgctgcttctggaagaaagcctcttaatttaaaaaatgtgcttgggctgaaaggaagcacatattctagaagcaagaagttggtaaaaacaaaataataataataacagaatttcaaagggatccctaaggaagaggtaagtgaatctcagaaaaaaacagaaaaccaaaaggacaaagaaaacgagctcaatgatgaaccacgtgaaaacaaaaaatttccatttcatctcaaggctgtagaaatttaagttccataattgagtattcccatctaggccctgccagccaccttcttattttgagaacaatgatttgtttaaacactttgacatttacttttagggatttctgcagtctgtacccagcaaatccttttctccagcttcttcctttttccatgatgcctcagcctatctatgacctgtgtctcatcacttttatatacctactgcatcctcactcctactcactgccttcctctctggagggaaaacatgggtaaaaaagaaaacaagagaagataaaggaatgttcagtgcaatgatcagatcaatatttatattcatttctttaatttgaaatgaattctctgaatgatatcctgactggagcacagttttatttctgttattccaatccattctttcagaatggttacatataggttgcaaatctgggggtggaggtaggtagtttcagataggagaaaaatgggaggaggaaaggcaagagagactacataattttccccttcacttcctcaaggtgacctcctgacttcccagattaggaagttctctccctgcctctgcacaccgcacactgctccctgcttcataggctttcagggcaccctgtccttattcttcataaaccttggcacatttttattttacatttatttctgtgatgattcgctggatgtttgtctcctccactgaactaaccgtccccgcccctctccccatggggtcaagggccccacctgcttggtttactgctgacctctagtgcctgccacataggagttacttgataaatgtttgttgaataagtaagtactttgcagccagatctatcttcaaaataatcaccctttaaaaaaacaatgacccacaattagcaatatggcttgcccaaagaacccttgaaagaggaatttttccagtttggagaagaatgtaagtaacagcactgatgggagaaataaaaagctctcccaggtgctccatttgaattttttttaaacaaaactcaaaagtgaaaggaaatactttcctgctttttttccacaaagaacaggacaagccaggatgttaattaaattacaaatcagctgtctgcttgcagctgacagagctttgtgtgcttccaagcaacgtcagatattttaaactctatgtaattacctactatggactagctgccaggaaggatgcttcatgaatatttaatgaattctaagatcctttttaaggaactgatgatttaaataactatgggagaacttactctagctcagtgccaccctccatctgttaactgaagatattggaaatgtagcctggtagaaatgccatttctcccctaaaatgagctaggctcaggatctagggaaggctagactcacacaggagaggtaactgtaattctaaagttaactgtttaattctaaacagacctcaagctctctaagtcagaatggaaccacagacctatgaactgggaaaataacgagtatggaattgcaaaatgaaattttgtaagatgccacacattgaggatgctctttataatttacaaagcactttcagcaacactgtcttgagtaattctctcaagaattggatagattaaacaggtatcatcattctcatttccaaatgagaaaacagagggtcagagagtttctaaagtgctaaataaatagtaaagctgtgtttcaaaccaaaatagtcctctgattccaagaggcagcctcacatagtggaaagtgcatgaattctggcattagacacatgatctcaaatcttggttatactacttgctatctgggagacatctatcacattgctggatacaactgagctttggttgactgaagttatgaaccaggaattacaatatatatctcatagaaatacaaagattgaatgagatgctgtactcctggcatacagtggctgcttggcaaatgtaatgctccctttggcttggagtctcaagaacttggtactctgcagatttgtcgtaacaacaacagccacaaccaaaaaaagtggtcgctaaaagtgaatttttcacacagcaaaaagtctttggtggaatgctcttcacttccacagaacagaaacaataataacctgttatacaattagtcacaaatacagtccttgaattttttgtccatacacatgagtattgtctaaaacatgttttctttgtagcagctaggtgctgccaccactgtgcatggctgagttcacaaatctgttgtaacctgtagcttccctgtcacttctctctctcacgctaagctttgtttctttgcagtaattagaatttttgccactgccatggctaatgctgctactggaaccacgagagcctccttggtttcatggtttggcaaaggattgtccttcatcaccagaggggctggagcttctgcctcctaaggtttctctcctcatgggtccaaaatttgaagactgattgttgtagctgccaaaatcactgtagcttccttcacctctaaaactgcttccatcatttacaaatccattatagccatcccactgccaccatatccacaaccaccacggctgccaccaaagctactacgaccactgaagattcctccacaatcatagttcataccaaaaccacctccacaaccaccaccaaagcatccagaactactttggcttctttggctcaatgaagcactagccttctcttgctttgacagggatgaatttactgaacactctttgaagtttcctaacttcacagttgtggccattcacaatatggtacttcaatcttattcatagagtcatggtccttaagagttacaaaggcaaaatccctttgcttgccactgcctcggtcattcatgatttcagtcacttcaattttcccacattcttcaaagtaatgtcttaggtgatgttcttttttttttttttttttttttgagaaggagtcttgctctgtagcccaggctggagtgaagtggtgcaatctctgctcactgcaacctctgcctcctgagtttaagtgattcttccacctcagccccctaagtagctgggattacaggtgcccactaccaagcccatataattttcttatttttagtagagatggggtttcgccatgttggccaggctggtcttgaacttctgatctcaagtgatccatccgcctcggcctcccgaagtgctgggattgtgagagtgacccaccatgcctggctcttaggtgatgttcttcagtgtcttctttagtgccactcatatggtttggatctgtgttcccacccaaatctcaagttgaaatgtagtccctactgctggaggtggggcctggtgggaggtgattggatcataggggtggtttctaatggtttagcatcatctccctggtgctgtctcatgacagagttctcacgagatctgattgtttggaagtgtgaagcatctcccctgccctctctcttcctcctgctctggccatgtcagtctgcttcctgtttgccttctgccatgattgaaagtttcctgaggcctccccggaagcccaacagaggccagcatcatgcttctggcacagactgaaagaaccatgagccaattaaacctcttttcctcttttccttataaattacccagtcttgggtatttcttgatagcagtgcaaccatgagctgatacagccatcaacaaatatctttttcacagttaagtaggcaactagtctttgagaatctcctcttgagacaactgtctttggttccacgactctctcatacctcatgtagcatggcatttagggctgcatccacctcctccacagtggcatatgtgacaaacccaaaggccctggagcaattggtgtttggatatctcattaccacacagtccatgagtgctcccaattgctcacaatggctcttcagactctcatgggttgtttcaaacctcaaccctccaatgaagaccttccagttattcgggctctttcagagactccgacttagacatgatggcagtaggaagatagactttagtgatgattcctctgtggcatcccagggccaaaaggagtaaggtgacaaatgtatctcagtagaataagtttctagaacctcagtttcagaacagcgcctaaaagcgcagattctggagagacggcctgcatcaattcctactttgataaccacatgaccttgggcaacttattaaaccctctgagacatggtaatcttatctgcaaaactggaatagcaactacctcacaagattttttagaaagccaagtgagatgatgcatggaaggcacttagaagagtgagtgtctgtgatctagtaagtagtcacttagtagaagttatgattgttttactggaacattagatatgttatttgattataaaaaattggaagaatagaaaaaactaaaggaaaaatttttgccttttactgttttgaatttttcaaattctctaactgcaacttctcccactactccataacacatagacagtttatcaaatctcacagccctcctagtctcacaaagtacactttagcctttctttacgccatcttaaatgcttgaaaaccttctctttgcacttttgtatgcaaaaagaatttactgagcaccacttctatgccagatattgtaccatgtgctagagatgtaatagtgaataaagaagatacagctcatccttgccctttgctcttgatgtcttctctacctctcataactttcccaactctttttcacatactgctcaaccttcaaaacttagttgataaatgatatctttccagatgctttccctagacatccaaatttggctaagcattcttattctgtgctcccatgtctgactccctgagaatccctcttttttctcaaagcatgtatgtctctgccattctcactggaatgggaagagttcacaattcattattgtaccaggggcaaatattctgcttgggacccagtaggtgcttaataaatgctactaaatggaactacccctggtagagatgtaagctccttagactcctgtgtactccaccatgactagcacatcctagaagtagtgcatagtcaagaagcctgtcactattctacagtagagctggttattgaacagtagtaccctgtaagattttcaacaataaaatcaaaaattggtttatgttgtgtagcacaggtaataaagtgagttcctttgaaagttttcatttagcagggagaattgttccagctttgggtatgacatccctgacaaagtgtattagctggtggcttcctggagtaaaagagttgacagaaagaaaaacagtaacatgcagagaagaactgagttcccttcttccttctccactgccagcactgagtcagagcagctacggaagcataacacacaaatgagacaacgctaagtattcttttttttttaatttttatttttattatactttaagttttagggtacatgtgcacaacgtgcaggtttgttacatatatgcatgtgccatgttggtgtgctgcacccagtaactcatcatttaacgttaggtatatctcccaatgctatccatccccacccgccccccaccccacaacaggccccggtgtgtgatgttccccttcctgtgtccatgtgttctcattgatcaattcccacctatgagtaagaacatgcggtgtttggttttttgtccttgcgatagtttgctgagaatgatggtttccagcttcatccatgtccctacaaaggacatgaactcaacatttttatggctgcatagtattccatggtgtatatgtgccacattttcttaatcccgtctatcattattggacatttgggttggttccaagtctttgctattgtgaatagtgccacaataaacatacggagaccacactaagtattcttacacgagcccatctaaaccccaggtcagcagcttgactcacatttgagtgtaccaacctcaaataagcccaataaaatagattaaagtgtatgcaaggcagggaagaggtctggaagaatatactaatatgttgaccatggttatttctggatgactattactttcattttttggagctacatatatttctttgaggaataaaaagaattagaatatgtaaaacatgatcaagtatttgctttgttgtactggagaaggttcagtgtggtataagttttgtgataaggaaaaattctctagtcctggaaagggtttatccatgttcagttgagttaattttgagaactggctgaaggatgcaaaggaaggggtttccagctgacaaatgaaagagggatgtgccgggaataaatttgctggagaggaccaggctttaagtcaaattgctttggtaccaagaaatcaaagcaatgatttgggagcaaactcaacagtagttcatccatttgaagcaaaacttcaaacatggtctgagtaattttccagggataactgccactggattctattgagcactgtacgatcttgtgggcagtccctgtctgactaatccaccagctgtgcaactgctacagcatctgtgagtgagaatcattcactactaaaagctagaaacatgttttgctcagtgcacctggtgcccagaaaagaggaaatgttcatttcagcaaaatgcttcctcaagcgatgcaaattccctgcagctcagttcctgggtttaaatcctgttcctgcaccaaccagcagtgcgactttagggaagtatgaaggctctctgaaactcagactcctcattttaaaattggactaataatgtatgacagtgtcactataggaaattgatgagataatatgcccaaactctttgggccaggacccgcctcctaacaggtgcttaggaaatataagattcttcctatttctctttttttgtttgtttgtttttgagatggagtctcgctctgtcacctaggctggagtgcagtggcgcaatctcagctcactgcaacctccgcctcctgggctcacgagattctcccacctcagactcctaagtagctgagattacaggcttgcaccaccacgcctggataattttttgtatttttaagtagagacagtgtttctccatgtaggccaggctggcctcgaactcctggcctcaagtgatctgtctgcttcaaattcccaaagtgctgggattacaggcatgagtcaccacacccagcattcctatttctctaccagtgtcatgcagtcatctttccaagtattgtaaaacgagcctatacacacacacacacacacacacacacacacacacatacacacacatgcatgtatatgctcaattcagccttatcaccattacagggaacaggcttccaccatgctattaccagtattgtagagtattgtagcatccctacagaacagcacaaactttctgaaggtggtaaaatgagctgctaaggccttgctgccacttctcttgatccagtgccttttctgtatgtgaggccatcttacccaaattctactcacacctctagctaggtcaacactcctactcttggtatcttccacttatgatgatcatctctgtccagcaggcagagaaaaaaaaagtctcagacacaggtgctgaaattgccttcactgctcattcaagctactcttcctaaccatgtgagtttttggacttcagaacctacctgtgaaattggcacttgcctagccttcccattatatttgacttccaaggatgagatcagttacccacctgaacctagaatatctcctggatgatctccagcagactttgttcctggtcctgggacttcctgggtggtcgattggcatatatatcctctgtgacactataaagactaaagttccttcctagtgggaagcaccattattcattcatccaacagaatgtttatctagcgtgttatatgctaatcactaaattttaagtgctagaaatacagtagtttaaaaaaagcaaaaatctgtgactctgtcgaaattaaattctagttgcgttaggtaatccagctctttgagctccctttttcctcaacatacttcctgtaccaagaagcagttatgaacagctgtcctttctatgggaagacactcaggggtccaggtaggcaaccactgtgaattgtctctggtggtggtgcaaatgggcttgatctatccagctgcctttgttttagagcacctcataatgagctggtgtcaatggcattggaacatgggaaagttgaaaaataaggcagaaagtgtggccctattactagtgtgttccaatcaaagaggtttatttcacaatcagacactttaataaaaatattaatgtttcctcaaataaggttgctttataatccatgcttgcttatggtggtttaaatattctccaaatacaatagtgtctaataaaatgccttttggaaataataaaagcatatttatacttgatctagatgcttaatatgcaacttaatgtgcaattgtagaatgttattttgtgcttactatactcttaagatgtaagccccaaatcaagaaaacccagaaagttttctaattttcttgtcctgctgccctgctgggaactgacagtgtcatctttcagattactgcctgtgacatgacgtgcatatgtattaatgctttacaagccttaatttatttaatccttaaacaaacttatggagtagttactgttttatttccctcatttaacagatgagaaaatacagggagaaagaaattaaataagtaacttgttcacacaactagtggatagaatgagatttatacctcattatccttgtaattccacctttaattcacacactatattgtctctcaagtattatgcatttcttactctctgactcagatgtttcttctgagtatggtagatactttggtcctttggtttaaaagctaaggtctgtaagcttccctttatccttgctgggccatagaatgcaattgggagaaagtataaatagaaataacctagttaatgacactgccatttctctggtcacccaaatacaaaattacacagatgaagatgatccctcagcatctttcctctctcatgtcttccagagtggggtccatctaactaaattgccagaacatgactcctaatatcagagtgaaggccaagatggtttacattagactgagagctccctgatgaaagcagtgatactacagctgtagctatctcagtaaccccctggcacatagaagaggtttagtacattttaccaagtgaatggatctaatacaagtttaatggactctaaatcagcagatatatttgtttttgtttatctccattgtccactcccccatcacacccttgtttcttctccctagaatattccacttgccttcaatttctctttccaaacatatctcttgcttctttctaccccaacacaccaactttcctttctctgcttcttcatcttttcccaccacattccccaaaatctagaatttcaccaatctgaattatttgcaactcagagtaagaggaatggatcacctccaatgttttgcacttgttaccttccacatgccttttgccatgtctttaacgtcaaagttcagttaagatgacaatctttccaggagcctccataatttattcactgcctccatcagtcatctacacctcacccccagactgcggtcagaactcatagttacctgtgcactcacaggacatttacttaatctatcatttttgtctgtttatttaattgtttactttttatacactataagatctttgaatgcaaggattgagtcttgtttatggctgtaggacctgtgccaggtattcagtgggtcctaataaatgtttgttaagtgaatattagccacctagtaactggtttccttatctatatactctccatcaaccaattcttttaactaatcaccctcagatacatcttccttaaacacaagtttggctatatcactcacccctttaaaacccttcagtagtttcctcctgctccagaataaaacgcacgcactttgatgtgaaattcacaacattctcaatctcttgctaaagtactatctcttactgatttttttcactcatttgcattcctttcaaactagctcagcagctctttcctggagccattttatctttctaatcttttctcaccttcctgtctcatgcttttccttctgtcttgaaatgatgcttcccaaatcacaggtgagaaataccttgctctttttaagattcttttcatgtcaccttttccacagtctctcctaatctatcttattccccccaaaatgtggtttacctttgtcactttgtattgttcttacaataaaattgtccttgagtttgtaatctttttattcatccctcatttcactgagcacttaaaatgagtcactgatgcactgtaatagaccctggtaatatttagagaaaacgcaatgaccagtgagctctgttttcagttgataagactgataaatgttatcaacctaaaatgtcatagttaagatgcatgctgatttcagagatacaaatatttaaaaagtgcatgttagaatcaatacaatatcaaataaaatatcatattcacatgctcccccagaggtcatttaacctagctttggccgtataaaggagcagtttcttggagaataagatatcacagtctactcttaaagaacggaaaggtatgaatccaagagacagcaacaatactgtcaaaggaacagcagactagaactcacggaggaggaaccataaaggttaacttcctctcttgagatttaagatgcttaaaggcagtttcttacaattctttccttgagaaggttggtacagtcttaaacggttgtgttagattaaaattaaaatgtattgtggaccattcacatgttacaatatagataagtttgataatttcttcttaaaattggcaacatgaaactaaggtgtcaggaaaccttgaagaatgagtgcttggggggaatattcaattaaaatttgaaagataaatgataaagtatcatccatgaggatatgatttgaatgactgcactgccataaagtttagactttcacttctagagacttggccaggctgataaagaagagttagtgcacattctctattcatcacagaaagtccaattctaaattgaattcaattcaaattctctaaaacccatgagcaacttctagtctctgcttgggcatatcttcgtccattcagttcatggcttcatttgtagttctgtgtgttttattttcttcttcatccttgtatcaattcatccttttatctaaactattaagttttacctggatatgcaaaattaacaatcacagtgaagcttcccaaatggggcagtttttaaccctaaaaatcattactctttccttaatgtggataggacttgctcaatcttgagggcagaacgactaccagttttattaggtgcactagctgcagggattcaacagtgtacaagcaagataggcagtattatttctcttgtggagctttccttctagtggtggtgactaacataatttaaaaataaagaaaatgggccgggtgcggtagctcatgcctgtaatcccagcactttgggaggccgaggtgggcagatcacctgaggtcgggagttcaagaccagcctgaccaacatggagaaatcccgtctcttctaaatatacaaaattagccgggcatggtggcgcatgcctgtaatctcagccactcgggaagctgaggcaggagaatcacttgaacacaggatggggaggttgcggtgagctgagactgagtcactgcactccagcctgggcaacgagagtgaaactctgtctcaataataataataataatgaaggaaataaagtcaaggaaataagatgctccaagagagcacaagaaggaaccatattcattagagaatgtcaaggatgctttctgaaacaatgacatattaactgaagtcagaggaatgagaatatctcccatgtgaagaggtgggtaagctgcctttcaaatgaaaggaagaacaaccatgagaatctttgtgttggaaaagagtgtggtaggttcaaggaattgacacggctttctgaagaggggtgagtgaagcaaacatgaggaaggagaggtaacctggaataagattacatacggccttgttagccttgggaaggatttgggtccccatcctaagaaaaatgggaagtcaacaaagaatttcagcaggagagtgatatgacctgatatatattttcaaaagctcactcttgaactcttagtgagcctgtaagaggatgtaactgcaataaaaagcagtatggaggttcttcaaaaatatgaaaatagaactacaatattatctagcaaacccacttctgggtatatatcccaaagaattgaaagcaaggtcttgaaaagatatttacacacccatgttcatagtagtactattcatgatagctaagaggtagaagcaacccaaatgtttgttgatgaataaataaacaaaatgtggttagaaatatccatatatacacacacacacacaataaaatgttattcagctttaaaaaagaaaggacattttgtcacaagctacaatatggacatatcttaaggacattatgctaagtgaaataggttggtaataaaaagacaaatggtgtatgattccatttatatgaagtgcctacagtggtgatattcacagaaacagaaagtaaaatggtagttatcagggactagagagaggaagaaatagggagctgtttaaaggatataaagtttcagatttacaagaggaagaagttcgggggatctgttgtacaacaaagtgaacataattaacactactgaactgtacagtttaaaatggttaacatagactaaaattttatgaattttttactacaattttttaaaagcttactctagctgccaaaggagaatggattcaaagggagagggcaaaagttggggagaccagttgggaggcatttagagaacctgtgctggtgcctgagacaggcaagtggcagagcctgcaggccaatgagctcagcccctgcccatctgcatttcctacagtaggaagcatctaggggccacaaactccaagttttcttttgcccacccacacaacattccaaatgtccatgtcttttattctttcaaccctccaacatcttttctcagaggagataagaagtaacaaaaaaaatgaattttgtaacacttggtgactaagttcactcccatctgggcccatcttttgcctgataggagacaggacatggtcaggtagcaggtggactttaagcaaccatatccagctttgagattggggcctagtggacagtgggtataaagatactctgtgttagcctctcatcaaaaatgcacccccagttattttttgtaaacttgagcatctgacctaacatgtgtttagtctttcttcctgactcgtatttctgttttggctcatagcaacaaccctaaatggttagagcaagagtatccagtctccgatcttttggcttccctaggccacaatgggagaagaattgtcttgggccacacataaaacacactgatagctgatgagctaaaaataaataaataaattgcaaaacagtcccacgatgttattcaaatgtttttgcatttgtgttggcccacattcgaagctgtcctgggccacatgtgacccacaggccgcaggttggacaagctgggttagagggtgaagagcctctgttccccagattacacatgtagtactcccacactcttaccaaacaattattttgtattgtgattaaaaattatatttcaaactcattatggaatcattcatgtgttcttatcatttagctcccacttataattgagaacatgtagtattgcgttttctgttcctatgttagtttgctaaggataatggccctacataacaaagtaatttacatcagctatacaatctataaggaataatgtaacaaacttcctcataactgccatccatctttaaaaagtattaccagcagaatggaggcccctgggtatccatcccgggtcatatctgtctgcctctcccctgaggtaattgtggaattttatctgtataattccctgttttccccaatagtcttactacatagacaggtaattgtaatggttagttttatgtgtcaacttggctaaattatagtattcaattacttaatttaggtgttgctatgaaggaattttgtagttgtggttaacatctacaatcagttgactttaagtaaaggaaattatcattgatattctgggtgggcctcatctgaccatttgaaaggtcttagaagcaaaactagggtttccatgagaaagaatagatttcatctgtggatttcttgcttagtgcctattgaagagtttccagcctgctgccctgccctattgattttagctcccacaatgacaaaagcaaattccttaaaataaatttgtttatatacacatattaatatatatacacatactggttccatttctctgatatgatctttactgatacagtattccttaaaaatgcttagtttatatctattttggaactttatgtaagcagtatcatattgtggctatttttctacaacatttcattgagaaatttatttatgttgatgtgtgcaaaactagatcatttctttttaattttttacagtatgttattattagtatatcacaatgtaccatttttttttttctgagagagatatttgggctttttctattattttcctttccggaataacaaaactaacaatactgctaaaaatccttgcatgtgttttttggtgcacatatgtaaaactcttgttagaacatatatacctaggagagtagaggagttctgggtcttagactatatgcatcttcaatttttctagatatctgttccgtgctttctccaatgatcttactacaaagtagttgtatttttgtcagaaatataccaatttacaaactatcagcaacatatgagaactatgatttttccatactctcagtaaaacctggaattatcaagaaaaacacttataacgtgactatatatcagatttggaaaatctcatcgacaggatttatagatacattatatgtaaggggtgagaaagataaaggagtcaaggatcattcaaagatttttaactctagtattcattaatatttattctaagtgttattattcttattattatctctaacgcttgtgatgaacttgaacaaataaaaaaacttcactaagtggtttggagttggtttatttcccagattacatcccttgtgtgcagcattcactgtcagccacaaggtggcaagctaagcatccttaaatctaaagctcaactctggtctgggtgaacttgactattcttagaaagtttataaagcaagaacttattccccagtagtgaattcttatgggtatagcacacatgcttctttcctaaaaattgtggcatctttgcaatgtatgtctccttgtataaggaaacaagcagaaacctttttttcttaaataaaactctaaaccaatcagggctctgctagcatccttttggctccctttaatcacagcacacattctagactcctaatcctgccatccaagaccctctacaaactgccttaaatcttcgcttctaacttcaccttcctttactttctttatacttcaaatacctaccgctccccagctccctatacacacaccactttttattcctctgcctaaacattccagctctcagggcatagtccacctacgccaaattccgttcagatgtgtataactcatagttcacatttccatgacttggtgaaggctattgattccttatcttctttatttttttgcatctattcaattgaaatgcaaatttgagtctcagcttcaagagtactcttccaaagacttcagggtctcctccagcagttagctatgattctcctaagcccctcaaaacattttttataccatcattagagctgtcacattttattataacatttttatcttttttctccccaaaagcttgttaccaacagagagtcatgacagatttttctttgactctgtcagtgaccattccacgcctggcagctcaatggatgttgagtagcttgctgaataaatgaatgaataaatagatattgtatgaaggcaaatatttaattttgagtgatgtatgtttcctatcagtatgtagagtacccaacaaagtgcttatattgcctgaacttttatctattattactgttgtcattataacaaaaatcatttaaaagtaaacaaacactgagttggttgttaaccagacacagaagatacagcttctgccatgaagaggtaagccaaggggacctagggagatggcataacttagggaacaattagagacacagacaatgtgtgcatatgtaaattagtataatatactgatataataaagtaattcacttaatgtaattaaataaatcattaggtttcactgttggcacgagaagtttccataattcagttgacacataaaatatttttttcagcaaacatattattgattttccacaaaggttataatataataagcatataatattgatttcttttaaaagctctccatccagagctacgagaatctcagaggaattgtaatcccttctaattaaaagcttcaacatgcaaatatgtgctattaggcattaggcaccatatgctgcactataatctgaacttgctaactgtgtctcttcggtcctctgaatataactatttcctgatcaatacattttttgcattttatcttcttgggtttagatctaaaaggtttcctaagttagtttatgctagatcttaattctattttaattttaaattgattaaatcaatagttactgagtgactatgagatacaagaaaatgggctatgctctaacatatggcacatgacatgttatcccatttgtttttagctattattttgatgaagacctactctgtgccagatattcctctaggaggaagaatctaaggctcaaaaatgtatataggtatgctggagtatcttgtgtacttgttgggaaatcacaggaataaattcagcctaacaggttttgcataatctttttagattcttttatataatactagctacaggactgtatatagtctggataccaaatttgggaatctgatcttccctttaagtcaaatttagtaggaaagccacattgtattgattttagccaatgttctcaaatgaagcaacttaagtcagcttaaaaattgctgttgactattattgaatacctacagtgtgctaggcactatcaattcagctgaaactcattaattcaagtgaataactcagtccccattaggagggctcacattttacaaatgaccaagcaagagaaaaacacccagctgaaaggcaacagaactggcaggcacttttatcatctgctgttaattggaagtagaagaacttaattttattcagaataatgcttcatcatggctttggaaagtaatgaattctcaggggatctgaatgtgcgcctctaataaactttctataagacatggcagatttgttgagagaggagaggggtcttcttataaaatattctgggctgtggaaaggtaaaataaaacaaatgtacattttgggttaaaatcaacagaaaatcataaaattattttatctggccatccatagactactatgagcttttaagttaatttatgtatgagcataatggagagttgaggcaagaaaatgaggggtatgctgaagatggagtaggtattacttcaagaggtctgagtgccaccctttgccatgaaggaaaactaataaattgatattttggagttagagtactcacgcttttacaatgtgacttgatactgcatttttaaataactccttcaacacagatttattgggcatctgtcatcagctaggcactttggtagatactaggaatacaataatcaatgaaataatttcattcccttttctcatggtgtttggtctggtatggggaggcaaatgttaaatgcataagtgactactgactacttaattatagccataatattagctgtgaaacagtatattgggcatttggagtatgtgcagtgagtaggacatatagttcaataggtttaggtgataatgcaaatgatagatgtgctttactgagcatctatattcttctggtcattatgctaactcttttgcattatttccaatttttataattatcctacaaaaataaaatacacttctgtcacagatgagaactcctgatcctatagatttcatgatggcagatgccatcaagccatagcctgttacacccttttgccatctcatcttctaagactcagattaaatgttacctctcttttaagactcatattaaatgttacctttctgtgaaacctcccttctagcagccaatgttctctcttctgtgctttccaaagctcttgctttaaactctaatatttagaagtgtaattaatctacttataagtctgacttgcccaccagacagtcatcttcttaaggaggagactatgttttaattgtatttcatttactttcatacctcctgcacccagcaagctcagtgcttgacatttataattcctcaataaatatttattaaatcattgttgagtgaaagaaatttgttcttataatctatagcaagaatgcaacacaaatgggaaaataaggatagcatttcatttgaaatgctaagaaaatatttgaaaggcaaattgttagttaataagtatctagaatagaccatgaaccttgtacacaatacatattaatttgaagatttaaaattgacttctttttttaacttcctaagtactgatgaacactatatatgtcaaacgaaattgcaactgggtttcaaccaaacagaattcacctagataatttagccttgcactgctttctcaatcttgatttatacttatcaaaatgtgacaaaatttcatgtaatccataaatacataccccttatgtaaccataagaatttttaaaagttaaaaaaaaagtaatgtgacagaatatacttttataaagttacatgtttacaatatcaagcaatgtataatagaatcaatgacccttgatctagaaggaactccaagatatcctttggttcagtcccctgtctatgagaaacactattcagaactgatggctgtcatagactaaataatgactaccatttaagttactaactcccaggataaaggcagcattttctatgactgcctatgtctctacccaatactagcttctaagataatataaaatgtaaaatttttttaaaaagaaaaaaaattgggagcactcatttccttctttgcatgtggattcaaaggaggagtccaattcaaatttccagcccctacatgaaggcttctgggtttgcctcatctgcaagtgctctctcccttgacattttatctctaaatgcttataatagttagcttgaaaattataccctgtattttggaattgtttgtgtcatttgtttaaataacagtctatgagatctatgagtcccttcttaaaactaaatttttaacagcagtttcgtcttatattttctgattcctccaagcaactgctatagtagatgtgtcttgtgttacagtaacaatgcaaaaaatctttaaaatatatttcttagaataaataaatatccaactctttacctctttttctttctttctttctttttttttttttcttttgagacaggttcttgctctgtcgcccaggctggagtgcagtggtacgaacatggctccctgctgcagcctcaaccaactgtgctcaagtgaccctcctgcatcaacctccaaaatagttgggactacaggcatatgccactgtacctggctaattttttatttttcatagacatggggtcttggcatgttgttcaggctgttctcaaactgctgggctcaagtgatcctctcgcctcagcctcccaaaatgctgtgattaccaacttttataaaaccacatttcaactccatttacgtaagtttatcttgagtaacgtttctactaaaatccattcatattgggctgcattccttgtgcctagcactgtcgctagcatataataggctataaatacatatatgttgaatataaaaatgaaggaagaatccagttggcacctgcggacttttcaaccacgtctgatattgagctatctcaaaacatgatggtgagtaaatgaatgagtgatgctacacccacaacacatccacatttgcaaggaacactatgcatagtactattgtgatttatgttgtttatgtttaccataaatgttgatatttctttttttcaaaaaccctggcatttttgaggcctccttctaacataattagtgagaagtaatgactgagtgaccttttgacaacaatccccagggctggaaggaatcatgctttttttcagaacctggcattttggctgcaagcagcagcactgggagctcactgaaagagccaaaatgtgtcagagcacagggcaaaatggcacagctgccaggtgaggttcagatgctgtctgtgttttaggttgaagcagtgaaaaggcagactctaaaatcggtcttgttcttacactcatgcgtagctggctttgagttcaagaaagtttaagtaaagcagttaaatgtacaccagaatcattacaataacactcagatcttggtcctggctctgtgaggctctgaagtagctgtgtgacatcttagcagctatgtgacatcttattagttatgtgacctcctctggtagacaaatttctcatctgaaacatgtttagagaactaggctagaaaagtggctctcttttgtgctgtggagacacactgaaaggtcatgttcatcgtgaaaaacatttcagatactgatattaattatatagtgattggaaatcatttactcaaaaaaataaaggataaaagatttaaaaggagacaactccagtctcactcgcttatattctgtgtgtttgctttagaggaaaagaaagaagtcagatgtcagttaatgcaacttcaataaagcacagcctattttatccagggtaagcctattgcaagtgaccctaactgaagctgtgacaataacaggtggttgcaaaggctcgtctatgcagtattattgggggtttttataaaagcttgggtatgcttataggcatgagttgcctcttatgcctgttacagaggaaaaaatactgagaagagtgagcaagaagctgtctaaagtccctgtcagcactgaactgtggagatttggatcagagtcaacctcagggaactgactttacagtatccttggagacactacacatatccctgaagcaaggctttaaacccttgaaagatcccatccgagaatgtactattcccttattgggtgagactgcaaggcaggggggttgcttgggaaagaataagaaagataactcttgaataagcataaaatatcgcttgtttttaaatactgcccaaaatagcacctccatttcttttttattctgcacataatgtcgtctaactaatatttatatatggtttttctttaacaaaaagctattcttacagaactatgctgaatcatggctctgggtctcaagttgccataactgtaaaatggtttgggttaaatattacctaaggtgtctcctaagagtatgattcagtgattttctcaaaaagatgtgagtgcctggctgctgccacctggtgtcagctacctgaactacagttaccaaagaagttaattctttcctgtgtttgcacattctgtccaatttagtaataatatgacagtgcaacatgatgactttataaggtgaaatggtctcaacagataatctagtctatatgactgtgtgatacataaaaattacattctacttttaaagacacctacaggtagattctctaaattcttttgtcaccatttctgtgtatcactacattttaaattcttcctgatattactccttcctgatatattcatcattatactataaagcattcccttcaaactcaaaaataaaaataaaatattttcatttatattttagtggaattaaaagaacatgtaagtgaccagcttgtccatatacacaggtgtaaatagaggcttctgacaaagaaaataggtctcagtcagtactgcgcactcaaattacctgtaaaatgtctctattagctggaagcatgggatgtcaaaagtagtagaatagggcatcatgactatagggatttgggtctaaatatgtcagttatttgctgtataatactgtaaagattacttaattttactgagtcagtttccatttgcacataggtacaacaatttccacctcatggaactttcaaagttaaagtaactagaacataatagtgtctaataaatgttagaaaactctgtgagtcatacagagcactatagatgcccctgaatgaaggtttccaacccttagaaaaacagcacaatacctagaacatagtatgtgctcaatacataattgttgataaatgattgattattactcatgttcaaatgtcagattataaggcttccaggacaggctttgatgctctacctcaaatttatattggagatgggtctgataacaaaattggtgcttatgagaataggacccagatcatgtaacacattgctatggattatatttagttgtattcacgtgagcttcccctacaagcctattaaatccttgaaggcaggagctatattttaaatatctctatatctctagtgatttgatgatcactagaatgatcatcaaatgtgacatatgcaataaatatatcattcgataaagtattattgacaccaacataactactatttccacgttaaatttcatatgatgaagttttttttttttttttgagacagagtcttgctctgttgcccaggctgtagtgcagtggcattatctctgctcactgcaacctccgcctcctgggttaaagaaattctcctgcctcagcctctggagtagctgggactaaagcagcactcaaccacgcccagctaatttttttttgtatttttactagagatggggtttcaccatgttggccaggctggttttgaactcctgacctcaattgatccaccctcctcggcatcccaaagtgctgagattacaggcatgagacaccgtgtctggtctgaagtaattatttttatcttatgtcttagaaaaatgaaactctagtcaagtagagtcagaagctctttcccagatacatactattggttttaacttttagtaaaatcaaatagcagaaactcattcacaagtatctacataaatcagggtaaaaaaagtttgcatttccttagaagagtggataatgcccagtgaatacaaatgtccctctctctcatctgtctacctggtgacttgcaacacagctttgtttgtctaactgtatgggcaggacctataggtaaaaagttgaatatatagaagatttaagcactaaggttaaaaggctccctgacttcccaagatttgagttactgtaaaaaatatcagaggaaatcctctgtcacaatgtgactaactgaattgataactgattatataagagaagtgtgtttaaactggactgtgtggtttcagaaaagcacagctgtttgtagtcaagaggaaggccatcatacagctacagttcctctaaccttgttccactttgaagtggattgcaggataaattttttaaaaactgtactataaaaaaccctgatgcagtcctttctcgagtctgcagaatgaagagggtcagctttccttaagtgattggcttcctgtttttcttaattatacaaaatgaggacaatgcaaaacacagctggtggaaactcagatgttgctcaaagcttgaaacacataacgactttgtgatgaaaaacatagaaaatacttgctggtgaggggagagcagcagtgacacatttccagtggtatgcttactacagctgaaaaaccaacttcacctcgaaaaataaacagggtgaaagtcttgctatggggtataaatgctagcctttaacttagccacacaagcgttattgaaagaatagaaaggaagaatggaaaaaatgcataaaaggaaggtattgaatgtctggtttatggatggttattattataatgcctaaagggtgacaaaggatttcttctgtatatctgaaaattcaaattactgtaggcagtaagaaagcaagctgaaaagtatgctactggatgacgaatcaattgtgtctagggaagaagaagttatattgcttaaccagaatttggaacaaatattaagttctgtgtgacaataaagaaattactcacatatttgatgatcccttgatggatcctcaatcatcgtttcaggctgagttcaagtataacatcctctttaataccttttccaacaattaggctgaaataacacatcttcttttcacttcctcagctttgaatagcacttgacaaactattaaaattagttgtatgcatatctgccatactgttaaagtacaaactctttgaaagtagcggctgttacttaatcactttttaattccccaacaattggtatcacacaggtccttaggaaaaggtcaataattatgtcagaaagatgccagaataggaagttttaggctctattcctccttacggaaagttcaacaagcaactatccacagacaagaacatccttttgaaaaccccaatacatgaaaacaagcctgaaacacctgtgtggctctacacaactgaatgaaaatctaaaaagggtaagaagactggccttaatctaactgtgctgctcctcccactcccccaagtcagcacaaattcagagtgagaatatcttcctgggcccagtttccacatgggcaaatgagaactggaggcagtcatatagcatccctagcattccaagatgcttctcaggaaggccactttggttttacctcacaggaaacactagaggaaatggcatggctagaccacctggagtcaggtagaaacaaagaaaggaaccatacgtgataagtaaccagtgcatggatcttggtggtacttctgtgttcctgtgacaccagatcagaaacgccaaccaacctctggctgagtacgttggctcacgcctgtaatcccagcattttgggaggccaaggcggatggatcacttgaggacaggagttcgagactatcctgtgctaggtggcgaaaccccgtctctactaaaaatacaaaaattagccagacatagaggcgtgcctgtaatcccagctacttgggaggctgaggcatgagaactacttgaaccctggaggtggaggttgcagtgagccaagatcgtgccactgcactgtagcctgggagacagagcaagacaccatctcaaaataaataaataaataataagaggcagccaacctgtaaagctgagctggtcaccttcagaagcatgttgggaggctcaacctaacttctgtactagccatctagatggctagtatctatgcccagccttagatcctaccccaacaaacctgcccaggcaaagagactcccatagttgtgcattccagagaagcaaaggtgctagattggcttaacctgggaagtcactcagccaacaaccttacccaggcagggagatttccatttctatgcaattcaaagaagagaagagctagacaagcttggcccagaaggtcaaatagctactcaactcagccaaaagcctacctcgtggctccacctgactgggaggcaatctttaattgtaaaattctaaggagcataacgtatttcacctatcttgaacggtatctccccctaactttatagcctagcctgcagccctgctcaactgcaaatcacaaagagcaaaattgcccagccagagaacacatcctattaccagcctgaccagaagtaatagcagtacccagtcatcagctttgtagtgcccagccagtggtctcactgaacaacagagttcagccagcagccctaccagtgtcagagcaaaggcagccacccagtcaacaggaaaactcacaataaactctaactgtctggggtaatcaccagctggtccttccagaatcacaagctagactaaatagtgaagatctagccctgccaaagaacccctggaaaggccatagcaggggctgtatcctcaaatgcacggacaacatacaagaacaaaaggattaggaaaaatcagggaatcatgacacctcaaaaagaaactaatacagttccaggatcagaaccaaaataaatggagatatataaatgactgacaaagaattcagattaatactcaaagttcagtgaacaataagattatatggatagaaaatttaataaaatttggaaaacaatacataaaaagtgagaagtttgaaaaaaaataaaataataaaaaagaaccagatagaaatcctagagatgaagaatataatgactaaactgaaaaattcattataaagtctcaacagcagacttgatcaagaggaagaaaaggtcagtgtacaatatagaatgatggttctgagaagagaggttatattgctcagttagtatttaaaacaaatcttaagtgttgttactcacgtgtcctttacccaatttctttttgtcctaccatactcacttaagattgaggccaattatgggagaacaaaaagaaaggagaagactgggtcattaacactgtgaagcattttagcccttgactggacacctgggctttgctgtgagagataaatgaacatccactttacttaagctacctctattttgatttcctgacagttagtagcaatgcctaattctaactaattacctgtgttgacatttgtgttctcagttatgggtgaggtggggtggtgaatagctgggtgcaattctgaatgttggaaaggatgaagtttcaaataactaataaccaaaaaaataactagggacctgttaatctatatttgtagaacaaagatggattctatgatttggcatataggccttccagaactagtccctacataactctcagtctctaaatatattcagttactcataagaccctcccctatcaacttgcagtttcacatttccttgccattgattgtgttgtcctctgcccaattctttatctggcttattcttgttcaagaatcagttcaggtgtaatctcctacaggaaggtcctcctgtcttcctttcacaggttaggtatctcactcttgttcacctacggcactcagtgcacacttttgacttatatctgatctcacttaattataattttttgttatggtatgtgtctctcctctctaaattgtgagctgcctgaaagataggatagtgtgcattcatcagctattattttcaatgcctggcacatagtaggtgttgcatagtaagtaccatctggtatagagtccatagcacataagaacgacatacttggaatcatgtaccatcactgattttgccttccactttatgaaagacctaaaatccaccccttgtcaacttctagagcctagatctgccctgaagcccatcacagaagacagttccttgatttccattactcttttctctaaggacatcttcctttctcccttcccttcatcatctcagtttagaaaatatattttggtgcctacttggctacatagatgctggactaaaactgtgtcttaaaattaatttgtcaaaaaaatttcctctgcattttattctattcatttctgccaatttcttcagagagcgaagttatctttgtgactcaaagcttgaggcctaggaaagggggttggaggaaaatctgtcttttgacatttaaaagtatttgctaaaattagagaacagttagcacttctgtttaatagtgagatgagtctacacacatttatgaacatccaaaataccctagctctgtgttcctactgaccacacatacctatactataaaagggagtaaataaaaagaaaggaggtaccctgttttttcataaatacagagtttaagctaagaggtatgctgtttcttattttgaacagttgttttctgcctctcactcccctacctccttttcttcctcttttctttctcttcttttttcccatctcctctttttccttttcttgtttttcttcctcttcatttccatctctttctccatccctatctcctttcacttctctttcttttctttctccttccacatctttgcctcttcttcctcctcctcctcctttatcttttccttctcttgtattcagaagacacctaagtacattcatttcacagtgcagcatcccaacagaactcttaaaatgaactgctatttatgaagagactaatgccatgcttggtctctactatgtcttcttcttggtgttttgacatggcaccctcccctcctcctgctcaccagatatcaaatgccaatgtgtacagtctcctttctgtacattcttagtgccttttccctatgaacaagcagcacactttttttctacacagtttcaagagtggtgacatgtagatgtaaaaagttgccaaattctagttatagttaatagtatagatctggaacaacagagtgagtggtgtggatatgagatggatggaaagtttgattttcaaacatgctcataactttagggaacagatagaaaacaagcatgaaagacatggcaaaccacagctgagtttttaaaatgagaacatttggggtttaataataaccagtttcacttactgcatactgtttatgtatcaggcacaactctggatacttcttttgcttcttgtcagtttgattaggtacttataacaactctttgaggtaaatacttccattctcattttacatggagagaactgaggctctgagtccttaagtggattctagattttttttttttatttttgtaaattttattattattatactttaagttttagggtacatgtgcacaaagtgcaggtttgttacatatgtatacatgtgccatgttggtctgctgcacccattaacttgtcatttagcattaggtacatctagatttaaatccacatattttaaaatctgatgttgtagattacaaaaatgattacaattctttatagtactttctattaagaggtggtgtctattatctatctcttgaaaatggcctggctaatgacttgctttggccaatggaatgcagcaaaagtgatgttgtagtagcttcagcctacacttcaagaagccttgcttcttctctccttcttgggacagagacatgtaaagaagtctgggctagactcctgaagaacaagagaatatgtggagcagagatgagctatcttactgagatactttaggcccacaggctttaaactgagatcaaccaagcctggcctaggtaagcagaacccacccagttaagcctgacctaaatcctgccttttagaacacagggagaggcaaattcactaggggccctaaaagattctgcatgttcttctggaatatgcaaacaaggtgacaccctgaccatactttgcctgagccgtttctcaaggttatatttgtagtaagcaaccttgaggaatgaggtaatattattcccctccaggacaagaaaaaaaaaacaggcttgctttgtaaaaataaattccccaatctcagtgttccatcactgtcatgcaaaactactacatgtgcagcatccatctgggttcctctgtgtttcctccatgggatttgggaaccaagagaaacctacaccaacatactaatgttcatgctgctttccatgtcataattaatgaagttctttgtttctgacccaggagtcttgtgtctcctgccaaaaatctaagaaatagtacaagctaactctttagcttacaaatacaataaaatctacttgacatatatttgtgagtaaacaaatggttgttgttaataagccactggatttttagtgggtagcaatagacaactgataaaaatgcctgcagtctaacctctctgctagtggtattcaacatgtggtaagtgatttacaaatgtgtgagataattttagtagctaagtaaatttttttcatttaatttttactattactaaaatgttaactatttttagttatctattaagtagcaagtgatatcaattttccatttataacacttacaaaattaaactaaaaagtgaattaatctaaaggaaagcattaatgataattcaaagtattatttttataatgcaaagactatgatgacaaaacataaatgaccgattattaggaatcactgtatacatcaatattgcttcttattgaaataaataggataccaaaaaggatgcaaggttaacattaaggtaggctgacagatcctgaatgatgctatacttcagatactgctgagaaaaaaaagttatcctaccttaaaccacatacatttatgatagtctttctcaaataccaccattcaggtaaagaactaaatgctattggaaatacaagcattctcttggaataggaaaaatatgtttaaaatagaagcaaatattcagtttctattaaatcagaggaaaaccagatgtcatggggaggaaaagctgtccatgactctaggtgttattatgacactgcccatttctcctagcatttcttcatagtaaaaatgttagtccataacaatcattcatcttcatgctccagactggcaaactctgagtcatgcacaaaacttatgaataactgagaagaactatgaagacttcttaaagacagatgtgttgagagattcatagaatatgttagcctgaaaggtacttaactattcaaccaactcctttatttcacagaaaggaagtaaggactagggaggggcaaaacttgttcagaatcacacagcaaatcagtagtgacagaactgagactccagatgtcctatctttccattcagctttcttccatgactcagtgttcccactcctctgggtggttcactgggtgaaacagagtatctgacagagacacaaactgggattcacgaaaaggcagatatcattcccaaaactgcttttcctcagcaaagagaagagaaaggtctctatactcttactgttacagagtttatatcttgaaaataagatattacaggatgttatatacaagatgttacagggcacgtattattcccctaaactaatatttctcttaaacagaaaaaaaaaaaaacctcttaaacagtaatgctaaaccaacacattaatgtcaatgtttacctgtttactctcttcctttttggacaaggctttagctatacatgttctaaatttcactatttgggatcttgatatcaattagagttttacattttgtagaaaattaaagaaccaagctaaagctccttaaaatctttgcctgtgctttgaatgttgtctataatgatcttagacacatgttaacactcataaatccatccagaagaaaattcaggttagcacatactttactatgcctgctatcacagtgaaagtttcagaggtccatagcattccacattttctgaccattgatcatcatctccgtgtgctcttggcacctcaattatagaatatcctaccattctttcttaaaaggtgctcttgctcctttgttgcctatctcagtgactggaaccaccatctccacacttgcccaagccagagacctgggcattatctgacttttcccattgcttgtttttctgccattaaccagcatctacccagccaactgggtagatgcaagtttatccaactacaccctgtcaatatgtctttgagatcatccctcctcacaatgactctgtctataaaacttccctggctagaagcatcgtcagctctctgctaatgtactgatatactcctatgattggctgccgtgctctaagctggattcctttaaaatccattttatctcactgccactaaaattagctaattgagctaaccagatcttatcaccggctttgtaaacaccttcagtgtcccatacattcaggataaaaatctgagctcctaagcagtccttacaaacctctctgagatcttacctctccacatttctagcttaatcttctgtaactctccattttcctaatattaaattacttatagttcctcctgattgtgcatgcctcccccacaccccccatggagcattcacacattctccacccctccctcaactgttcttttcttagttacctcctatttatcaaacttagttccaacatggatccttctaggcagcttggtattatccttccatttccaggctgggtaaagtggaatgagtcctctcatttgattctgtacaaagttcccttgtagcacttttcatgttaaatgtatcttttaagaaaattttgtgtgtacatagtatatatatttatggggtacatgtgatatttttgatacaggcatgcaatgcataataatcacatcatagtaagtggggtatctaacatctcaagtatgtatcctttgtgttacaaacaatccacttatactcttttcattattttaaaatgtataattattattattgactattgtcactttgttgtcctatcaaatactatatactcatcagtgtttatgtgcctctttctcacaaactgtaggcttcttcagacttgagattatttctgtcaatccacatctggtatagtatttctcaactctagctaaagagtggaatcactgggaaattaaaaaactacatcccagtgctcaagcttcactctaatctaactagaatctcagaggtagagcaagacatgttccttgcctaagactttgaacctggctgtttcctcttcctgaaaatctcttttctatatggctcactcgcctttctttaagtctttgtttgagatgtcgctttttcaaaaaggtctactctagtcactctatttaaacttattagcacttttcctgcaagctttccaatcctttaattaacatcatatatcattctgccatataatacaattcactttttcaatatggttatcgtttactgtttgcctccctacatgcagaaataatctattttgtttgctaatatagcattaatgcctgccacataatatgtgtttatctacctttctacctatctgtatctatttatcaatctttctctataaagaatgaatgaattatatttataatctgtttttagcagaaacagatgtttaggaagtcctgaaagcctgcagaagtgaagctgattaattatgcttctaggaatcagaaaatgcttcactgaggagatgatgatcaagctgagccttgaaggattttctagacagagaaagagggtaagtttttgaaataaagtgtctaggtaagcaccaagctcagagtacaacatattgcagtcacttaataaggtcctgttaacaccaaaagacaattcaggcagaggcaacagcaagtgcacaaaaatgagagaaggcataaactctttgggatgggtgaggtgtgcaagtaatgaggataaagtttgaattgataatttttggctaaattagataatttatttattaggtagtttatttctgcaaatgacacaaagaatctatgtggatttttagtatcttaattcttgtagatttccctacaatattaaaaactgttatagctgcttactatcactgatatacttatggcccatattttcttattagttttcatatatactttgtgatatggtttggctgtgtctccatccaaatcttaacttgaattttatctcccagaattcccgtgtgttgtgggagggactcggggaggtaattgaatcatggggccagtctttcccatgctattctgtgatagtgagtaaagtctcaagaaatctgacgggtttatcaggggttttggcttttgcttctttctcatttttctcttgctgctgacatgtaagaaatgccttttgcctcccgccatgattctgaggacttcccagccatgtggaatggtacgtccaattaaacctctttttgttcccagtttggggtatgtctttatcaaaagtgtgaaaatgaactaatatggtaaattggtaacagaagtgggatgttgctgaaaagatacccaaaaatgtgtaagccactttggagctggctaacaggcagaggttggaacagtttggagggctcagaagaagacaggaaaatgtgggaaagtttggaacttcctggagacttgttgactggctttgcccaaaatgctgatagatatatggacaataaggtccaggctgaggtggtcccaatggagatgaggaacctgtttggaactggagtaaaggtaactgttgctatgttttagcagagactggcagcattttgctcctgccctagagatttgtggaactttgaacttgagagagatgatttagggtatctgacggaaaaaaattttaagcagcaaagcattcaaaagttgatttgggtgctgttaaaagcattccatgtgaaacggagcataaaagttcagaaaatttgcagcctgatgatacagtagaaaagaaaaatccattttttgaggaaaaattcaagctggctgcagaaatttgcataactatgcaggaccctaatgttaatccccaagaccacaaggaaagtgtctcctggccatgtcagagaccttcatggcaccccctcccatcacaggcccagaggcccaggaggaaaaagtggtttgggggccaggcccagggtccctgtgctgtgtgcagcctagggatttggtgccctgtgtcccttccactccagctgtggttgaaagggaccaatgtagtacacaggctgtggcttcagagggtggcagccccaagtcttggaaatttccatgtggtgttgagcctgtgggtgcacagatgtcaagaattgaagtttcagaacctcaacctagatttcagaagatgtatggaaatgactggatgcctgggcaaaattttgctgcatggacggggccctcatagagaaccactgctagggtggtatgaaagggaaatgtgggatcagaccccccaccccatacaaagtccctactggggcactgcctagtggagctgtgcaaagagggccactgtgctccagaccccagaatggtagatccaccgacagcttgcactgtgtacctgaaaaagcctcagacactcaatgccagccatgaaagcagccaggatggaggttgtaccctgcaaagccacagaggcagagctgcccaagagcatgggaacccatctcttgcattagtgtgacctggatgtgagacctggagtcaaaggagatcattttggagttttaaaatttgactgccccactggattttggatttgcatgggccctgtaacccctttgttttggccaatttatcccatttggaatggctgtatttacccaatacctgcactgccattgtgtctaggaactaactagcttgcttttgactttacaggctcataggcagaagggacttgccttgtctcagatgagactttggaccgtggacttttgggttaacactgaaataaattaagactttgggggactgctgggaagccatgactggttttggaatgcgaagacatgagattttgaggggccaggggtagaatgatatggcttggctgtgaccctaccgaaatctcaacttgaattttatctcccagaattcccacatgttgtgggaggcacccagggggaggtaattgaatcatggtggccggtctttcccaaggtattcttgtgatagtgaataagtctcatgaaatctgatgggtttataagggatttccacttttacttctttcccatttttctcttgccactgccatttaagaagtgccttttgcctcccgccatgattctgaggcctcctcagccatgtggaactataagtccaattaaacctctttttgttcaaagttttgggtatatctttatcagcagcatgaaaaatgaactaatacaccttgcattattcacgtgtgtgtgtgtgtgtgtgtgtgtgtgtgtgtgtctttcttttctacacaactaatcctaacctttggtagtacaaaaagggttcatgatttttcttttgtaaaaatatagtttttcaataagaccttagccaattgcacttttatttaaaactcaataatacacagtgccaaaagtttatggtttcctgtgagaagcagtaaaaaaactactgtggtttttgctgaagaggaaagaaaaactttcaatagttccattgctaaactataatgaaagattagtagtaattaatcatgcagtgaaaagaggagagggagaacatttcaagaacagaatatatgtgcaaggacccagaagcatgagaaagaatgacccgtgtgaggatgttaagtatatgttgctataatatggtaagaatatggggaggttggcaaggtgaatctgtgggatatggatatgatgcttaacttgcttaagtaatgaaggttatgatatgctgaggagtttagagtacatcataaagtattggacagccataaactagggaagtatgcaggaagtaggtagaagaacagaccagttaagtggattcctataagaataatttaggcaggaatgataaagggctaaattaaagcaatgttaatgcagagagagaataacagatggaggcatacttgacagtacttggtggctggtggaatgtgggggctgatggagaatgagatgtctgggataactcccaaacttctggttggagcagctgagtgcctggaaggtgccactcaccatgaaagtgagtataagggaaggagagaaaagatgatgagcaagttttgtgcatgtgaagtttgagatcctgtagaatatgtcttgttggcagacttctagaaatcagggggaggaactgggctactgatttaaatgaggaaatagtatgagcactttcaatcctcagtaatcgattaaagtgtgtattacctaatggaatataccaagggtttgcagtaatatgctgtgggtttcatcaagcctcagacattttcctggatcataaataatgattaagatatggagaaaatgtatattaaaacaaatataaataatctaaggcctggcctgtaaaatttgcatggatttttaagataaaaccagtctccaaacaaattgctaactctttgacttgtacttacagtcttagtctcaaactacattacctcttacacacactacattaactcttgagacgtgtgtttgccctcctctgtctttggtcctctggtggaaacatttaaacaagactgcactaaagcagttcacaggctctgtgtgatttgggtcccagtgagcagcccattcaagaggtcaacctataagaattcaacacacctcctagctgcgagtaaaaggcagcaagcagctgctgtactctaattcagctctgtctcctcgtattttgaaagactgaaagaatccccattgaaacactaaaacgtggaaaggaacagcaagctatttggacattatagttcctttggcatgaatatagtattttggtttcaatttcatccttaccctacgcaagataaatcattcacttcaattcactttaggagttgcctgctaaggggtcagacgcttcttttatattcagttgttacctgctgcctggaaaatacacacgataaagtataaaaaattccttttaccatcaggtagtctaaatgtaaagaatactcagaatactgtgttcaactaatagagtttcagtagtagagagggtattttcagaagtgctaacaccagttaatgaaagatcttctgttgagagaagcacgaaaaagccattctgtctttacacaaaatgactccagtatttgtggttaaacagctgctctccctttttttatggtggaactcattattttatttccttttacaaatatttgacgaattgaagaaccacataggcaaacaataattatgagaagttcagtagtcttttttcagttaggaattttcctttattgacctatgatataaattatgacatgaacacaaaagacattccatctttggaagtctagtggagtcggtttttctgtctctcattttcctcattccagccaggcctttcttagtaaaggaaaatcttatcactatatactatatttatttcctctataaaacattcttgtgattattcctccagcattacgactatatatacagatgttcattttccctaaaggaacatggaaagaggataagagtcattttaaagaaattgttgggcacaaactatgggacaactctgctaagctatttctcaaatttaatttaattttaaacatatgatagacattactattccaactttataatgtctctcatgcaaaatctatgctgaatttcaagaaaaatctgagtattaattatttttaaaagttaatttaacacctgtaattccagcactttgggaggccgaggtgggcggatcacaagatcaagagatcaagaccatcctggccaacatggtgaaaacccatctgtactaaaaatacaaaaattagccgggcatggtggcatgtgcctgtactcccagctacttgggaggctgaagcaggagaatcgcttgaacccgggaggcggaggttgcagtcagccgagattgcctcattgcactctagcctggcgacacagtgagacttggtctcaaaaaccaaaaaaaaaaaaaaaaaaagaaaggaaagaaaaaagggaaaactgttttaaaaatatcaacattgatttagtgttcatattcacaaataaagaaattagagctctcagttaaagtaactggaacctactagaaagcggcaggactatgatttaaactcaggcctgtcagataagaaagaaaggctagcaagataaagttaggtgagacgaactatagctttcaattctatctgacaagctgaatttgaatgaataaatacttgaaaaccaggataagttcttgagtagaaaggcaaggtaataaaaattatactttagaaagattcattaagtttatcagggacttgaattgcagggatcaaaattatacaaatcttgaaggtggcgaatatatatatatattttaacttaaaatatatatgtattttactactaaaaagtcctaactactacagcattaggactatatatatatttagggaaaactcttttaagttaaaatacatatatattaagttaaaatacatatatattatgtatatgcgtatatatacatataaatacatatataataaacatacatacatatatataaaatacatatatacatgtattttaagttaaaagagtcaatgttttccaaaataataataataatactataattaaggaagtataaccataattacatgttgacaataaattatgggacagttatagacataaaattgtgtatatttgtatatattaacatctatagctctatctatatgtctatcaatgaatcacagcagcaaaaaactgaggagtgactttacaatcttcctactatagaaaagactatttcataaattatgagactagatgtcctgttcaaataaggtcaagatgaacaaaaagagtcttgaatgagaatggcagaaagtgggatttagactggacacaatcttatccttgcaggttagtacaggtgttgcagtaagtagttcagctaagggtcaggtgtcttcctgattctatttaatctttcctaaaggagcttcctaatatcagatgctgtcaagagtaagaaatgtcaatttcatggttttgcttatgctgacccaataaaagaaagtaataagaacttcaagcttccttttgaggtctattctaacctgatgattttgtcatttttatgcttcatttcatcattgaaatactcacaatggtggcagatcctatcaatgacagttcagtggtcccagatctttcaattccagctaagataagattgttcttaagtgtatctgaaagtagcatggccgatctaattcacatggcagcatatgaatataagcattttcttctaattccacccaccactgctccctctccctgttgcttttaaaagcatctgctgtcacagatgcagaagatatgtcactatgaacaactgctttgtttgaaagagctgcatttcatgtctgtcatctctttaaagtaaaactcaagtccactttcaggtaactccagtgaaatgaagagaggaattcttacaaggtccatttttgttttaagggttaagcctgaaagaaaaacttgctatcttaacaaaccctaatgttatgttttttgactatatgtttgatgtatgcaaaagaatacatgtaatgtaagggaaagtcttgaagcacagtaatgaaattaacatcaactttaaaacctgaatgataaatattcttgtatgggttctgcttcattcttgtatctctgtatctcttatgatttaacaactctcctaaattttttagcactccttttttcattgtatggttttagtgtatatatacaaatctaccccaaaatattaatatattgtttaaatgtgcttctttttgaccttcataaaagtgttatcataccatatatcattttccttgacttgctcaacatcatgattccatttgattttatgtttcaaagattcattcatgtttatttttaatgctatatattattctattatgtgaatattccataaattatatttttattctcctgttgatataaatttgtattgtgctcacatcatgttttactttttccttttagaaacaaagctactatgggcaatggacatttacaataatttctctatggtatatatatctaagagtaaaattgctaagtcataatgttcagctttataaaataatgtcagtttgttttctaaaatggttatacccaccagtagtatagaagaaacaacctcaataacatttcacagtatcaggcttcctaattttatacctatataattgagtataaaatggtatcgggcttaatttggattcctttcttatacgtgaggtctggcattttgttatactatataagtattcactatttgtttaccttttcttttgaaatgttttgatgatgtctattgaacatttttctgttgtattatttatatttatttttatttttattgacctgcaagagttcttcatatattcatagctcaatataatctcagatatcttggatcaagtgatcctccagcctcaggctcccaagtaactgggactacaggtgggtgtcaccatgcctggctatttttttttaatattattattattttatagagatgggttcctgctatgttgctatgttgtccaggttagtctcaaactcctggcctcaagcaatcttcctgcctcagcctcccaaagtgctgggattataagcctgagctgctgtacctggcccagcattccttttttttttttttttttttttttttttttttgagacggagtctcgctctgtcgcccaggctggagtgcagtggcgggatctgggctcactgcaagctctgcctcccgggttcacgccattctcctgcctcagcctcccaagtagctgggactacaggcgcccgccactacacccggctaattttttgtatttttagtagagacggggtttcaccgttttagtcgggatggtctcgatctcctgacctcgtgatccgcccgcctcggcctcccaaagtgctgggattacaggcgtgagccaccgcgcccggccccagcattcctttaatgtagttgagttcaacatctttcaattattggttcatgatttttttaagatacgcttcctaatgacaaagtcataataatattatgctatattttttctaaaatgtttaatattttgccttttttatgtatttaatcaaaagtttgttcatttttatgtatgtgagataggaattaatttaatttttcgtattatatataattgtcccagcactatttaattaactcattaagtcctcatatatgaggtaggtactattaggattacttttttaataataaggaaattgaggcatgaataggttagtaaattggctctagaactggtgaacttaccttctgtttcaaggtccttttgtttgtttagccgatatgcttatctaatcctgaaaccacactgtcatcagaattgttttagtataactgatgtctgttaggccatgtaccctcacctgactcttcttcttgggattatcataggtattccttaccctttgctctcctcatgtacatttccatcaggttgtccagctcctcaaaaagtcctgttaagatttttgcaggaattgcattgaatctacagatcaatttggaaggaatatctttattatactgaatatttatatccatgaccatagcaggccattgtatttaagtcttctttggtaaatttcaataaatgtttatacatccttttttgcatatatttagtttgattaactcctatgtaacttattttgttgctgttgttttatttgtattttacatggagatggtcctccatactactagaaatagcagtgccttgtttaaatcttctgtaactttagtaattttttaactcttgacattaaaacgtatcttatagcgttaacgctgtgggcttacacctgtaatcctaacactttgggaggctgaggtgggtgaatcacttgaggccaagagtttgagaccagccgggcaacatggtgaaaccctgtctctactaaaaatacaaaaactagccgggcatgatggtgcatgcctgtaatcccagctacttgggtggctgaggcaggagaatcgcttgaacctgggaggtggaggttgcagtgagccaagatcgtgccactgcactgcagccggggtgacagagtgagattctgactcaaaaaaaaaaaaaaagggtttgtaattaattgttcattgtgatggtggatttattactttctctatgtgttctgtttctgtttatatacactaaggatattttattaaatatgcataaatttacaatgtatatttatgaaataagcatgttatgattatatcatgatcttctttaactctaatagtctattttgtcttgaagttgattttgcctgacatttataaagtacctcaactttattttatttagcatttgcctagtacatatttgttccatttgttaactttcaaatttttgagtctttatattttaggctcatgtatcatcatttctcagcctgttggctaagatcaagtgtaggcttctgtctcatcaaatggcatattaggtggactttaaaaatcatttaaatgtcaatttttgtcttttaactggcaagtttaatctatttatatttgtatgaatattgttatatttgaaactatttttctatattattttttgtttttgtcatacacttttgctttatatttgttattgacttttttgattgattagaattttttatatattacattttattcctctactaatttgacatttatacactatttctaatcttttaatggttacttcttaaattttgtcatacattcatatcttaataaaatgtaaagtttattactatcttaaccaatgctttgccatccccatcctccaaaaaagtacaaagacttgaaatctgattacttctgtgataatacagtaatcttatattgggtttcccaccttgatgggttttcaaagctcatcagtaaagtcagaaaactcaatcacttttttgcagacacttgaatcattttcttaaagggaactttaacctcctaatatcttattgttcactgctccctagtctagttcaggtcactggttttatgggagagtgtgagaagtacatatccaggtgacaactttttgtctgtgcaatttgagaggaaaaatccctttcagctattgtgattagaaagtagcagaaggaacttgagttacagagccagaaaatcccaaatttattttctttggcttatgtgtctggctttaactgagaaaggatctgagtctttttgccactgattatgttcatttctctccctcataggtattttgtgggagaacttctgatgaaaagaaggtacccaagactgctctcattccatcattatatctgacatctctgttacacattcccatgacccctgagccaaaatttatttattatcattttttactattaaaacagtaaatcaagcttcatgatgtatgtagcctactatataaatgtttttctgtcatgactttaatttttttctcatgaacgtttattttcacaaatgaaataatatatttattcttgacaatatttagatgtgtttttctggtttttaaaaaggcggttctggcatttaaaagtccccagtgcatctgatggcagacttgctccaagctcctaacatcacttagtgggcaggtttattccttggtcagattcactcctgcagtgatcggcaaaatactcctagaatttagctttcactcctatgaatctaaagaactccatgaaaaccttgctcattatattatgcagtccatgctatttagctctattcttactggttttaaaaaaataatcaattgcatttttgtaaagaaattggtattatttttctcaggagccccactacttcatgcctccttacagctcacctgaaccatggtgatcataactggatttggctttcaatcactcctcttttcagtgcacttcctattacgatagcatcactcctctgcttaacaagcccaaacattttaggatgacctacatagctgtgtgctttgtgaatgccatggccccagcatcattcctcttcattcctgccacacacactgttctaggctcaccaaatttattgacattccctaaatatgcctcactattctgcctctccattcaactaacatttgctgagctcctactatgtgccaaacactggagatacagagaataagaagatgcagtttgactccgcaatccatgctgtctcccaggtttagaataaccctctagcaactcctactaatcttccaaaaactactcacacatcatcttcttttcagccccacccccaaacacctcatttgcacaatgaatcatcattcttttgtattcttagtgtttctatgatggtggcaagataattagaatttgggtttgcattactaaattttttcttactccccaattccaaacagatagctatgatttatcccttgtctctggattctgacaaggctcaggacacactcaacctaagtttacggactctgaagcccttttgtcagaggcatttgaaccagagcagctccattttgaatacaggctggctaaaatgaggctaagacctgctgcgctgcattcccagtaagttaaagcattctaagtcacaggataagataggaggttggcacaagatacaggtcataaagaccttgctgataagacaggttgcaataaagaagccggccaaaacccatcaaaaccaagatggtaaactttttctagcatatgtgaaaaaaaaaaaaaaacaaaatatgggcaagcagcagcctttggggctgctttgtctatgaagcagccattcttttattcctctactttcttaataaacttgcttttactttactctatggactcgccctgaattctttcttgcctgagatcaaagaaccctctcttggggtctggattgggacccctttctggtaacatctttctggtgaccacagaagggacaatagtgaggaaacccctgacccaaagactaactccaggtaagtggtggggtctggtaacactttcaaagtactattctaggtatcctgactttggagagggagtggagaggttgtggctgaagggttgaaggtaaagaagaaagagagaatgtctttgagatgctggaaagtgagtaggggaggctgcaggagcttgagatgaaaataaatgtctgtgagtctggagagatagcaaatctggagaaatatttgagagttgcctgtggagaagtcaacacctagagaatgggattctcagctttgctaatgatttctacaccctaagtgtatcagaaaagcaagaaggcatgagaccatagagttttaagcaatgcacttctgtctccatgaaaatcagtgtaaggtattgatcagtcagtcactctagaagctcaatcctgtgaaaagtcattaatgtgaaaaatgctcacaacttttcacagtactaggggtgggaggaggagaacaaatcccttataactagaagtctagaattctcctagagaatattgagggttaaacattaaaaaaaagaaattttaaaaaatgttatacttaatgcaaacctaatcttttgtcttgagtcttatcaattacacattcttctattataacatgcatcaatatgttctataattatatatttacctgtccctctgtttgccagaagttttgaggacaggggtcatgtcttaatcatctctgtcacctccggctatggcacaagatttttcatactgaaagaactcaatgtttatgagacaattgtcccaaatcaccaaatatacatggaaataaactaccaagacggaatttattttaaaactcatttcttacaatacatttcccttgaagtgtttcctcatacttccatacacatgtgcaaggcaaatactgcagtcttttctaactggagtgtaccacctatgtttaatatttgtatagagtcaaagttctactaagcatggatatgcactttggaaatgttcatctttaaatattatctgagaaaacgggaaataacatgacatgtcaacttgtataatcaatgtcctaccctgttggaagggcaatagtaagcatctaggtttgcatttacacttgctgtcacacataacaatcactgtagggcaaatagtaattagtgtgtaatgaacagtgtccaaatgggatcagctcctgaattaccatttaaatgtggtaatggcagaaaacttgccacaattattgctgctcagcaagccccaagagatcccattcttctccaaagtcttaggatatttagcacatttctttcttagtgttcttaaactgttggctatgcttggcacgttttttctcccaagtaaataagctctgagattaggagacataactttagcttttaaaattcctgacagcgccttcatgctttgtaataggcaggcactcaataaacacacaattgttaattaatctgacagtatctagagtaacaaaactgtaaattacatcttgtaaatatttactttctatcttctaggggtgagagataatggctcgtaggggaaaatagaaaataaagatctaattccaaacactatgatttaagtcaatggtaaagtgctatagtctaacatatgaaggtgttccttaccttcatattgctgttgcatttactcaatagatgctgcatctctccctacccaacagatgctctggactatatagctgtgaataatgcagaagttcacctctcatagagcacgcaaacttttgaaggaggatattgatatactgattaaccaaataataacagaaatttaaagcctacgatgggtgatggggcacatctatgagatctgggcctgttcctaagaggtgcaaattgggaagaaaatgatgggacaaatcaaaaatgcaaactggattatgcagctctctgattcaaagactgctatacttccttatttctctcacaatagagtccaccttacttagtgccacacaaaagtttctagtatgaaggtcctgctccaatgttatctttcatcctctgctccctcctattagtagctctgatgtattgctgcaattaccttaacgaccatactgtcatactccatgctgttgtcatgttcatactcctgcccccaccctaaagttttgttataaacactgctatatatgtgtctctctgtgtgtgtgtgtgtgtgtgtgtgtgtgtgtgtgcgcgtctttctccactacataatattgatcagggaaaatacaaaagaccatgccttgtttttttttttttgttttgtttgtttgtttgtttgtttccctcagcacttagaagaaagaaagaactaacagtcaggtgcagtggctcatgcctgtaatcccaggactttgggaggcagaggtgagaggatcacttggggtcaggagtttgagaccaacctggtcaacatgagaaaaccctgtttctactaaaaatacaaaaatttgctgatggcaaatgcctgtaatctcagctactggggaggttgaggaaggataatcacttgaacccgggaggtggaggttgcagtgagttaagatcatgccactgcactccagcctaggcaacagagcaagactccatctcaaaaaaattaaaaaaataaaaataataataaaaaagaaagaactaacagcttgaggtactgggtgatgattcccaactttgctacacttagaattacctgggaagcatttacaactcctgatacccagtttgcatccgcaatcaaatcagaatctctgtgggggtaggacccaaggagcagggattttattatttttaaaatttatttttttggagacagtcttgctctgtcacccaggctagagtgcagtggcatgatcttggctaattgcaacctctgcttcctgggtttaagccatcctctcacctcagcctcctgagtagctgggaccataggcatgagccatcacgccaggctgatttttgtattttttgtagagatgggttcttgccatgttgcccaggctggtcttgaactcctgagctcaaacaatctgcccctacctctgcctcccaaagtgctgagattacaggagtgaaccacggcacccagccaagtcggcaggaattttagagctcaccggttggttgctaagtgtaatcaagactgagatccattaatttaagggttcaattacttatggggacatttgtgagtattgttgaaagtatatgatgtgggcaataagccagaactcactgaattaaagtatgagcaatgagaaagcaaaaagaaacaagtgttagaccagtagtatgctagtctcttgagagtctaggtaataccatttaggacacaggcatgggcaaagacttcatgactaaaacaccaaaagcaatggcaacaaaaaccgaaattgacaaatgggatctaattaaaccaaagagcttctacacagcaaaagaaactatcatcagagtgaacaggcaaactacagaatgggagaaattttttgcaatctatccatctgacaaagggctaatatccagaatctacaaggaacttaaacaaatttacaagaaaaaaagaaataaccccatcagaaagtgggcaaagtatatgaacagacacttcttgaaagaagacatttatgtggccgacaaacatgaaaaaaagctcatcatcactggtcatgagagaaaggcaaatcaaaaccccaatgagataccatctcatgccagttagaatagtgatcattaaaaagtcaggaaacaggccagtaacaggattacaggcctgtaatcccagcactttgggaggccaaggcgagtggatcacaaggtcaggagagcaagaccattctggctaacacggtgaaaccctgtctctactaaaaaaaaaaaaaaaaaaaaaaaaaaaaaaaaaaaaaaagttgggcatggtggtgggcacctgtagtcccagctcctcgggagggtgaggcaggagaatcacttgaacccaggagatggaggttgcagtgagccaagatcgtgccactgcactccagcctgggcaacagagcgagactccatctccaaaaaaaaaaaaaagtcaggaaacaacagatgctggagaggatgtggagaaatagggacacttttacactgttggtggcagtgtaaattagttcaaacattgtggaagatagagtggtgattcttcaaggatctagaaccagaaataccatttgaccgccaatcccattactggatatatacccaaaggattataaatcattctactatgaagacacaggcacacgtatgtatattgcagcactgttcacaacagcaaagacttgggaccaacccaaatgcccatcaatgatagactagaaaaagaaaatgtgcacatatacaccatggaatactatgcagccataaaaaaggatgagtttatgtcctttgtgtgcagggacatggatgaaactggaaaccatcattctcagcaaactaacacaggactagaaaaccaaacaccacatgttctcattcataagtgggagctgaacaatgagaacacatggacacagggaggggaacatcacacatcagggcctgtcaggggttgggaggctagggaagtgatagcattagcagaaatacctaatgtagacgacgggttgatggctgcagcaaaccaccatggcacgagtatatctatgtaataaacgtgcaggttctgcacatgtatcccagaacttaaagtattataatttaaaaaaagaaaaagaaaaaagagattctctctatagccaattatgttaggaaacatgccccatctttgatagcattagcatattgaagactgagcaattattcaacaaagaaacctgtttaacattacctaattgaatattttctaaatttatttgtcttcagaacactacttttcccatctaacacctattaattttcccaagaaatgccaatacattttttttaatttcaagaaattacatgagaatggcagtgcaaataatgatgtatcttagaggaaggaaagaatggttgagagaagactttatatccttagaataggaaataattggtcacatttgtagaatgaaaagaatgaaacataggggagggaggaattgaagatgctgtaacaagcaatgatctgatttctttagccctggtaagaaatgcacagttaaactgtgggtggattttcttttctcaagcctctcttctccattgatgacctcacagagtccagaagacaagggaacatggactggcattctaatgtaacattcattcatgcctcaacatttattgagcatcttctatgtgtctcgtctagacaatagaggtgactattccatttggaatgccaacaaaagcctcacccaaaaaatgaaacttaaattggtttttcaaaagtgagtggataattcactaggaagaaaaagaagaatatgaaagacagaagaaagcatgagaaaacaacaatgaaagaacaaagtagcagtccaaaaaattgtgactgaaatacggatgggactggtagaacatgaggctggaaaattagactaggccacacatatacaaaaactttaaatggcatgcaaaacaaacagtttgggatttatgaggtataaaataggaaaagacatgctatatttgtcttacagaaaaatcactttgacagcagtgtgagtgataaactggagacctgccacagagggactagtttagagcctactgcaattatggaactgttgcaggtttccatggatacaactgggtataaagtattatttagtaacagagcctgaaacatcatgtgatcattactggtttaaagcaaacctcctacctcaggatttgggcacctttccaaaatataaactcagcatttatatcaactgctgctatgaaagttatttgggatcatgtagatgacctttcatgcaaaaagtagatcacaaaatgtaggtcgttgaaaaaattacagcagcactttgtaaaatggagatttgagaagatactcattttatatttattttgggggtctcatacctatcttgaatatatagttatggtagaaaaagttctatttctgaagcacagtggtgtgatctctgttcattgtaacctccacctcccaggctcaagcgatcctcctacctttgcctccagactaactgggactaaaggtgcgtgccaccatgctgggctaatttttgtattattttgagatttggagagatagggttttgctatgttgcccaggattgtctcaaactcttgggctcaagtgatccacccacctctgcctcccaaagtgctgagattacaggcatgagccactgcacctggcctggcaatagtaccttaatgaaagacttagtcattgtcagagctacctcataaaaaggtaaatttcctttttctaaaaaaaaaaaaaagcttatttgttgcatattgaaataagcattcaagcaactgaaccttgtatgagatccagtgggagagtctacagacaccaggaacttcctggctctgcacagacagattttgcggagaaaacacaatcttgctctcaaggtagtgaagctttcataggttattactgtttcatttcttccggaagttgtttcaagctttatttaagattggctgaaaaaagcttactatgattcctttaaccataaataaagcataaaagaagaaatatcacaaaatcatccaaatactgcagatgctttcttggttttaaagtcacagattgaaaactggttttaaagcaggaggtataagcatttgatgctctgattattttttactttaaagaaataattggagttttagaagacttgaactctacagcatagagaaaccaacaaaaccaacctaataaaaatattgcatcttaaaggtaagagctaaaggaatattaatgtggaaaaaataggagccactctgaagaatctgacttaaatcacataggagaaaaaatattttttccacattaacacctagcattagctaattttaaggaaaaaagaaaacatttattaggcaacttacaaacttctctcatcagctgaaagaattatcagacttactctgttgaaatttctttccttcttttctctgtctctctctctctctctctctctctctctttctcttgacggagctttgctcttatcacccaggttggagtgcagtggtgcaatcttggctcactgcaacctctgcctcccaggtacaagcaattctcctgcctcagcctcctaagtagttgggattacaggtgtgtgtcaccatgcccagataattttcttttttttttttttttttttagtagtagagacggggtttcgacacgttggccaggctcctctcgaacttctgacctcaggtgatctgctcacctcggtctcccaaagtgctgggattataggcttgagctattgcacccagcctactctgttgaaatttctagaggaagaatggaatttcagtggcaaataccagctcaaggtaatgaaggcatttctaacaattagcactatctctagatggactatgcagcatttgagagggtgtatgtagtcatttgtgggtggtactctggcagaagctaagagaccatcatgcgtttgccacaggaagcatatgggtgaactagatgacctctaaattacttttgattttggaattacatattatcaatgaaaacgaaactgaggttgaactgttaacttaattgtacgaaatatatcactttccaaatccttatatcaaaatactatttctaaaagacttactatgttatgcatcaggcactatgctaggcataggggattcagcaatgataatgacagaatgaatctactgtggccagactcagtgactcacacctgtaatcccagcaatttgggaagctaaggcgggcggatcacctgaggtcaggagttcaagactagcctggccaaaatggggaaaccccatctctactaaaaatacaaaattagtcaggtgtggtttctcatgcctgtaatcctagctacttgggaggctgaggcaggagaattgcttgaacctaggaggcagaggttgcagtaagccgagattgcgccactgcactccagcctggatgacagatcgagactctgtctcaaaaaaagaaaaaagaaaaaaaaatgaatgaatctcttacgcttatggagctttagagtctaactgcgaagacagcaaagtaagcattaattacaaggagggataatgatagaggaagtacttgtatttctcctccttatgaccactattattattagacagactattttttttccaaaaagttgatactgttctcaaaagcactctgtttctacaaatgctagaatccaaaaattatgtcaaaatgtctttttaacatgagaacaatgatgtcaatgatgggtgaaatgataatgagtagaggaagatgaaagcatacatatattcttccagtctctggttttcatattatttgtaaggcatggatgcttttcaagagaaaggctaagatgatatggcagtggcaaccatgaaccattaaagcagcagttagagttactagatgtaaataaagaaaaatctatctccaaaagcttgctttgaactttataatgggtggattgcactgatatcatctgaatccattgatcaattacagcatcagtaaaagtaggacaagaaggcatcatttgccttcagtaggaagtatggagcaccatctatgaagtattcttgccatttgaaaccataacaacaacaaaatccatttaatgtaatcaggcctgtactcctaattagcaaattacaggaacaaggacaggtgaaaagagaacaaattaaatgataccatgagaatagtgcttaatcaatctatgtttttcttttcatattattaaaactccaataaggtaactattactgtgcattttcacaaataatgagaccaaagctcagaaggctttattaagatatccaaagttgcagagtaacaagctaagataaggtttggggagtactgtacctaaattcacaggatgtgttttgcactgggcctcactgccccaagagagattatttcatccactctcattttactgcagcacagaaggactaagccctttgctcagaaaccaccaactagtacttgcaggatctaggtgtagattacaggttccttaattccaaattcagtgctcctctgtccctacaaattataaatttgggcaacccttgatgcccaagctgcaatatggatcagttaaatcagattctttgagggttggattaagaaaccactattttctaaagtacccaaggtggctccactttgcagctaaggttgaaacactggtgttatgatgcttatttccctaatccaactcagctattttacattttatctaatcctattcatcactaaattctgagaatttcttcccaggtaccacgcttatctaaactatattgaaaatatcagtgtatgaaaggaattccacctcctctgataatattttagttactatgtttgttaaaatcatataacaggccaggcacagtgactcatgcctgtaatcccagcactctaggaggccagggcagaaggattgcttgagcccagtaagtttgataccagcctggaaaacacagggagacccatctatgaaaaaagaaaaacattaaaaaaaaaaaaatttagccgggcatggtgtcacatacatgtggtcccaactacctgggaggctgaaggggaaggattgcttgggctttggaggccctggaggctgcattaagccacgatcacatcactgcacttcagcctgggtggcagagtgagaccctgcctctaaaaataaaacaaatcttggccaggcacagtgtcacatgcctgtaattgcagcactttgggaggcaaaggtgggtagatcacctgaggtcaggagttcgagaccagcctggacaacatggtgaaaccccatctctactaaaaatacaaaatttagccgggcatgatggtgcatgcctgtaattccagctactcaggaggctgaggcaggagaatcattcgagcccgggaggcagaggttgcagtgagccaagatcatgccattgcacagcagctggggtgacaaagcaagactccatctcaaatgataataataataatatgataaatcagatctcaggacattaactgagccttgttttacgagggactatgaaaactgtgtcatatgtcagcatccataagcggtgctccctcttctacttctgctttcacagtacagacccatctaggcagaatcagctttctccaggcatgttgggtcattctcttctttcttgctttagtgccttgtttttgtgaagagctgagcagaaactgcccctctgggtagactcatctaggacttactctttctattttaaatgctttgtgtctaaatttgaatggtgtattcatacatcttagttcatgaagaaggaaataggatgcctattttacacctacaggcttaagccatatggatttctcagcttttaccagagctgtgttttgggagcatttagtattcaggtataaagtggtactctgaggccaatttagcttctatgccttatgtatacattccgtaattagaaattccaagggaagccagcagtggggctcacatctgtaatcccaacactttaggaggcagaggcaggcagatcgcttgagcccaggagttcaagatcagccagggtaacatggcaaaaccccatctctacaaatggtacaaaaattagccaggtatagtggtgcacacttgtagtcccagctacttgggaggctgaggtaggaagatcacctgagccctgcgaggctgaggctgcagtgaatcctgatggctgaggtaggaagatcacctgagccctgcgaggctgaggctgcagtgaatcctgatggagccactgcattccagcctgggccacagagtgacaccttgaaaaaaaaaaagtaagaaggaaggaaggaaggaaagaaagagaaagaaagaaagaaggaaagaaagaaagaaggaaagaaagaaagaaagaaagaaagaaagaaagaaagaaagaaagaaagaaagaaagaaagaaagagaaagaaagacagaaaagcaagcaagcaagcaggcaggcaggcggcaggccggacacagggaggagtatgaatgtcagggcaaaaatagggcatttctgagtccctagccatcataccatcaatgaagaaaataaatttcaacctaaaccctaaacatttattattattaacttgtattggtagttttttaatcacttacatgacagattccacccttcccctattctctccacaatactgtggggacagcagaaatattcgacagattattaaatccaggattattgaggctaagtaacttgttctgtaacacaagctggttatgaggatatgactagaatctatctgccttcaaatataatgctcttttaacataccttgtttattttttcaaattcattcttcaggaatttaaaaagggaatttatcatgtataaatataactgcagtatttagtgtcaagacctcactgcttaacaaaaccagaactttattcctcttataggatagcatttttgggtatttcttggataacaacagtaaactttgtataccaaagaaatctgcgaaatgaaactatgaattatcactattaattaaaaaatgagaaaaagaaggaaataattgccttttacaacttatccctcaaaactggtacatggtaggtgtccaaggaatgtttagataattgctatagaagttcaaatgctcaaaggataaatggcttaacacaaggtaaaaataaaagcttacagtagagaataattatatttgactaattaaaatatgaactttgctcacttcattgtgtttggattatatgtataaaggtagtgatctagctatgctgaagctatctctactctgttatttttatgtagaagattgtacacaggtaacccgcatatattatcaagcaagaataaggagaaattatatttggtgttgacaggttattctggaagctgtagtgatacatttgccactgaaagaattgttttgaaacacacacacacacacgcactcatgcacatacagagaatattgctcttcattattgacacattttttccaataataaagataggcatcaacatgtaattaagaagcattaggaaaaatacccgtggaaactacaattgtgagaaaaattagtacattttctggaaagaaatgcagtgcttccatgtatcatctaagagctttaatccaacaatcatttcatctccagtaatttattctaagtaatcaaaagacaagacaggcaattttgcataaatatgttgaagagagcatgacttatgacagtgagaaactggaaattacctaaatatccaacaatacaaaatgacaggatttggtatctcggtagaattgaatcttaatcacctactaaaatgtttttaaagaatatatagtgacaaaataattacacgtgatgatgttaaatgaaagatccaaagaaaatatgcctacattttgacaatgtttatgtaagtaaatttaaaaaatatatttcagtttttacacaattgtagtttacaaattttcttgaataatcatgactatagatagaatattgggagaacatattatttattaatattgctaaaggtctgtggtagaaaatagactgaattcgtggttagaaaacctgagccccaaatgaatacacttgagggttcatctttgtgatcacaagccaattatttaacatttggggtctcagtttacccttttgttaaaagagtagcataaattccagaggtctagaattcaaatattttcagaggtccatcagataatataaaagcatcaggaaactcagattcagacattcattcaatgaagaaatattgactgcttattagatgtcaggctctgtgctggacactgggaatacagtagtgggagaaatagaggtggctagctgcttatattgtgatcaaatcttaatattttcctagagatggagaagtagggtaggacacagtaaaatagctgcaataaaatcaatactttgcatgcagtgtctcagtttattctctaaacaactctaagaaatacctattattttctccatttctccattctactggtgaaaaaaaaaatagggaatttaactgacttgcccaatttcataaaggtattaagtaacagaaagacataaagtaattatattaaataatgaaaactttgtgatattaaacaattcactcaatctttctatcagtttctaaataagaaagagacaaaagcttgagtagatttccattaagctttcctttcaattcataaacactatgattctattttcaatctaaatttagctctgtaaaccatataccagtgatcccatctacatatattaaaacaacctattttcctattatcaccaaaaagcaagtgtaatttgattttgcttttatgtccctttaaggatgcagtgggagaaatagagtgatcaccttggggctctggaatattctcatttggagtctacttttgattttgcaaaaagtcagcttcctcaatatgttatcagctctgcagaagatcttaaaagtctgctgacaattgtcacctcaaacattaattcattcagtgtttcttcacaacagagaattactgttgctgagttaaattaaatgaaaaaaagaaaaagtgtaaaacaatttaaaagaaactaaaactcaaactaaatgatagacatgaattagataatgttcttctctgattgcattggtgaaattagaaaattctaatttagaatcaaagtccagcttatctttgaaggaaatagaatagaataaaatactgaaaaatgaatagctagcataaaagcctaggtcaaatgtaacatcaatcgagcatcttcttttagtcttctactgagaattaattgctctgttcatggttctcctagaggacattataaatgctttagaaggcttattagtctgtcctgaactcgtttatgtaactgtctctaccaataaatattgagctattaaagggctgtggccaggttatttatatctctatgcacccggatcatgatggtctgaacatagcagacattccatatatatttctaaatgaaaaaatgaataattcaaataaaattacatttttctattgaaatgtgacttttcctctacttgaatatgacctagagcaagccatttacctctagatctcaatttgctcatctgtagaagcaggtatgcatctgcatcacctctaacataaagttttagatgtgaaaggatgcaatcaatctaagagccatttaggataactgtggaagaaaaaagataaaagacaattcttaggggtcaacaataggttcaaaactagtcactcatcctcttaatggcttcattttcctagttctcaatctctgaacctgagtcatctttgactctcactctttctcattcttctttgttaccaagatctatcttcttagttctcacaatatatcttatctcatgtattggtttatgacaagattatccaattcagtcattttataaacatttattgaacacctactatctgccagacactgtgctaggtattgtgggtactctgatgaactcagtggcttcagcctctgctcccatggagcttatattctagtaggatctaaaaacaaacaaatattcaataatacacaatgattagtttttgacatggaaaaatggcacctatcacatgctggaataaggaaattttcttaaagaaatgatatcactaccaccacaatgactacacaagggatcatcatcatcatcatcctaatatgtaataagctgctactaatttatccttaaattgttataagataggtactattagtcctactttacaaataaggatagtgtatctaagcaaaaataacttgactaagattgcataactaatttaacatttaactcctgagtctgtgaccttgagcagtaacactgcttaagatattctgataccagaggaatcaacaggaataagaaaaagaagagctcagttaattttccagaagtaagaataacatgtacaaaactcaggagatgagagagaagaatatattaagataattgaagaaagttcagcgtgtacaaatcctggggcagtggggagtagggtagggaaagtaatgataagataatgaagctagagatgttagcagaaattaaattatgtagggctttataagtcaaattaaggtatttaaactttatgttaaaggcaactactgcaataggtatcctactggcattcatttcatcttcctgatttatgtgaggctactgtcattcaggcagtgttctaagtgctagagatggcatggaacaaaataagcaaggtccttaatctcaggaagataatttaaaaaataaaccagaaagtaaaatgtattgctaagtgctacaatggactgaaaataggatgtgacgggaaatgacaaggtcaacaccagatgatattaaaaggtctctcagaggacactgattttcatctttgtctttgtagtcatgatggtttacactcaaagctgtagccaaaataatgtttgtgataatctcttctaaatagtttttcaaaatatattttaacaaataatatgttcctttaagaaaggtcgatagatttaaagtaaaagggaacttttaaaaaatttctactcccaagtgataattatttttaactatttggtatatattcttcttgatagtttttacctaaattaataatataaatatttgttttcacataaatgagatagaagttactgtttggtatttgttttggtttgttttttaacatatgataaatattattcaaggctagtacataaaaatataattcatcattttggaaaaccataattataagcattttgttcaaggttaatgccataaattatttaaaatattccaattaatgggcatttcctttgatgccaatgtaacagtactaggcaatatactactacagattgttatgtatgatcattcttgagtatttctcaattgttaccttagcatgcatttttagaagaattgccaaatacaagggtatgcacatattaaatactgaagtattctgtcatattatttcccaggaagtctataccaagttatagtctcataattatgcacaatttacatcaatgataatagttacttttctatatcttcgtcagtactaattattattaatcttttaaaatacttattaatctaataggtgaaaatgccacattactttaattcacattccattgctaacactattcaacatctttgcatataagcatccatttatgagggacaatctgtaatgctacgtaatcctctgcaaaaaaaaaaaaaaaatcctagaactcttcactgtcaattgcacccatttataaggaaaaatctgtaataccatgtaatcctctgcaaaaaatcccagaactcctgtctattagaaaggtgtttggacttcttaatttgacattcatgactctctgcctaaaatttacctttctaggcctctggtctgaaatttccttacatggctcctaagttctcttcaaataggtttgctcactgatctttcattatacttttctttcccacatctgcacctgtgatcatgctgtggaatttacaaccccatcattcaagccttagatcaaattctgcttctctccaggaaaccattcctattattctagtcataactgacctcttttttgaatgtcttcagtgcatttctttttctcctcttaaggcactgatcacattctacttttctttgttttcctagtagattgttagctatacaaaagccacctttagcatggtagctggaagacagtagctactcaaatacttctaaaagaaataattgattttacaaaaaattaattctatgtattccacacctcagagtgcattaaaaaaatgaaaacatttaacattttcaacaggattttaattttaacagtggaaagtatacataatttaaatgcacaatattagggaagtggataaaccgcagcatattcatggaattttatgcgtacatgataacaatttgtaaacagagagtacagaaatgtatataatgtgtgtcactgttatgcaaaataaacaacacacacacacatggaaatactccaaaatataaattataattgtctttgtatggtggacctcttctaaatattttttctataaactttcctatgctttctaaattttctatattaagcatgcatggtattactttaaatagctttatttccatctttctttaaaataagtacaattgcaaaactgcaagataaaatttttaaaaattaattgatggattaaatggcaattgtgacacataagtgaaactgtctaaattccttttggacagctgacaagaagataaatgcctctgtttctatattcaagtaaaaacaagtgcactcgcattatgaaaggggagtgggaaggaaaaggaaaatgatctttatgttcttgctacagaaacaagaaaataaaaaggggaagaaaaaggtcataggagacattgatgcgttaagctcctctttctacctggtggtgtagtatcaattctgccccaagaccagttcaatcccttcccccctggaaaatcttccctggaccctcgcatgtaccagtctctactttctctgaattgtgttttatttactacaagtgtcatatttgaaagcattttatatgtttctaaatcatttctactttttaattctttctccatatccaggatccaaggtcatcaagagcagggggccatagagcttaattttttttagtgttattcaagcatctaaaacagccagacacactacatgcttagtaagtatcttcagatgagcccttttcaatgagatagtgagtcactggaatgtcttactgtaaaagagaaagggatctaaaatttattgagccacaactataattcaagtgatttacgataactattatatattttatgctaactcttaaacaaggtattctctccacttgagagtcagaagcaagtatacagatagaacttatttccacgaggctccaaagtcctttcttctaccctgtaaagttgagaaagccacataaaaccttccacttcttgatgcatagccttgcttgagctaaactagagcaggctataatgatgtcctcataaggaaagatgtaagatttttgggggggcagggagagcagaccagtaaatgtcatttctgcaggaaagtgaagtcagtggacttttaaaatttcatactctgtctcctgaacttattaaataaagagtcaggtaaagatttctaatattctaaattcagtttactcctttttttaatgaatataattcctacagtgggaagtgcatggactctagagcaagacagacctaagttcaaattctgggctttacctcctcctatctctgactttaatcaggttattctcatttatctagtaagtattgatccccatatctaatgaaagagacaatcaccccacagagttgattcaaggttgaagtaaggtaacctaatctctaatatggtacctggcctctggtaagcactctaaaaatgttagtggtctcccctcatcccaacatcctttgtcctctgagataagaatagttctttactgcagacataacacatgactctaacaaccagtctctctgaacagcttttctttggtttggtgacctaaggagaaggtcttgtgtcagataacaattcctgtgtcaagataggcttgagaaaagcaacctctaaccacaaattgaagacaattccttataagcatctctctagaggcagtgagcaacaggagactgtgcgacttttgactttaaaggcagcaccaggatccaattcctctcatacacagagcacctagcaaaggccctggcactggccagtgagcagtattagacatgtggcccaactcattcaaggcaaaattccttcttgaacattttataacacaaaagacaaaaataaacacaatcatatctgatcctatttcttctttgtttgtgtgtttgtttttaccacagtccctagagatacagacttgacctagggtagaaacaagctgcaccacctccagcaatggttctgaaaaggcactcttcacacacttatctgctgaagcagtgactcatgaaattcacaacgtgctaagattcggtgagaaacacttcatatcaaattaacataagcaaaaggttacttgagggaacactgcactacttttttaggtgacccagttatggctaaatttggaaagttggcaaggctgattcttcccttgaaaacagatctcacagaaatataagatactatgaagcctcagggcccagttttttgccgtggcatccatagtgagtagggccacttgacaaagtcagacactgtggatgtgtctggtcacttcaggttgccactgagataaccgttttctagagtatgctttgtgagacagaaatcagaggacaaatcaaactacaaacaattaaacaaaaacttaaatactgataagtatatgccaagcactgtttcaagtgctatgtaaatgtttattcccataataatcttatgaggcacttactattatctgctccactttttaaataagtaaattcaaatagaaagagggtcacacatctagtaagtggcacagggccatagatttagtaagtggcagaacctgaattgaaacagaggcagtttggctccagaatctctgttcttgatccctacgctgcctcttaatgctacgtgatgttactacatatagtaagacaacacctaccatttggtttctggcacaaagtgtctctgggaggcaatgcattggagtggtttagaatgctgactcaagagcaaactgcttggcttcaatcctgcattctgatctcgagagctaagtgttcatgggtaagttagttaacctctctgtgcttcggttttcttatctatatattgggtgcaataatagaccctatctcagtggctttggaggactaaatgagttaatacctataaagtactaaaaacattacttgagaagtagtaataatagtcaatagttgttaagtgttattgtttgttaaaaagagagatactatcttgtctcagagttacaaaagaagcaccgtaattctcgcagtttttggtgagaagacatagtagttggaaaaatataaactgtgctatctgatgaactccagttaaggtcaacccaagccaatggaaaccttgggaaaggcacttaattacactaggcctcagtttctccaactgccgatgattaacacacctctgccatagatgggatgaaaattatgagttaatatgtataaaaattggaaaatgaaacctttgattactgataatttggtaatcaaataggattatcagattccctgccttcccttttttatgattggatatactagtagaggatgttgagtgaattagccaaactccagcatcttttgccaacataaaatgacacatggactggcagcatttaatggttaggcccaaagcaatctcagtatttaagaatattttaaattatctataagaatataatttggaaacaatctaaatgtccagtaatagggggtatgataattaaatatatgttggggaataggttattctatgaaatcctttatgcttttttgcctttaacccaacaattccacatttataaatttatcttatggcatactactacttgtatgctaagatacatatgtagggataataattgtagcaatattaataatagcaaacagctggaagtaatccaatatttatcagtggggcactgatgaaatacataaaatgagatatgtggatgatactgaaggaaaaagcttttcatgatgccacctctgaatattgccagtaatatttgttttattccttatatttttgtattttataacttttctataataaacatattaatatcataaaattaatactaattattattctgtagtgagcatatattacttttgcaaccaggtaacaaatattttttaaaaattttttgcaagattttttttgcccttaatacttcctatgagttccttaaataaagaaaaattttttaaaaaacatgacaacttcatcaatatagtcatatcaccaggtcataaaaggttccagatagtgacctaaaccagaattatcttggaagagaagtcaggtggattggtaggtcctatccactgaaagacacaaaatctactccactactgatgaataaagggaacaaggggtaagccaatggtggaagcctgaaccaccaggtcaatggcaagcccctcccctggcctggcctccaggacctgttgacagtgtccttgccctcctcacttttccttccctggccttgccaatcctgactttatagcttcagcctattcatcttttctgggagaggtgacccaacccaagggtaacagcttgagggtgtagcacaggccattcattcccagaccagcatcccagtcatacatagccacagattactgttccaccttttctccctctggaattcatacacgctgtttcctctgcctgaaatattctcctccctctcctgccaagtttcttcacctggatctttcttctttatttatcaactcagatgcctcttactctagaaagtctaccttaacacattagtctgggatatgtgtaccactgtctgttagatgacatacacacacacacacacacacacacacacacacacacacacactatatgtttcccaatggtttatgcctctaactgagctaaacactccctattcaaatctactatttacttaccggcttctcaaataatactgtcaaatttttgaggccaaggaccatgtgttattaatagttttgtccttagtaccaatcaaagttttggcatatagtttgaggtcagcaaacatttattttattgtatgaataaataaatgatgagtgttaaaggcaacagacaaaggtccatatgccagtttctacattgacagtagagaaaacgccatttactaagaagaaaaggaagtgctgagtagtgactgtgtgaccagtgttgtcaactattgaacaatatggttaacagtatatacagatgaacagagacagttcatgaggtccctggaagcctgatggggtcagatgcttgaagaagcttaaaattctatcattattagtctcctgcctgagactcttgactttaccactctaattgtcacccaagtgcctctatgctactatttttatcagtggcccaagtggtgatgccaggaaaccagtaattaaaatcatttttttaaatagctggtaagtcagctatacacataactccacctcttaagaaacttaaatgaggagtgactacaaagatttttctgtgccattcttgcccaaagaaagatactttcaccattagtagactccaaagagaaatcaaagactatacaatacctttatgccaaagatgttcactgcaatgttgtttatgctagcaaaatatctgaagcatctaaacatacagcaatgggaagagttgtaaaaataatgatgcaatggaaccattatagtgagatttcttttcaaaaagatacatcattttttacaactattttgaagtataattgactaacaacaacctatttaaagtgtacaatttagaagttttgagccatgccaacatctatgaaaccattagtttaatcaagataatgaacatatccattgctctcaaaagtttcctttgtactctttccctttacaacttttctcatcctcaagcaagctttctgtcactacagattgagttttctagaatttcatatagagggaagtatagggtatgtactcttttttagcctggcttttttcatttgatatacctattttgagattgatttctatgttgcatgtgtcaatagtttatttctttctgttgctgaatagtatttcaatgtatggaagtgtcacaattttttttttcagtagaacctgttgatatatatttgggtatttccaccatttttctattacaaataaaatactatgaacatttagggagaagtcgtcattgacttatgtagacatacgcattcatttctcttcagtaaatacctaggagtggaatgactaagttgtttagtagataacgttcatgatggctagcaatgtggaaagtgcttatggttaacactaagtattatataaatgtaagatttaaacatagccatatgaaaatgaaaataagaaaatacattaaagctagagtggtagtttaatttgtgtggtaagactaaaggtaatgttttttcttttcttagttcataaatattttataatatggttatattatttttaacttttttaaattaaaaagaagtaataatatttgttaagcaactactatgtatatacacatacacacattcctttttgtctttacagcttcataagataatttttattggttcaattttcacagatgactcaatctggactcagaatgattacgtcatttgtccaatacaccagagctagtaagtggtgtggctgtgatttgagtccaggtccacctcacaaaaaagattttgttcattccaatatgtaaattcttaatcatggatagcagctcatatgtctttataaaatggggtacacagttggaacctcacgaatttctaaatgcaaatataaatgatcaagcttctgttgaacaactctgtcctgcattgctccgtgaggcagttgggctgatcgagaacactgcaagacgctggggactggcttgatctaatttggaatcctcctagcaacactatcaggacaacggctctctcttgaggaactaagacttcacagaatgttcaggaaaaccaaatcaggaaggaaatatcggtattttatattaaataataccatgagatagtttaaaaacaccagataacagtttatcataactatattaggaaaagagtctctgtgatctaagtcatcaaggagacactccattaatggcaagttcccacaaaaatttcagactaggttagcagatacagccagttcccttcagaggagagaattgctgactcttctatgccctacctactcagcttggacaaggtattggaacctctctgagatttggtttcttcaactgtaaggtgaagaaaatagtatctattaaaataatttattttgctggttaattgacaaaacacaggtaacagttatcatggtgccctgcacatagtgaccactcactaattatcaactactcttgttattgccatagttgttttgttgcttttactaaataccacagatacaatgcctaattgtcaagacaaaaggatgagatgagaaggatacaaattaaaagttttttatccttctttagaatgcttcaatctctttcagaacctactactctaaaacttgctatctcaagtcattaaaccttacaatggagattccttgcctaagagcagctaatgatcacacttagagaactcacatcagaaagtacattcttaggttgaagtgacatcatatggtcaccaagttggaggcagtcactgataatacttttatagatcctctctttcatatttgtaaagtgggaccttgcctatggatcttatgttatttctgtaatcagatggaaaaagagatatgaacacatttgaccaatagtaaacaactgtgaatatgtaacaacagtttcagtgaagtaagataactagcactgtgtattattcaatcatttattaattttttcaacaaatatcttttgattgcatagtatgtgccttgaaccctgccaggtgataggaaaataaatggacagtaagtccagtaagtagaagcaaactataaaccaataagtgctgtgttgatataaaataatagaggctgggaagattgggaaaatgagtatctttagggagaggtggagaatgtcagtggcagctttatgaaagaggtaacgtctgagctgacactgcagcataagccaacagaagaaaccgtgtgggcaaaagaagacatgtaaaagcctgacacacttgtggaaggggcaattaaagtcaaggtcagacagacaaggagaagctagaccatgacttgcctataggcaaatattatagtgtctgaattttaactaataccaacagagagaaataggttttacataatagagaaagcagattaaatctgcatttagaacaatctttctgtcagtaaagtgaactgtagtcagggagaccagttgtcttggagtcagacaagtaggtgctaaatagtgaatgacaaatatatatacattttttacctgtttgttgatctttaaaatatttccctgtctatttaacaaagctgttatgataaacaaagtcatcttgagattatgggagtggaagagttttataagatgaagaatgctatataacacaagatgtgtcatgattaccgttattttgtcttgccattttgaccatctggacaatcaattcagctatagctactaaagcagttacatcaattgtgctataatctacatctgctgttacaggactttcaaagtagctatatgagccctgccatggttcttcatttttcatgaattaatccagtaagaaagaaataaacataactgatagaactcttaagtgaaagccacacttaattcctcagccaagcattcaagcaggcacccaattcataaggatgatacaaattcaatggaatattacccccttgatttattctgtcactacaaatggttgtgtatgacagttatgtgaaaatcatgaaaagtattatgtgtcataattgtaattctggggtagaggaaccaatgaaaaataaatgtagctttatttttattggatgagtctaatagccacattaaacatgacataaatttgatttgcaaaagtaacattgatcaatacctaacacaagcatcgcacacatagtataccctcaataaatacagacatggacgcaaacagagttaccagaaccatctaacactaactactaattactgctcttggtcacctgaaatgttaaaggtatggaaatgtttgctggaaaaggtttttatttctccaggtagctaataattcttcttaattttaggtacacaatacagcctttcattaaggcattatttgttaaccaaatttgtcattcagaatagtaagttaacaatgattggacacagtccttagctatataagtgttgtatccaggctggctgtcattacagcatatactcttctagtatcattttttttaggggtcataaagggacagagttgccctctgtttccatctaaaatattgctatctatcaaaataccacaaaatagaggctggtgacctgattaaaaagggccctatgatattttgtctccaaattatctgaaattattaaatttttaaaatccctactcagagaaaatttcaggacaaaaacggtaaaaaaaaaaaaaaaaaaaaaacttcattccagtaccccatgtaatatttccattcagtcatttatcattcaacaatatccattcaacatatgtcagacttcaattctgggtataaatggtaaagaaaaatatatatagtgacgaggttcatgttcttatggaatttaccattcagtgatcaagacagacattagtaagcaaaggaatatcttattacaaatgacaaaaaagtactatgaaaagtaaaaacaggattgatctatttcagactggaatggcaaaggggggtcagagaaggctaatctaagaaggttacatgggttgagataagaagcacaagaaagaatcagcaaggtaaaaaggtggggcagttgtaggaaggaagagcttgtgtttcagttttcagttgacaaaatctggtctttgtagttacagataacctaatgggtttgagcatttactttccaatttaataaactataaagtttgtgggactgaattttgatatttgttttatgtacaatgaaatattatttcagtaaacaaagtacttgaaatgaaataattgaataggcaggggaactgtctgaagtattgttaggatgatgattttaaaataatgatgagggtacattttagcactaatagttgcatgaccgtacagtttggtggctttctataattcacaaagcactgtccagtagaataatttaattgaagcctctcataaaatctcacagtgatgatgtgataaaatgaaaagagtcctaaattttaaatcagaaaacccacaatatagtttactactacttgttggctgtacagtctttggtaaaccacttaggctcagaattagcacctcatctaatgaaaaatgaattgatgataataacaccaaaattgcctacccttgcactgtcattatgaagacaaatgaaatcacttttgagaaggtgcttaacaaatcttaaaatgtaatataaatttaaggtatctgaagttttattattgttagtctcattttaaagtggacagataacatttccctcatttttccaatgggtaaactaaagcacaggaaaggtaaataatttttgcaaagaagcattgctagaaatgtgaatcagatatcatcatccagttcttcctcctctcttccctttctttttttttttttaattatactttaagttctggggtacaagtgcagaatgtgcaggtttgttacataggtatacacgtgccatggtggtttgatgcacccatcaacccgtcaaccagattaggtatttctcctaatgccattcctcccttagccccccacccctcaacaggccctggtatgtgatgttcccctccctgtgtccatgtgttcttattgttcaactccaacttatgagtgaggacatgcagtatttggttttctgttcctgtgttagtttgctgagaatgatggtttccagcttcatccatgtccctgcaaaagacatgaactcatccttttatatggccacatagtattccacggtgaatatgtaccacattttctttatccagtctatcactgatgggcatttgggttggttccaagtctttgctattataaacagtgccagaataaacatatgtttgcatgtgtctttatagtagattgatttataatcccttgagtacatacccagtaatgggattgctggttcaaatggtatttctggttctaaatccttgaggaatggccacactgtcttccacaatggttgaactaatttacacgcccaccaaaaatgtaaacgcactccaatttctccacatcctctccagcatctgttgcttcccttttttttatgttttcattcattcaacaaacattagactattaggatggccatataattcatcattaacaatgggcacttttgaaaataaaagtgagcactactaatgggtacactacgaagaagggaggtaaacaccaggactcttctggaaacctaattcatatggtcaccctaagtaatatgcactggaaatcaaggaataaacaaaagcagcctttgccctaagagtctgatttaaaaaataggtaaaaacagtcaaagaaagtaatgcagtgttgtaaagggtaaaacaggtatgtgtaggtagttatgggaatttgaaagaagggcacttaaaccagtcttgggggcttaaagaacacttaaaaaaggaagtgatctgtgcactgaaacttaaacgctgaagtatcctggtaggtaaatagtaaaaagcatctgaagcagcagaaagagtctttaaaaagtgtgtcatattcagggaattgtaactatttggggaggagcatataggttcatatgagtaagtagaaggaaaggagcttggagaagtccaaagaggttgaacctggggtcttgatgcttttactaaagggattgtacttaatcctgggggctaaaggaggattttgaagcagggaagcaacatgatcaaaatctatattaaaaagttcccacttccgtcattacagcacacaaggccctcactctggtgagccgtcctgctataatacgtcaatggttttaatacattctaaccatcatccttttaatgaatctcagccatgtaagaatatgagaaaaataagcaagaccaaaccaaatgacacacaaaatcctatcaactaaaaccagaaaagtgggctgtagcaaaatgaaagccagcatgcccagaggaaaaatagttctttcaggtctgagatcagaaaatttgagaatctaaagttaagcaagactctcaaaagggaccaaagtggctcaaactcagaagagtcttttggctccaatcaaaaaccaagtctaatcttctctggaagaaaacgtctccatattgaccctgaaaattcccactatttaagtccagcaaaaatatgagaccaccatcaaggagataggatgaaacagactactatgagtgacaaagtgtagaaacaacagatgtagacttacaaggactttagatattaagattatcagacacataatttaaaatagccatgagtaatatttaaataaataatgaagaaaatatttaaaaatatcaacaaatccactacccaagaaggcgattgtaaacagacctctttgactcattgatagatgatgtaggtacaaatttagtaaaggtatagaaaatttgaaaaatgtaaacaattaataaacttacctaatgaatataattataaacttgcatccaataattacagaacacacatttttcttaggcaaacaaaaaacattgacaaaatattcaccacattctagattaaaatgaatttcagagaatagttaccataaaaagttttctagatattattaaatcagaaattaataacacaagaaagaattcttagggaaatttaaaaaaattttaaataacctggctcaaacaaataaatatttgtaaataggtgggttggaatgttaatttaaaatactgcatatcatatattatataataccaaagcacctaaaatatattgaaataaatgtataaatgtattgtaatttaaattgttaattaaaagaaaatggcagaagtcaatgttacatccctctgaaacatttatgttaaagcaggttaaagccccaaaagtagagttaataataataccagaataataaaattaaaacaaaaatagtaagaataaaagaagaaagaaaaaaagagaaaatgacaacactagggatacaaagttgcttgaactagcacaccccaatcaatataatcacattaacacaataggggagaaaaatcatgatcatctcaacaaatatagaaggaaaaaagatactattcattatcaacaataacaacaacaaaaatgaagagaactgataaaaaaattctcgaaagtttttcaaaattaatgctttttttaaatgtaaaatatttaaggaagaaattataaaattgtattgaaagacattaaagatctaaataaatgcaaaaatagtctatatttataaatagaaaaattcagtatcataagaaatcaatcttcccaaattaacttataggttcaaagaaattccaaaaataaccccaataagaattttcacaagtttccaagttcatctaaaatgcacatgaaagaataaaacctaaacaaagacacacctgaagaaaaataaaatggaagaatttgatctagtagacccattttaataataatttaaatttttagttaatgtagtaatttattataaagaatttttaattaatatagtattgatttggcacagagataaacaagatgaccatgaaacagaatacagaacatagaaacaggctcacatagtatagaaatatgatataggacaaagtgagcattgcagataagtaaggggagaagaaagaagtgttattcaacacatgttgctatgagaaatatttagttatttggaaaataagaatacaaaataatcaacaccagactcattaaatacttaaatataaaaattttacagttttatatctttatgatcttgggataggaaaatattgcttaaataagacagaaaatgtgtcaactataaagaaagaataattttgatcatattaaaatgaataacttaatctacaaagtgggagaagacatctatgatgaatagtggatagtatccagaagatataaagaactcttaaaaatcaataagaaaaagataatacaatataggtgtaagcacacagcaataaaccattattttacagaagcagacacatgaatgctgaataaagatatttttaaaacctcaatagtattcctcattctgaaaatataaagaaagaactcaacgatatttttgtacttcataagtctgataaaattttgtgttgatgatgtgaacaatgcaaactcttaaacgcttctagtaggcagatgaatcggcacaactactttagaaaacaatttgacatgatcttgtcaagttgaataggtgaaaaccatatgacttagtaatttcaatcctaaggaaacttgtgtactgataccaataaaattgtgcaaaaataaatgttgctgcattgtttgcagtagcaaaaattggacagaatcaaagtatctgttagcaagagcatggaaaaatgaataaatattatcccagaaatattgcacagagtagaaacgaacaatatactactacatgcaacaatggggatgacttttaaaagcattaataaatgagaaaagcaaattgcagaaggtgaaagcacataaatagaattagggaatgggaaaaggtaccctcaaaggtaacagcattattctaattcttaacttggaggaggggcttatggtgttggttttattattatactatatcatttccactcatatattttagttattaaatataacagagtaaaaactatggaagtttctttataaaaaaattcaatgtagaaaaattactctggctactgtgagaagaatgaactggagtagaggaagtctggaagctgggggttaattaggagattattttcatgctgaagattatggtgtttttaaaaagataagcactagctgtgagtatggagaaggaatagatggatttcctcaatgagtgggatcaccatattatagattcatgttttggcctgaaaaataaatgagcctcccatgtacgcctcatttgttcactcgctaattgaataaaatatttataggaagtcagaattaatttaggcacatagagaaacttgctaagaggtcaccaataagattttggagagaaataaatgtacaagctatttggaagagaactaaaagcaggggctgctggctgactcactaattggttggtcagttcctactaatgggtatttgcaattacctgggcaaagcatccaagtgggctgctggggattttaagatcagcatcagtagtaactgtgtcataggaatagcgcaagggtaagagtgtgtggctgtaagatgcttgggggaagggtggcaggagggatttatttgctcagaacaccgccaagctgaaaattgtcagcacattgggctggaaaacaattctacctacccaggacaaagcacaggtaacctataaatagaaagttgcttgttgaaattgtacattagtagtacaacattttgaagctgttactggactccttaagggtcagtaagtaagtaaaaagttgcggaccgcactttcccactttacacatcaaagggggcattgtttgatataattttgacttaatagtttgtccacagagaatgggctgctttgtatttagattttgctacaaaagcaatctttgggaaacctagcatgattaagggaatagaaagtgtcttcctttgtgtcagagaaaaaaatatttatattttggaagtacctttatcctgaataacttttttcctcataactatcagagataaattggtatacttccagttcaccaccagaaagagtctttcttgataggagcatatgactgtatagaatgctatacaacatgctctgacagcagcagagatttactgatattgggtattacgagtgtaatcagaccaactacaaacattcttggatatgaaatccaaaagtcagattccttcataagagtctgatcccacagtggactgaaaacttcatacatcagtcctgcttactgaatagtatcaactttagcacacactgattttgagaatcaatgggaccagcaacacgtgttaggtgtttcacagaagtggaggggagaacattgccagggagacttcatagcaaaggtgactatttagcttgtgattgaaggatgagagcattctatgtgggttggaactaatattccatgcagaagaaatggcataaagaaaacattagacatggtcaaagaatgaggaaaaatttactatggctatagcttagaattgaaggatcaaaatggtagatcaagacctaaacatggaaagctttgaatgccatgtatgttctagctctgttttgccggagatggaggatatcgaccactgtgatacttcctcaaagctctttcaaatctatgctggagatttgagagataaaccaatctctggaaattttatcattgtgctatcccttacatcaacttcctcctttttagtttcatagcctccaatctagtgcaggcccttattaactctagcctcttaactttgcattcagtctctctgctttccagtggatcctatcagttgtttgaagagtactatcccaaacaccacccttttgattatgctgctcttctgtttatcattacatgactccctactgatgactggatatatcccaactattaataacttcatcctgagttttcctacctacatgtatttacttatgccattccctccaccatgtggaggataatcaacgtaatgaccccaccttttttcaagagggaaacggcagaccttctgatctccccgacacaaacttgctccctccctatcaaaattctactcattaaactccactcaaggaaaattctttccatgaaaccttcccagacctttccagctatgtaaaataataatcagtgcttatgtagcactttctagcttgtataacactttatagcttatggatcacttatatcattgaaagtatggcagagaaatattattataatattatcacagttttacagatgaaggaatgattagagaggttcagtgacttagtgttaattatggatcttcttactccagatctcatggtctaaactctgtacatcattcttctgcatttgaatttttgagaaatattaactacacacattttaatagttactacctcaattacttgtttttaatacaatgcatacacatagtatttaataaacaaatgcaatgttaatgtacccaattcaaatgattccaatctaaaatagacactggcttcttccctaccaccatagtatacatacgtccttcccaccacaatgagaatattttttctcttcatgtgttacacaattacctcagtattgcaacaactattatactgtaattcatttattatcctaatattcttctctgctaggtcctaaagtagtccagtgattgcagtacatttatttttgtatcttcaatgccttactaagtgctcacacataatatgtactcagggattatttactgagatgcttactagaataatgaaccataacagaaaatctttgaataatgtaggatatggtcagacatccatgtgttggattcttcaacttgagtaaagatagggggaagaaatcgggaggtgacatctaggttctaaaaactttcctgttttgttttgtttttgttttttcaaagaacttgagaaacttcagcagtgtattttcctgtttttcttttataccatgcctatttctacagaggatctgaggcattagtaccatcataatacctaatgttattactcccacgatcactaacgccaccactatatttacaagtaattctaaaatgggataataacactttatttcaataactaaattgatacatataaaactttaacacactaaaaccttgtaaacatcttacaattgattgctgtcatgattatttatattatttttattatcactattagaacaatggtcagaatgactactgtagttataactcctactaggagttctcatacattaagcatttattgctcaggtactgtatgaggtctatcaaatcattattattaaccttaataaaatcctccaagagcttcactatcattcccatttaatagagacagaaactagggactaaagatttactcatcaagctcttccccatgacattcctccttttattggtcctcagcattttcagtgaacatcacaggtcaaatagtgcaagcactccccactttaacccacaccactccctcatcttaagactagcatgataaaattatcaaataatacagttgactctcttctgagagttacctctcagaagagagtcaaccttttttttttttttttttgagacggagtctcgctctgtcgcccaggctggagtgcagtggcgggatctcagctcactgcaagctccgcctcccgggttcacgccattctcctgcctcagcctcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggcccgagagtcaaccttttattcaagtcaaaagtccttaaaaatttgaagaatgaaacatctaaaatttcacattactccccctgaagccaatgcatgttcctaggacactattcatcacagatgactctttaccacagactacctgttactggcaactgcactagaaactggaaaccataattgggctggattaccaagtggccgctccatttctcctgaacaagctgcttccgcattacttatgactagttcccatcaagactgggataattatgttatttctctactcaaggttactctatatgtgtcacctagaaatcaaatcaagtctgaagtttcttctgggagcatctgcttgtaacttccaggtactctgagaacacaatcttatgatccatgaaatagattccctaactaaaagccagacctcatttctgttggaggaaaatgataaaaatattgaaacttcagatggaaacaaagttggcctgcattacccttattcaagatccaagtgacagacacttccctaaaaatatcggtatgatgaaaatttgaagtctgaggttatctgaaattttgactatttttttgattcatgaaccttgtatctttctcatgatgggccagactatagtttaacatgtgaaagaaaatcatgttatttggaaacactagtcatttagattataagagaataaccacaagtgcagtcttctaatcatatcaatattttctcttttctcttaaattttaaatgtgaaatttagtgggatccttaggtcaggaattaacaattaggtgccaagcatagaatgtatttttctttgtctttgtcaccattgtctttatcatttttatcataataattatgatagtaactgctattgcttattgaggaccgactcttttgagactagttcgggtgattcagatctattatcttttattatgaaaacaatatgaggcaggcgtgttgcccctgcattaaataatatggtcctctttcaacagtactaggagatcttaaaagaacatatgtataacttatcagtggtttctaaatttacattaggtggagtaagaagcacaccattttctgtgaggagcccttatctctggtacccctggcaacaaggtcctgagcatgattcctctttacttcaagacacaacactcctaactcttgaaagctggggtgggagggaagccatgggtagcttgcacaggaagtgggaaggtctatgtatctggaatcctcctccacatcattgattcatctagcaaatgtgcacattgggaagcatgtgggacttagggaggaaagttggtggagccagtcactgcccatgactcagaggtctgaaggtggcagagcttcttgatatgtgaggctaaaatatattttggcctgaaactcagagggaaaaaaagaaagaaaagatccagtccttattaattaaaatgaaaaaggcactgcttataaaatcagcaacaaggctgaaggtagggaaacacaaagttagctctgcactagcagggaagagctatgcaagaggaacatgtacaggagcagcaagacccaactacggcccaaggttttctaagcagtgctctagaagcattttctcctccacacctgctatatttatatgctctttttggaagccaagtggctcatcaattacatattttattttattttattttattttattttattttatttttgagatggagtctcactctgtcacccaggctggagtgcagaggcacaatctcagctcactgcaacctctgcctcccaggttcaagtgattctcctgccccagtctccctagtagctgggattacagatgcccgccaccacgcccgctaattttcgtatttttggtagagacagggttttgccatgttggccaggctggtcttgaagtcctgacatcaggtcatctgcctgcctcagcctcctaaagtgctgggattacagcataagccaccactcccggcccaattacacattcaaaatatccgaacacagtatattagcaacctaacattggcaatgtcagagacattcactttaaacacaagcctatgcacaatcacttattcaacattctcagttgttatttatatattttgtatcctatatcatttgctgttagtaaattgaacgtaaggtttcttgaacccacaaaatacagaaaaatctctaatttccaattccatttctgaactcttacagaatttacacatatactacaaaaattaaattagtacctaattgtaaaaccccatattattctgttactataaacgaacaaattttgtagcattctcccccagagtactgcagcggaaatttcagcaaaggcttgtacccaaaagtagaagcacaggctgtggagaaagataaacctgagtttgaatcttgtctctcaacagacattagctatgtaactgtattaggctattcttgcattgccataaatacctgagactgggtaatttataaagaaaagaagtttaattggcttaaagttcttcaggctgcaaaagccagcatttgctcagcttctggggagtcctcagggagcttttactcatggcagaatgtgaaacaggagcaggtacttcacatggtgaaaataacagcaagagaaagcggtgggaggaggtgccacagactcaaacaaccagatctcatgagaactcactcactatctcaagggcagcaccaagccatgagaatgcaacaccatgacccaaccacctcccacaggccccacctccaacataggggattacaattcaacatgagttttgtcagggacatatatgatccaaactctatcagtgacaatggtaaattactagacctcccaaaagttcaaatgtctcttctgaaaaatgactatatatatatgtacacacatatatacacacatatatatatatatatacacacatatagatatatatatacccccgaggaggttattgtgactattaattagcatagcacctgtaaaacacttaacacagcacctggcacagattaggagcccaatattccttctttctctctatcctcctcctttaaaatctattattcaacattgccaaggaactattctctggttagtccaagctctacatttgttgagcacctactatatgtcaagcactacactgcatactggcaatgcaaaaatcaaaaggtttacaatctctgcccttgagatatttgatgtttgtgtaaattgattgtatgttccttaatcaaatagctatattccaaattatcctagaatatttcttgttctttacataccaatcttgactctaccacgcacttttattataagaactacatagtttcctgaatttgatgcatttttgcttatcttcacatctttgcacatgttacgtcttctgctcagaaatgacctccacctggatatacttcaagtctttctcagaagctttcttgaaacttgcatgaattttgaagagcctctctactttcatgacaatctatgtgattttttgtctcagaagtcacttggtgggttggagacaaagatgtcagttttatgtttaacttctttataaaacagaaaccaacctgagggcaaggatttttaaattattcatctttgtgtttctatgcttagcaaagtgttcaatgaatagttggtgatcaataattgtaaaatgcataattgagtgaaatgatgaatagtctggctgtgaccgagattgaaaaagagaacagatgaccagtattctccagcacactaagcaggttttgtcagttcatttgtctagaacagcccccatagctttctgcacacggccaggtctctctgacaagaacatttggtttccaaattacatattgcacagcatgaatccttcctttcctgcaactgcctgttaattatagtgccacttttgctctgtctttgtctcaatctcctaatctctgagatataatagctgatttacttaggattttctgagctttataaacaaattctgcaacccctccccacatacatcttcttgtaaaaacaacaaagaaaacaagaaacgtctgttcagagttcaaaagtaaagggaaatataagatcaatacaaaattatttgagactgaaaaaatactcccctttgttcctttttttgttgtttttattcacatgtaattgtaaaaaccaacctgctttagagagtagctgtggaaatgctggggagctgtcactggagattagcagcatctccaagctcttgaagctgacagctcctagaagccaactgagagattcagctgaagagttcatttgatcacaccggcagaaatgcctaggaaatgtttctgctcttcatgtgaaaactttgaagagttcaagttcttccttaggttataatatttagcaagtattctaacaatccctctgtcattctctattttttcagaagagatacctggcccatcttattcatttgtgtccccagtacctaacagaacttgacaaattaagtgttcacatacatactcaaaagctcaggcaaggggatatgactgagaaagggaagaaggaaaaggcagacgaacggagagagggagagaaagttacagagatagctgtgaaaggggagaaaaggaaaagtggaggaaaagagggaggaaagaagaacaagagaaagggaaaatggagaataagttcctctacttttttctcataatttttacaagagacagcatcttaaaataaatataaaacacctccaaaatattcatagttactgtgagagcaaagcccctctccaggcagttgttgactcttagagccactgaggtacaatagagacacattccagatgtatcatgtttgctttacctgcctcttgccttggtctacctaagaaggatttcaggctcaagtaatgagtgatattcttcaaccctttcccttactgacccatcaagaaatccttaacgccacccaagaccatcatctatttagcctcagcagatccagtggtttcctaatagcctctagggtaggggaaagactgcaggagcctatgtctgagtaaataactcagaaggggcaacagaatcttgtagaaaccatttgggacatttctccacccctgttttcatcctgaggttaggtttggggtagctcttttttgctactatgactcctcctttgatctaattttcaatccaactctcttttgctttagaatttgctgtgctcttaactgcaagtccttcattttctcaacatttttaaacatcatgagaatttaaatgtaatttgttatgtgacaaaaacagtaactcttgattgtaggaacttaactataaaaaatttaaaaataaatgcatgatcttatctattaaatagagccactgatagtatgttagtctttaatgtgcattgacacatatatttgttgtcttaagaataagatgatactgtacatagtttctaatctgctttttctatctgaataacacattataacaattttctttcattaaaaattcacctcaatattattctgatggcataactctttatgttccagcaattccttgtaaggaaacagggagtgaagaaagctctggaactctagcagtcagcctcactgttcacttcagcctgcactcactgttcctgtttttcctagcatagcatagcagccagtcagaagtatcacctgagcatttgtttggtttgtctgtttcaggaaatatgacgccaattctatgaacttggtctgggtgattcttaaatgcatttctctctctctctctctctctctctctctctctctctctcacacacacacacacacacacacacacacacacacacacagaaaccacgttttgtttctactgtgagccatccccacagagtatcagtgtagaaaaatgctgttgaatggtaaacaaggctaccaaaagtaatggcagggagtacattgcaaataattcactagattatgtgtgctccttatggagcagagactctatcttttccatttttatttctctcaggcttagaccagtaattagcccataaaaaaaaatctaatccattaagaaatgtttatctaatgaatgaatgaataactgagagaatggacataaaccataattaagaagactggtcataagataataaaattttctgaccctatcacattattttgggaaaaatgaactgtgctatagagaaaatgatttaagatttagacaagaaaattcatcttaaaacacacaatagcaatacaatgtcactaaatcctctgttttctgtcaaattgtcacaacaataaagtgtccttatagagatgttgcagtgatcaaatgagatgacagtgtagggaaccagggaaacttggaacttcaaaatgtcctaggatctcagcaccaagacgatattacaataggccatacttcactaccactcccctgcccaatacatacacataaaaagacaacagtaacaatacaacaaaataaatatcttcactgaaaagaaagttttaaaatgggtggcaaggaatacgggtaccagctggtgctatttcaggtaacatgaaatagtagaaaaaatgatggatttaggagacagacctaggcacaaattttggttctgcctcttcttagctgtataactttggacaagttgtttaacttctctggcatagttttttctttggtaaaatttttataacaactgatgcttcctgggattattatgagaactaaataaaaggatgagaagtccctaacataatatatattcaataaatgtcatttcacttgcttttcctcactgccacaccccaggctttgcctgaaccagtgagaggaagatgttatttatactaaacagttttgcctaaggccttgcccaccatcagacctgaataccaaactgccaaatggaagtttgctgtgttgaaatacttataccagacttcaaacatagaactcagaggttattctatcaaaagcttagcacttgtcaacaagaacagcagagactccagaactcttttcagtcttgctttttttttttccaagacagaagcagacaaatcctcattgatcattctaccgaggtagctccaaccctccaaaataatatatttaaaatcacaggttattttatcatgtttgaagaaaaaaaaattactggaaataagaatctttattgactcttttagttttaaggtcagttgacccagaaaaagaagagtgctccgtttgagagtagagtgaaactctgactgaaaaggaagaggcacactgcaacatgtaaatttgatcccattttacaaatggagctaaaaggagcatttaccatagtaagctgacagcctttagtaaagtcaggtttaagtttgaagagttccaacttccactaagtgaatcatgtctagcagtggagacagatgattcaagcaaatttcagaccattcttctaatacgcttaagccatccctgaaggtaaatgttaaaactatttaatacctgaagcttcagaatttgtggcttgggctttgcccttagactttttggttgctactggaaataagattatattttaaagtttcttctatcagaaaaagcaacactccagaatttttacatcctttagttttactgcacgcaagctcctgtctttgggtaataagggtctttcctattcacaataaaaggacacattaaatgtataccttcttcataagtcagtagctatgaatgactttgagcaattccatagcttttctttcttgagtaaactcctcagcatcaaataggactctgctcctgagatgaaaagaagaaagactggctacccagaataattcaaataaaatgatgtttatgatccatgtatattaatgtagccatttagagaaagtcagggctatttataatcattctggactttctccaatcaattatttccctgtttgaaactctttggttgctcttatttttagaacaaagttcagacttctcagcatattatacaaagcttttcttgatctggtcctttcctacctttcccaacaaaatctgaaactctcactttttttcctggacatttcatttcagccacacttaactaccagccattaccatgacttctctgtgcttttttctaacctgtttcctcttactgtgatatgcctcctcttctcacccaccccctacctactgcaacacaggtttctggggcctaaatatatcctactcattcattgagaatcaactcgtgcaccacttactccaagaaacatttcttgactgcctcctcttcccctatccctggatgataggaatctgtcctctggtctcccacaacattgtttatttttatcacagcatttctcaccgtgtattatgactatttaaaaaaaaaaaaagttccttgaaggtaggctctgtgtctcattcttcattatatattgatacagagcctgtcacacggtagttgctcaatacactgtcattgttattgatgaatgcagactatgggccaggcttgtttcctagaaacatacaagttcagggccatccttatgatgcagggactgaaccaatcacacacactggcctgctctcgttgttgggttcttagtaaaatttggactgagtgaaataacaaaggcagctgtaacaagaaaatcattataataataagaataagcaagtaatcacgggcaacttcctgcctcactgcaataactggaacaggataatggggagaccagaattattggcacatttagccatattctttaaagaaaaaaagcatacatacatacatacatactaccaaaaatgctctgtacagctgctctatttgcacttgaggcatctgcagcttgggcattaaaacatatgtgaagagtatgtcaggcgatttgggttgagaaatctggatttgagatctttgtttctaaccatctgtattgtcttcaatcagccccttcatctccctgattctcagtcttttcctcttacgtgatctttgatctcctttttagttcaaaagtctcattcattttgacattctgagttggtagagcccctgacacacataaagtattcaaaaatacataacaaatagtaaaattaagtttagcctaaactgtctacttatttaagttcatgctaaagatttcttcatttatagtggactgtaacttaactggatgtgtaaacagactacaacctactctttatcaaccagtttcagccagtcacaggcggacaactattcaaactgtgttcaaataaggcaaatgccaagctgtaaacaatccagctgtttctgcaccttactttcattttctgtatgtcaccttcatttttctgtccataaatctctaactatagagctacccagagtctctctgaacctattctggttcgagggactgtttgatttatgaattgttctttgctcaattaaactttgttaaatttaatttatccaaagttatccttctgactaaatgaatgaataaatgtcactctccttccctgtctgcttttggggttttgcagaatgagccacagtaacaaacttgaaggaggctgtgtcctacaagcattaagagcttcagcagctcccactttcctctcaatctgcttcaacaagccttttaaaaaagtagcactggagcacaaagtgggaaataccggacatcctcaaggtcaacaaggaaatggagaggcaatagatgaagactacagggtcaatccagaagttcctcagaaaagcacaataattcaatccgctggaggagaggatgacaacaggggcctctgcaaagagcaagtgatcctttgaagaaaacaaagcttcagtttcctcaagaagttcttcagagaaaagcaaaacaataacaacaaactttcctttagctcttcccaggcagcgggaatttcagacagaagatcagcatatttgccctcaaaagccacagcttgggtgtgcccatgtgaccagctccactgggcatctgttggcaggaagtccaatgctgcctttctgataaaggcttgatggacagcccttctatattccttacccacccttccttggggccaatactgatgcccattaccactcttggcttttaacctaaaagcccaatgtctactgtggtcttaatttattgcccagtagatgctttaaaaggaacgtgaaaaatatacaggcgtgcacggaaagctaaagcatttagaactttgagcatcttccttgtaataaatacctaatacatatgtgttaaatagtttatttgaactataaaaatacaagtataattattattatttaatacttgtatatatattttctttccattcagctatgcatttctctcattattttgtttaggaccttaactatgaagatagtaacaaatacaaaaaacaaagcacctatatttctaggcactatactaagccttcatacacattatttcacttaattccctcaaggactctgtcatcttcctcattttacagatgaggaaagtaaagctgagagaagttaagaaacctcctcccaccaagatcacatactaagaaagtggtatggccaggatttgaagtccacctctaacatctgtgctcttagccacaacaccatactgccaaattcttcttcatacattcttcacacaaaaatgtgtaccatgacatttaacaataaacagtttaatcgttaattaaaggataaatgagaaacagtgaaaagccaaggacaaaatgtagaacttggtagtttaccatggtttgagaaaaccaatgagacattgtttgggaggaaccatgttggtgtttctgactaagttagggtgcatgtataaatttccctttcttccctttgctaatctggacaatgcagattaagtttttcttttgcttacagaatatgagtgaaacaaatgtatagtcacagaagtatgtatatgcacatgtgtgtgtgtaaaaatcaaagtttgaaatatatcttctgagccttcagagattcatttggccgagaaatagccacagtcctccctaaaattctaatgcctaggatttatatgctatttacacagattaagaagtattgaaaagtagtataactgtgacattgaagttaaggagactaggattcaaattttgattctgctacctaccagctgtgcctccttggccaagttattcaactactagtggtctgggtttccatttctgtgagttgtggagagtaaaatctaccttgcaggattattatgatgtttggagatagtttttgtaaaattcttactgtcattttgggtacaaaacagacacataaaaatgacggtttttattatgctaggcagaggaaacatcattttcctattctggaatgcacacctgacaaacttctactcattatgtaagtcttaattcaaatgttatatttatttattctattaacatttcttaagaaactaatataatgctctttgctattataaggtacttggagaaaaaagttataaacttaagatctctgatctcaagggatgcacatttttttttttttttagagggcgttttgctcttgtcatccagactggagtgcagtggcacgattttggcacaccacaacctcccactccaaggttcaagcaattctcctgcttcaacctcctgagtagctgggattacaggtgcccaccaccacacctgctaatttttttttttttccgttttagtagagacgggtcttcgccatgttggccaggctggtcttgaactcctgacctcagatgatctgcccatgtcggcctcccagagtgctgggattataggtgtgagccactgtgcccggctgggatgtcctctttaatggacaggttaacagaccattatgtgaagtgtggtaagtgtccaaagaaagcgatgtccagtgggctttgcaggccagaggacaggctacaaggagagtcagataaggccacctcgagaagtttacaaagagtttcccttacaaagattatagcaatgattatgaaaagtttcccaacagccccaggctgtgatcactcttttctgtgaacccaccacacgatgtgtatctctatcacagcattgtttatattgaactgaatgtttaattacctagctctgctgctagacagtgaacaacttgaaagcagtggtcatgactttgactaagatgaattttcagcatcccccataggttctaacctagagaagcagcctgataaatgcctgaaagaactgaattgaattgtcatggacctctgaaaaggcaggtggttaagtagcaggacaaactataacccaaaactgcagctgcttgggatctaagggagacaagagagggagaaagattacttcatttgttcttgtctggggaagttcagattcagagcaaagcaatgccaaaggcaaaagtgccaggcactactctctagacatcgcagctcattttgttttgtggtctgtgattgaactctggtttagatctgatgtctatggcctgagatggctcttagtgtggagcttttggtttacagtgcgatgcagtctcttcaaaacatgacaccctggccaagtaagaggtaaaatctgattcttacaagattttctagcagaactcttaagtttttgtgaggcttaaaaaaagttaaacatttacaacatgccaatatgaagctcatttagcctctgctaatgacttcagtggctttcttaactatgttactttctgtctggtttctctaccttatgtttgccttagagagctggaatgaaaacgtgtttgcttgtttggctgatttcatctttgatttagcagttccaacctctactttcattttgatccaatattagatgtgttgttcaattcattgtcttgaaatcttgccagattgcaaataagcaatttcaacaagagtaataaaaatggacagaatataaggaagaacatcaattgtaatccttgcttaacctcctgcatggtccaaatgtgtccttggcaccaaatggaaggtgaagaggaaatataaatagataatttaactttcattaaaattcagtaataataccacagacaagatgggaaagagaaatgatatcagcatttagtgtgggtttactatgtgccaagcactgtcctatgttatctcatttacatcccatggcaacctaacaaaataggtgacagtcccatttttggaagggaagaagttaagaccaaaagaagttaagatgaataatcatttaagattaaaagcaacaaaatgatgaagctataatgtgaacttctttgtctgtctggctttaatgtacatactttatccattataaggttaaatgagtgttattttttgaaattgctcaactagccatactttttgtttcattataaatttaataatagaaccatagtatgaagtagaaggaacagaggaaatcaaatattccagagactccataactcaccatgggacttaacacagaactctgtattatcttcagaaattattagtttgatttcatatttgtgtgtgtgtgtatgtgtgtgtgttcagcaaattagagtgttggtcaacatgccgttgatactgcattcatagaattccagtgtaacaattcataccttcattagcttgttggctatcatcaccagcatatttacattgaaacactgaatataattcaagaacctctattggcacttctgggatacccaatctgaggaccactgataaaatctgagagcactcagtgtaatttcacatcacgtctgcatgaaaatactcaacttaggtctttagctctctttaacttttaaatttagttattttatcaagtatgttatgagttccttctcatttatttaagtttcctcattcagtaaaccaatattatgataataggatcccagactctagcatttggaaagagttgcttatttttgacattttggtctaatataatctgagtgttattttttgaaattgttcaactagccatactttttattttattggatgttttatactgaacatatttttcatgttctgaaatggcaatacaactgcagcatattgcagatatctgtgtttttttttttttttttgtctgaaagtgaccttttgattattttctttttgtaaaaccaaagaatcattaaggcttctacaaataaagcataaacaaataatagctgttgccatcttataacattgacagttctaatacttattataaaggtttgcttgacctcaagccttgtaaattgtatgaaggaacactagaccatttacttccagggcattggtgaggtcataaggctaattactaagactaaaacccaatgctcctcaacttctcaacttacatctgcctgctacttggtactacctctggagtcctaatttcaaacattattagtggctcttcccaaatgagcaaagacaatcacacatgggccctgggttgctcaatgccaatgctccctcccagggtcatatctgctttctcagttccctctcttcttgatatatccaattccttcctatgctcagtgtacctcccactctcaggctgctcagcacacctgtctgagtaggcttcctcatccctccagactgacaatagaatttcctcatcatccccattctattaatttcctgaagataataagcctatgaactatttcaattctaaaatttttgcttcactctttgccacatctatggcaagaatgaagactattctcagcaatcagactgtcggcactccagaaaatgtcaacgttactctgaagggacacacagttattgtgaagggccccagaggaaccctgtgaagggacttctgtcatatcaatgtagaactcagtctccttggaaagaaaaagaggctccggttgacaaatggagaaacagaaaagacctggctactgtctgtactctttgtagtcatgcacagaacatgatcaagggtgttaacagtgggcttccattacaagacgaggtctgcacatgctcacttccctatcaatgtcgttatctaggagaatgggtctcttgttgacatccgaaatttcttggatgaaaaataaatcctcagggtttggataaggccaaatgttgcttgtttggtatctcaagcccagaacgatgaattaatctttgaaggaaacaacattgagcttatttcaaattcagctgctttgattcagcaagccacaacagttaaaaacaaagatatcagaaaacttttggatggtatctatgtgtctgaaaaaggaacagttctgcaggatgatgaataaggtctaagagttgcccagctacagaaacaagatgctggatgattcctaagacctatttgtgatatataaacaatacaataaaagacctattgatggccaggcatggtagctcacacctggaatcaaagcactttgggaggccaaggcgtgacgatcatgaggtcaggagttcaagaccagcctgaccaacgtggtgaaaccccatctctactaaaaatgcaaaaattagccaagcgtggtggtgcacgcatgtaattccagctactcaggaggctgaggcaggagaattgcttgaacccaggaggtggaggttgcagtgagctgcgatcaggccactgcactccagcctgggtgacagagtaagactctgtctcaaaacaaacaaacaaaaaaaaaaaacaaaaaaaaaacaactattgatttggaaaatttttttacatttaaaaaataaacaaaatttttacttctgatcacttttccctctggggaaactgatctggggaaccaggtgttagagtcacacacagtccatggtctcttttccttaacactgttaacagtacagtagttaagagaacagaccttgaatccatgctttctgaattttaatcccagcttctgccacacagctgcatatccttcagcaaattattcaaactctctctgtctcagcttcactatatataaagtgaagataacaataatacctcttttaaaagggttatgttgaagatgacataagttaattcacataaagtctttaggaaattgcctaacccatagtaagcgctcaataaatgttagctattattagctactattgacttccttcagagatgtccttctcagttgcccttcactttgatttccggagatgggcttctcaaagattccccttccttctgaatccatccttaaaacaagctcaaagcctaatgatgagaaaaactgcatgtttccgggagagtcagcaactctggggtgctccaaacctggtgtttttctgtatagtagcctggatttgacctatctctccctatatgcttcgcttcagtgaggcagcgtagtttaagtggctccaaggccagactacccagttaaaaactctggctcaattctactttcaagcttggattaccttgggcaagagcttaatcttgctgtgcataataacagtacctaactcatcagattatgaagattatatattagttcaatatttgtaaaatgcttagaacattacctgcatacaataaattctatacgagtttgttgaataaatgccagttcctattagaggaagtaaaaatgtccatttttgtcaaagaatgaaactgtacatgtgtggatatgttatatatacacacacacacatacacacatccatacgtatatatgtatatatatgtatgcatgtgtgtatgtgtgtgtggatatgttttatatatatatatacacacacacacacatgcatacgtatatatgtatatatacgcacgcgtgtgtgtgtgtgtgtgtatatgtagagtgtgtgtgtgtgtgtatatgtagagtgtgtgtgtgtgtgtgtgtgtgtgtattaaaaaaagacaggttgatttctttataagtttctacaggagcttgaattaccaaaccttactcctaaattaccactaaaatttcctcaatgactttcaaacttagagtaaccaattcatccaagtaacacagcaaagtcctgaaaaataatacttatagtaaactaaagccaactcctgcagctttgtatatacaaagcttttcctacctaaattgcataggaataaatttgtatggagtataaatcaaatccagatacatattttgctataatgagaaattttaaagtgacggaaagagatacactttaaatttctgcaatcactcatagatcaaagaaattttaaatcaaatagctcctatgtaccaagcaccatatgaagttctgggtatataatgggaaacaataagagtgcctgccttcctgttgcttacaatcaaggtgacaaggagataggaattaagtaagatagaatccaccataaatgaagcagaagagaagacatgtacctgcctgctgtgctacctgtaaaccacagctagaggttccccactctacatggacagttttacctcctagctggaatgaagtagagagggagactaagtgctttcctttttcaatataatgtgcattgaacagtcaaggtgcccaattttgtagtagccctgagaaatgacacaaagaaaagacaaagtcttttatttttctatcaagaaaccccagagagcacctgcaaattgatttagctattttaaaagaatcaagaaaaattacctgcataaaaaagagtccttaaaataatgctacagtaattttttccttaccagtattttttttcttctctagtctaagctggtgattaaagagatatctttcattctaaacttaattctactctattcaagctctggccacagttaaatcaatttattttccatcactatgtagacacctgttaatacattttaaggtagatgctctgtgtgtctctgggtatacagtaggcacttttgaggctgtgctagttacttgggttggggggcaggatgcgaggtgattagactgccaaatcagtctgtccaggaaggcctactcaggaattgggcccttttagtgaatttgatgaagatgtaactttctaaaggaaatctctgtggaccagaaacaagtaatgcagtttttgtaacttctttccttagaaacagagagagcagttataaccattacataagcagcttcagagcatgggatgtagaatctgatgacccagctctttatttcccaggtgttaccccagtttcctcacctgcaatactaagggaccacatagatttcctttgcagaaaaatcataatgcaggttagtaaaatcatcctgtacactgtaaaatgttctatataattattattccctcaaatctggaaggatggttctcttaaaataggggaatcttatctcttacaaagcagagatttcacccataacttgagaacaatttagaccactaattgctttgggttttctgtttgttttttaaggccaagacttctctacagaagaataggtgtatagggcttttaacttttctttcactagttggcagaacagcaaaaatgcccctgcagccaatgggcatacaagcctgcttcttataaagcaatgtctgatgtttttgaaatatgacaaggaaaataaccatagaagcaagcaggtgttaaagccctaccatgtgttgaatcattgtgccaggtagtttatatatgttacctctgatccttataatcacccacttaagtatttctatgtcattctcattttactgatgagtaaagaagttcaaacagtcagtatcttgcccagagatacagagctggtaagtggtagatggggaatttaaacccaaacctgcctgtttctaaatgtttattttttgcttccccaatacgtggccgtctatacatgaagatgcagtatattaagaatccagaaatcattcctgagttttcccgggggctgagatgggtcttttcaaaggtccatctatgtattctaagcctatcccactgcttcacatggaatgatcctcaacccaattcagaagaatgagaggctcatatctgtctgagcatctcctagtgtgaaaaatatttcttcacttcctccagcaataagagattatcttatttcgccacctggtaaagtttcctttcaaaagagcatctggaaattatagtgtgcaaggcactatacatacatgtaagatgtcttattggaggccgggcgcggtggctcacacctgtaatcccagcactttaggggacagaggcgggcgagtcactaggtcaggagatcgagaccatcctggctaacacagtgaaaccccgtctctactaaaaatacaaaaaattagccgggcgtggtggcgggcacctgtaatcccagctgcttgggaggctgaggtaggagaatggcatgaactctggaggcgcagcttgcagtgagctgagatcgtgccactgcactccagcctgggcaacagaacgagactccatttcaaaaaaaaaaaaaaaagatgtcttatgggaatgaagtaattttttaagcagaccaagaaaagaaaatggggagtgtgggaaactaataattcctgtatgtagaaaataatgagggttctgtgggtgcctgagcgctgtgtggctgacataggataagtcaaaggcctctccctcatcctctgccattgtttcaagacacacaaattctcttgaatttggaacctgcagtgctaaagaaacacatatctctcatttatagaaaattcatactgcagcacattctcgattatctgtacccctgcagagttgcattaagaaagttaacagcttagcatggaaaatttaccgaagagtttcaaaaccatgaccttaccctacaggcactcctactttcaaaattggataaagaggaagcagtcagggataagagagagggaactggttatgaagggagacaggctttgttcacacccttcatattccaactactagctatgtgctcttgggcaaactattgaacgtctctgaacctcaaattattatcagtaaaatgggcgttataataggtaccttttctaagggttaaataaaatatgtcaagtaactatcaatatctgatatataaaggggcctaaaataaggttagttatttttacccaaagcctgaggagcagattgtagatcacttgtcctgaaagtttgggaaaggttctcatcgaacacaaggataagctattaagtgaccatccataattatctttatttatttatttattttttgagacagagtctcgctctgtcacccaggccagagtgcagtcgcacgatctcggctcactgcaagctccgcctcctgggttcacgccattttcctgcctcagcctcctgagtagctgggactacaggcgcccaccaccatgcccggctaattttttgtatttttagtagagatggggtttcactgtgttagccaggatggtctcgatctcctgacctcgtgatccgccagcctcagcctctcaaagtgctgggattacaggcgtgagccaccgcgccaggcccatagttatatttaataatgtttttgcatagagtggctagcaccacaggtgaatatttcccgtgcttgattttattaattgcacgcactccagtagaacatatttccagtggggcatctccacaactggatggacataggaaacctggttcacaacattcaggctaactcagtgaaaagaactacacaataatttgtcacatttcttccacaatgatgatggtgtgagatatcttcccgaaaacttctgagaagggggccagctctgaaatatctaaagctttgttttggaattttctgtttgtctgtttttagttttccataaaaagcaaagctgtgggctcttaaaaattttcaaggtgggggtgcggctgtattctctagcactggtttgcagtggttaataagtaactatgtggcttcaagtaatctatgcacacagtagatggaagaaaataatccctttcccataaaaaacaggttatttaaattcaaatgaatcagtatggagtacttgacaccacagggtttgaccacctccgtggctgtaaatgaaaagaaggacttttcgaagaatttgaatcaggtacaaaataaaagatgccagttgtttatagaagctggcaattaagaaaatgtatgagggtaaacagaagaaagtaacttcttgacaacttccttggactttaattctttggcatttactttatctttgtcagagccaggcagggggccagcataacttctgcagacttctcatcacccagaagacaggcgcagtatgaattacttggatgtttcagtctgacagaaataaccagaatccaaagcttcataatgtaaaaagaaaaaaaaaactctattctagaaaccaatggcctggaaggtcaactttggttcaaaaaataacaacctcagagcacaagattttacacttaaaaaaaaaaaaggaaaaaaagcaaatattaatataaaggttatagtcagttcctgctgaattatactgtgggtttcacttcattagaatcatcaaacctttactgcatgcacatatgataagcgctgtgctggaccctgaaatgaaaaatgttatccagcggatgtctaatgatgggacatcctctcttcacacattagtagtacaagttataacccaggcatattctctgtcatcaaagggcttaaagtgtatgtctttatatgtgacttgtgtgtgtaggtattgagagagtaagacaggtaaatatgaaacaaacataatacaaatttataaatgctagaagcatttataacatatataatacataatatattatctaaatctattggggataacatatataataaatatttcaggtactaatggcataataagagctatgaaagcacaaagaatgaattaagaaaaacttcatataggaggtacattttaactgcacttagaaaggtacgtacaattatgccagttgaagaaacagtgggagagaaggttttgctcagacatctttgtgtacatatatataaataaaggatgataatgatgccttctctagacctatcgttacaatcatcaccaaattaatatttcttataaaacaactgataattaatattgggccataatgtattcaatgaaatataaacaacaaaggcaagcatgcatcaaatcctaggcacatcagactacgattatctaggtatttcaatagatcagtgcggtagaaatgttttcaaaattaagtttgatgatcaaaattttgtcctgtgtaaattttccaagattaattccattagcctattcactcatttctgcgtttatttaaaacatctttattaaacacctatagatagtcaggtagccattagatcataaattccttgaggatgcattatgtactcattaaatgttcgtagatgacttgcagatgagagctcacatctagtctgtgacacagttggttcagtaacctctgtcatagagatgtgaacagtatttgggggctaaagcggatcctactaggctttctagcatttattacccaaattggtgtgaatgtacagtgaaatgatttccatatgcagaaaatactacatgcacctctttagttgtatgagtattcattaatattaattacatctaccatttactgggcacttaccatgtgatagttatggtgcttagtacttagcatacttcaattcattctcacaataatgccataaagtaggaattattagccccttttacagatgaagaaaatgaggcctagaaaccttaggtaacttacccaaggtaacatagctagtaaaaacaggaactagattatgaacaagatcttactgcctacaaaacctatgctcttatacccaagtcatcttatttggcacttttgattataagcacttgagaatagaggtcatttagaatgctaatgcgtattaatactaaaaaggaacttggagatgcatagaagaagaaacccccttcatagaagaagaaacaggctggttctgataccttgattaccaaaggctgattttaccactagtgcaaagggcacctgcattctagggtgtttgtatcatagttaaatggattcagaatgaatgctagtgcttcccagtctaatacagagatgcaagtagataaaatttgtgcgagaaattgaaatctaaggggaagactgtagcttcttgactttcattttatttcatttttctctattgtatccgttatagtttggatgtttgtctcctccgcatctcatgttgaaatttgatacccaatgttggaggtgggggctggtgggaagtgtttggagcattaggttggatcgctcatgcactgctgggtgccttccttttggtaattagtgagttctcattcttagttcttgctagaactggttattgaaaagagcttggcatacctccctcaacccccgccctgtctcgctcactctggctttctctctctctccttctctctctctctatatatacatgtgtgtgtatatatatatatatctcacacacacagacacacaatgtcaagccctcaccagaagcagatgctcctgtcatgcttcttgtacagcctgcagaaccatgagccaaataaaaatttttttctttataaatcattcagcctcaagtattcccttataacaacacaaagacagtgccacagtgcctcatttctgagtaattatgatttattattttttttctaaagcaacaaaatgaataaaatgtgaatttttacaaatgacatatagggttttcctcgatttctcctccaatgattcaggtataaagcttccaagtacttaagctatataagctttgaattggggccatttttctttgcaggtttgttctttgttttcttcctggatcttgagtactgccatgcactcagaagttccacaaaccttagagctcttgaatatgaccattaaggattctctgatgaaaggaacatacgactaattccctagtaacagtttctttatagagtgtcaccatgtacaaatatcccattttcaaaaaggtggtaatagaccattaaaatgaactatgatactcagcagaaaatatttgtttttatataatgggaccaactcagcatcctacagaataaagccccatgaggtagatattattagtgaaggagaaaggctgtgtaatgaataggatggagagaaactcatgaattaaacaaagaaacccaaaggtttgatttcagtgtgttgatgaattaggtgttaatgcataaagctactcatagtggctatgatttgtgtgttttgtaacatgtttttaaacaggaaaatcaaggtactgcattttcaaaggggaagttatgcaaaaatgtattttctgtaactctttatttgataggtttgctgtctactggaactggcctgcagcaaaatagtgaggtggtcagatcttgtctttggcccattttgtgctttgattcctctgagactgcctgtggcatggccctgaaggcatgctttatgcctgcaatcctggttctaaggaaggattccagggaaaatcacagagccacactaattctacccttccatcaacacatctccaaactcagacctgctcttaaagctgctcagaaatcctagagatgactctaggaagttcccttgtctcatgttccttcagaaactattccaaattccaccaccttctttgagtccataatataatctctctctttcagagagtaaatacaaggtaccaagaaagaaccctttcagcttccagttgatgtgtactctagtagcctctattccaaaactaatgtaccccatgagctgaaaattacatctattcattccatctcctcagaaatatacctctttcctctattttaactttttcctctgaagctgctccaaaagtctgcctacatttgtttaatccattctttacctttcattctttctttctcccactacaattgaactctcctccctcattactccactgaaaccacccatgtggaagtcaccaatgacttcctaattaccaaatgaaaagaaccttctctctctttcgttgtaggtattagagatgtgggagttttggcctgagactagacattttcattactgacttgagactattatggagaaattggacatcttaattactgaattgagatcattatttacagttaaaaggctcaaaaaacttgagccaactggagtagtcatacaaagccaagaatagtgagaaggtaggagaatcttgtttattttgtttacactgatgaagtgacagacacagagggattaagaaatttcccaatatcctatatcaggtaagtagcagatcttgactttgaagtcagagagctatgctccttcttgcttaacctctcattaaattgctattcatagtctcttatgatgttactttttcaataatatgcttcagaggctctcccaataagtatatactgatcacagtatttaagagatgaactatattttattgtgttaatatgctgtaatggattttaccataacagaaaagttataataaactttcctgtatgtgtgtgtgtgtgtgtgtgtgtgtatatatatatatatatatatatatataaaatttttgtgcatttgttgaagtaccgtttgcatggtaaaatttctggaaatggaattgctaagtctcaaggatctgtgctttttaaaaagtgatggatactttcaaaatgccctccagagatgctgtacctttttttttctgaaagcaaacattatcttacttgacctttctgagctatttgactttgttgactccttcattcatcaatctattcattttcatgataccgttaccttccagttgatatctaactctgcctgatctttctccatcttctttagagcatcctctcccttcatctcccctttaaacactgggttttctcaggctcactccttttcttttcatctataagttcttcccaagtgatttcatcatacttattgttccaactataagagttaaactgcactccatatcgtcttagaaaatcttagccttttcctgttgttatgtagtatttttgtacttttggaccaattaattatgttaatgggggagaactcagtgatactcttcatactaagatgttcagatccagatccagaaaacttttcagagttcacaggaagatgctatgtgtcttgagacaaataaaaatagaagctttcaaagccataaagagagcaaaggtcactcctcttctgtctccgggtgaatttcacactgcttgagatggtcacaggttgttggaatccaaaatcaggtgaagccattggtattggaaaacagactatggcttttgaattattatgttgatatgatggcatttgtaactaatgaggcattgggaaatgtgttaatgggaaaagggatttttgtgacttgtataatctatgggaaaatgtaaccttggagactggactagagacatctataactttgcttccataacaccagtaggcaccatgaaaggtgaaaactctgtgatccagttcagcatcaaactttttcatatattctaagaccccaaagagtcatgagtaccaatatacagattttaatgccagtaataatgaagtggtcagaattattggaaggcggaggaggtacattgggagatgaagaatatcactgtaaatatatgaggaaagactagataatatagcaggagagttttagagggaagagaggaaaaaaataggcttgtctggaagaatgatagccagatgattatgaaagaagctataaaacctaagcaagaagcatgaaatatttgaatacatgaagaatgttctgtgttcctggaagagtaaatattgtaaacgtgtcacttctttccaaagtttgtcataactttgatgcaaaactaagttagacatttgtgtgtgtgcctgtttgtgtgtgtgtgtttctttttctcgagttttgtaatagtctaatgagaaataatagtagaggaatggaagatatacaagagttatttaagagatagatttatatcaatgattggttattgattaggtgtatgggctatgggaggaaatttagggtaacgcacacccttctgtcttgagagattggttggatcattgtggcattcactgtcacagaccaaacaggagcaggatcatgtttaaagaagaaggcaatgaaatcagcttttgacatttgaaatcaaactgtttatggaatgtgtaaggaaagatttttttcaatagctttgggataagatctaaagtcaagaagataggtctgggctaagtttattgatttggacattagcatataaaaatagacatgccaagaaaaataaaattaattatcatgtttaatacttactgaataccagggaccaggctcaactgctataggtattatttcatttaaaccttttaactattattgttagacccatcttacagatgagaaaattaaaccttaagttattaagtgacttacccaatgcacagagttagcaagaggaagaacctggatataaatctaggcactccaaatctaaagtcagtgtgtttcacaagatagtgcaggacaatggtgaggtacaatagaatccaatattggaggttttttttttttttttttagatggagtctggctctgttgcccaggctagagtgcagtggcgtgatctcaactcactgcaacctctacctcccgggtccaagtgattcctgcctcagcctcctgagtagctgggattacaggcatgcgtcatcacgcccggataatttttgtatttttagtagagacaggatttcaccatgttggccagactggtctcccactcctgacctcaagtgatcttcctgcctgggcctcccaaagggctggaattacaagcgtgagccactgcaccttgcccaatattagatttttaataattaaagtagatgtgattccagacttgacagatgtagaaagaaattcagagcagtttcaattctaactgaaggctctttcaaaaagatctaacttacattaaactgaaatgattttcctggtaacttccacccaatgcctaccttgaaatccctgcaatcaacagagcaagaccaaagtctccttacatagtcagttatttgaaaccagtaagtaatgagtttccatattcctgcctccagtaatgactcccctgttacctcagcatcgtctatcctttatttaaacatcctcacttcttcagatagtctcttacatggtcaccttgaactgccctcacatgtgccagctcctgtttgagtatttatcttgcactatcatgacagaagcagacacattatgcatcaagagtgatgatcctgctccctaagtgataattccaccagtatatgttcaagtcctcctaacttatgggatattacagcaaatatttccacctgggtctcaggaaaatgtctcctgctcctctcagtgtcaggcattctcttggctctttcatgcaataacaggatggggcatagtgaggaagaggacagaggaattagtagcttattgtctcttctagcctttcttgggagaggcatttggcatctccatcactccagaattctaaggcattcctgcagaaaagatctttagccttaggtacctcatgcaaattcagtgttggttataactcagcttttctgtttgtagatgaccaagtgtataagactgaatgctttcttaatagaatatgaagtggtgtcttataacattaatattacattatatagtactcacaagccacaccatgaacctgaggaccctcttttctgaagatccaaaagctttcttctccattgccaccacaagcaattcacccatggaacttctttgtaacccccatatcctccttgaagtgaagatttttgtgacactcacctcatcccatctctcactgaatcttgaagattatcagatttgtctaatttcttctcacttattataaactctgtgagggcaggggctatggataacttacctttaaatgccctacatcatctaaagcattcataaatgttttcttaaagaattgcagtctaccattgatcactttcctggggggagggactatttttcacctgctaactatgccagtctttgatccctactttcttatctgtaattgggaataaaatagtagcttcttcacaggatcattagtaggatataatcaaataatgaatggtacataataaatcttgcctatagtcaccatttagtaagtcctgtcatttataccatttttccaactgtattaaaggacgtgctgttctgaattgtaatatttattcacttctctctctagctggctggtatgttcaatatcggggcctggatcttacttacttttgaacatggcacaaatgtttgttggatgcaaagctacctcacaccaagcctttgcttcatcacattcattcccttactttagtagtgtgtgctggcatgaagttcagaggcaagagtttgctgacactcctctgctgggaccccgatgtagctctggtttcagcagacttcttaccactctcttcctctccatcttttgtcctcagcagaccacctgtctcattaaagaccagagctttgggaaactcacttttttctatcctgatttatttaaacagaagcctccttgagacaaaaacgtatctaaatgttttatagcatttctgaatttctgtttctcttaattgaagttccatgtgtaatgtgtagataaacattttttccctagaaaaatgaaaatgctgaccagctgtgaatctttgatatatgaaaggctctgatctgccctgtgtattgtacccatcatcaataggtttgcagggcaatttaaccattctatttcctcccgtcccattccaatctcctttcatttcatatttcacaaaaactggaaacataagcagaacattgacctataatccagctactcaatttctacagagcggcaaaagcctcaagagaatgcaaacatactttgactccatatgctttaatgttgagcagcctgcttggggttgtccaatggcacaaataatccttaatctccttcgagccaagagttaaatgtttctcttatcctgagtgatttactagagaacagagcagaaaataaacgtaatgggctacaccatctatttcttaagcaaaaaaaatactaagtcacagagaaaagaaatattcagaagaaagggcccagatctggagagatggagctcaccagaagaaagaacatcaggaatgaaagccagaagatctgggtgtgactcttggctttgtcttgtcattctgtgaccatgagcaattcaaaatctctctaaacctctttatcctcatctgtaaaatgatgaccaaactgtactttgtttttttttgtttgttttttttttttttcatggagtggttgtgagaattaaacatatgtgcaagtgcttgtaaatagcaggaaactatgcaaatgttactcttaatttctatcagggggccttttcatccacccatgcaaatgtttcattagcctgtgctcaagtattctgaatggcattctgccagttcatttccattcactaaaacaatcaacattccagtagaatattgatctgggcctcagagtagaaagcaagactaatttattcatgacttagtaacagagacaaagaaaagatgtgttaccttaggtcaattttcattatgtacaagaaagacaaaggaaccgtacagacaccattaacaacaaacctcacagcacaaaacctctgcatggaaagaaacccagtcctgctagagagaggactgttgtttcacatggcatgcatcgacaggttggaatcatgatgcattcagttccaatttatcatcagtagcaaataaactcttccatgtgtataaccagtccaatctttctgaagtattcagaaatatatccaacatctgttcacttctctgaaaagacatccattcgattcacttgagccatggaaacaaaaatcaccatataaaacataggtctgcttgctaaaaaggctactcagtatattaaaaatgtgaatcagcaaaacaatataatacactgaaattttagaaaaactttatcatacgaagagtatagccaaatgtagtggaagagaaatataagttaaatatagtagcagggaggaaagaaaaatactctgggctagatgtcataaatctaatattctgcaactatgtttgggatcatgaaaagtctcttgactctactctgtcccatttccttaattgtgaaagagtatagttgaatttaaacaatctggaccataatggaaacagagagatcacagttcaaatctccatcctagcactcactaacgaagtcaccttaggaaaaaatctctaaataattagaaccctggtatcttcatctgttaaagggacataagattatctctctcaaaaaattgtaatagggagtggaaaaaaatgcatttaaaatacctggagcacagtaggtatttgaactattttaattctctaccccccaacaagtttatatttctgtttattgtgttaggatcagttcaaactaatagttttgtttgtaataattgctatttattgagcaccaactctgtgccaggtgttatctttatccttaaccttaacaacgattctttaagtagtcattattgtccccatttaccatatgacaaaactgaaggccagaaggattaagaatctttcctaggatcacacagctagtaaagcctaaagcagatattaaaacctgatatgactgttttaatgtgctaatccatctcccaacagacctgtaataacaatgataatcatagtaataataaaaataaacctattttaatctaatggccaaaaagttcacaacagtgatcctttagagcactgcagcttactgaactcaactaaaaatgtgtgagataatcaagcaatggcaaacaggggctttgatggaatgactacagacagaaatgctgtaaggagccatagaaaagagcaaagagccatagccatgggactggcaagcctgcctccctgcccctagaacattctttttatgagaccagctctatggcctacacattggaccagaagtcctcaacccttttgacaccaggaaacagttttgtggaagacatatttttttcacgaatgagaagggtggggagacagattcaggatgaaactgttccacctcagatcatcaggcattagattctcataagaagtacacaacctagatccctcacatgcacagttcacaataggtttcctgctcctatgagaatctaatgccgttgttaatctgacaggaagtagagctcaggcagtaatactcagtcacctgctgctctcctcctgctgtgtgtcttaattcttaacaggctacaggccagtaccattaggccacactcaactgcaggatctgcttccaatactgctcgcagtcaaaatttaatatagttgtttattgtctagcattgcagcaaaggctgctaattaacctccaataaacggtcattcctttttccttagaggactgccccacaccctcctctcgacctttttagttgggcatataaccatatataataaagatgacatttctctgccttcttggaagctttggtatagcaatctgacttatttctggacaatgtaatttaagtaaacatgtgctgtgtaggaacaattccaaaatggggaatacagtgggtggcttatttactgctgcttctttctcccttcttccttccttcttactttctataggataaaatgtatacacgatgatttaattttgaaatgccatcttggatgggagatgaactatttatgttgagggtaatttgagtgaccagatagaaggatcgtgggtccctgattatcatggaactaccaaccttgatcagaatccttctttctaggttcatttaagtgagtgatatagatgaaatgtttgtatccctgccaaatttcatatgttgaaatctaacccctagtgtgatggcgttagaaggtggggcgtttgagcagtgattaggtcatgaggctggaattctcgtgaatgggatttatgcccttataaaagaaactgtagagggctcctgatatggtttgaatgcttgtcccctctaaatctcatgttgaaatgtgatccccaatgctaaaggtagggtctggtgggaggtgttacagtcatggaggcagattcctcatgaatgatttggtgatctccccatggtaatgagttagttctcactctattagttcatacaagagttggttgtttaaaagagtcggcacttcctcacctctctcttgctctctctctggccatgtgacacacccactcctcttttgccttccaccacgattaaaagctttctaagccctcaccataggccagcacatgctggtgccatgtttgtacagcctgctgaactataagccaagtaaccctcttttatttataaattatccagcctcagatattcctttatagcaatgcacactggactaacacagctccctaacctcttccagcatgtgagattacatcaagaagatggccatctatgaatcaggaactgagccctcactaaacatcaaatctgttggcgccttgatcttggaattccaagctcccataactgtgagaaataaatttctgtggtttataagccacttagtctatagtattctgttatcacagcctgaataagctaagacaatgagaaaggaacttctttctttttacttcaagtattctgtcactcacagacaaatttaattctaactgacaaaaatatcaagtccaacttgtaggtagcctcaatctaattgtgtatcttctgggtggagctttgtattttttttcaacactttttaaaatttgaagtcctgtctgtccctggaccctctctctaaagtgtgggctctctattctgcccctcaattcccactaggtctgctataatgccttttcaagactcctttcagtttgctctaggtctagactggaatgtcatcctcttaatatatctcttgactaccaataaacttctggatccaaaatctcttgatgttttccagatatctagagatgctagaagctctactatctctttggggcatgacagtgcttttatgattatctggagcaagaaacaaaacttacatgcagatatcacagatcctaagaataaaaagggtgaaatcaagtaagttactgaatgactatccttcactctttttccaaatttctcaccctgggaattatcatttggatgttgattttcaataatgtctctataagatgctaaaccaactatgaggtatatgagggcccacagttcatataagaccaccctcctttctgatatcaattgcaagtttgggggattcccaaggttaccttcaacttttatcattcactagaaagactcacagaactcagtgaaagctgttatattcacgactacagtttattaaaggaaaaaaatagacattaaaatcagccaaagaaaggtgtccattgggcaaggtccagaagaggtgccaaacatggggcttctgtcttctactcatggagtcatgagcacattactctcctggcattgatgtctgacaacatgcacaaaatattaccaaccaggaaagctcacttgagccttagtgctcagagtttttactggggctccatcacatactgttcataaggctgaaatttagtctccagtccatctggagacagaattgataccacatgatccaaaacccccattaaaaatcacagtgttagacgatccaatggcaaaaaccccaggcaaacaaaggcattcctaccaggcatcatattctaagaatccaaagattacctcccaggaactgagtgtaaaggtcagacttctgttaggataatgttaaattcttcattacacagcattcctcttaactcccaggatcctggatttgacattgacaattccgatatttcactgggtaccctgacacttcatttgctctggcaaaacatgtgctgtactatggtttgtgctatttttggtatctgcatcaccataatggtgtgtcttatctctataaccttctgaggactggtctgatacctcttttaaggaagtaaatatgatgggcagaccaacctgacccagagtagaaatgctagaatctgaggcagggcagtagagagatgcttttgtccaggcctaaagaaaataaccctcagtttgaactagactatgatggaacatgctgtaaaagaaggaaaatctacatcccacaccagcctttgatttacgcattttcatatgaaagccatttcatcagcagtgttgaatatgaagagatatataaatatacacattgacccaagcaataggaagtacactgcaaatgcagatctcactccttctgacaaaggcaaggtgactaagtgggcctatttctttctgtgacttcctgaatctatgatttaaatgaaattgatgccacaaaatgtttcatcgcatgttataaataaactctctggcctgaaggactcaacttcaagttgtacatttttataaagaatacattacagtttaatgtgggagtgggaggatctaattcaattcaagcagtgatgattaattaaagttagtgtgcaaaatttgtttatgatctacagatataaaataaaattttatgactttgttaccatatacgccccctctctccaggtaaagtcacctgcaatttcttcatacagaaaaaaatgccaaggcataatgcttatttgtaatcatgcctttgcaggtagttttgttttgttttgttttgttttaactgcatggtctagagatgttgtgagatggtttcttggcttaagggcacttgaataaaaatgaaggctgaaagcatcagaagtatttgccttgtagaatggattacaaagtctcaaatgtagcaatataatgtagctgagaaccaggttatctatctgggttctatctctgtatatcatcgtggggacccattttatcctctgaacaacagcttcctcaattataaagttgaaatagacctaatgctcacatcttcagggattataaatatgatatgtttgtaaagtgcatcttaaaactatagagtgacatgagaatgttaattgctattatgtgtacttttcagtgaaaatttatcatcacttaataattcactatggaccaagagctgaagtacaagccagggatataagagcaactaagacatgatctgtctctttgagttcctcacaattcagtatatttgtgtctgtaagtcaggtgggggaaatggtgttgagggagggagattcagagattcagagagactgagagagatgtccctcattcactttccagaatatagaaataacttggcaggacttagcaaagtccttgatcattaaagatgttcaatataaatgtttatatattgaccacgtaatgcagatccagagacaactcatctcaagtttccttaaagaagcacaagacatactgaattaacggtaacaagacagggagtaaaatctcacctggacaaaatgcatctgcccctcccccatgcatgttttagctttaatttttttctctgtaatttctctagtttagaaagggtcagcttgtactagggaaccacaaatggaaacacatgtgacatgataatatggaagtagagggccagctcctctcacatcatcctggtttccataaccattcattcagatgtcagtatcagatcatcagtacttagagtcagtttctttgtaaatcttttttttttttttttttttgagatggagtttcactcttgttgcccaggctggagtgcaatggtacaatctctgcctcccaggttcaaatgattctcctgcctcagcctcccaagtagctgggattataggcacatgccaccatgcccagctaatgttgtatttttactagagatggatttctccatgttggtcaggctggtctcgaactcccgacctcaggtgatcggcccacctcagcctcctaaagtcctgggattacagtcatgaaccactgtgcctggccataaatctctttttaaaagcagtcatggcccagacatggtggctcatgcctataatcccagaactttgggaggccaaggagggcagatccccacctgaggttgggagttcgagaccagtccagccaacatggtgaaactctgtctctactaaaaatagaaaaatcagtcaggcatggtggcatgcacctgtaatcccagctactagggaggctgagacaggagaatcgcttgaacctgggaggcggaggttgtggtgaactgagattaagccactgcactccagcctggtcaatagagcaagactctgtcacaaaaaaaaaaaaaaaaaaaaaggcagtcacttctgagtttgaaggtcctgattagatccttccagtcagggattaaaccggagaactgagaaaaggtggagctataagtctagttttattgttaacaaattggggcattttctgagccagcctactcagttataattaagccctgagaggaaaagccctaccaggttacagggtaacatcaccctcttccaatttcctagccaacaagaccactttaagacataaatactttcctctgtttattaccggaaaatacattttccttagtatgtccttctcccattctttaccttcttcaccattttgaagatcacctcagatattaactattcaacttattctgtattacattttctccatacagaaaaacataccaagatataatgcttatttgtaattatgcctttacaggttatatatatatatatatatatttttttttcatatattctgcatggtctagcaatgttgtgagatagactcttggcttgagggcactcaccaccatctctttctccctcccttccctgacccaaggctggatcaaagattgctgtcctgggctccaagagtgaactctggtggttatctcaaacaaattagaatctattctaacagtctattgacaggatatcctaaaaggcaggtaccttttcttatgaatctgtgcgtctccagagtagacacagagcacagcaaatatttgttgaaaaatgcatgaatgaatagggcaggaacacaggatatttatttactgtatctcttattctttctatccctagagtgactctagtttctttaggactgtcttaatttatgactatttacttggcacacttatatattacctttcactttcaaaaaataaatgggtttggatgacaaattatatagtccaacactattcatacctgaacctgtttgtaggccccttatatctggaccctgaggttctgtcatccttatatccaagttcccatatctaattcttaatcatgggctgacactggacgacgatcttttacttcagccaattccactcctgctattttccctctcttcccctactcaattcaaagggccttgcaaatgtcttgtctccagatctggtgcccaggcaggcaagccatgactaaaggacacctgttttgaaatcctaggcctctttggactagaattcctgacaaccaaaattcagctttttaatctcaaagtaaagttacaggcagaacaacaacgactattttataccttaagaggcttccttctgaatgaagcaaagtggcaggcacatttccatgaaatatagtcttaacatttttcaaatgatcttttttgctctatggataaactaatgaaaaataatcataattcaatgttaaatattagctgtgaatgacatttgtgtacatatcgttccctttttaaaaagtttcaaattctaagcctcctccttggctctcaaaaaacaaaacaaaacaaaacaaaacaaaaagcctgaaataatttgtccactaaaattacaaattatatttcaaatgacttaattacaaagtcatggaatataatgaaaatgacaactgactctaagttagtaactacacttataattaacagaagactttgacaaatgtttatagtgctttgaaacaggaggtcaggacatcaattacagaggtaacataaactcatttttcctatttataattcaaatccaaattaccacatattgtaacatgtggcaaaagccccagcttttcaaacttatgcctggaggtcaggtaattgtctcatagaaggaaaaagcagaaaaccaagcaggacagatgggaagtagggcactgtgggccaaaaagcttcaaatatattcaaaaaattgtattgattttcagagatgctctggctgtgtgttcccctagccagctttattttctatcatacttctctcctttccttaccagcaccctgtacaaaataatatgaagatgctgatatctgatgattgtggtagattgtatttctgtttatgattgttaacacccctccattgtcctttcccttaggaaattatacattcctgcctcattgatttggagtttggccacggtatatgctttggtcagtggaatatgagtaggtatgacatattttttttttcgtgaaagtaggagaagtaccatgagtttctgccactaatcttgcttttatgtgctgccatgagaatcttagctggagattcttctatagaatgggaaggcaaggaagcagagctggcccttacctagagacaagctatagtggtaacacaaacctgtaagtaacatgagcaaaaaaataaagatttgtaagtgctgaaattttaagtatgtttgttatcacagctgaccaacacattgataatgatgatatataatagtattgatggagctttacaatgtgtcacacactgtcttaagtgctatatatgtgttaaattatttaatcccattttacagatgagggaatggaagcaaagaaagtcaaataatttgcacaatattacatagtcagcagccaagccagatttggaacttagactctggcttcagaggctaagatcttacgctataccacctatctatctatcagtagtatttccaaatattcatatattcaaatctctttcatatctccatgcctttccacatgctaatccttctggaattccccttcagtcctttctcacttagaaaactcctattcatcctccatgacccatctcagagagtcaatttctgtgagtctaattgcttctcattcaccccaccccacttcttgaagacggttgcttctttcttctataagggcataacattttatagttttgttgtaacagtgttattactttctgttgtgcttgtcttcctttctagatgttgaactcttccagggtgaggaaaatatttcacttatttttaaatttctagagtcaatgtgcttgatacctagtcaatgatcagaaaaagtgtgatgagtgactattagagttctagtgacccattcaatttgttccttaaacccaagtaaaagaagatgtgggaataggtaagcattctcttagtctacagttttattttgtaactgagttcacattataaactataaaatagggagttagcacattacatcgccttcacctgtagaacaatttctctagcatgtgttgccctcccctcccctataggcatcactaggaattcggctaacacataggtctccaaatccatttcttccctttcacatttatttgctgctcagccagatttttggtcaagcattatcctgggtgtttctgtaagggtgtttggggatgagattaacattgaaattaaatcagtagactgagtaaagcagattgccctccacaatatgggtgactctcatccaatcagttaaagacctgaatagaacaaacaactgactcttctcaaagtaaaagagaattctcctatctaatagccttcgaactggaacatcagctcttgttactactacagcagcttctggtctttggactggaactgagacattgattctgtagattttagacttgacagcctctctttaatcatgaattccaattcattataataaatctctttatgtatatatctatatatgtatatgtctatatatgtatatgtatatacacaccccatattggttctgtttctctggagaagtctgacacttacaggaatcaagtatttagggaccctctcctcatcagcaaaacaatttgatatcaaaaaagtactcaccaaacaactagctccatatgcaattggatgtgtgtatacacatatatttgtacatataagtatatatgtgtataattacataaacacatttttacaaatatatatttatatttaaataaaatcacacactcagaaatttttttgaggtaattataattatccctatttcatggctgaagaaataaagcttagaaaggtttacctaaggacagataaccaagaaacacaaaactggaatcaaaatgggatccaaatccaaatttacatgacacccaagatctaagctgctaaccactaaaatgcactactgaatatcagcttcatttcatggtagagaaaatttatgtgttgtcctatctacatatccctcttttttaacccagttttgcctgaattttgttttatatattagtctatcttgtatgacttatttattgatgagaatgccacaatttaaaatatccgttatgtgagtgttagttattattattcttaatactgaatacttcatgttcttatttccaatttatgagacgacttaaacagaatatacaaatgtatttctaaattctaacaccattcgcaccgggcaggtaagtaagcaacttaatagaaacattagaccatcaagatatttccacacagtgaagaaagctaatgcatgtcttgtgagagacaaaataccattattatggatatacaaacatggctaatattcaaatatagataatataatcacaaatattaaaaatacactaaaggtaaaatatgaattcatgtatcattcttagacaaagtctttaaaataaaaaaattgagaggaaatatgagaggatagaacattgattcaagtttttttttgtttttgttttttgttttttgttttttttttttttttgagtcatagtcctgctctgtagcccaggctggagtacagtggtgcgacctcagctcactgcaacctccgcctcctgggttcaagcaattctcctgcctctgcttcctgagtagctggaaatacaggcacccaccaccacgcctagctaatttttttgtatttttagtagagatgggttttcaccatgttggccaggctggttttgaactcctgacctcgagtgatccgcccacctcattcccccaaagtgctgggattacaagtgtaagccaccacacctggccagattaaagagatttttagtaactaggttccattgcaaaaatttatccttgtgtccccacccaaaaagttaactctggtggacagagcacagactaaaaaatcaaaatacttgagtcattattctggatatattatttaataattgagcaacttttgagggtaatctttagatctcaaaaggcagactagaaataataaggactctgagtgagacagatctcagtgtgagcccagctctgtgacacacctgctatatgagagtataaaagttaaccactttgagtatgaagtgccagataaagatagtaacgcccatttcgaatgaagtgctttctagagtgcccaacagagggtacccttgataaatatttgtgcccctatctccagaccctattttcctcacccaaagttcctttctgagtctatacttctataatgccatgatctgtaccctacattctagggtgactctactaaaaaagttgctgaatggattcttctgactatttctatcccatagtgtgtttgtagcttttgtttcttctttaagcaattgagtttaaagataggttttgtcaaatgttctctgcattccaaatgtatctttgaattatcaaatagaaggtaaccagcttcccaaataccatttctgtgaagagaattgctgtgatcagaatgcctcgttcactgaatgccctttctgataaaactaaattgaaacggtttaagtactcattatgggtttactgagctctgcagttgattccttcaagctacatctattgaacgcttggatggcataaaaatcagcattctaagaaaaaacacaaacactttcaaaacattccttcatccctcgtggtttctagcgtgtctttctagagcaataatattttatcgctgactctgagtcaagtcaccatttccccttagtaataatttttatcctcttctttccttctgcatttccacatccaattgttgaaaaatttgaaaatatttttacattcaatttttaaattaatgtgtcattttcatgcgaagaagacacaaaacactgtgcaaaaacaaaccattatcatttatccaaaaaatatttgagcatccacaatgtgccaggcactgttctaggtaccagcaacagaaaaaaataagcaaacaaaatagacaatattccttgttctaacaggtgtatcttcaaattgggggagtatatagtatatctggtcttgagaaatgtgatggggaaaaataacacaggatatgggacaggaagttagggtggccagggaagggctcatagagaagatgacactagaggtaagacctaagtgaggcaaagggcaagcatgtgcttggtggttggggggaataaaaggggagttggggtctggcacttcaaaccagggaaacaagggtaaagatcctcatgtagaaccatcagtatgcttggtgtatttgagaaatggcaaggaagctgaaacaagggggagtatggctagagacaaggatggaagtgtccagatactaaggaaaacatttaccagtcacaaagactaacttcatatgccaaagtaggacaatggcaagcattggctgtgctctccaaataccagactgtctatattttgttaacttaaattgatttccaaagtgaacgcactactatcacctctggtgttctactcatcatatatttacttatttactaatgcattcataaactccttcacttcttttgacaaagtgttagcatctatggtgtaagatattagataggtacggaagaacaatatgctttcaaataacacagtaaagattcaccaaacccctttttccccctactaaacacacactttgaccacatttcacagcctatcctgtagtcatttagggtcacctgacaatattttgatcaaatggccacctgacaatattttgatcaaatggactgtcagaagaagtgatacacttcatttttaggcttggactcctaagtacctccttggagatcctccatgacctctcctttcctttgcatgctggcagagaattggtggaggattctgaaaccctgggaactcgaagaaagagtagcattgaactgacaaagaaaggtaagacaagagccttccttgaagagagaccagcacatacaaaggcactgaggtgcaactaaacaggacctgttgtagaaagaaccagaagaagttctttggactggagaataaggcgaatgggcatgatggcaaaatgtatacataaggactggatttcagaggtcctgcacgccatccaaagaaatgaagacttcctcttgaatgagatataaagagaaataacatggctcaggtcaattccaaccttcctcttgatcgcatttacaccattctgagccttccctgtcttcttcaccactcactgtatttctcattaacaaaatgtccatattctcagagaggtttgtgaactctcagagggcaggctctctctctctccttcaaatttgtttttcagaacatgaagtgggcattcaaactattttttcatatttaaagcaacaaagcactctagttatacatgattttgatgtaaatcatgaggaaaaagagtaacttcagtgatatgttgcctctgcccagggctgcgggagatcaaagagcagggcgcttatgatgggatgctagtgtgtccaccagaggctacagaacacacaagtggtgtcgatttcacaacaggctcaccacaatgttcaattctgtgtctattgcctctggtggcataatataataattcaaacaacaatacaaaccactattgattgaacatgtgttgttttacataaattgtcactaatcacaatacatctccatttacagatgaggaaacagcttccaagagtttaatgtcacacaatgactgagtgggtagagccaagatttgaacttagtcctgtctgattcaaagcccctgttctttccatcatatcgctcccacccctaatattgctgtggactcatagtccaaagcaccatttgttttgacacttgtattttatcttaaaaattcctatgaacaaagtattcttattaacatcagagtagatacctttttgtacttattagtttcatgttttgaattaattaccataagaaaaaaaattacaaatttacaacctcttgcagcagcaagtatttaaaaacatagtgcataccctgtggggtaagaagacaagggttacatccggcagccttgtcaccctctttccacacttctgggatttaccgagtacaataattttttttttttttttgagacaaagtctcactctgtcacccagattggagtgcagtggtgagatcacagctcactgcagcctgccttgacctcccttgctcaatcaatcctcctatctcagccttctgagtagctgtgactataggtacatgccaccatgcccggcttatttttttaaattttttttgtagagacagggtctcactgtgttgcctaaaccagtcttgaactcctgggctcaggcagtcatctcatctaggcctaccaaagtgctggaattacaagtgtgagccattgtacctggccttacagtactactcttgaccccagagcagcagttcctctgaagactttacaactctataaatgtcctacagctggaagagcaagatgacagtagggggaggagattagttgtacagccttctgctctgggaacctgctgtaaaataaacactgctgaaaattcctgttcctgttaaacagaatgacttccgtgttggctattgcccatgtgcatgtgctctcagcagagaaaaagagacaaaataaaaagtgacttgtgcagaaaattctggaataattagaaattcttttgcaggaagtctggcaagtttcgccacttttaatgactggtatggacttctcttggtttaatcttggcttctgaaaattcgtctgagtcagtcactactcagaacagactgaaaagtgattatgggaactaagtaaaggacagctggctcccagtaaatttgtgaaacgagattttttggttttgaggtttttgttttgttttgtcttcctcttgtatttgcatttctgtgttccctggatggaaggcaagcttcagaggcagagacttaagactatataagtatctagctctgtgagcttggacaagtctatcagttatccagaacctcatttgaacagtcctcatttttaagcaaacatttattgtgcactaattgtattctagacctggctccaaatgttggtgatataatggaacaaatcatagttccaaccttaagtaaactcatggaaacataactaatagtgtaaaaaatgctttagtaagactaaacggaggatgctagtcacccaaagtgggtgtctagtctatttctgtccttcagaagaacagaaagcttcttcaagagagatccaactctgcctaaacctaaatgatgagttggaatgagtcacatgacatatctatgtattgagaaggtagggtacgtagaagcatatctcaggcaaagagaacatcaaatgacacaggtacagagacagagagagcgatctggtagataaatttaaaataaagcatatacagaaagtctagaaacctaacatatttttaatagagaagttgtcttaagcaagcctcagccttacaataagtttaagtctaatattcactcatttccatccatccattcattgtactagaaactattccagctgctagcattataaacatgaagaagtcataaaataggtaagtgaaaattgatagacaggacttctagaaaagcgccttaaaatggagacagacacctgaggcactccttttgcctttccctctcattcttccctgttaccaggaatacagctctgatagttaaagttttagcagctctcttgggccatgacgtgatcctggtgtattagtctgttcttgcactactatgaagaaatacctaagacttggtaatttataaacaaaaaaaaggcttaattggctcagggttccacaggctatgcaggaagcatggcagcatcagcatctgggaaggcctcagggagcttttactcatggcagaaagcaaagcaggaacagttatgttacatggaaagagcaggacacggtgtgttggggggtaggtgccatacactttcaaataaccagacttaacgagaactcactcactgtcataaaaatagcaccaagggggaaattgacccccatgacccactcacctcccaccaggccccacctccaacattaggattacaatttgacatgacatttgggcagggacacagatccaaaccgtatcacctggacatggaatgcacaagctaggataatagacagggaggaagaaggagcctgacaatcatggagctgccttcctctaaatgtattttacataagagagaaataaatattgctaggctgctattatttgaggtttaaattatatgcaacagaatccactttccaaccaatttagagcggtagcatggtgtagattaagaaagattatagactttggatacagacctgaatttgaatcctggctttgtcaaaaataagctgtttcctcctaccaaaatgagactgatatacagagggtgggtaaggggcttataaatattataaataagtgcctaccatatagcatatgtgtgatattattatctggattatttggattaggtggaaagttaaaaacaagtctacaaacaaaacatccaaaagccctagaatctaaaaaaaaaaaaaaaattaaaataaataaataaataaatcactaatgtagtgaagactgtgacaaaaataagaattttccatggaagaattagaagaaaatttgaaccaagatgataaaaaattaatgaattaggtacatttcaaattaaatgtatctccttaacatcagagtctgcaagatatttaaaaggataacttatagggacttcctcatctattatcctatacctgtcaactactcaaagtcatgctacctgcaacttacaacaactcagcacttcagcacagggacagcaaacaaatgcaaatgctggcttgctgtcttctgaataggagtaacagctttcatatgctttcagacttaattaactttggccttaggcccagaccctgaatcatcagtttataagaggtgcagaataatggcacaaaactcacataatgtaggggtaactcttagaaaaacttttctagaactgaaagacaaaaatagaattgggcacagtagtgaaagcaacatagtgatgagtgtccttctaaatttgtccatctttctgaattatttttcatgaagacaactatgcattcatgttgctactgtattcaacagtaaattctactaagaaaatatgtgtgactccaggttgatgtttaattggtaatagctcctcacacagtctacttgattaaaaatctcaaatccaatatgtcaccaagagaagactttttacttccttgagtagtcatcatcattgtgatactacatgaatgagcagagtataattaattaaataagtatttattgagccttactaagtaacaggcactgtggtagtttatcctggcttctaaattagtgatcctctatcctgctaactggagactcatatacttcttcaatctcccattcaaaccttagctccttattaacttatagaactgaatatctctggacaatattttacacaaaacaaaactgaacttcaatcatcatggcctctattgaccactgtgacatgttctgtcactttagttgagtatacaagattattaggaataatacaaatttatttataacctctcattgacctccttttagtttttgactataggtacaatagtcaggagttaagcagcatgaccataatatgtgatgtatgtgtccataaatatgtacttactacttttgcgtgtgttcacacgcatatatgtctgttcatgtcttcaccttccttacatgggctcatctttaatctctaaaatctattacttcagcctccatctcaccaagtcttcccatttgttaatgactttttcccacaagacagttgaaattaattttcctgtcaccgactttgtattgtgggaaaatcctggatttatggagtttccctaacagagaacttttcattgactcctattccataaacctagtatacagcatctgcctctctttctttatttgcatcaagttgcaactgcaggcctgaaataaacctggcaagccaggtagggaatctgccatccagtccaaccctgcggccccctctatccagagtgttgattctgctgtcttgattttcagcacctgtttggattcttgttcttaacagaacatctatgggttccactgctttaacaaaactcatcatggaaatagcctcttcagataaaaacctaaaataaattaggaaagagaaatcataaatacagcagtggctctaagaagcagagccgcttctctcctgggaagttgccattactgttagggaataatgtcagaggctctgggaaggctctccatgcaaaaacctttctcagggattcgaagatatttttaacaaataagatgaagtataaaatttcacaagtggaattcagccttaaaactccagagaaactgagattgcttgttacagctcataaaccctagtggctcctgggctatgttttgtttgctctagtttacctccacccagtgaatgcattttctggttcacatagcactcgttgcctgacacatgttcacaatgcttatttctagcaactgcctacaccctagttgaaattcactagataactgacattagacgggacggtattttagccttcctttttggtagctatgcaatcctagcccattgtctcacttctcatcccttttacaccgaggaggactgaattactaggttctggatgatggccatttgtccaggtttcccaactgagagtaattaattgccaaaggatttatgcacagggactctggcctctttctcctcccttgtccacttaaatcagtaggaggtagtttcctggatatgtgtgcctcctctgggtacccatactggcccttgagtgggttttttctctatccagatagagtaatagctacatagcagaaaggcagtagatctacttgaatctcatataagagctacatattccagtctagtctgacctttactagtaacaagggtggtactatcattctcctgctgacttgcttctcaactgatacagtttccagaataaatatgagagctatttattaagcataacaaataatatatatatgagctttaccaaggagaataatttgatgatgggttggctgtttgtgtataagaaaagaagaccatcctggatgtggagaatacttcagatagaaagtctggaaaccggaaggaaaacattaacattataattagtcagttctttctttttcccctttactttggcttttaagagaacctatgtttccaatgattttaaaaataaaagttcttaagaaatgtctgtatgggtaagaaaattgaaacccagaaaggttagatgtctttccaaagatcatatggcacagctatgattgggatctgaggtcctttatcacacaccctttaatcaacatctactaataaagggaaagtaagaaaaacaccaatggtaacaacatttaaagtggtttatacatatagagcagttctgccagacattcttctaggtgccttgaaatattaactaattcataaaatactttatgtgaagcaacgtgtacctgattctgtactacctgtggcaaatacaggcataaacaacagaagtggctcttgtctttacattctagtagaggtgacagccatcaatataatatattgattagcaaatcattacttaattatactgtaatatgtgctcaaagaaatatagactttcatgacagattgtaataaaaggcctgatacttgaagtgtaggagtaaattaggatgggggaaaagcaggaaaagatgttccaggcagatggaacaagtgagaaaagcctgcagcagaaaagggccttttcaaaagcgtggggcatcattggtgactggagataacaatggagaggtgggactgggacagatcatgaagggccctagaggtcataaaaagaatttggggttttatcccaagagtaacagacatccattgaaagagatatgtgaataatttgacaatacaaagaagaaaaatgtaggtgcgtgactaaattttcggggatggaaatcaacaatcttggttacggcattcattaaagtagattgtatgaaggtgggacaatgaatctgcctaacttccttttgattcgtatcagtcattccgggcatccccaagataagtgcatttcaggatattccagtagcttcacttatacctgtttatgagagaagtttaaacttcatagtctggaaacttcctgctgattataaaggattttgagagttattacctaaatcctgtggctgcttgtaaatcagtgaagacatcattataagaaatagtaggaaaaaaaccatatttctctagtgaccatactggaacaaaaatctcttattacctagaaatgagaactacttacaaatccttccttataagaatagccctgcacagaatcattctaacttgacacagatcatatttttacaaaacactatatcagttcaaccactaaaaatgttgctgagtatagtggcttatgcctggaatcctagcagtttgggaggttgagctgggaagatcacttgaggccaagagctagagaccagcttgatcagcatagctgacctctgcaaaaaaagaaataataataataataaaaattagctgggtgcagtagcatgcactcatagttctagctattcagtaggcttaggcaggaggatttagtgcaggagttttccattgcagtgaactatgacagccctactgcactccaacttgggagaaagagtgagactctgtctcaaaaataatagtattgtctactaactcaaaatgcatgagtaaattgcatatagaacaatattaatctaatattcatacaaagcaaaattcttcagagactgaaggaagtccaagtctgcagaatgccattaagtatcaaggcaattaatgagtttcaaaagctcacttgtaaaaaattgcgtccctgaagattcattaaaagactctatggaaaagcagcttctctcacccaatcacttcttcctccacctacaaccagatggtgagagctaacctaggcctccatagctgcttttctcttcctttctctcagactatggacaatgccatctgttcccaaggttttgtgaatcatatgtaaactaatgacacacacttcttttctgtttagccttaacttttttcactggatgttttgcttatcatcaaaagcaacagcagtccatctgttttcagtctaatacacccttgagttaacacagggttagcacaccagggagacaacatacggatctcattccgccattaaggaagtagtatatggaggtgaataagagcatggaatttggggtcaaacagatctgaatttacagtcaagtcctgccacttaactgtaatgtaagttttgacaaattctttcattctaggagcttcattgtctatactgatgaatgaggctaggaacaatctcacataactatatgaagcttaactaagatcactcacttgaaaagatgcctggcacataatgatcactgaaaagtttgtagcttctatcaacatcatcgctcaacagctagccagcttctcatttgtaaatatatatttataccctgattaaatatattgtatgtgtggtagaagaaggtagtatagtggaatgtcttttgaactagaaatgaacagaaattgagtctagttccttttcctgtcctcatagccatgtgacttaggtaatttatttaaatttctaaatctcagatttttaatttgtgatatagcagtaatacttattgcataagtttggagtgttaaacaagataatgtatggctatgtaaattatgattctacataaaaaagttcctagttgagtcagcatttaggataagtaacatttattctcatagaaattttgttacaaatggctgttaagttcaagtgacaacccacagcaatgtattcaccttaagcatagcttaaacacaatgtatttgaaataaaaaataatacaaaataacagcaatgactccaataatagttgctaaataaaagacaaaaaaaacaatgtggctgtacaaaaaatattttgtctcaggtgctgatgctggagaaaatataataatagatatctgcagaatataatgattgatgtctgcaaagaaaatataatgaaatatttcacgtttcaatggaaacatgaaagttcgatgtcaatatatagagattttcaggaatgtttgcaaatgatgacagattccagttgaggttttacaaaaatgtttggacagttgctttttctttctcaaagttttttagggttcaaaatgaaagggagagctacattaagattttcctgagataatgaatgaaaataaaataaaccaagaaagaaataagagggcaagaaagaatatggattttcatgtgaaggagggttacttcaggaagaatctcaagagttatgatcagggatacaggattaggagataaagaagaaagaaaaaataagttgcctataatagttaccatttattgagagtttactatatgtcaaagtctgttctaaacgcttcgtatatattaaagtcatttagtcttcacacttcgtctatgaactagtgcgattgtgagccttattttatagattaagaaactgagatgcagttataaatatagtaagttgtagaaccaggattggaattcaggcagtctggatccagaccccagactcttatgaaaaagaataaatattgggtttgggacaatttattcatgtaacagtatttaatatcagagagtatatacagatgactattacagccacactttctgtattattggagcttacaatttagctctcgtactgagccaacaggtagtgctcttcatgagcatagtttggtcatccagtaatactaggttatcaggtttccaaataagcaatgttagagccatttccaactcttcacttctttatacatgatagtgacatctttcagtgtcccttagtctctctctcttccagcatatggtctttgcctctgttcaaaccatagtcaacctccttcctcctcctcaacagacttcttctaggcagaacactccaatcatcttcaaagctgtttcttgaagctgttttcaccagttatgtctatcccttttaccctgtcacaattctgcttcttgctgaacaaaaatctaggctacaaaaagagtatgacaatttgcctattgcaccagtatcagtatgaagataagggccatccctcttaagggcaattattgccccttggactaaccaacaccctgcctcctcacttcctcataattccaaggtgaatctacctatccttacatgctggtcctctcagaaaggatactattctattattcaaactaatcttgaaatccaggaaatcatttctactggggtgtgagagcttggcatttcttcacttaaaacctttcccaaatatttgtctaaaaatttagctaatctgatgggcttgaaataaacttttgctttgcagccagacatatttagattcaaatttttgctcttctgcttcctagctgagtgtctttggacaaaggtagcctctccatagagcagaagcaaataccatagcttgtactgctggtttgagaataaaaggaaatgttaacactgtctttgcatgtattgttgtcttttcaggtcagttgtcttctagcagttttatacataattcttagttactaactttttaaatgctagaacccaagttgagtacacagagaaaagtagattctttcaccttctaatcaatgctttggatatataacagtatttccctcattaatttactcaacaaacatttatcaagcatcaactatgtgccaggcattagtcaggacactgggatgcagtggccaacaagatccataaatatctattagaacagcactgcatatcaaattatatgacttcattgaaatgagttcttttctatttatttcacacagttgctaaacctctattttctttaaatgtaaaagtcaatttgagaaatgtattcaataatcatataggaaagcagtgacttactgtcctgaggaccacttcaaactaatcatttctcttcacaatccttccttcccctgatatgggggtataagtgttaccaaagaatatgtgcccatctctgtgctaagtgatttatcttatttcatttttatttctctgtaaagtagacaatttaaagatggacaacctgaagttcaaaaagcttaggtacttgaagaaggccacaaatctactaacccagatcaatctagctggttgaggcactgttggtttgtaatttcaaatgtgtaatatacattaggaagtggggggtaccggtttcagtatttgaacatgcagctttatgctcacaatgtgtggttccaaggtctcttaatggcagaataaaacttcagaacacagagaagagaacatgctggctcttccaaccatcagttttacatgctttcaattaatgcttgatctctgcaggtgggaatctgcagatgagacaatccatctgcagtcagtaatcactccatttcactgtcttgaactcctggctagtaagggcaattaaagtcacgcccctgctgagattcagactcagtgattgttgctgctcacttgccagaaaaagcaagaaccaatgtggaaaaattgaaccttattgaaaaaaaaaaaacaaaccctcttttctttgctgacttttaggcctgactttgatgcagaacatttaagaaatattgctattatagtatctgcttctagtgagggcttcaggctgcttgtactcatagcagaagatgaaggggagctggcatatacagagatcacatggtgatagaggaagcaagatagaagggagggaggtgccaggctctttttaacaaccagttcttatgggaagtaacaaagtgagaatctacttatccggctacccaccccagggaagacatatgtttattcaggagtgatctacctccattacccaaacacctcgcattaagccccacctccaacactggtaatcaaatttcaacatgagatttgaaggagtcaaacaaaccaaattatagcacagtcccaacatagtcactgtctggctatgtgatactgagtaactcagtgaccctctttgaaagctgtaagaacaatgaggataatggtacctgatctacagacttcagagaactgttgtgagggttaaatgaaattatcatggaaaagagctttgaaacactaccacacaaaatgcaaaggcaaggaatattttggttctctctcaacacaggctttgtgtggtagctggcaagggaagggtcctaaagaggtgccatggagagtggggagcctggtgctcctccacggctttcctcctgtggttagtactaacaatcagatgtggttgctgaatagagctgaaggctaacagctctgggtgaagatctttcaaagttctgccactggaggaaaaagccaacctccttgacccacaggtctctcagtccccatgactagggccttgagatgaggccccaaagactcagccccagctcagttttaggattaatctaatctcacacagaggactctaggaagcctttactcagtgacttggtggcacagatgtcaaaccaccagctgctctattgcctctattgctctgatctcacacccttcttcttgtaggtcagaggagtagtgagaagagggtatgggcttcagaatcctatgaacatggattccaatactggatctatcactggtttggttttaaataaacaggccaaatttctcagcctcagttttctctttatcacaatgcagatataaatagctactgaagaccaaattagtttacagaatttgtggtggggtctctgagtatatttgagcaatgtttataatgacttaaatatactggtctgaatgatgagtgtaagttatccaagaaaagggaaaggaagggcatttctggaagaaggaagattttgtgagcacaggaagcagaaatgagtccttatggtatagtgactgaaaagaaagacatgttaaataatcaagtttaatatgtgttgtgaccaactaagagaattcaaatgaattttaggttctccttggttttcttagcactatctccattctccagacttactctcctatgcctgtgggttgatgtttcttaaacagagattccctgccaggtattgcaggtaatcttgcctgtatgtacctgtaaattcttcactgctttagaaataagcattgggagaaaagcttaacaatcatagtccaaatatttgacttcaacctaagaactgcaaaaccaagtactataagttttcagaagaaacaactgcccttgccataatagttgctgaaaataccagcctccaagaaacagggattaacgaaaagcctcctacacaaagttcatcagcctccaaatgacacaaccactgaaggattttgagactcgcagatgagcacatgcagctggtaggaaatgggctgaagtcgcagcaccatgccattatctgcaggtgcactgaaagcaccaattaagcctggagacagggtgtttaggtggaaggatgggttttgagaagcaatttcattgtgaaacaaagttccacaatgtcctattgctgaatccagaaaaaaggaagaggcccttaatgcaaataagaaagctcttgactttgttttccacagtgcaaaacatcccagttataaatgttgacttatttttagagtcaggtttcagaaaacatctataccaacaaaatcaggaacaaagcatcttgaatttacaaatttcaaatagaaaacatctgatttagcttgcatgaatgtagtttttcaatcccctaagcaatttgtttcatgttgagattgcctcatgaataaaaaatgtcctggaaaagttggttttgttacatctcagatatttaatcaggcatcaggcacaggatagatgcaatgtgtatttattttctactttggctacaatatcaaggactgaaaaaatgtattgaaagatctgaaatgacaagctgagtagtaggagataattcccctgtggcatttagaaggtatatttttccttttgtctttccttgagtgctaattttattcttggtatcatctgcacccagcttgctccccttgcaccatcatctctgtggcccatgtcttgacttcctttatacaactttctttttcttgttcacactccagaaattgagtttctaagcctctccactccattcactaatacacagggtgtccagggcctgttaaacagtacgtcacagaacatatttgttgatgggctacctatgaaagcagcatcaactctatgggtacccttctctagagttcagtttgtatgtggtgcactgaaggtaacctgaacatgtgggtcagatctggtttcaaatcccaactgagtcacttacaaagccatgtgacctctgaccagatccttgaagtaccttctctgagcctactttctcctctgtaaagtgggaataacaatacccacctctcagaactgttgtaaaatttccatgaaaccaaataaataaatcactatatgcaaggcctggcatataatcgtattttctgtttaatgtgaattattactgcaatctaataactcatggttacttttcttgcttccacttaacgtaattataatgtgttcccagatacagaattaagtggaatacagtgtttgactttgagaatttcagtgaatgattctagaggaagaacatataagattttgacattattaaggtgagtagcgctcttttattatttgcaatttatctctttttgattcttacttagacagtatctgtttgcattctcacaacaacctcttaagggaattacaagcatccaggcattcctatttaagagacacagaaactaagttccagagaaaagaagtgagttgtccaaggttacagagctggtttgaagcagagccagggctataattccagttttctgacaacctatccaccataccatccaacttcagttttaggagctccaatatcctgtgagttcctagaaagctggcctttccatatttgtgtcctcaatgcctagccaagttcctggcacacaggaaatagtcaacaaatctttgatgagtgaataagtgttctgcctggaagcattaataagaaccacagtcagtcctaaatacagaatctagacatgatcccaggattattgggcaagaagttccactgccacttcagtagtttcacagagcaagagcaagctgaatcaggtacagcctatctcccagatccaataggtaatcaattccttctagtcttctcatacatatattacccattcttttcctgcagctcactcctgttctaatgagcttgagctagagatttatttatctgccagaggactattccaaatatacgagtcacagcatgagaacatcagaaacatagcagaatttccaaaaatgaaaatatatttcaaagtaatattttgctctgtattttctgtatcctttttttttttgagacggagtctcgctctgtcgcccaggctggagtgcagtggcgcgatctcggctcactgcaagctccgccccctgggttcacgtcattctcctgcctcagcctcccgagcagctgggaccacagactaattttttgtattttttagtagagacgaggtttcaccgtattagccaagatggtctcgatctcttgacctcgtgatccgcctgcctcggccttccaaagtcctgggattacaggcgtgagccaccgcgcccggcctattttctgtattctttaggccagcagcagttctgatgcttcaagcctcttcactcatttacaagatctaaagcactgaacagagatcttcctttaagagcagtacctagtgagtcaatcgttttcatgaacaggacatttggctcgagccagacagcatatggataggcactcagtcaacctcctgactgtagctctgcctgcttgcctaaggtcagacatgaaatgctgcctgagagtgcagttctccataagaggctgtcaaatccatgtctcctgaggtaaaggactttgtccaaagacccagcatggttctttctgaatcattttttaatacgcaacttccttgttaacatcaatttatggcatgcagaaggcaacctttctacaatgcttcgtgtctggagatctaaaataacaaattacccagaatccaaacaacaacctggatttggttttgtttctcatatttcaggacttctaaactaatctgttcttatattaaacactactcaatgacatctcatggttctctccaatccctaaagttacatggtattaaaatcctgaaaaactaagtgattaggcaattgaactatattttatttcaccttgtaaccaaattctttcaactggccttgaggttttttttttttttttttttttatgctatacaccatgtaacatataatagcctaaaaacattcatccataagaattctaacagtcgatagtgactgcctaacactcataaagaaatcacactccttacttgcttgcattcaagaaagagacttgtggttggggggtggcgcagaaaaaaagaagaaagccaaggcatttttctccatgtttctgcttcctgtgataattccaacagcagtggcacctcctccttggctcctactctgctgaacaggcctgcagtggttccagcttcctgtggttgattctggccctaagttccttcctttagtccttcagtttaggagtgggcatgttttcctgctgtggttaatctgtagattgccttgccatcttctgtttgtttctaggctctttcatggattatgcaacttactgttttatgatgtgccttttatttcaaatacttagaaggacttctgttttcctagttggaccctgttacatgctctatttcatttttctttgccttccacaaaacactgtgtgaaatattaaataagaatcagacatacttggtccaaattctaactacatctgctggaataagtaacactgcctgggactcagtcttcagtttcctcacctgtaaaacataacgacataactgattttacagggttgttgtggagattagatgagaatatgaatgagtatgaatccttagtgcataatgcccaaaaaatcctggttattatttctccaaactcagttctttacagccttgatagaataccttaactgtagtcacctagctttcaacatattttcccatgtaaaattttctaattcctccatgggtacctcaattagtatcatttactcttattaaaaacacctgtctttcctccagtctatgctatgaatttatttaaacctacctgccttcttaaataaactctatttcactcttatgactcatttgcacaatagcctccaggtattcaaaatgtacaaggtcaccctgcacttctgaaatatttttgaatgactaacatcaccttctttcctacctatcaggtttcatttgagtaaatttcttgaagatcataactatagttaccattaattttcttcaagtcatacatatacacattaaatgtcaaaaaaaatgaaaaaaatgatgctagttattgagtgaaacaaatatctaatcaggaaaatagtgtttgctgcacttttcttccactaattgaaaactaaggatggagggatttcagatgcaaataaaataccaggtgggttccacagtactgcatttaagtactgaacttcatagaagtagcatttgtccctgtcaggtgcaactgaacaccatgccttcagatgtactgtgtatatatgtgatagcagaggaagagcagaaaaactcagatgtggtcctcagttttcagatgacttagctaaatagagacatcactgagcagtaggaaacagcatgagaacatgaaacattataaagcatagaaaaaatttgtgttgcaaaacctatttagcaccataaacatgagaagagcctaatataaaggcctcttgacatagcagaaaatagctattggtagtctcttgaacttcaccatacagcagtgttaggtctcaccactgcccacaactcttacagccaaagtatatataaaataaatcactgtattaaaattaggaaaaagaaagtagatctcaataaatgtattttcttgtaaagagtggttagcttttagaaggcttggcatcaaaggtatgtgattcagttatgaaaaaaatacacttacatgtaaaaatttcattcctttcattcactgatttacataggtattgagcccttgctcccttccaagtactgctttaggcattggagatatgaagataaataaaacacagttcttgcccttaagaagagaagcactgagctaaagtagcaaatgttaaataaatattgtggggaagtgtcaaggtgtatactatacacttaaaatttaataagcataaatctggctctctctgcctataatgtgcatcctactccatttcacttggaaaaaggccctcagacaagatcagctcaaatatgacccttccaatctccactgtctgtgtctgtacatctctacagtgtactcactgcacacttctaggagtctctctcacctctaccctgttcctggtggaggactatgaaatcctcaaaagcaaaagtgacagtttattttctctgaacaacttctgcatatacttagttagctacacagaaatcaactgatcctgaatttgaattacccagcctttagaatgtgggagaggccttccttcacagtgctgttaagcagactggagactatctacgtaaaacgctagcacagttgctgacatgtagcagtcgctcagccaaatggaagcttttattattacctgttttttcaacattcaaaaacgtaaataactatgaaatgagaaattggctatacagttttatctcaagaaaatctgtatattgttcttaacttcctaatatgtataaaatcatcattttgtgacatttactagtatttctggaggtaaaatgcctaatgtcttgtttttttaaccattctacttaagtgggaccaacattcagaatggaatgtaataaagcaagactctatttggatactttgaatgtattaatgaatgtttctattgagaaacaattaagtttcaaaaaaaaaatagcacataagatgtactgtacaatcatccctcctcctcaatagaatatttaactttagcagctagtgagccagggataatgaggtgatgactcactttactggtgtgaaagataagaatgaataaatttataagtatttattatgcatttaaatagttaactacttcagtttgagcactattgacatcatctttcttgtaattaattctgttttacccattgtcctacttttactatagaagttaaaaagaggtttgacaattctccaggtacaatcagttatacgtcattttgctcatcattaaagccaaaagagtataaagcagggaactaggtgtccaaaattttggtactaccatattggtcaataggaaatagcagaaataaatagctaagttaacgcacacacacagacacacacacacacaaacatgcatgcagaccatgcacataattaagataaagagaagaaaaagagacaaaaaagttcaaatttgaatagagccatgtgaataattaatagtcaaaaaatattttgtggattaagtgtatgtaaaaatgctacaacatgggtgaacctggaggacattatgctaagtaaaataacccaggcagagaaaagcaagtactgtatgatctcacttatatgtgggatctaaaaaagttgacacaacagagaatagaaaggtagttaccagaggctgaggtggtcgggatggggttgggggtagggggaaaaagagatgggaaaaggagagatattgatcaaagggtacaaagttttggttagactggagtaatcagttttagatatttattgcactacatggtagtcataattaacaatactacatatatatatttcaaaattgcaaaaataacattcttaccacaaaaaagataagctggtgagatgatggatggatatgttatttaacatataacatggaacttaattctacaatgtatacgtagatcaaaatatcacattgtacttcacaaatatacacaattatttgtcaatcggaataaattgtatttaaaaatacttagattggaaaaaaaaaagaaaaagaaaagtcactatggccatccctccatcccttatcccttctctcattgaaaacaatgtagagcgtgggaaagaaattaaaaaattttaattccttttaaagaaaagaattttccccaagatatatgtatcacttaatggcagctatttattgagtaattattacgtgtcagccacagtggtaacagatacttaatattcatcatctcatttaatccttatactaattatgtgagttaggtgttatcatcacaacaatattcatttaaggaagctgtgtttcagagagtttacatgatttactccaaatcacatacttaataacaggcagaagtggtaattccaacctaggtttatctgattccaaagactttgcatttaaccactgtactcagtggcaatcaaaataaatggaattgataagtgccagtgtaattgtggcatatatgatattttgattctttgcctccatataagaattcttataacattgacataaagaaatggctctctactgtaagacaaaatgttattaatggtccacagaacagtttatcatatctatgttctttttaacataaggttttgccctttcatctttaacattttttcaagtgtataaattttagtcatctcatttgggtccagctcaaatgccacttccttttttaaggtctccatgatattctccagttgaaagtaatttctgcaaattttgaacttccatgcttttataatacaacttactatctttaattatttttagtaggaacatatcatctcctccactaggcttcaagcttccggaggtagtgatctatacctaaattatgtctgtgtcttctctgtgttgagaaaacatttgtacgtgtttagaacaggcaacgacttagacaagatatacattattttactggctaaaattctacgttaaactacctatgaaaatatgaatatgttaaataaatgaaaaatcagtagaaaaaaattttagtaacttaaaaaaactatgttaaagcattttatatacacttatacacatcagttggtaactaccaatcattcttacatattcattaaagtaggcctttgggtatcagtattcatccaaaaccatcatttttctcacataaaataatttagaaatagaaaaataatctattctatattgttattaattcagtttagcttttttttttctggctcaactataatggcaacccacaccattagaattacatgtatatacgtgttacttttagatgtacagcactctagttcttacaagtttgatttgggtagttattactaatggtcaacactgattgaaatagttaccatttttaaaaatgcaatcaacttagcatggcatgcaaaaatcattcaatactttactcttgccttcctttccagactcatttcccataccttcctccttccctggtattctataatactagcaaagcaaattcctaacattccctgaacatgccattctccacatttctgcctttcagctccttttgttagcttcctctctccacattcagtactttttatagacttctattagtacttattgcatgtttttctccaccaccagaccagaaaattttcttttagcctcagtgattagcatcatgttcagcacgcagcatgtgtaggcgcgcgacagatgaattaatgaatgtgagcctacttaaaattccccaaactcaggactcatttagatatccaaaaagaacaaaccttcctttcctacctcctgctctttaaaacaagctttaaatttagcatggtatgctaagcatattaccttttcaagctataaaattataactatcttcatacttagtcctaattggtcattaaataaactcttttgaaagttctggcaacatgtatctgtccattattaaccctctgaggagctagaaatgcagaactatccacttcgttgcctataaaaacagatcctcaaattaaaaaaacaaatacatctgatttgattttctcccagtttataccaggtatattcctctagattttcatttaggttgaaaaatttctgtttgtaaacatatttgcctgaaaccactactttatggcccaggtcaattgcatggttaaataaacaaataattaagcatataaatgaagcatttattatgggtaatttaaattcaaattaaacatttgctaagaaccatcgaagtgtaaaacactatgcaaagagctttcacaatcattatgattcttaaccaggcttcactggccactatgttaggtttaaaatggctcaaatcacctgaaattttgtgctatatgatatgcaataataataatagtaataataacaattataatagttaacatttattgaagacttatcatttgccaggtactaagctaaacagtttacaagaattaccatatttaattttcactacaacggaaagggaaattgagacttagcgaagttatataacttgctgaaagccacattcttaataactgcgcaaactggaaaattaacccaaactgtttgacccactctccgtgctcttctccactatatcaatacctctgttttcctgggaaatgttcattgctttcattagtttctcaaatggtctgtgaatcaaaattgttaagaatgtctcgtaagtattcacttagtcactcttcaaaacatcttgttaggcagtatattatcgctgttaattgatgtggaaagtaagaccacataacttgtatgtttgtaggcttataacattagatacaatttcccttttaatatagcatagcacaaggactatttttcttggttgtttctgtaattgatatttagatatagccatggtagcagctgggattattctgttgctgactcgagttaccaggatatcctgaagtgttgtcatgtaatgacatgtcatgaaggcaaaacttgagcccttgtggctaaaccaaggcctaagagagaattctataacctgaaacgtactctgaactgttattttccatatttttaaagtactctcctgccaccggtgcctctccataacagcatatccacgttccacatgccgcaggaaaaaaagtattaagattatttctaaaaacgagcttaggcactctcacagtaaaagaactccattgttttatacgcctacaggataaagccccaattgtctcacctggcttatacactctgactcccatccacttctctgtgttcctttcccaggactcccctttatgaacactgtacttgcaccatatgggtctttgtagtatttttcaatgagtcacacagcttcagaagtctgcttttaatatacagtcccttccacctgaaatgttcttcttgactactactcatctggaaaactataactcattcttcaagattacattcaggtctttttctctaagacattcccaaactggaaattcagatgaactcctctctatgggttttttgttcatggcgccatgattaatgcttttgtcataccatacatgtaattgttttaagtagaagtttcaaatagaccacaggcctactaagagaacacaatcccttattcacctctgcatcatattattaataattgtcacattgcctataacatcataggagccaaacaagtattggagaaagaaaggaagaaaattagcaggtggagaagggaaggaagacttgatctggttcttaagactgaggtcatctcagccattgtgtcttctcatcaagaaaattattctccttaagagagctgtggttatgttatgatgggagaacacaaaacaccatggaaagacaacattgcatatataaaagaaaatgttcatgtgagcacttgaacgaatcagttttacaatcttagtaatttgagaatacagctttgcaactaatatttgtaagaaaactacattgtaaacatacaatatttttatttcctaagcatttccaccttatccatctcattgaattcatataatatcctcattattctgatgtaggtattttttttcttttttgattggtaaactaaggcatagtaatagagtgacaactctagccttattccttctctctgtcgacctacgacatgaatcctacaaacttttttactggcctactttgttttatcagagaataagccataatttcaaaaatctttcttccaaaacccttggatgaaaggaaaaaagaagagtgaatatccatggtcatgtaacctgattttgatctgtttatcagatcctcttctttttctatttttagacaacaaattagatattaatccagaatcagttaagtccaaatatgggtttgtaatacagagtgggggtgaaactaaatgaaactccaggagagcagatggatttagctattgttaagttaggaatggtttccaagaacattttgtatagtccaaattgtcttctgtatgcaatttattaacagttaacatgtaaaaagtggctaaattgttcgcctcattgctcctgggctttgtggcaccttctagtatattgatgcttatgaatgaatttccttttaatggtcaaagcttctataagattaaaaaaatatgcttcggtaaaatggtccccccttctttgcttaaaatcacaatagccatctgtgcaaagctgctattgtgttccaagcattatacatctactagtgccctttgcacagttctgcagaataggcctaggctttatcaggctcatattacagcagagaaaagtgaattcatagaggttaagtgacatgtccaagatgcactgctggcagaggtaagacttaatccttgaactttttagcttcaaaccactctgttcaacttgcattgctttgtgtggcttatgtaacagcaaacacaacattggaagcacctctgaatcataataatcctaaacactcaactttgggaataccacattgaaagtatttaacatatggcccccaaattaaatgtagcatgcactttttaaaaattacagacagaactgaagtcatcactgaaagaaataaagttactaaaataactggtactgtagaaatttataatagctttgtcagaaagcatggaatgagatttgaacattttgcatggaatggttttgtatcagcattttaaatataatctttataaattaggctataattacaacagagtacttaaaatttattacacacgtattatgtgattggtactattgaacaggaagaacacatctctgcttaaaatctacttacagtttagtaagagagatcaacacatatattattacttaataattaacatatgctgagtaatacatgtaggtgttttggaggtacagaggctgatacaagattgaccttacccttaaggagattgtaacatactgggtactgtttactgaaatgtaatgcttttccctatactaggctgtctgctccataaatactgctaaaaatggaaaaagaaaatcctaccagttttcaaataagaccactaccaatggaaatagtaacccaattttccttcaacgaacacttaacaattgtctttcatggtctccaaagtaagatggagagaaaacaaaattgaatgagtagaacaaaataaaattgaataagtagaaggtctgggaggaatgaatggtctggtaggtaaaaagtcacggaaatacgcaagaaaacatagggcaatttgtgctctgtcagaacaaagaactctatgctacttattataattactgaatcatggtttttgaccccttactatttgccatgcactgtgctaagcacttatgtatgtcgtctaatttaattttcatacaactcattaaatatgccctattattcacccaaatctatagataaaattggggcttagagaagttgggtattttgcccaagatcacacaccaagtaaggatttcaattaaggcagtaaaactccagaatgtagtttcttgaccttgactttgctgttgatagagtgtttagaggatcttccaaccagaaattcccctttagctaagttcgaaaggtgagcagtatatgccatggaagcaagaggcttgaggagcaaggaggtgagtggtgacaaaccaggcagaaaaaaacagtgaacacaaagtcaaggaagcaaaaacaagacagactgtcacttgttaagcaaacagaaggcactttgttatgtctaccatgtagacatacggaggaagaagtgagaaatgaaataatgttaaggatacatatggagaaataatgtgaaggatacatatggaggaagaagtgagaaagaatgttaaggagcctaaatttgagacctcttaccaaatgtcacattggtaagtaaatctgtaaacattatcttaatcctcaaaatttccaagtggcataggtattattattataataattttacatataaggaaattgaggcttaaaatattaaataacttgcccacattgaagggttcaaaaatattaaagagattgactcaggagaactaggtacctcagtagactttggggctaagggaaatagaggagttaacaataacctccaaatttttaccttgggcaacgggagagataaaagttatttctccccctgcctgtgtttatagggcaaacaaaagcatcacaggaacagcaagaaaaatacaagaaacctaatcagttaccaaggttttgtttcaaaaaccttaaggaactattgctggaaaaggaacatagtactgttttctgtaattgtttgactatagctagattctctgaggcagtataatcacaaagaatctaatatgacaagccaacatcttatggcataaacctattcatcctagccgaattagtatcccaatctcttcctaagaatacacacattttgaatacaaaacaacttaattcaggtgaacttggttttaatcaaattcagctataattattcagtttcatgaaacacaatcaggtaatagttacttttcaaaaactaattttttttagaaaaacacacaataaaattgtcttcgtatagtctttccaatgcaattatatggatttgaaatacaatacatttataatgcttacacactgagccacgaagtgtaccaggccttttccatgtattatctcacttaattatcacaacaactccttgaattggtactatcattatctctattttacagttaaagaacgaaagctttgagcctttatttttccaaaatcatttctgaagaagagtgaatattcaagcacaatcattggctcaaaaatgtacgtcattgacaggttttcacagtttttcttttcaaagtattttcatgataataagtacatattaatcatgcacacatcgattatgttacagctagatggacctagcaccattgaaaagcacaaggtgtatttgttttccacaataaaaagtaatgtgtttagtcatgacaccttttgaaaaaaacacagctaatttctatcaccaaatcacttttaaaattcaattattcagttcaattattttatttaatgtctaccatcaaagaagaatgcatcagtataacattaaacatatttcacttgaaattcttaattattctaaatgtgtctggggatttgacctgcttaacaaaaaatacacaatagttcttggatagggcctttgctgataagtcattaactaaatagatgatataaaggtagcatgaaggcagaaagcaaaatagtgagatatagccatctgatccgaactttaaattcatagtgtttgtctttcacatacaaaattatctcactttctctgtttctgatttcagactgcctgtgaacattgagctaggtactttacaagtattagttcatttccttcttacaacagcacaatataaaatatattaaattgagtcaacaaatgaagaaaccaaggtccagaaagattaatctattcgtccaattgctaaacagaaataagtggcagaacaaagattcaaacatctatgatttaaatgacaaaatacaatcgactttttggtataagtaattgtaaaatatacaattcataaaatctaatttactttagagtctacttcatcatatgtaataagtgcatatacttcgttctaagtttaattgttcttttatagcatatatccaaagatgtgtatctgaaaaaattaaacgttcttctaagtaagaaataagatacctgaaattaatgacatatataagaatccttttacatatacattgctttaaagatgaagacacagttaatttatgaaaagtcaactgaatatactgttgcgttttttttgtttttctgccacaattcatcactgttgaattcttacaggacattttaggtagttctgaaaatacattgttattcaaatgtttaaaaataaaatttcatctcttcatatgtatagtatgaaatagtcatcaatcttcactgcgttgctatttttaaaactcagaattttcagtcatcttctggtgaataaaatcccatagtctgtgatccattacaattgtctgcttgcttatcactaccctctgtgccccactctcgagctccatttccttccaatgtctttgcccagtattcaaaatccccaagtctcttcagacctcagctacacatctatattctggatttcttcttggaaaagtgcaaatggatagaatttgtagccaggcagctttgcataaggaagagtcaaagaaacctggatttgattcttattaactgtaagtgcttgggcatgttcctgattttctccaaatgttagtggtgtagaaatttacttaacttgaagagctagggtaaagagtagaaataatgtcgttaaagtgtctgatgcacaggctaaatataataactgttggctttaatttaactaatattaataaaagaaagcccttctaaataagccctcagacttgtccaacaacaggatgagctgtatggtgaggggaagagcattctgtcaccaaaatgcactgaagagtgactaatcctagactaactcaagcaaagtaagaaatgactgttggagttcttattccaacattctaaaagaattctcacctgatttggccctaacctagagctctgatgtcttgcttagaatctggtacagggaaagtactcaaaaaacttgctttctaactcttccattctgactatcttcgtctccctcgttttcctaatgggctgggtactgactctgctttctttcttgtttggtatatgcaactctaaaggactcttttctacctctttttgctttgaggtaattggaaaaagagcttcatataggatagcttccagaattcaagaaggcaaacctcatgcactcatgaaagcagtaaacaggctatgtttgggaaagtgcatgacctgagtctcaacaactttgggtcaaatgtaggctgtaccacttcctagcagtaagacatgaagaaaataaactcatcttagactatttattcatctgtataatgggctaataactacctaatatgccaatatgagtattagagatatatgctttgttaaacacttagggttagctcttatatataataggtagttaataaatgctacttttcttcctttactttctttgctattaattcctaacccagcaagaagaacttgggtgaaaccttacagtgttcattaaagacattatttgtacagtataaaacaataatatttattttataaattatagcatcaagagaaaataattactcaagataatttggagtacactgaaatcaaataggagtgtccagttcagccaacctcagaatacataaatgaatgctaagtgcaaaaaaaaaatgaacaaaaatagcaagcaacaaaagcagtcttcagtttcatgggcatgtaaaaattgatgtgtattgagacattttgagaacgctttctacaagatgttgaagttgcagaataaaattattctgtgacaaaataactgatcaagtatagctaaccaaaatatcaaggaaataaaaatttctacaaaatcagatcttattcaaacataacatcaagaatggcattgtatggtaacattacatttaaaaagtcacattattccttcatctcacatatttggaatattggcctaaatagccctacattccagaggagaaaacagagagaggtttgacggcttgctcagtatcactcagtgagtaggagtgttgtctggatttcaagcttggtctgtcttattttaacatcctcctccatttgtttgcacttttaattattatagaggacacacaacgtaacttgaacatggaaaagcaaagacatcctcactatcagttggtttctggctaccctgacttcttgcccaaccttgaacttgcagtgagccactgagggacatcctgccatcattccccagtctagcacttaaacttccaccaagacatatgtaccggtccttgatcctggattgtctccagtctctgctttccattctggctttcaggatgtaaaacagaaagccatagacaagaccagtcacacggctgggtgaacactgtaggtctaggaatagccactccaatgagaccatcctgtcttcctcttggatccactcccaatcacagttgacttagactttttctcctgttcacaggcacctgttcccaagccatttctcttacttccaatacattttttttttctgttatcttaacgttgcacaattccagcaagagagaagactatttcttctgtttcatgtctacctgaatttgaatctcagcccttctatgcattgtcaggtgactggataagtcacttaatctctataatgtcacacttccattctttaacatgagaactatgacatgatagtgtaggtacttctgcctttcttcattcaagttatcctttacttctaggaattattttgagggaaaatgcatgtagcatagcccctagctcagaatagatactgaatgcatgataggtcctgtactcccattctcaccctggatacttcttgtgggacatgtgtccttaagccaataccctactctctcagacttccaaaatgttacaattgaaagggaatttggaagtgtttgagctcccccaacccaggcacattttatttttctttttactgaaaagtaaactgagtccctgaaaatagaaaagatgtactcatagcagaactgattctgaaatcccagttttataattcctaatatttggcagcttccttcatgcccaacttgcagtgtcctcattgtcttctttctgtggctctacttaaagccccgaacagtgccttcatttgtctttgcagatgtatccagatcacaccttatttttcttctttatttctctaaaggttttctcaagtcatactcagctgtggtctctatgtttccccctttctgtcgaaatcgtcatccacaattttgttttcatcctatgaactctaatggaattaccaaatcccatgtttttctcaataattactctcctctgctgggccatataactgctttgttcatttccacaggcctagcacaaacctggaaaatagtattgaatacatatatttgctaaatgaacgaataaataaatcatcaataacatcagctccctgatccttgggatacttgccttgctttattcctgtggtactaaacctcttggtcttctgtgctatacttcttttaccctgcacctctcaaagctgggatttttgaccttgtggttcttgctacatgttctgcattctgacagcagtaacagtggttgactctcaaatctgtagctacagctttactctaatgtacttagtgctgtgtttcaactgggcaggttcatcaaccatgtgaatggttcactatcaccccaaacttactgtgcaaatggacttaaaatcaaattcttcacttacttctaatttccctagttctgttgacagaacatcattctttcagacctctggacttaaaatgtaaaaggtcttttgattcttttgttttccccttccttacacattaattagtcactaagccttgattatcctctcaaatatttccttttgctctgtctcaaagcacttctcactcttaacacctttaggcattctttgtgacctttctaattctaactcatcctttccaagtattacttctgcattgaaacctttattgacctcacagtttaaatcaggccttatatacacgatctcctatcatgtctttcccttctttctagctgttattgtatatctatttaagtcttctgtctcttccactatactataaactccatgaaggagggactacatctattttcttcatcattgccttctcagaaccttacacagtgtctggcatatgaaaagatctataaatacttgttaaaaagctaatgaattaataattacttatcgagataaaaaagtaaatgaactaataattacatattgagagaatcaactttttcctacagagatttcatgcctgatatcactttgtccttatagtattatcaaaacagggagtttatacttgtaaaaagtttcaccaaaaattcttaaaaataaaaaatgttttacacacttaaaaggggcttaccttattagagaaaaatgtgcttaagcagaatccacactctcattatgcaagatgaatgaagtgttcctatgcttagattaattgagtcatccttctttcaaaaaaatgaatatgctgtctttacaagaaagactgttaggttctaccatacaaatgaatcatggtttccattgtgtctactgtagtagggtttactaaatttctctgaagaaaaccctgagaccctgacttgctctaaatgatcaacttttctttcctcagattagatttgaacaaagccataggataatgaagatgatgatttctaccaagataagcagtgggtgctgaaaaaaagtgattcaacaaatgaagaaaacaaatatttaccattcatgtttgcaaggatcacacagttgcccaccacaaatacaccctctatgagataaacaaataaagctcaagtccacaaaatgccccacactaaactatagttttctcaaaacattagcatacgattagttacttgggtctcaagagcttgagttaagagaaaaaacaaattttggtaggtaaatttgataacaatgaacataagcaaactagccaaatcttcaattttgaagatattctcagtgaaagtgttaaataagagaataaaaatacattttttagactagaaatgtccataagagctcctggataatatttttagtgtcttcttagcttagaaaataatgctaaaactatgtagtgaagatatatatatatatatatatatatatacacgtgtgtgtgtgtgtgtgtgtgtgtgtgtgtatttatatatgtattttagggtaatacattccccagaatagcacattattatattgttttttcctctgttttaaataacagtaataacagcagccagtacttcttagcatatatcatattaactgcctgtatatttaatttataatctcatttaattcttacaatatgtgttttaatatgccactagtcttttcattttgcacttgaagacaagtcttcaggaagtttaagtatctttcccacatccctactgctaataaatggtaggagtttttaatccagatctgttgaatttgcaaactcacatccctacctctatgacactctatgttcacagatgctgattcttaaattataaggagtctaaatctgagttctgcaaagttttgttcttctgtaaagtatttaaaagaagaaacaacatttcacttcagagtatagttttcagagtttggcagacttgagtttgaagaccagcttagcccatttagctctataaaactatgggacgttatttattactctgggcccctaatttctcattaatataatgggactaccatctagacagtcattccttcatgtatacaacaaatattaataagcacctactatgtgtgaggtatcatactgaaaattagaggtaaagatatacataaataagagatagccctggccctcatggagtatacaacctaaattttctacatgtaggctcaaattcacaccaatataatgtttaaaaatatgaaaatatgaataattttactattcaaatggcttaaccattattgaccagagcttttcctaagtaattaattcattaattttgttactttcacaaagcactgacatttcccacttcttgattggttcttctagacagaaaccctgattaaagttgaatctacaggtagtaactagttaattcatatatatatatacacacacacacacatatatatacacattatgtatatatacacatatatatacattatgtatatacacatatatattatatatatattttaaatttaagtaggcacatgagcatgtacacatgtgcacactcatttctagaaaaggatttgaggtggcttgctagttaatttaagaacaaactttttagctggttgctcttagcaacagtctttagcagttctgcctagttggccagaatgatttcttaaagggaatgaagcattcaaagtagtttaactaacacatggaaaataaatgacttacttcagaaagacttacacagggactgggaattctaacgtagttgggatggagaagacaatggtgctgagaagccccctacacataggggaattttccagagatttccttcccctggactatctcatgcctacatgtctaacaaagccagaagaccagagcaacatggctgacaggttcctgtggcagcactggaaccaggcctcatcctacaaagtacaggaccaacccttcttaccagttctattgcaaatcattcagttctattgaagacactggaccatacatggattctatgtcagagagacaaaagctgcttattttataagcaataaaagcaaaacaaatcctttccagctggtatgaaactatcgattattttaagatggatttaaactaactcacaaaatataggttactatgggaattatgtttacagacattcatgcatccattcattcctcaccaagtacttatcaaccaacttctaggtctcagtcttggtgaccaagcgattcatttatttgttcattcaatatatatttatcaaatacctcattttccctctgctgtcatgaagtggagttcagtagaaattatatgcagataaaaatatcttaaaaatgaagtatgatgggtgtcattattcaacaggtccttctttgaaattaacactaggtctcaattgcctaaataattaaacaatagattatatcaaccattcattcaacaaacataataaattgaacttatgttgtaagcactatagcagtagctaggtgttctggatgttaagtcccagactctgacacctcatgatatttacagccttgtgacacttgagttcaatatgaaggaaagaagtccatgactccatgtgagcagagatgatacaaagtccagggatgtcttccatgaagagatgacacaaattgagtcctgaaggaatactattaatatttccttgatggcttccctccttggatagcgtccataccattgtaaggcactaggcaagtttagaaaaagatcaatactgtatttgctaaacaaacgaatgttcttgttggcaataagtagaatatttatatgcaatgattaaataatagcacaaggtgctaacacaattcagagccaaaagcaactatacagagagtgctttgggggctctgaaaagccagattatatacaaggaaagatttcaaactgttcaataagtcaggattattcaattgaaactaagcaactttagacatactgtataaatgatctcattaatattttctgagtgatacattgaaacatcttgattgaacacaattcaacatagaattagattaaatggaactgagtctgtgataggtaataaggatcttcaaaaccatcatctatgaaatacatcaggtcctgaacattaacacgctggtactgatgaaacttactttggaaaatctgcttctccagacagaaagcaagaaagtaatcttgacttgtaactagtaaaacaagtaaataaacaagaaaacagagacaggaggaaagaagaaaggaagaaaggaaggaagggagggagggagggacttctataaatctatttaagtctattcattatctcttactttgctacaaatttcattacattggcgctgaagttgctatacagttttccaaaactgcttcagagagaaactaagtaaacattgtcaattaaacgtaaatacaaaaagttaacctaacaactgtaaaggaagtctagagttttccagatagacctcttctctaaagttatatttaagggagacttgtacaccaatgccaaatgcttattcaaaattgcagaacacctagctgtgacagtgcaaaatgaaacatttcagattatcctttctggtcagaaaaatctgaaagttatcttcctgagtccaaagaatggaagaaaaaacatgaatgagggtctggcaacatccaaaaattggccagacctagcaaatatagctccccaagcgaacacctagagtctgaatactagtagaatgctgattaatctgagatcaaatctataagtgatttttatctgcctccccagaacccagaacatctaccacctaagctatctttacagagagataaagatttttatttttttcattcagatatatttgattctacaaatctcctctgtaggagaagtagcagggttttgggcacatgcaaattcttgctgagtttcctggcttgacactaaaagtgtaaataactgacatggaggtgtatgtgaaactgatttaactggaagtatcaaggtaatatccaggtcctggacttctgaagtggaatggaaaagaataaaacagaaagccagcagtgacttcaactggcctaactacatactcttatccattataagagtacaataggttgtattcccaagctaggagctggctgaaagaggtcagaagccagaggaaagaagagaccaatatctgaagtccttcagctctacttctgcccttatgatctgaaacatttgtcagccttcattgcacagatggaattttacctgagagtatgcattagctgagccctctgtactatgtatactctggctttcaagatttgactaggtaacatgcactcattttgatcatacaaatatataaataaaaactgtggggcaagcaccagcttctccctttgctcttggtagcatcccagaaatacataggtttagtgctttggaagcatggtcagtccccggaaaatgctcaaagagggacaaacaagaaaaatagagactttccctgggctcagagtcagaaacctgggcttaaacccaagtgccacgactttgggcttggtcactttgggcaaggtatagccaaatttatgtataaacatgaaaggaactttaatttggggccatctagtctagcccccaaatagttctttgatcatctgaaaaatattatggagaaatggtcttcagcctgatgtttgaaccttactagtaaagagaattttcatcttaatgtgccttagtgttctcgtctataaaaatatctacctcatagagatgttgtattaagggataaaagataactagtttacgaaggctttctatataataacagtaaacattattttaaaatatgagtgagaccaagattgagaatactttctaaattgccagataaaatcattacaaagagataagttctgtacacagcaagcaaatacacaatccccatttttagtctcttaaaccttatgaccactttctctaagaccgtttttgaaattcaatttagtacttctagtggaagaacaaaggtgcagtttgcatattctgggtttcctatttatctacagccacattttttttttctttgcaaacttttcaagataaaaattttaaaccccagagctctggaagatgcttgctctcccttcagccaaaacaggcatccggtttctacaataaatgagatcatagcatccccactcatactgctgtagctaggaacctgtcagcatttttattataaaacccttttctttcctctggcttgagagaccaaccatagcaatttgttggggaaatagctacagcaaagggcaatgcacaagtacagagagaaaatgtctcattttacaaaattcaaaaaaggtgtatttaggaattaggcaggcctgcagaatcccaaggagcatttcttttggatggtcatctggccttttaaataaagaaaataaagtttactaatatttaaaacaaaattttctcaggcagcagatgttaggaaaaaagttgtctagttgaataccatcaggcaccaatacatctggtaacaaaagctataataacacacacattactgaatctgtgctcacatggaagctgctgtgagggaagggagcattctctatcagactctgaagtgagataatggggatgggaaaggttatgccaactacttcaaataggagaaaataggatatattaataatatgctagagatgataaatgaaaccttatctagcaaagtgatggcacttggtgaatactcagcgaaggaagattgaatacagttaatatatggtctggttgacacagttaactcttttctttctcactcctgagtcttgggtatgaacatgaaaaagcttctttctaggttatttcatactatgttaatgcaaataaaagtgaaaagagaaaggactacatctgagagagtaagagaaagaaaactaatatttatttaatgattactacatgtgagacattgtatttgttgctttcttgtttggttggtataacaaacacattaaatatatcttatctatgtcatatagatgaagaaactagagctcagagaagtgaaagagcttccccaaagtcacagagctaatggttcagtcacaatactttgcagtgccaaactctaccctcaggacttgcttcttacatctatgtttgcctgcccaagagcatacacagagtatctttgcttggtacagagggtagaataggatatataatctcacattctctccccctcttcctccctttctcctttcccacttctatccaaggggaaggcacaccttcaatgccccactactactttcaacacttctcaagaagtgttggaccatagagatcaattgtagacttgaatagaaaatcaaattatttttcctttctgacacagtacaaggctttaaaaaactgagatttactctgactaactcctaaaatccttctctatacctaaagacatcattggttctcttgtcttctcattatctggagcagggccttcaacttactgaagtatgagactacttttaaactactgtatgggccctcatctgatattagttgtacttatgaagagagagtgtcacatagcaattaataacttccaaatgaatagcgtatagattaattttgaatagcatatagattaattcatgtcaagtccttagaataaaacactgtgggtggtgatcacccaaaaagggttagtccaatctgctttgtgagttgtttttcccatgtacatttcttagtactagctcaccagcaaaactgaaaggtccccaaggcaggaactattttaccgtatttgagcattaacctgaggtgcccactataatgttaaacataatatatatgctcaagagagaactagaaattgattaatggacaagtgtacctacatttctccaaatggagattttcaccaaaccataatgaggatacttgagacatggctccaagagaaaaatcgaagtctcctacccttagataataagccaactgacatgtgagtagctgccatcttatttgagaacttataaaataatatcattattatttgataatatgatagtatcattatttgccatatgatgcagtgatatcattaatccctgcctggtttaatccataatgtggatattaaggctgttacagtgcactggaccagcattttagagataatgactgtttttagtgtgctcattcatcaaactaaataatttaaactactttaggaatttggaaaaaaacttcaataaagataatacatgaaaccccatcaaaattatgtattttatattaggaattacacacacacacacatacacacacacaaatggaagtttcaaaaatattaccttatttataagatttccagaagccatcattcaggatgctattgttattctatctgacaccatcatttaaatttatatggaaaaaatattactgtgttctttataatcactgaaatatataatgtgttcataagtctgacaagtacattcatatatatatagatatatatatatatatatatatagagctgaaaaaagcattaaagtagttttaaatgttttctactatttaaatgttttctactatggtgtctctggaagtataatctgtgacttacaataaagtaaatccataaccttatgaggaaactattttaatttcaataagatcaccatggcatggagatctgattgcgtttatgatttatcagcttctctgtaccttactagacaagaatggccaattagtgatgacagagccaggcatctcaccccagatactagctgcattattcagggttctccaaagaaacagaaccagtaagagagagagagagagagagagagagagagagagagagagagagagagagatcgatcgatctagctatcctcccccaccccctcccccaccccccacacacatatgaattggttcccattatcacggaggttttgtcccaaggtcagcagtcagcaagctggagaccccagagagccaacatgcagttccaattctagtctaaaggcctgagaactgagaaagctgatgatataagttccagcacaaaagccagcaggctcaaaacccaaaaagagccaatgcttcacttcaagtccaaaggccagtaaagatcaatgcatcagctcaaagcaggcaggcaggaggagctccctcttactcaggctttttgttctattcaggtcttcaactggttggatgaggctcacccacattagggaggacaatctgctttattgggtctaccaatttaatctcatccagaaacaatctctcagatatacccagaatgatatttaaccaaatgtctggccagtcaaggtgacacataaagttaaccaccacatcaaggtaccacattaagtaatgcctagtctttatttcagggatcttccaggcattatactaaatgaatataatatggctcctgcccctaaaatccctacagtttacacgggcaaatggataagcaaacagaatttacaattgaatattacaattaggatacaattattaagtattacatgccataagagtccaggggtaatttaattcaaaagatactgggaatgatttcaccatatgtactttatttaaaactttccctggatatccataagtgagtacaaggcaaaaggcttcttaaagtctgagctctttcagtattctgaattgtacaattcaatattccctttctgtgaacatactttattggtggcataaaagttaaccctccttatttttttatattcaacgtttttctctcaaattttctaaaattaaaaataaaaactgtaaaagaccttgaagtggcaagtatgtattgtcaagggggtcaaaaggtcaatgcagcctgcttgtttgggacattcagcacctgtttaactccttagctcatttttcattttctctttctgggtcaggtataatctaggatttttgtttttggtatgaattatataaacttctagattcttctttttgtagcattagaagccttcaacaacgtgttggtaggttaaaatacctccaatttactgataggtgaatttcaaagtgtttgatttaatactacccagttgactctatctgcaatctacatcttctcagcaatatgtaaagtagtttaataaaatagaaaaaaaatccacttattttatagttaccacataccaggcattgtgctaaatgttttgatatgtgatctatcacttaatttttacaacagtcctgaaaggagggtgttatttttccaacttcttgcagataaaacttgtcagtttctcttttctcaccttgatttccaaaacttctagttcagagttagaggtcatgacgtagaaagaataacattgagttcgaaactagaagacctagttgtagccttggctgtgtaacttgctgtgtgaccttgagtaagtcatattctatccatgtgatttaataacctcatgcagaaaatgatagtgtgaatactatgagaaatgatgtttggatcaaactcctctcaaaagaaattcttgtacaataaaactgactcctctcatcagtgtaccttacattcaaattcaggtgtgcataaatgacatttttgcaaattgactcatagcttaaaggcacttaagcatagaatcctgctatttgaaagagtacaaaattatattggaaatgagtgtatattccaaatctaacctgcttaggttcaaattttggctctgctatttaagagtgatatgactttgggcaaattacttaaaccacctgcaccccaatttctctacctgtaacactggggtaaccagggtaactactatacccatctcaaaggggcactgtaaagattaagtgagttgacatttctgaaaacactgtctgacaactggtagcaggtcagtgtgtgtatgtattgagagagaaactgaagtcttggcaatgtaaatagctgtctccttaatgtaccaattttgaacacttggattttttgcatattaggtatttttgaggtgatacaaagcaatatagtcgtgagactcctattaactcaaagtctaacagagttttaacccgattcacaggagaaaaactagactacctcttatttacaaatccataaagtaaagatgaagaatgtgatgacatataaagtagcttgcagcaatataaatttatataactatgattaaaataaatgcagaaatacccatcatcaagcatcttaaattattttttaaaatctgacttagtaattttacttattctatcctatccaaaggaaataattttaaatccaaaagagacttattccccaagatgttgattttatttttaatagtagaaaatttaaggggaaaaaagccaaaatatcaaaaggatggttaactgttatacagcaattaaaatacattcacaaagcctaatataaatttaaattattcaaatgcagactcaacatgattacaactacacttttaaaataagtcatgtataaaccaaggaaaccaaaatagtactgggaaactaggaaaatacacactaaaatattaagtttttacatctagtcctctgaaacaaaaagtattttctaaagtttgttttttgaatttctgtttttttctaatatatttcaatgaacacatgttactataaaataaaaaaaaaacatataccaaaatggtcaacctttggcaatattcaaaataggtaaagggaaactaccctgctagtgacaaaaaatatgcataatgatatatgaattgatggctcctctgctaccactaatgttttacaacaaagttggccacatttaaataaacaaatgggcaaacaaaactacttctctgccacagagactgtctaggcaggaaaaaggggtctgggagaggtggagaaaggcagaaggttccagggaactgtccaccaaggaggtgctgacaggccctctgatattgggtgagtgttagagcaccctctggaggctgggagcccacaacccatttcctctttctctttctctttctctttctctctctttctctttctctttctctttctctttctctttctctttctttctctttctctttctctttctctttctctctctctctctctctctctttctctctctctctctctctctctctctgcctccccgccccacccaagactttcccttcccatctttcccttcctatcattctgttctattttctttccttccctgctccttcttctgtttgcctggtaactacggagattggaagaaataacactggtaaaacacctaagatactgtatatatgtttaataaaaccaaattattttaccccttccttttgctgttttagtccttgaactcatccctttcttcttctgattccctcccttttttatttttccattttcttccattttaaccttccacttactctccctattctctcttttgtgagagtcaccctgtagaagaaaggtaggttgctttctagaagatgactcctttcctttgagggttagggcagttacaaaaggtccaaatactcaccagaaaaaaataaaatttcaggactctataacattttcaaaaactttcccctatcttaatatataaaaacaatattgaagatacctgatgtgtcctacgggcttcacagtggttcagttgagctgttatattaacaaattgctattatgagaaagaaagaggtgctcaagttttagccatgtttcttttaaaactgtaaatattcaaaatatacaacataatgttttgatatagtgaaatggttactacagccaaactaattaacatacccattatctgtgttacactctgtgtgtgtgtatgtgtgtgtgtatgtaagaatacctaaaatctactctcttagcaaatttctggtatacaatccaatattaactatagtccaaacactgtacctgagatctctaggtttattcattccacataaccgcaactttgtttcctgcaacccacatcttcaaatttcctcccaatctcccataaccaccattctactgagtttgtatgtgttctactttttttttacattccacatataagtgaggtcagcagcattttcctatcttcagtttatttcatttagtttaatgtcctccaggtgtatccatgttattgcaaatgtaaggttatccttcttttcaaaggttggataatattctaatttatagaatagatataaatgtatctctataaaatagatacatgccacaatttcttcatccatttatttgtcaatgaacacttaggttgtttccatatcttggctattatgaattatttaaaatagtgttgcagtgaacatgagaatgcagatatctctgtgagatgctaatttcgtttcctttggttatatatctaaaaggggattgctaggttatatggtaattctatttgtaatacatttagaaaccttcacactgttttccataattatcacactaatttacattctcaccaacagtgtacataggttcccttttctccatacccttgacaacactggttacctcttgtctttttgataacagccattttaatagtatgagatgatatctcactgtggttttgattctcattttcctgatacttaacgatgttgagcacctctccttgtacccactggccattttaatgtctcctttgaagaagtgtctatccaggtcccttgtgcattttttttaacataagccatatttcaattacatcttccttttaattaaaatagtaaagcaaaggaataattgtagagaatactgtaatttataaagtatttttagaatattaggacaaataacaaatattcttttatgtttgtatgtatttttatcttagaaatattggggaataaaagaagggagacacacacacatggactgtggacctttgcaatgcagctatagacaagataaaggaaagagaaatactatataggctggcccttgaaattaaattcaatactttgatctttgtggatggagaaaacagttaagtgaaggtaaagttgatgcctattttctgataatgacataaaaactactatgacaaagaaaaaaaccttttagaagacctccttccccatggcaagcccattcccataaatagccttgtaggtgtgatgatggcatatggacaggggcaaaaaaaaaaaaaaaggtaggggggaactgatataatagaaaatctttttttttggaagaaggttattttggtttctctcatgagaacttaaggttagatgggactgtaggtgatctgtattttaataaaagaagtggaattacttcctcaataggcttggaattaatttctggaataaatggtgttgtacttacgtttgtatctctaatgcccatcataatgcctagcatggaaagacactccatgtttacagtcataagtcgtatagtcagttaactaaattgaatagctctcaggatgcaacaagacggaccctggagatggctaagtgacaaaagaagataacttttgagtgtctagcttgaaagctcaaattactcagcatccttgaagccattctgagataattagagcaaacagttttagtgtttttgaaactgacagtctggcctacccatgaaaatggttttagactttgccatgtaaataactttcaggaaaggaaataaatattcatcctaataatcttattttcacacttagtaggtaatcttgaaatgactgcaggtttctgaagtatccttattgaaatctgtgtctccatgattttttcaaaaattatttaaatcccattttaattactaaaagattcaatgaaaatccttattttatatttttttcttaaatcaatattgtaagaaatgtaatcatctgccatatcacttaaatttgagaccaaagggaacaagagcagtttattgctatgcctccagtgtgtagaatttctagtgtggtcaataaatatttgctgatcaaatggaataatagtataatttgttaattaattttcataaatgtacttcattttatgaatgtcatatcaatatataaatggttcctatattttacataaacagcatagagcaaagaaaaataactttgggaaaagtaatgattgatttcttaataaagatgaagaatttatcaagagaactatcttaataacagtgggagcagtttctcctataagtaataagcccacctcagtgaagctatgaaaataattaaggccatataagcaacaatcatttgatgaatttatacatagtaagtactgcatgcatctcatttaactgttatttctcacaatgacatagtaatatatactgcagtagttattgctgtggccactttacatatgaagaaactgagacttacataaatcatatcaatagtaagtataaaatttagctttgaaacttaagcctgtctgtgaggtaaattttgcatattattttctgttgtcatctgtcagataatgttgaagaacttcactaggaggaaggctacagtagaaagtcccaatactctttccatatttaagattataagatagaatccttatgtcaacccatctataattaaccttctgttaagtatggttataatataataattgatcccattataaagggatttgagaattatcttattcaaatactttgcaaaataagatgggttagagtctctaaaagcattattttattttcacataacattaatttatttttcaaaaaacgatgtctgcaaacacacatgacataggtgtttcactctattgacatgaatctctctcataaagtgaatttgttaaatccgaataccaaaaggaagagaacataaagaaagttaaactaatgtatttccttagccttaaaaaaaaaagtgtgtgcttgaaattattttaattccctccaatatggtttgaaagttaggggaaaacctaacagcataaaagaaacttgtttgtaaatgaacttgaagggtcgaatgcatattcaacaacattctctacaccaatggcttatcttatttgattattagcttgtgtttaatttcccttgacaaataattcacctttgttaaatatcatttagcaccgctaagtaattcttgtaagttcatgggaatggattttaaacagtagccattgcaaggatgctactgtaaatgcagttaggagagtgaataaaagcatgaggtaggggtggcaggttgtatgggagagaacctaactccttagttattggtgctattcattcacatacatcttcctgacagtgatgaacacacaaaccttcaacaattctaagatctcttcggggtttccaaaggaacaacaagctactctttagtatgggcaatatattttttaaccaaccctacagtgtaacctatcatattgagtagaaaaacataaatctctggcaataatattatcattcaatgacttcatgaaagacataaccagagattgttagagctggcaggtgcctcagagataatctcatccacagtcctcattttacagaagaaaatctgaggcccagagaagattctctaggcatagccaatataagacttaaaatcctgactcccaatttttccgttaagcttacacctcctgtgagcactatccatgaagttcagtgtgtgtgtttcattaactttactgcctaaggtgcttaccagctgtccaatccaatctctggtgttatctttcagaaaaataggaattatgtgatatacattcacttagagaagtcaaacttcagttatttcagatgaagaaagctctctctctttctctctctctctccttagacagtcaccatagtagccacatgaagtgttttatataaataagctggacaaatccactggcttttcacaacaaaaagaagtgaagacttgtaacttacagtaacaggacatgcactcaggccattaatgggctaaaactgttcaaacaccaagttctatgcatctttttcaaggagtgcgtcgtcaggtccaacaaggaagcaccattaatatatttcagaaaaggagcaatgaatgataacctgttttaaaaaccttcaaacctcatttctctgggaacaccaatcacctttacaaaaatctggggtgggacagttatttactacaaacttcactgagtaactgcgccacctcttgataaaatttgtttgttgatttcaagtggattgtataaaagggaaaagcatgcaactgggggcaacctgagcctagctccagattttctgtctaaaataaaaataagctgtttatcttaaaaaatgtcagtttatctagagttcatcgaccaccccacttactcctgctagttagcccagtgggttggggctctaggtggtagtaacctgagatgagttcaggagctcccaaattagcagtctggagcccagtcactagctaaatgcataaggagatcccaagcagagagccacccaaggtgccccatttccgagctgcatctgctcttgtagcctctgtatgttagagaccagggtcccatcaccattgagttatgagcccaacatcggacgccagaaaatcagtgcgatctcttggcccccaaacccagctggctcccagaaagagcagagcagtcgcagcttctgtcactctcccaacaggcagacataaacaagcaacagaaggaattgttctctcccccgagggaggcaacatgcattaaaaagacatgaacctcttcctaccttgcatccaaacatcaacgataaagtgttgttggtgcaagcaactttgcagtggcaaatcattggtgtaaaacagtcagggtccttaacaacaggggacattccttccgggctgcggcagtggcagctcgctgggggacccaaacgctgtgctcgccgggcacatggagcgacagcctagaccgagctgccgcttcgatcactgccccctgcacccgccgtggccatcccggagccccggtggaagcaacgccgcgggcaagtaccgagcctctcggggtctcccttccctggggaacgaggcgtgtggggggagggacagaaccaagaaagaatttttccccctacggtgaatttgggggaggtaaaataaaaataaaataaaataaaaataaaccataaaaataaaaggaagccaggcacttagaggagggttcaaaggaggtggggcagtattagcatgtaaaaggatgtgcccgcctactctccccagtcacacaagattgtcatgcgagctgaagggggctgaaattattccctctgaagaagaagaagaagaagaaaacatactgcagctcccgatttggtaaaaagccagtggcttgctgcaatccagagtcactgtggggagcgctggccgggcaagtggggtgggaggaaggggctgagaaagggaggaagcgctgtgcttgccagactggccctgcctttgggcgctcttggtgccacgaaggagtccccagcgtgggagcgcgggacctccccgcgctgacgtgaccccgagactgcatttggcccccaccgctacagccacccgagggtagaagacctccgaggccgacttcccgggaaggggaggcccgctcggagcgcggcagggaacttcctcccagccctttgacaacagcatgccttgccgggggcagagggccagcaaagaaatctggggtagaaaacaggctcaaaatgatttcgctggtgccctacgaggttgacttctggttcagcgagcctactcactccctgggtagggaagcggcctcagaaccaaggctttatttgacataacatttgtcaaactcaaaaaagaagtgtctgccccttccccaccttgatgtctttgagactccaggaaaccccagaagtagtatttatgttgttccagaagtatgaatgacaagactgatggatgttttattgtttgtttgtttttttgtttttaactgaggctgtcaaaattgcagaaagaccaaaaaaaaaaaaaaatcagcatgtggctggctggcacagctgcaaaattgcttatggaagacaaaaacaaatgtgataagaagggtgtgggggtaggaagtgggtaaaactagcactctttgggtgccacctgggtgcctggcactatgcctcacagatggttggtagaaagagagcaaaacatccgagtttggaaacagattctggctctggtgctagatgtggctttgtgtaagtcatttacattatccaaacccctgtttgcttacctgtaactagatggtattaacccctaacctaaagggttgtcaggaagactagacagatatactgaacaacacattcctgtggtaagccccagtacatggtagctgctcttaacttacatagcttatttcatttcttagcttcagaggtagatattatttgacatattttttttctaggggaagaaactgagccccttagtgttatatcacttgctcaagtcacataatcaataaacctgaaggttaggttcaaagaaaagtagtagaggagagtttagaaaacagcatcatgagagacataacacacttctccagaaacatgttccaaagtcttcagatttatttgggaaggaccaggactgtcacatttacatgaatgtggtaattccaagacacttaacaatttggtgctaaattcagaaatcccacctgaaatacaggaacaacatagtcaaaagtatccatggcaaactgttagaaccacatcctcctgatgcaattccatcagaatgtcagaccacctatatccgaaactaataagagcctcaatatcatggtatgcttcctccttagaaagtttaaatgtattggttagaacaaaagaacataccaacttgtaaacctttaagtcaaagacagtgccttataacatgcctttgccccacccatatccaaaatactctcgtcccttctcccaagttaatagaaaataaacctgattatgtcataattctctatgatgcttattataaatatggattatgaagcccaaccctacattttcatcccataggccagtagaatgtcaataaatctacattttaatcagcccccttgtgagaggaatgcaagtcctctttatgaaataagacttatctgaaggaaactcaatatggaacaaagtatgagcaaaattcaacacggaaagaccctcagagttgagttacacctggttctaactgtagagggcagccatgcctaaggttttgggattcttacactaagtgcagaagtccttgcctagtagatttctccattaggaatcagtactgattcaatctaatgaatagctggagggactcaggaggtctaatctatacgttcttaaatgtactaggtcacattttaggagcaaaactctggtctgaggccttctgtgaaaatttaaagtcaaatgtacagattaagtatatcctttaccattttattcctttatgttagcataaaaagtgtgattgtgtgagcactcccacctacagagcatctataattacggctggtttttccaagagaatagatcctaaaaaagctgtacaacatttcccttattcattagcctataatttggatttcaaacaccccaaaagtattgtatgctccatattgtgatgttccaataatatctaacacagtctttccctgatgaattacccaagctaaagctgacctcctattctagggcagcattaaggctgctatgtgcaagttattccccattttacagtttgtgctagtttagattgataaagtgaaatgacaaaatataaaacaaaatgtatatttcatttccttgactttttatgtttaactttaatcagtgagagttcatttctctgtatgtgcatgtgtatgtgtttatctgttatccgtttatatgtattagagaaaatgctttcccttaattctcctctccaaataataactctggggtaaattggaggggaagatgagggggaaagtggtttccatgacaatgcattccatagttacagccagtaaccactattattaaaataaatgaattactgttaccttaagataccaacacattgcattactggtttgaaaagcactaatttgagagtgtactgcatgggggtgtactgcaatatttttaggagatattactaggaaatgcaaggagatgacgcattcatttttatagtcaaaataactactcttaattagacctttcaatgattgataaaatttacagttcttcctaataattatcacttttataaaatgatgcatcacaacaatacactattaagcatttctcctaatgacaactttcctcaaaatggactcataattacaaaaaacaggattatcaataaatgtaaccaggttttaattttgatcttgtatttattattgttatacttaatcagaaactgggacacagtaagaggcattagctagttatgcatcttttttctttgctgatccttttcatagcaatttttaaaaaaggggttgttcatgttgcgagggaaaagaatagattggctactaggagccatggtgctgtttcctactctctgcctctgtgtgactttgagcaagctactcagcctctctaagcttcagtttccttttttattaagatgaaataggtatactagattatttctaagtttgcttccaatgttgaagttctctgagtgatcttctaaatacatttttatgaatgtaaagtaaatttgagaaaccattttgttcagttacctatcttcagaaaatttgctcttctataacacttactatttgataggcactaatatcatgcttgctatgtacactgttctgaattccacagagtgctagagccaatcctactcatgacagctggttgtgtgtaactcggtctaattccacattcagtgacatcatgctagtagctttgaatcagtcatgagagaatatttataccatgtaaactaacaaacactacaattcaggacttttttctgcaaaaaaccttttaccagtatagcactggtctaagtactttaactacattaatatatttaaccatcacaatcactcaatcttaccaaaaaaaggaaagcaaatgacagggcgagattaagtaatgcccaaggtaacaaaattggtatactaatcagctaaatgaaccaactaacaaaaatatttttgatgactttcaatcacaaatgtttatttcttcctcatgttagatgtccttcatagcttagctatcattctagcccatgttgtccattggcagaagagtacggtctatcagtagcttctgtcagatagaagagtagccactatctaatgttctcatggtggaaggaaaaatgatcaatggctgaatatgcagcagatcttaaaacatctgttcagacattaaaaacatcttccagcttacattttattagctaaggaatgtcatgtggtcaacctgatgacaaaggttggggaatgataattctttcagggggaggaaagagagaatattgataacagtaatataagagactatggcttattcgagtgacagaattgagatctgaagccaagccacctgatttgaggatctaaggtcttaacaaatagactatcccagctatcactaatagctaatacatcccaatttttcatctactctctataatagtgtttgttatttagtaactctttgagagaattcttccttatgacccctataaggaaagcatagtttttagataacacatgaactttggagacaatcaaacatataaggttttggcattattagctgtgtgatttcaacctttaaatccctttccctctcctctcctactgtaaattgaagtccacttatttcatttaatctttagtagagatgttttcatgtaagtggaacattgcatttttatcattgagtttcctgaaacatgtaaggcagagagggatatgaatgtctttctgccatcaatgagtttacaaaccagttgactaggttactctgaaatgagagtaacgaagctcttcctaacagtaacaaagtatatacaattaagaacgaacaaatatactcaaagtccatacaaatgattgaccaatctagttaacttatctaagctaccatttcttgttccgtaaaatggtgataatactatagcattgctataaggcttgaatgagataacatattgcaaaatgcctgtcatctttatctggtttgtattagccactcagtaaattataaaggctttgtgtcacttgtctgattttttttttaatgaaagttaacagaaaagaataaacctattagactcacccaatatgtataatctctttatactgaacaattctaaatctttaacctttcttaacaagttttactgtctcagtgactctccttagaccctttctcagctcttccatactcctcttactgaagaacacacaaatgcaatgatacattctcagaccccatataaatggactctaatatgcatcatgttcccccataattgtcaaccctttgtgttcactgtaatttatttattattattatactttaagttctgaggtacatgtgcagaatgtgcagttttgttacataggtatacacgtggcatggtggtttgctgcaaccatcatcccgtctcctacgttaggtatttctcctaatgctatccctcccataccccctacccccaggcaggccctggtgtgtgatgttcccctccctatgtccacgtgttctcattgttcaactcccacttatgagtgagaacatgcggtgcttggttttctgttcttgtgatagtttgctgagaattgtggtttccagcttcatccatgtccctgcaaaggacataaagtcaccctttttatggctgcatagtattccatggtgtatatgtgccacactttctttatctggtctatttttgatggacatttgggttggttccaagtctttgctcttgtgaatagtgctgcagtaaacatgcgtgtgtatgtgtctttatagtagaatgatttataatcctttgggtatacacccagtaatgagattgctgggtcaaacggtatttctggttctagatccttgaggaattgccacatggtcttccacaatagttgaactaatttacactcccaccaacagtgtaaaagtctccctatttctccacatcctctccagcatctgttgtttcctgactttttaatgattgccattctgactggcatgagatggtggttttgatttgcatttctctaataaccagtgataatgagcatttttcatatgtctgttggctgcataaatgtcttcttttgagaagtgtctgcttatatcttttgcccagtttttgatagggttgttgccttgtaaatttgtttaagttccttgtagattctggatattagccctttgtcagatggatagattgcaaaaattttctcccattctgtaggttgcctgttcactctgatgatagtttcttttgctgtgcagaagctctttagattaattagatcctgtttgtcaattttggcttttgttgccattgtttttggtgttttagacgaagtctttgcccatgcctatgtcctgaatggtattgcccaggttttcttctaggatttttacggtcccaggtcttacatttaagtctttgacccatcttgagttgatttttgtataaggtgtaaggaacgggtccagtgtcagttttctgcatatggcttgccagttttcccaatgccatttattaaatagggaatctttttcccatggcttgtttgtgtcaggtttgtcaaagatctgatggttttatatggtggtgttatgtctgaggcctctgttctgttccattggtgtatatatctgttttgcttccagtaccatgctgttttggttactgtagccttgtagtacagtgtgaagtaagatagcatgatgcctccagctttcttcttcttgtccaggattttcttggcatttgcaggctcttttttggttccatatgaactttaaagtagtttttttttccaattctgtgaagaaagtcagtggtaggttgatggagatagcactgaatctataaattactttgggcagtatggccattttcccaatattgattaattctatccatgagaatgaaggtttttacatttgtttgtgtcctctcttatttccttgagcggtggtttgtagttctccttgaagaggtccttcacattccttgtaagttgtattcctaggtattttattctctctgtagcaattgtgaataggagttaactcatgatttggctctctgtctgttattggtgtatagaaatgcttgtgattttggcacattgattttgtatcctgagactttgctgaggttgcttatcagcttaaggagattctggactgagacgatggggttttctaaatatacaatcatgtaatctgcagacacaatttgacttcctctcttcctatctgaataccctttatttctttatcttgcctgattgccctggccagaacttccaacactatgttgaataggagtggtgagagagggcatccttgtcttgtgccaattttcaaagggaatgcttccagtttttgcccatttagtatgatattggctgtgggtttgtcataaatacctcttattattttgagatacgttccattgatacctagtttattgagagtttttagcatgaaggggtgttgaattttgtcaaaggtcttttctgcatctattgagataatcatgtggtttttgtccttggttctggttgtgtgatggattatgtttattgaaaggcatatgttgaaccagccttacatcccagggatgaaaccaacttgatcgtggtggataagcttcctgatgtgctgctggatttggtttgccagtattttattgaggaccttcgcatcgatgttcatcaggaatattggcctgatattttctttttttgttatgtctctgccaggtgttggtatcaggatgatgctggcctcatgaaatgagttagggaggattccctctttttctattgtttggaatagtttcagaaggaatggtaccagctcctctttgtacctctggtagaatttggctgtgaatctgtctggtcttggactttttttggttgttaggctattaagtactgcctcaatttcagaacttgttattggtttattcagggattcaacttcttcctggtttagacatgtgagggtgcatgtgtccaggaatttatccatttcttctagattttctagtttatttgcatggaggtgtttatagtattctctgatggtagtttgtatttctgtgggatcagtgagggtagcccctatatcattttttattgcatctatttgattcttctctcttttcttctttattaatctggctagcagtctattttgttgatcttttcaaaaacccagctcctggattcattgattttttgaaggtttttttgggtctgtatctccttcagttctgctctgatcttagttatttcttgtcttctgctagattttgaatttgtttgctgttgctttttagttcttttaattgtgatgttagggtgtcaattttagatccttccttctttctcttgtgggcatttagtgctatgtttccctctacacactgctttaaatgtgtcccagggattccggtacattgtgtctttgttctcattggtttcaaagaacatctttatttctgccttcgttatttacccagtagtcattaaggagcaggttttcagtttccatgtagttgtgtggttttgagtgagtttcttaatcctgagttctaatttgattgcactgtggtccgagagactgtttgttatgatttccgttcttttgcatttgctgaagcgtgttttacttccaattatgtggttaattttagaataagtgtaatgaggtgctgagtagaatgcatattctgttgaattggagtggagagttctgttcaccgtaatttctaagtcctctatgtccactcacctatccccaagtatagactactttgagcgagtcacacgtagtgactgcttggcctttatctaagtcatacttagaatgtttgcatgaccttgacttgaaatagttttcttatttagctgattagtcaataaatggatgaataaagaaccaataaataagtgatcttggccaggctttccactgcttccacctaggccctaggtgaaatattgtgaagatctttgagtcctgacccagctcccctccctgccacctcctaggtagaaggagtacactctttattgaagaaatgccagcctattcgttctgaatcaattttgacattttgttttagcaccaagtgttttttgaaataattattgtcccctcacaattttgcctttgagacttctcatgacagtcactttcagccttgtttccattttgaaaaagcaactccgaaacactaccctctacaccacctctgagaatattcttagtggcaaaattcaaataaaagaagaactcttcttaggcctcattgttcaccaaatttgatgtcaatgttgaaatgataaaagttggatctatgttccagtcccagtttggacacttgctatgcaattctgagttagttacttaatctgaaagttaattttcttaagtacaaaaaaaggggaggaggttgttgagtaataatacctctgtcacagggttcctatgagaattaactaaaatgccacatgtaaaagtacctatcaaaatgcttggcacatactattaataaatgcttaataatatccatttgtccactcactgattcttttattcattcattcattacacaccaaagctagccaagaaacttatttaaaacaaatgtcaaccaagcacagcaaaattcctgtgaaatcactaattctatttttatattgtgttgcccatctgtgaaacaaaggcaaattgatcattgtcaaaaaaatatactaaatcagagttcaactttgaaagcagcaattcatgggaagactgacaagaacatggctcattttaaatggctttatattgccactgtgtggttctctactacaaatagattttccttatcagctccctttcatctgaacaatagatggctcttctagctgcatgaactaaatgaggtgtcttacatacccccaggaacaccactctattatgtcacaagaaggggccctcagctaatcatacagcaagttgaatgattactcaatgaaacaattcctcccctaaaactgtgaagacatcagatttctcatacaatctccagctatgtatcacagatttaagataatgatacaattaacactttttctgttaatgagctgcaagcataatggttcaagtccctgatggtaccaaattttaagtacagcccacctagattcttatgtccagtttgtttaaaataagattgttataagaaaattaccttttggtacagtgtgtgagttagttgtattacatgaatgctggtgctttcttcctttaatacaaggactgtcaatctcaaatgtaatgcattggaagatgtgcattgtatttgctttagttagcatctgatcatggaaaaactttgcttggttgacgacgttagcacattaactttatctcccccttttggttactaattacatactttgaagtatctactatgtgctagacactaggccaagttcgggatacagtggttaagtacagatcaatgcagtgctggcctcatggagattacaaaccaatggagaaggcagatggggataagtgcttcgaggagagctacatggctctataagagcatatataggggaatctcatctaaaaatggaggtaggaaggcataattaggagagtgataagtgagttgagataagaaaaataagtgggaattaactagacaaacggaaaggggaaaagcatctcaaatagagggaataggatatacaaagaatatgtggtaccagcaaacaagaacatgggaaggactgagataaacgtaatacagaaaataaggggaaatatcaagtgaacagaggctgaagaagacagtagaggtgagactagtcagattatatttaaaatgtttgttcttattctaaaagccttaggaaactacagaagaaatattttaaagcagatttattggcgtagaactgacataaaataaactggaaatatttacatttaaatctggtaattttcaacatacgtatacatctgtgaaactgtcaacataatcaagataataaacatatctatcaccttcaaacgtttccacgtgcccctttataacctctacccctcatactctttcccaatcccccatcccaaagcaatcactcatctgctctctgtcactaaagatttatttgcattttcaagaggtttatataaatgaaatcatacaatatgtgtttggagtctgaattttttccactcaacatatctattctgaggtttatctagatggttgcatgtgccaatagtttacttcttttcttattgccaagtaatattacattgtaaagatatattacataatttgtctatatttgttgatgaacacttgagtcactttcagtttgaagttatatagctgctacgaatatctgtgcataagtctctgcatgaactgatatatttccttttcttctggaatggatttgcttgataacctgatgaatatgtgtttatattttaagaaactgttaaattgattttcaaagttcttgtttcattttacattcccaccagcaatgtatgagaattctagatccttcacatcttcaccatcacctggtattgtcaatcattttcactgtagccattctaatagatgtgtaatagtacctcattatagttttaatttgcctttccttaatgactcattgtgttgaacatcttttcatgtggtttttttccctgctatctttggtaaagtatcaattcaaatcttttacctacctttaaaattgttagtttcttcttaagttttgagagttttatgtatatatataaatatatatttattatacttttaagttctagggtacatgtgcacaatgtgcaggttgttatgtatgtatacatgtgccatgttggtgtgctgcacccattaactcgtcatttacattaggtatatctcctaatgctatccctccccccacccaccccacaacaggccccggtgtgtgatgttccccttcctgtgtccaagtgttctcattgttcaattcccacctatgagtgagaacatgtgatgtttggttttttgtccttgcgatagtttgctgagaatgatggtttccagcttcatccatgtccctacaaaggacatgaactcatcactttttatggctgcatagtattccatggtgtatatgtgccacattttcttaatccaatctatcattgttggacatttgggttggttccaagtctttgctattgtgaatagtgccacaataaacatatgtgtgcatgtgtctttatagcagcatgatttataatcctttgggtatatacccagtaatgggattgctgggtcaaatggtatttttagttctagatccctgaggaatcgacacactgacttccacaatggttgaactagtttacagacccaccaacagtgtaagagtgttcctatttctgcacatcctctccagcacctgttgtttcctgactttttaatgatcgccattctaactggtgtgagatggtatctcattgtggttttgatttgcatttctctgatggccagtgatgatgagcattttttactgtgtctgttggctgcataaatgtcttcttttgagaagtgtctattcacatccttcgcccacttgttgatagggttgtttctttcttgtaaatttgtttcatttctttgtagattctggatattagtccctggtcagatgagtagattgcaaaaattttctcccattctgtaggttgcctgttcactctgagggtagtttcttttgctgtgcagaagctctttagtttaattaaatcccatttgtcaattttggcttttgttgccattgtttttggtgttatagacatgaagtccttgcccatgcctatgtcctgaatggtaatgcctaggttttcttctagggtttttatggttttaggtctaacacttaagtctttaatccatcttgaactaatttttgtataaggtgtaaggaagggatccagtttcagctttctacatatggctagccagttgtcccagcaccatttgttgaatagagaatcctttccccatttcttgtttttgtcaggtttgtcaaagatcagatggttgtagatatgtggtattatttctgagggctctgttctgttccattggcctatatctctgttttggtaccagtaccatgctgttttggttactgtagccttgtaatatagtttgaagtcaggtagcatgatgcctccagctttgttctcttggcttaggattgatttggcaatgcgggctcttttttggttccatatgaactttaaagaagttttttccaattctgtgaagaaagtcattggtagcttgatggggatggcattcaatctataaattaccttgggcagtatggccgttttcatgatattgattcttcctatccaggagcatggaatgctcttccatttgtttgtatcctcttttattttgttgagcagtggtttgcagttctccttgaagagttccttcacatcccttgtaagttggattcctaggtattttactctctttgaagcaattgtgaatggagttcactcacaatttggctctctgtttgtctgttattggtgtataagaatgcttgtgatttttgcacattgattttgtatcctgagactttgctgaagttgcttatcagcttaaggagattttgggctgagacgatggggttttctagatatccaatcatgtcatctgcagacagggacaatttgacttcctcttttcccaattgaataccctttattcctttctcctgcctgattgccctggccagaacttccaacactatgttgaataggagtggtgagagagggcatccctgtcttgtgccagttttcaaagggaatgtttccagtttttgcccattcagcaagatattggctgtgggtttgtcataaatagctcttattattttgagatacatcccatcaatacctaattgattgagagtttttagcatgaagggctgttgaattttgtcaaaggccttttctgcttctattgagataatcatgtggtttttgtctttggttctgtttatatgttggattatgtttattgatttgcgtatgttgaaccagccttgcatcccagggatgaagccaacttggtcatggtggataagctttttgatgtgttgctggattcagtttgccagtattttattcaggatttttgcatcaatgttcatcagggatattggtctaaaattctcttttttgattctgtctctgccatgctttggtatcaagatgatgctgggctcataaaatgagttagggaagattccttctttttctattgattggaatagtttcagaaggaatggtaccagctcctccttgtacctctggtagaatttggctgtgaatccgtctggtcctggacttttttggttggtaggctattaattattgcctcaatttcagattctattattggtctattcagagattcaatttcttcctggtttagtcttgggaggatatatgtgtcaaggaatttacccatttcttctagattttctagtttatttacgtagaggtgtttatagtattctctgatggtagtttgtatttctgtggcatcggtggtgatatcccttttatcattttttattgcatctatttgattcttctctgttttcttcgttattagtcttactagcggtcttatcaattttgttgattttcaaaaaaccagctcctggattcattgaatttttgaaggatttttttcgtctctaactccttcagttctgctctgatcttagttatttcttgccctctgctagcttttgaatatgtttgctcttgtttctctagttcttttagttgtgatgttagggtgtcaatttgagatctttcctgctttctcttgtgggcatttagtgctataaatttccctctacacactgctagattcaaacctatattagatatatgttgcatatagtttttcacagtctgtggtttgtcttttcattcttatcagtgtcttttgaataccagaagtttttattattgatgaatgcaatttattattttttcctttatggttcatacttttattttcatatctaagaaatctgtttaacccaaggtcacaaagatgttcttctcttatttcttctagaggttttgtagttttacattttgagcaatgatcaattttgagtaaatttttatatatgatatgaggtatggatccaagttcatttttttgcacatgtatatttaattgtttctgtattatttgttgaaatgactatcctttttccatttaattgtatgtctttgtccttatatgtatggtttaattttggactctccattctattaatctgttttgccatctttccaccaatactatattttggttactgcagctttataataattattgaaacaactttgttcttctttgatctccaactttgttcactttttttttcagagctgttttgactctcctaggtactttaaattttcatacaatttttagaattaacctgttaattctacacctacaaaaatttcaactggaattttgattgtgtggaattgtgttgaatctttagataaggttagagagaatgaacatcttaatgatactgattcttccaacctattagcaaagtatctgtctacttttaaggtctttaattttacttaattttactcagcaatattctataatttccaatgtactgatttttttcacatatttcatcagatttattcctaagtatttcatattttatggtattctaaatggaattcctttattgattttaatttctaactgttgttagtacgtagaaatacaaatacaaagtttgtatattgtccttttattctgcaacattgctaaactcacctattagtctggtagctttttaaatagattctatcagatatgacatgtcatctgtaaacaaaaatgagttttacatcttcctttgcttctttttctttactgattatgctggttaaaacatccagaacaatgttgcacaaaagtagtgaaagtggatatccctgttcctgatcttaaggggaaaacattcagcctttcactaaataatgattaaatatgatgttagctataggtttttcacataagtttcttatcatgttgaagaaattcccttctatttatattttgccaagagtttttgttttgttttgttttgtttttagttaggaatagatattgattttgtcacatggtttttctatgcctgagatttttttaggtgattaatatggtgatttttgaatgttaaacaatcctgtattcctgaaataaagcttgtttggtcatgatatattataattttagtgtactactggattccatttgctaaaatttatttagaactttttccatctatgttcatgaggggtattagtctgtaacattttttattgaaatatatttgcctgtttttataccaaggcaatataggcctcatgtagtgagttggaaggtattgcctgctcttcgatattttaggaatgatttgcatagaatgggtgctatttcttctttaaatgtttggaagaatttaccaaaaccaaactatctaggtcaagagagagagaaagaaagagacagagagagagagagagagagagagaatgtgatgtgtatgtatttttgtgtgtgggaaggtttatgtaaagtatttaagcaggagtgggggatgtgatattatattgcatttcaagaagatcgtatagctgtagtgtggtgaaggattggaatggaacaatattgtcagtgggcagaacactgaagaggtgctctcagtagtgcaggcaacagataatggtgatacagactagagaaacagcactggaaacaaagataaatagttcaactcaaggaacatcttagaaagtgagtgaaagtgatacatattgggggtagatcagatatgggggaaattcagtatgacttctaggtttctggtatacataactggataagttgtaatggcattcactgaaatatgatatactaaaaagtaatatagtgtttgtgtatacgtgtgggatggaggaggcattattccgtttggggattttatttgtttgttttgcttgcattgtaaatttgatttacagtgcttttggtaactctaacttggatacattcctctagagcgcagcgtaaactgggttagaaatataaacttatgaagtgtctgtcaataggttgtgttaaaggctcagaaataggtatcatccatcctgagagaagagcatcacaagaaaaaattatctagagtcagactttgcagaactccagtatgtaacaattttcttttttttctttttctttttttttgcttgttaaaaaacatcaggaacctatttttcttagtagctactctgttgattctgcttaacgatgacataatatattctttttcagtaatgtatataccctctagatttggccttagttggtgccagagaggcagcaaggtagtgagataaaataaatattgcaaagaaaaaagaaatctaaggacataacaacaatatgtatggttcttacaatttgctaccttcttgatttcaatatactaggtattctgtttcattcctttgtttctcaatagacatacacctcctatatgttgctataaaattattatttttgagatattaaaatgttagtggatgccactatacaccaattggaatggctaaaacttgggagtttaacaattccaagtgttgatgaggatgtggaggaactgaaactcccctacattgctggtgggaatgtaaaatggtccaaccactttggaaaacagcttggcatttcttaaaaatttaaacataaatgtattgtacaacacagccattgcatttctaggtattcaagagaaatgaaaacatatgtctacacagtctgcagcttttttcataatatctccaaattggaagcaacccacagatacattaacaagtgaatgtataaacaaaacaagatatatatgtaaaacctcagaagtattgttccaattgaaaggcatgaaactgtgcatattgtataaatcattttacatggaaatatataaaataaaaatcaatatatagtgatataaagtagatctactgcttcctaggcctagaggtagacagagggaagggataaaaagaggcatgaggaatcttggggtgatggtaattatctggaactctaatgtggcagtggtttctcagatgtacatgtctatcaaaacagatcaaatttacatcaagttgtatatttaaaaaagattcattttattatatgtaaattcaactcaataatatagattaaatatcttaggtggtttaaaactcaagaccaaagaattacattaactttctaggtaaattactaaattaaacaccaatgatagagtttatttttttaatcaaagtaactcccaaatcaattttttcctaaacaagtgttattacatgaagtgatgactccctactttgttagaagatagaattccacatggggctcagttttctagaactagaaaatatttaccctatgtttgccaagatcactcagacaactactgtgttcactcctatgagcactttacctgagttttaaaaaatattttatatcactaggaaaagatatatctttaaaaatggaaagctgctagtgaggaaagcctaaagttttagagtttaaaattgagaaatattgataaggcagtaagtatatgattgaaacataaaactacctggctaaggaacctgggactttcatttgactgttgattagaatttccatttttcctcacatctgccagaagatcaagggaagacaaactaggtgaaggatgtagccattttacataaagcagtatcaaaacaatatagtagtatgcaaaactatctcacctctatgggcattgaaacttatttgaataatattttatttatgttaaataactaccctgtgatcccaaagtttaatttagtacagtctcctggggtcattttacaggatctgatgaagcggtccttgtgcccaggccccagctaggccctagagtccattgtcttgggggatattaaccagattctcagcctcacaatgactgtgtctactctgtatttaccctaacgttcagaaattgggaagttatcactgctattagtttccatggcatccactagataaaagaaggaaggttgcaagaaaggaccaaagtaatagaaaaacagttaacattttactggagtgccaaagggaaatggctgcagtacagcaggggaatggaaaggcacctattaattggaagcccccgggggcagcatagaggcacccagcttctgcagccccatctccctccttccaagcagatcagcacaaaggcaagagggaggtcctcctgagtgaaaaaggtaaacagaataatcccatcaggctccattgccactggatatacttacaatccttactacagaagaaccccacagttcttccaagccctgagcccagctgggagagatgctggaaattcatgcagctgtattgcttcaaattaggaggacgaggtgtagatgtgctaagccctacccagccactgtgggccaagctgcagcaatacagttccatatagagaacaaagccgcctctggagtgcatcctcctctggaggccagtagctactgcacctctccaacactggtgctccatcttcattccaccaatcccacaccagtggctgaacaccacaactccagcggtgcagagcctgaacccagaatcaactgtgactgtcattttgcacagcagggaaaccaacccctgccacctgcacttccaaccagaggaacagtctggcagtcttacccagggcaaagccaccctgagcccgccaatctgtttcacaccctccctgagtgggagaggttcttgagccactgagtagatgacacatccccaggtcaacaaaatggctatcaggccatgcccaggttctgagaaacagcctcatggtgccctccacaccactgtgggcatggccctggccttcacaaaacccacacacccaaaatcagggcatgagaagcatccccatggactacgcatggcagatgcgccccaggctgaccaaacaactgtgtgcctatgctcttttttttttttttttttttttttttttgagatggagtctcgttctgtcgcccaggcgggagtgctgtggcgcgatctccgctcactgcaagctccgccttccgggttcacgccattctcctgcctcagcctcccgagtagctgggactacaggcgcccgccactgcgcctggctaattttttgtatttttagtagagacggggtttcaccgtggtctcgatctcctgacctcgtgatccgcccgcctcggcctcccaaagtgctgggattacaggcgtgagccaccgcgcccggccgcctatgctcttaataagagtaacagccccatgattccaaccccactgagacagaccccaagtgggccaacctactgtgtgtatacacgtacccttgatctaagaaacaacctaataaatccatctctggcaaagtcacaccaccaccaccaccaccaccacaaactctctcagcctagaccactgagatactcacaaacatcactagtgtgaattacagctgaagaaaccacataaagactaaactatggcacccacctagaaccaaagctaatgcacctactgaaccaacacctcgtctaaatgaatatctttccctatgaaacccactccataaattgaaagaggtgactgttccaccagacacgtataagttaatgcagggccacatcaaacaccaaaaagtaaggaaacatggtatctctaaaggaacacaataatcctttagtaacagactctactcataaggaagtatataaaatgaagtaccagaaaaggaataaaaaataattatcttaaggaagctcagtgagatagaagagaatacaaatagacaattcaacaatatcaggagaaaattttaggatttgaatgagaaactcaacaaagagatagataccataaagaagaaccaaacaggaattctataactgaagaattcaatgaaataaaaaatacaattgagagcttcaacaaaatactagaccaagcagaagaaacattttctcaacttgaagataggtcttttgaaataatcacaggcagacaagaaaaaaaaatgaagaaagcctatacgatttatggggcactattaaacaaatatttaccttctttgcattccagaagaaaagggaagtggtatagacattatattcaataaaataatagctgaaaacttctcaagacttggaagagtcatagacattcagatccaagaagctcaaaaaatcccaaatatattaaacccaaatatgttctctctaagtcacattgtagtctaattgtcaaaagtttaaagacaaaggaagaatttcaaaaacagcaagagaaaagtgtcaagtcacatataagggcatcaccattagattaacaatgaattactcagcagaaaccttacaggcgtttttcaaaagacttaattttttagagcaattttatattcaacaaccaaattgagagaaaggtacagagatatcctacatacctctgtccccacaaatgcatagcattccctattattaacatcctcaccagaatgttatatttgctacaactgatgaacctttattgagacatcataatcatccgaagtccatagtttaccttagggttcactgttggtggtgtacattctgtgggtttggataaatgcataatgacaggtatcagcaattattgtatcatatagagtaatttcactgcccaaaaaatcctctttattttgcctattcatccctttacctactccaacccctaggcaacccactgaactttttactgtctctatggttttaccgtttccagaatctcatataattggaatcatacaatatgtagccttttaatattggcttcctgtttccagtttttacctattatgaataaagctgttgtaatttttttctttcaaaaaatatatactgacacatatcatagagaccctagtagtgagctcttaaataattcacaagatttattcactttttaaacgttttactttgaaataattataaattcacaggaagttgtaaacacagtacagagaagtactatgtttactgtaccatccacccagtttcccctattagttatattttacataactatagaacaatatcaaaaccagtacattgacattggtgtaaagagagggaacagtttatgttattcctaaaaactcccaggaaagaaaattcatatctattaacactgttacaactcttaaagatactaaaaatcaagaagttatctattgatttatagttctgaaggatctttaagaggccatgtagtataccaaccatctttagtaagaatttttttttgcaattaattattcctatttacttatattctgatttggctatcaacccatccatccatttagcattcattgagttctatgacacttcagatattaaactataagctaaggatacaaggatgaataaaacatgctctgtctctctaaagaatttacacactagagaagacaaagagtcatgtaagctggcaacttacatgacgatgtgagaaaagagttgacagttaatatatacattggggtcttgggaaggagaaataatttgctatatggataagtctggatgagtttcaagtagagaatgacatgcgccaagaaagtctaacatactgaaggaaagagaattttcttttctttttttttttgagacaggctggagtgcagtggcacgatcttggctcactgcaacctccactctctgggttcaaatgattctccttcctcagcctcctgagtagctgggactacaggcgcctgccactgcgcctggctaattttttgtatttttagtacagatggggtttcaccatcttggccaggctggtcttgaactcctgacctcgtgatccacctgtctcggcctcccaaagtactggaattacaggcatgagccaccgtgcccggccggaaacagaagtttcatatggttgaatcacacgtttctctctgggaggtgaagaaactacaggttggttgggtagattttatccaggctaaaaagtttaggttttattgttttgtcattgtatatatagaagagccctgaacaacaacaacaacaacaaggacatagcccagggatcttcaatgagctactaaatatattgaataatgagaaaatgaatcacattctctgtatatctaataatacataatttctatacatagaaataccttagattgggcaaaccttttaactcttgcacaatgcctttgaagtgcaggtggggctataaaatataggccttgtgacatcatcttgaatgttttttcttatgtatcatgctgtggcaaatttctgcatgaaagaaaatctgaaaatttaactgacaaaaatgtaaactcctgtgtgaatacagcttttcaggaagaactcttcagttctgactgcactaattagggaatttaccgttctgtgtcctcaaaaggattaggcagcacttttctataaaaatactaaacataccttaatctattttaaaattgaaatactaagctaaaatgaaaaatgcagaagcaaagtcaaattcccacctgaggtaatgtttgaacattcttattttcaactaataaaaaaggtacatggagtttctcagaaagctttctcccacagctggatacaaatacaaaacacattgagaagaaagacaaataaataagtctgatgggaagctgtaaagcccacctgcatttttaggaaaggaagctactaagcatgaggaatttttttgaactacgaaagtttctgctctccagatcctgaaattaaaagtaaaggtctaaaaaaaaaaaaaaaaaaaaagaaacctggacaaatcacctccataaaacacaccctcctcatcttttaaccaaacagatatccaaaagatttctcgcaccaagcactgaaaactaggaataaaggtgaaaaaaaaaaccctgaaaatactaatagttataccgacagttcacatattagagatcactattcttgaatccatgaaaaagaggggctcctagccctctactcaaaaacaatgttttcttactttacctataatttatatgtaaggttcatgatatggtttggatctgtgtctgctcccaaatctaatgtcaaattgtaatcccaaatgttggaagtggggtctggtgggaggtgactggatcatggggatggtttcttataaatggtttagcaccattctgttagtgctgttcttgtgataatgaatcagttctcaggaaatcttgtttaaaagtgtatagccctgttcccatccttcttcctggtctggccatatgacatgtctgttcccctttcacctcctgccatgattgtaagttttctgaggcctctccagaagccaggcagatgctgctgtacttcctgtacagcctgcagaactgtgaaccaattaaaccccttttctttataaattacccagtctcaggtatttatttgcagcaatatgagaatggcctaataacagttcatattagaattctaagcccatcttagattaaaaataaaaggcgggatagctcctctataagcaattataaagagagcaaggaagaatgaagtaaaatataaacagcagcgataagacttaaaaaataagttattacagatcagccatcataagatcaaatatttatcaatccttgagtaatatctgaggacatcattacatgaagtggctaaaacataatccctatgctttaagaaaacagaacatgatgaactgcatttaataaatattcccattcaaaaatgaattgaaatataaaagtttatgtactggcaatatttagcccttagctatctgcaaaccttagctctgtggaatggcttgctcctcaaaaattccaggtggattgctgaaccacagttcaggtctataaacattaactgactgactactatgtgccagaagtgagaggtacaaaaatggatgatatattgtttctactctcagggagcttagaccgtgtgtgagataggcaaaaagcagacaattataacaacatattttgacagctgtgggcaaggggtcactgggaactcagaaaaggagtgcttagtcaagacttgagaatgaatggaaatctgtgaggaaagagatggaaaacaacaagatatgaaaagaaaaaaaaaaaaaagaaaagaaaagatcagccattctatttatttcttggattccagaaactgatgcttcaaaataattctttactactgaataaaggtgacaattaatatgctgtattattttacatttgaaattagcaatgaacttaactctgttcttggtctttatttcagcttagtttagacttgattaaaaaaaaaaaaaggacaggattttaattacagagttagaaacgtgaagttaaagttattttgcagggctgtagccttagacaagtcacttaactctgaggctcagtttctatatctataagatgaggctaatgaaaagaatgagagaaggcagagtccaatgagttgttaataataaaatgttatatatgcaaaaggatcaattttattacttattttccagcctgggaatgaaggctattttgatgttttggttgcaagatacagaaaagacaataattcaaactgcttaaacaataagaatatttgttgaccacaagcactaaggtcattattctaaagagttcgggcccacttccctgccaatcttttgccctggccttcctctgcatggggatggtgtatcctcaggaaggtagtaagataactgtggcagttctagacttcacctccatgtgcaacaaggaggttggcatatagaaggtctctcagaagatcaaatccaacttttcccaagaaccccatggaaattcttcctgcattttatagatctccaaatgaatcacatggccagtccagaaccaaacactggcaaggcggatagcattaaccttagacaagtcaggcttggagtttgagtaggcaatgtttctcctaaggtacatgggttttgtagttgaggaataaatacttgtacaacaagttctgtgaggaagaagggaggggacaaatgaatgatgaataggcaacaaaaagcattccccaaagctataaaggtatatgcaattcccttttttaatttttttattagaaaacaatattactagaaatattggcataacttttaaattatatacatattcatacatattcacacaacctgtatacataatcagattgaaattacagtaaaaatacacttaccatgatggaactaaatttcagctattataccaaaggaaacaatttagtaattttgaggcagaaaaaaaagcatgggctttgttgtctgacaaatatgagtttgaattctagttttgtaataaactagatatgtgatcttgggcaacttagagacattccaaccctcttcacagtaaaatgagaataaaattagttaacatattgaattgctataagataaaataaaatgacataatatgaaaatacttgtccttgcactaaggtactgaataattattagttcatgtctcacgagctgcctttttttcctctatccctagtgctccaaggtatcagtttagttcaaataattaaaatctaaaaatattttatggtacatacttcttatatgtgctaatttaggtgctgggtatcgtaaatggttagaacgtgattcttgtcatcaaaaggtttttgattgaacacatgacacagatgtctgaatagtcaacttgacaacaaaacagaatagaaaagttctgcgcctaatagaaggagacaacagccaggccccacttatctgcacttctagactagacaagtcattttcccctctgtggccgagtgccatatttcctctgtgagcacaccatataggctgccattcccctgttgctacagtgctgatgatttgtctgcaaccagtttcctgtggtttcttgagtagaatcaaagacacctgacagggcaacatctgctctcaggctgtgcagctgcagggctctcccatttggataccaggacaggaaatcatgtgtgagaaatctgctctctttttcagagacaaggtgcattcaggaggcctgccaactagattctctacaaaaatctgctgaggcccccaacatgccaattggtcttcactgagaccttctgaataacagacattaatgaaccagaaatgaggaagacttgggccctgctctcaagtagctcataatcacatttatgttcattacaggatgtgtaccaataactacataatgagaagttgaaaatggtaaggtgataacattttcatttgcacagcactgtacaattttatatacttcatttcctttctcttgagatatgggcatgtatttttggatttatttattaaattaacttttactgagcccctactttgtgctatcagggaatataaaaataaatacgctagatattcatttgcttatttgctaatttatttgtatatgtccttccaaaagcgacctaaaacataaataaattttggtcctttattgctgagagatgaggacaatgttattcttggtttgtggtagagaagtaaaggttacgcggactgtaaattaagtcatcttggtatatttggctgcagggtcttctgctaactcattgttctctcttttaaaatacttggctactaagaaggctatgagaggttacacaaagattatcttccttcagggaagctagaacaaatttatggtagaattcccattagcctgaaagacagaggctgggtgttatggctcacgcctataatcgcagcactttggaaggccaaggagagagaactgcttgggaccaaaatttgagaccagcctggacaaaacagcaacacccaatctctaataaaataaattaagaataaataaataactaaacaaataaatggaagagagatggtagagaaatacttgagatgatctttcaagctttataacccaccctcccttatatgttcactagcctcagtcaactagaatttttttggtctttcagtaaactctgatcttccctgactccaggcttttcttcaaactgtctcactcacctgcaatgtcttcctcatgtccaaacaaacaatctaaaagttttctacacagttacagtgaaaacacattttgcaacttctcaatcaaatcaaggaacagacctgattataactgacatctagaacctctatagccacccctgggatataaatgttatcatgtgctgccataacaacgttttggtcaatacaaactgcatataagatagtggtctcataagattataataccatattttactgtaccttttctatatgtatatatgtttaggtatataaataacattgtattacaactgcctaccatatgcagtatagtaacatgctgcacaggtttgcagtcaaggagcagtgggtcataccatgtagcctaggtatattgcaggctacaccatctaggcttgtgtaagtacactctatgatatttgcacaacagtgaaattgcctaatgatgcatttctcagaacctatccctctcgttaagtgatgcatggctgtttttgtacaatttctattttaaaaaaatatatataaggaaactaagccttcagagttagttcttcccagggagaaagttaatctcaggccctttggattccccctgctgttggtttcctctacgtgtttagcactatagtagcatgtcctgaagttgaatcaatgtaaagcagaattttcacagtaatccctgtaaggcagagattattgcctgtttttctcacctgctatatccaaaatacctagaagagtgcctagcatatagtaagttctcagcaaatatttgtgttttttaatgatttcagaatttaataatacatttctatacaatttggctcctaaatatatgccacctttttcatttgccgcaaagaaccactcacttgttccaacagtaaaggaagactattagatttatttaaagatggtagactttgctctgtactttttttttccttcaatttttatgttaagttctagggtacatgtgcacgatattcaggcttgttacataggtaaatgtgtgccatggtgatttgctgcacagatcatctcatcaggtatgtattaagcccagcatccatgagctcttcttcctgaatatttgttgaatgaattattaaatatttatttaatcaaactgatttctgtatgtacaatgaggaagataaaaagtgaggtttgaagtcggagtctgactctagataccacaactttgttaagatttgaggtttggcataggcccgtacatgtttttctattgctgagtttagaaagaaaaatctttgtttaaaacattttccaaatttatttttaaaaaaataaatatcatatataaattatatctcaatgtttttaatagttattgaaaaaaactatataccaaattatactcttatgttcatgacataattaactctgctgagagagtatacatttctgaaactatcatagtcatcatttcccagttttattacatggatcaaggtgtttaacataggctgtttttcaattacttcatattgatacaaagttgaacgacaaaccatagaaagtcaaggatttcaaatcacatctggaatggatactaggatgatatgtgtaatttatgatcttaccacctgattgactgcaaaattgttaagaaagattccctgaggtaatccaatttgtttttagtacctaattaacacttcccagtggtttctggatgggataattgagaaatgtaatgcttataagattgaaatcaggcattgaggtatcctattaagtcaagaatttacctgttattggcaatgtatttaactgatggcagagacagcattagaaaaaaagaatggagtagatatttaggaaaaagaagacaggtagctgaattatttgcacttttagaggaattgatggcaaatacatgttcgactcttatatcaaaattgcatcctggagggaagaatatacagacttaaagttccaagtcagaaaggatgaatcaaagagaccatgggagagatagtactaacattaattaagtgactggatcagatactgttctaataagcatatgtgctttatctcacttaatcctcaaaagaacaaatatgaggtgcatatatcactatcttcattttttatatgaagaaaccaaggttcacaaagcttttaagatttcaagcagcaagaaggtgacagtgattggtattattgtaaaaactgtaggcattatttatgataatttaggagtgcaaaggccaggtacaaaccaaaaaaaagtagcttggagtggtagttctcactctctttctctgtgtggtgacgtacatggaagaaatcacagcattcacatacagccacaatttcctgggcatcctcagatcacatgctgcagcatagcaaaaatcggctgtggttaacatgcaattctatgaacactacaactcaagaaagcacatagagaggtaaaagaacttttattttcctgatatccttaaatcaacttgaatttgttttttaagtaaataagtgcttaattagcaacaaattgcaattgatcacaaggcagtaatgtgtagcaatcttatgttttaaagttgcctagaagaggttaggatgccaggtacaaaattaaaaaccatggattggcaaagaaaaaattagataaactgatttttctttccttgatttgagtggtaggttacaagcatagaggatgcagtagctctcatttactttgttcttagcaagtgttgtactatttcacactacactcttctccagtagcaaggtaacagggaatatcttggctgaaccactggaaggtagaagatggccgagtccagggaaatattcaaaaactcaaatcttccactgcccagttcagtgaaaaggccatcttatgtcgtggagaaaacatggggtttagaatcaggtggtttgtattcaagttctttctgtcttgcttgcctggctttctagccttggatcacttaacctcttcacttcactttccttcattcacttaagtatgtttattgaagacctactatttcctaggcatggttctaggtgctgggaatatagtggtaaaaaagacaaagttctgctttcacagagcttacattctaatgaaagaaacagccaaactatgaagctgtaactacttacataaaatattaggtagcaatatgtgctgtgaaaataactttttaaaaaaactgtagcagtgtaagaagagagagtagaaggatgtatgtggactattttattttattattatttttttatcattagaaatacatctgtatttttaaatccaaaatctaactagataacatggctgcttctttggttttctttttcttttttttttttttttattatactttaagttttagggtacatgtgcacattgtgcaggttagttacatatgtatacatgtgccatgctggtgcgctgcacccactaacgcgtcatctagcattaggtatatctcccaatgctatccctcccccctccccccaccccactacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggacctgaactcatcattttttatggctgcatagtattccatggtgtatatgtgccacattttcttaatccagtctatcattgttggacatttgggttggttccaagataaactactcaaagaggtctttttcaggaaggggtatttgaacagagacctggaaaggaagaagtaagcagcatttattttttccaccagaagttattagcaaatgagtcaacagtaatcacaaagatttttgggcaagaataaacttggcttattcaagagacagcaaaagatcagtgtggctacagcaagaaaacagagaagagagacagattagtctgagtatgttggaaagcttttgaagccaatttcccgttaaaatagacctttctggccgttggataaagatgtgactggataaagaaaggagtggaaacagggagataagttaggaaacaaatcccatagtgtaggtgagagataatggagggtttgaattagtaggcaggcacagacatatgaccaatggtaacagtagtaagaagtagccatatttttcatactttgaatatagagcttataggattttctaacaggttggtggtaggctctgaggaacataagcagtcaaagattaatttatgtttttggcctgggaagatcctaaagctgagggaaatgaagaattttatttttatgtgataagtctaaagtgactatgggatatcaaggcagagctattgaatagttatgtattcacataggagatcaggaaagatgtagaaactggagatggaatttgggagttataagaacgtgtaacttatttaaattatctaaagtcatggaatgggcttgatggagtgaaggagcatcactagaaggctaagccttggtcaacagtgatacttagagactagcagagctggaaaagtcaaatagattgagaaagagtggccagcaatataggcactaaatcagatttcactgtactagagacaagtgaagaaagttttaggaaaggataagtgatcaactaggttggacattgctgagaggtagagaaagatgagaactaagaaccgaccaatgcgttttgcaaagtggagatcatgagggacagactgaagctgcttcagtggaacagcagggagaaaagcttaaccaaagtgggtggaggaaagaagaggaggtaagaaaacagataaccttgagtatagactactcctttgatgagctttgctaaataggaggacaaaaaatatgggaaagggtaaaagaaattaagacagtgattctatttaccagcaaacagtattttgaatattaaacaagtgagtggatgtagaagatctttatgaactccaaagcactatataaataatatgttattttgtgacaggaaggatcggtagagataggaaatgaagcatattgaacagtatcctttatggcattgaacttacccgccttattctgtatgttttgaagtggatgttttctttacttttatataacaatgcatctgctagaataaaataatctggaaatgtttgagtaaatgatcttatttaatagataaataacaattatatattgtgcattgggggaatctggaacttagaaaagctttgaaataaattatacaatatatattttatagggaagttaagttcatgaggatcctggttgtaaaaaataaataaaatagcaaaaccacggagatagcaaaaagatcagtggttggtaggggttgggaggctggaatttgactaagcagagaataaaggaattttaagacagtcaaaatactccttacaatgttttaatcatgaataaatgtcattacacgtttgttgaaacccacagaatgtgcaaaaccaagagtaaaccttagcgtgaaccatggacttaggtgattatgatgtgtcaaggtagattactcaattgttacaaatttaccattctggtggggaatgtcgttagtataggaaactatgcatgtgtgggggctggagtatatggcaaagtttctgtaacttcctcttagtttttctgtgaacctaaaactgctctaaaaaataaagtccaaaaatgaatgaattaaaggcttagataattcataggatgttatgagaaaataatttacttgtattaaaaatcccaaatttttgcagcttctccaacatatcttttactatcatattcaacatcaaagcagcaagctagatttaaaacaacacaaacttaaaaaatttaagtttgaagagaccggaagaaccctagatgttacagtgaatgttttgaaggtcacagttagtcacaaatttattttgagtcagagaaaaatattaacccaagtacgttctgcacagaacttggtaccaataaatttttgtagaataaaaggtaccaataaatttttgtagaatgttacatgagtagataaacctttccttaccgacaggataaaatttgctgatttctgggctgggcctgtggttctggacacttcatctcatagtcaaggaaattttcagcaattgttttttgttttgttttttttgagacggagtctcgctctgtagcccaggctggagtgtagtggcacaacctcggctcactgcaagctccgcttcccgggttcaagacattctcctgcctcagcctcccaagtagctgggactacaggcacccgccaccacgcccggctaattctttgtatttttagtggagacggggttacaccgtgttagccaggatggactcaatctcctgacctcgtgatccacccgcctcggcctcccgaagtgctgggattacaggcatgagctaccgcgcctggcccagtgtgtcttttacccagactatctaaggtaggtcaacagatattgtgaaaactgtccaaaagcaaaaaggaaacctgcccaattttcaatatatgctagggtgaaaataaaggtcacttttagtgtgagaattaggcatgttagtcagtatatcatagtgaaagtttattgttcccttcaaaagtataatttggaataaaaaaattaattttaactagatatgtaaaaatgattctaatagaatgactggcgtacttcatcagtatataaaatttgcaaaaaggttataaaattcattaggaaacatggtggtcaaggtataaaatgctaagatggactattgaataaagctggggatatgcgagactatttcaaaaaatcataaaaaaaatttaaaacatcattcatttccacaatggaatatgtatttgtaactaacttgtaataattataattaaagaatacttttttatgcctttgttttctagactctgtggaaggctttgttatagcagcgtaggagaaagaagcaataagtggttgtaaagtctcttgcaaacacaaaatgttatgtaaattctaaatagaaataactgttgagagaccaggcatggtggctcacacctgtaatcccagccctttagaaataactgctgaggagagtattttccttcaagagcacgaatacactcaagctattgactatgtttatacagtgatgtggagaaaagagaaaaactgtaagcaaacagacctgggcttgcatctctagttctaccactttctaggtgtgttcaattgggtaaattgcttaaaatttccagaaaaatacagataattccacttaccttagaaggttgttaagagaattaaatgtaatattatgtgtagattctagtatacacaaagtggatacataacagttactatttttctttcctcgtctctgagtaaaccaagcttgtccaacccctagtccaacacaaattcataaactttcttaaaatataatgagatttttttgtgattttttttaatttttgttttttagctcatcagctatcgttagtgttagtgtattttatgtgtggcccaagacatttcttcatcttccagtgaggcccagagaagccaaaagattgaacaccactggttaatttcccctaaactggataagaaatactacaaggcattacaactcccaatgagataaatgggtggaagaggcatcagcctacagcaactaccagaatcataattcctggtgtacatatttagttttttatcaacatcctcaatccttaagtgccctaaatgataatgaactaagaataattatgcttgttaggtaacaatgggcaaatctttctctactctggaattctcttcctttgtgtttagcaggaatgagctagattcctcatatattcatccaaggactcagtgtggtccttggatgaataccagtctgcaaaactgtttgtttcccatctactacaaagtattgaaaatgaaagtaagcatttagagacttttataacaatttgaccaagtaagtgtatatcttttgttaaaaaaaaaaaggattttatcttgtatgtttttggtttatttccccatttcacttctccagtaattcatttttattgcattttacaaaagtattggtctgcagtagattgtaaatttaaacacacacacacacatacacaccttttatcacaaaaagtttgaggagcattggacagataatcgcttaagccctggtattctacaagattattttctgtccatgttgcctgaggctgaccaactccagaggaagataaggtgtttattgcctaatgtcctccaaagaggcacctcctctccatcaaagataatgaagatgaggatgatgatggtgatgatgatgatttccctctttacatgcattatctcatttaatcccttactgttattacaccatttaatagaaagaggtaattaaagcccaggaagacacaaatggctttagttgtatttgattccaaatcctgtatgtttcccaccatgccatgttgcttccagtgatactgctttcccaagaaaaactgcttgccattagccaagtctatcccgtgcagcctgggggaatcacctggtaaagtcggcaaacctgtgaagtctcagccaaaaaggcatgcctcttatcctaataccatgggaattcccctttagcctaaccagcagaagtcaactaaaatcatagagcctcaggatttaaaagtatctgaggaataatctacaatctgtattccaatggttgggtcattgccataacatactttacaactggttatcacttgtaaatctgaatacctccagctacaggaacttactacacacagaggtagctcattgtcagtatattcttataatctaataaggattgtttcagttaaattaatctgagagctttctctttgtacctgtactgttttgggcaaaattttactgtgtggagccatggaaaacaaccatgtagaattgttctactttgtaacaacaagctatgtatctggattttttacaggcagctgtagagctgttagaacttgagttgaattctggctcttaacatttagatatgacctgagacaaactatttgccctcatcaatgttgtctgtaaaatgaggacaataatcctggcatcatttaaatgttatgataattaaataaaatattacatcaagtaaaagcaccaggtaggtactttagaaagtttgttgaactgattcctttatattttctcattgttttactcttctgaacactgttttctgatactgattcattctgtttcttaccctatagttttctcccctaggccacctcagggattcaaatttgtattattttaaatcataccataaatgaccataatattgaaagatgctatttagtttacaaaacgttttcatgttctgattcaaattaatattacataaatcctatgaacctagaagaacatattaacatttcataggcaaggagttgaagatctttattctttatatagaaggtaacgtagattcactaagttgaaaagctcgtaaagattacttttctacaaaatacacaagcaattaattaatttattaattctttctgtttatttatttattttgagacagagtttcactctgtcacccaggctggagtgcagtggtgggatctcagctcactgaaacctccacctcctggattcaagtgattctcatgcctcagcctcctgagtatctggaactacaggcacgcaccaccatgcctggctaatttttgtatttttagtagagatggggctttgccatgttgtccaggctggtcttgaactcctggcctcaagcaatctacccaccttggcctcccgaagtgctgggattacaggcttgagacactgcactcagccctaacttattaattctaaagtaagtaaccattgtcactagatgccagtctaacacctggagatatagatgtgaataaaattctcattgcctctgcctttgagaagctattaggctaaaggggaagaaagatatggaataactgtgatgagtgtaaagctatgcaggatgttaaggcagcataaaatagattggcctacctgcactggaactgttagcttatggtaacctctcaatcagaaccactctagtgatgataaatactattataattatcataataatatcatagcatcatctgttttctgcacagctatacttcattgtgaggcttgagcgtttatgataatctatcttctttcatttaaatcaaacaatgctataaactcagtcaactgattccaaaaacaaatgttttgaatgtagttattgggaagtatggaccaccctatttttatgaaataaaagtttgtttacacaaagcaaaagtggccctaataaaaacaccatcccttttttcaaaagtgttaggcataatgatggatgacattttctccattgcaacaaaaacttgtcttcatatgctactgggttctctggaaagaagtgatcttttttttttccttataagttcagaaaagacaataattatcccttgaaaaaatttatacatagggatcctggtatctttaataaatactttccaaaattgtcttgtagtaactatggtatcggtggaattacacctgtaacaagcatataattttctatttaaagtactcctagagtgcagtacgtttatgatgtaatgaactctttacacgaaggaagaatcattggttttgtcattggtaagcttttgtcattggtaagcttttaaaattaattgtgaatcctaatgcagcattttataaaacatgctttagtttagaaacctgggcatctcatcaatttcttctcttcccaaaggatttagatcaatagtagccaacacagtccactcatgctcatattaagtttcatattcctgttcctaggatttaattctctagtaataaatctcttagtaaatgatgttctctatccagggctgccaagcaaactcactgttttgataaaggttcggctttagccttctgagtcttctaatggacttgctaggctgtctgccctttcagagatccattcaaaagaaagggcaaaaagtccccataaccatttagtaaattggcttcattaccaaatgttacaggtttaccaatagtctggggtttgcctttccttaggggagagaaagacaacctagcaaacaagtgtttcagacacaatcaactctttaatctctgcttctaattgtgatgtgatgacctgtgctgcttctgcagcgttctccatagtgagttagcagcggccccacaacactgtgcacaccttcatgactatacttttaactgtgtatttaaattatttttaaccacctcttctgtgacattatgagtatttgggttacagggacaataacttgtttttctctgcagtcctgtatatactaatatgaacaggagacaggaaaatactgattagaagagggcagttccccagcaaaggtggaatgatgtggtagagaaagagaggagggatgtctggacactgggccggcgacagtcaggagcagagaccggcagctacgtggcccaactccaggggaagaccaccttcccactccatccccctcttcctgctccccatccatctcgctgagagcccacctccaccactcaataaaacctggcactcatcctttgcacccacgtgtgatctgattcttctgggacactgggcaagagctcaggatacagaaagctgtcacatggccctctgcccttgtgaaaaagcagagggtccattgagctgattaacatacaaggtgtctgaaaatgggaaagctgaaacagcttggtaacactggggttgcaggtatccaccccaaactaagtaacacctaaaccaagctggctaatcagattctctttcttgggattttagaattgaagcaatgcatttttacccgtgatggtgtaatggttactccagactattggtaaacctgtaacatttggtaatgaagccaatttgctaaatggttatggggactttttgccctttcttttgaatggatctctgaaagggcagacagcctagcaagtgtcaactttattggattgaaggacctgaagtactgttcctgggtgtgtctgtgagggtgttgccaaaggagattaacattcgtgtcagtggactgggaagggcagacccaccctcattctaggtgggcacaatctaatcagctgccagcatggccagaataaaagcaggcagaagaacatggaaagactagactaactaagtcttctggcctccatttttctcccatgttgaatgcttcctgaccttgaacatcagactccaagttcttcagcttttggactcttgaacttaacaccagtggtttgccaggggctctcaggccttctactacagactgaaggctgctattggcttccctacttttgaggttttgggacacagactggcttcctggctcctcagcttgcagagggcctattctgggactttactttgtgattgtgtgagtcaattataataaactcctcttcatatattcatctatcttatccgttctgtccctctagaaaaccctaaataatacagatggtcacttaaataaaattataaaaatgttttcttattccttggtttcatttcatttctgagggcccatcctattcttgagtcccatcattcacatgtatatttatataaaaaatgtattttggcttgatctaaacatagctgggtttgttactttgaaccaaaaatatatattattttaattactcattttcatttatagaaacatcatatttgaaaacaaggtggggccttcatcatatgcaaccttcatattttaggtaagaaataaaaatgcaattgctaaagatttcatttaaacatttttattacacttgccaactgtccaaaagaatgcctcaaatattaagaatacacaatttttgacatcttaagtcttcatatatttccttttatcttcatggtactttgcacaaggtcttagatggtggcgttcaataaaaaattattctattagttaacttaatacaatgctcggaatctgtgtacagtagttgttgacaacttaatttattataatctccttcctgtattttctttcctaagaggatttaaagcagctcccaaaggataggagcttaggtcaggtcagagggagataaaggcaagaaaactattcatatcagttaatatagttttttgctttgtttcaaaatttgactacaacaagcatagagaggcaaggatttccctttttctctcttctacttcttttccactaccctggcactaccttccaaaagaaatttcacattggagatcctgtgtccattcatttagtcattcatgtattcatttaactaatatttattgaatgtccatgtaccagtcagagaagtaggtgcttgagatacaagacagagatgaggattgttccttccaacacagcattcacagtgaggatctaagagtaagtgagtaatttcaataaagcatactaagggctatgttgggagaaatacataatcctatgggaggaggcagggtgaaatctaaccaagacacagatgcatggaaggtttcttaaagaaaatgttcaacttaatatccaaattgaaaaaaaaatattttataacaattctccttgcccaaggccctcatagacatgccattcactctgcagaatattctccccattatgacttgtgcccacaccattatttgaccaatttatttggctaactcctatgcaactttcaggacagagtccgtatctgtctattcactgccacatttccacactagcaagtgccaactctaacataggagctcgacagcattttgaaaggtaatcacactatattctaattattaatagttggtttacatgactagagccttctcaagggcagtgatggtttcatttcttcactctcaacagggcctgcctctttctattccttgacataaaccggactcttcatgctaatcaggctggaagtgtatcgtaagtcctcactgatactcacattccatctcttgagtttaatcagcttccatttacctatccatttgcttcttagtcttggtattgctgtttccttcatctctcaccctcatttggatccatatttcaatgatcacattctctgcccaacccctctgattgatgctctggtttgaacataacacaattctggcgttaccatcagcatcttctcctagacacagtttctcattttttctatctggggtcacataaacacaaagtgtcccctgacatgccactgctctctacttaccccaacttctcaattggctcctccctcaggagaagaaagaggatacacaaacattcagatgagtgccaggtatacagtagtcattccacttattcagaataactttttttaaatgccattaattttatagtggaattcaatgtaagagtattaactgatctataaaatgtttcacatatattgtgtgagatatatacctctataatttacctccttcaaaattccttaaggaatttaagaaactgtgtttgttggggtgaggggctacatcagcaaaagccaggggagatttttactttattccataatattctaccatagatattatttagatgcatttattataaaattttcctggcttacaattagtacagagtctacctagagagcttgcagtttatgcccccttcagtcaacattacaaacctgcaatttccttttatctcaccattttattggctcccactagagatactgtgagacagtaaaagagatgggaattacacttgcaggaagaatgctttccaaaacatgttctagcacttgactcttgatagtgtgtggcagctggaggcaggtggccaaatgtcccagtgctataccctacctgactctaattttcccctatagttactctctttctgtagcttacctatgactctacttgtcaaataagtacttattcttccatttcagatgtttccacttgtataaagacttcaatgactgccctctatagagttctgcagttgttctagtcaatattttgacgcacctaacaatgatagttaacatttacatagtgctcattttctgccaagcactgttctaagcactttataataaaaaatggctaattgaatcctcacaacagtcctatcaagaagacactgttagtatctccattctaaagagaaagaaactgagtttggaagttaaagcaggtaagtcttgaagaatgagttcatagattttaatcaggtaaagaaagatattctacacaaatagaagagcatatatatggtatatatatgcatatatggcatgaggttatgaagcagaatagtatgggtattcattaatttattcaaaaattatattttgaacattggctacattgtagacactgtgcttagtttggcattctgggagtaacgggtagcaaaggaaagagaaggtgctacaagcagcttattgttactggtaagtaaagatgaaaggggaaatgtaggcaggttcagttcatggaggatgaatgtgtgtaatgctaagcagcttagatttgacccaataggtgctggagaaaacaaaggaactttaagagaggaaataagaagatggttatatttgcatgtccaatggcagaaagtgatgccttctttcctaaacttccagagtattttgtacctttcatattatttattgtatattaccttttagtataaatttaaactggattcatataaagtacctcaaggggattttaagcttctaataggcaacaaacttgaccactaggtttttggatcctccataatgcctagaacagactgtactttctacttaaatgtgttcagtaaatgtatgccaggttgaattatatagtccctgtttctacacctgcatcaaattcctccctgaaaactcatgtccctttttgtcttagcaggctgagcacagggacaaactactaatgacataagcaacgtgctacatttgtagtagattaagaaagttctcctggataattagacatctgatagtactgactcagcctcccagaattcttcacaagaatacggtctcccctcaaccaaacactgccttctcaaaatcctggatcatgtcctgtcacatagaaattggacaaactactgaaaaatatcattttttaggatctactgttgagtaattttaaggtttctgaggaaaatatcacacatacttgagccagaacagatatacaacttccttgctgttatcagaaaggtataaaaattattttgtcatactcagctaatttaaaaatatttaagcaacccattctttatcctactactgaaaaataaatgaagttaaaaaacataaaagtaatttacataaataaggtgttcagcattctaggtcacttcattttggtgtaagttttttttatagcaatcaaaattatttatctggataaattctaccttttcctgcttgccctcactagtaaaacaatttaattctattatatcagcatcaccttttcttgatgctgttttcccaaactttaacccacaagacggtattcattcataaagtaatctgtacactctctgaaagcacacaaacaagtattcccacaataccttcagttcacttacattcccataataccttcagttcgcttaaacagacatttaatgaagtgcaatactccttccgtagcggcctttgcatcacctaacttattactgacacatccaccagagggggaaggaacattgtggagatgaacagttgaatggtatttacaggagaccactgatccctatcaaattgtagtgtcattttagccttcacaagtgcaaagataatttctatgatataggaactgattgaaattttctcttccctttccatccaaggtgcatttctatgtggagtagatgaggtgtcataacactgtgtacctttcttcctattatagtatgagtaattttacatctatttgaaattttcatgagtacagtgaccatgtcttcttttttcttatcatcgctcagggataatattcaaaattgttagcaactggcctagcacagtgacaaatcaattagaatggatgctgcttagaacaccactttgttatgtacaaacagaatatcagttcagcaactggcataatgtggagaacataacagctcatcagtaaataattgttaaacaaatacgtggatgaagaaattaaccgacttactggatcagacctgtctcacattcagtttcaaatcattcattacttcagtgctttcattgtatttaatcattcactttttaaaatccctacaaagtagacactacgtttattgtttagggtaattagtaggggaggaaagatggttaaatagaaatagcccatgctttaagatgtttatagtcgttatagtcttgcttatagtcaagatgcttatagtatgggaaataaaatattttcataaataatcataaacaaagtagaaatgaaaagtatcaatggcttacttttggggacacttgagattcaaaaatagatctgttggattccaaagaccatgtgcatctcactatgtaaaacattggctttggaatttacacacccggatttgaatctcagcttcagcattacctggtatgttggataacattgggaaagtcattaaaccattttcagtctcagttttcttatctttaaaagaggggtaatagtacccacctctcagagtttgagtgtattttaagtataaccatattttaacatatttagcacaaagtgtaataatacagtagatgctcattagatattaatcattttatatatgcaagttaactgtatcttatattagaatactggtattatggtggtcataaaactatattgttttaaagaaaataaaattatcagcttctaaaatttcatattagattgggcaaaggcttgaggatcagacagacgcagaaacaaacagttattccataaactaccacgtttatggcttgaagcatattacctaacatatttgaacctctaatttcttcatttttacaactatataggattgctatggggatttaaaagaaagaaggtgctcatgatacattaactgcttcaaaatgcaatttaaaatatgaggagccttaaaggtcctgagcagagataataaagtcctcactttctattttaaaactaaaattaagattgttcctaacctggaacatgtttcctgtcaagatttttttttttattaagctatgtgataggatgattgattccattggaaaacttgtagtggataaaacactcacaagaggtcccctatgcagaaggctgaatgtgaaaagagatgtttggagaagcagagtattatctgcataatagctgtaccttggtccccagagtaggtagcttatattcctagataacaggactccaagacctgaagaaattctttccctagttgagatatagtagatattattgaccttgagtttctctccctttggccttctcttaaaactctggatacatgtattatcaggagaaatctagtgcaaggcagacctgtgcctgcattaagaaaatgatactgaagttatggaaggagaacaataaagaggaggactcaatctgagtctcaagtctttccacatctcagcaatgttatgctgggcaaatgacccttcttttaaatcctactttatttcatctgttaaatgagaatgccaatgtttctaagcttaacaactttcaacgtatatttataaataaagttatgcacaaagaaaaagtacacacaaatagacgattcttatcctaccccaagatgtcactattgctcattatggctattttagtctgagccatctcgttattctatagcttatgacttgtttgttgtgtttatgcttattttgagtcatttttaaaacagccaaccctattatgaagccatttaatgccatattcaccattaaatgtaaaagaattagtattgttttttcataaatgtgtagaacttgttacttcagagtgtcacttcagaaattaagaaatggaattttaaaatagcctatttgatagtacagaatatttgaaatagtaataactgcctgacttgcctacaggagtgtgcaatatataatagtacaaatacttcataaaataaaaaatgtgactgaaatatattcattggtatatgtctacccctacatgcagtgctaggtggattcattgttatagaggaagtcaaagtaaaggagcctggagataaaaagtaggcatatctataaaccctaggacaaattataaacgactgaaatttctgaaaaaaaatgtagatgattattagaaattggtggattctactccctctcaccagattcctgggagaccaaatgctcccaggaatctctctagcccagctcctaccctctccaagaatctctcctttcccagaaatctctctctaggccagctcctcccctctccaagatttctctctaaagctggttctatcatttaatgatgttccaataagaaagagaagagaaaaaaatatattaataacattgtagggaaatacagaaaaagaaaacatcttactttcataaaaataatttaaaataattagaagtgccagtgtcttcagatgagtaggaatcagtgcaaattttctgacactatgaaaaatctgaatgtagtgacaccaccaaacgctcctattagccctccagcaatgatccctaaccaaaatggaaattcagaaatgacagataaagaattcgaagcatgtatttcaaggaagctaactgaggtacaagacaaagttaaaaatctacacaaagaaacttctaaagcaatctggaaaattaaaaagaagataaatatctttaaaagaatcattcagttcttctggaattaaaaaactcacttaaggaattttaaaatacaattgaaagctttatcaacagactaaaacaatcagaagaaagaatttcagggcacgaagactggcttttcaaattaacccagtcagaataaaatatacatatttttaatgaacaaagtctcagagaaatatgggattatttaaagtgaccaaatatataaattattggtattgctgagaaagagaagaagtaagcaacgtggaaaacatatttcaggaaataattcaagaaaatttcactgatcttgctagagaggtagacgacatttagatacaagaaacctagagaacacctgtaagatactatacaaaacaaacatcaccaaggcatacagtcatcagactgtttatggtcaatgctaaagaaaaaaatctttaggcagctagagaaaaaggccacattacgtacaaaggaaacttaatcaggctaatggtggatttctcaccagaaaccttataagccaggagagactgggtgcctattcctaaagaaaataaattccaaccaagaatttaatatcctgcccaaccaagcttcaaaagcaacagagaagtaaagtatttgccagacaagcaagtgctaagtgaatttgttaccataagagtaacattataagagatctcggtatagttcagatatttgtttctgcaaatctcatgttaaaatatagtcaccaatgttggagatggggcctggtgggagatgtgtgggttatggaggtagattccccatggcttggggctgttcttgcagtagcaagtgagttcttgcaagatctggttgcttaaaagtgtgtagcacctcccttctgtctctggctcctactctggctgtgtgacattcctattcccacttcaccttctcccatgagtaaaagttccctgaggcctcctcagaagctgagcagatgctggtgtcatgcttcctatacatcctgcagaataataatcccattaaaaatccttcttttaaaactttcattttagattcaggggtacatgtgcaggtttgttatataggtaaactcatgtcatatgggtttgttgtacaggttatttcatcaccaaggtaccaggcctagtatccaatggatattttttctgctcctctccctcctcccatcctccgccctcgagcaggtcccagtctgttgttgcctctttatgttcataagttctcctcattaagctcccacttttaagtgagagcatgcagtatttggttttctattcctgcatcaatttgtgaaggataatggcctccaactgcatccacgttgctgtaaaggatatgatttcattctttttttttttttttgagacggagtcttgctctgtcgctcaggctggagtgcggtgcagtggcacgatctcggctccctgcaagctctgcctcacgggttcacgccattctcctgcctcagcctccctagtagctgggactacaggtgccagctaccacgcctggctaatttttttttttttttaagtaaggacagggtttcaccgtgttagccagggtggtctcaatctcctgaccctcgtgatctgcctgcccaccttggcctcccatagtgctgggattacaggcatgagccactgcgctcagccgatttcattctttttatggctgcctagtattccatggtgtatacgtacgccattttctttatccagacaactatttatgggcacctgggttgattctgtcttttctatgtgaatagtgctgcagtaaacgtgtggtatgtgtctttataacagaataatttatattcctttgggtatacactcagtcgtgggattgctgggtcaaatggcatttctgtctttaggactttgaggaattgccacactgtcttccacaatggttgaactaatttacagtcccaccaacagtgtacaagtgttcccttttctctacaaccttgccagcatctgttatttgttgactttttaataatagccattctaattggtgtgagatggtatctcattgtggttttgatttgaatttctgtaatgatcaatgatactgagctttttttcatatgctttttggccacacgtcttcttttgaaaagcgtctgttcatatcttttgctcacttttaatggggttgtttttttcttgtgaatttgtttaagttccttccagatgctggatattagacctttgtcagatgcacagtttgcaaatattttttcccattctgtagtaaacctgttttctttataaattacccagcctcaggtattcctttgtggcaacacaataatggcctaataaaaatcctaagggagttttataaacagaaatgagagaactatacctgctatcacaaagacacaccaaaatatatggcacacagaccctatacaacaaccacacatggaaactagaaaataaccagctaacaactttatgacaggatcaaaacctcatgtatctatatcaaccataaatgtaaatgctctaaatgcctcacgtaaaatgcacagaattccaagttgggttaaaaaaaaagacccatcaggataaaaaatcaatgtacaaaaagcagtagcatttctaaacacaaataacattgaagctaagagccaaatcaaaaacacaatcccattgacaatagctacacccaaaaataatataccatctgcagtcttgaagggcatctttcacatgtaatgacccccataggctcaatcaaagagttggagaaagatctgtcatgcaaatggaaaacaaaaaggaaaaggaattgctattcttatatcagataaaacagactttaaaccaacaacaataaaaacgacaacaaaaaccaaaaaaaaaagaagggcattacgtaatgataaaggttcaattcaaccagaagacttaactatcctcaatatatatgctaactatcctaaatatatatgcactcagcattggagcacccagattcataaaacatgcacttctagacctgtgaaaatacttagacatctgcagaataataggtaggatttcaacacaccactgacagcattagatagatcattgaggcagaatagtatcaagtaaattctggacataaatttgacacttgacaagctggatctaatagacatctacagaataatccactcatcaaccacagaatatacattcttctcatctgcacatggaacatactccaagattggccacacacttggccacaaaacaagtctaaatacatttttaaaaatcaaaatcatactaactatactcttggaccacagtgagataaaaaaagaaaccaataccaagacgaactctcaagaccacacaattacatggaaattaaacaagtcactcctgaatgacttttggttgaataatgaaattaaggcagaaataaaaaaattctttgaaataaataaaagctgagacacaacataccaaaatctctgggatgctgcaaaagcagcggtaagaggaaagtttacagtactaaagtcctacatcaaatattataaagatctaaagttaatgacctaatatcacaccaagaaaaactagaaaaatgagaataaactatccccaaagctaaaagaagaaaaaaataactaaagatcagaagtgaatgacattgataacccaaaatccacacaaagaatcaacaaaaccaaaacttggttatttgaagggataaataagatcaataaaccactagctagaataaaaaagaaaaagagtgaagatccaaataagaaactaaaaaagtgctattacaacatatcccacagaaatgcaaaagctctccagaaaccattatgaacacctccatgaacaaaaactagaaaatctaaaggaaatggataaattcttggaaacatacaacctcccaagagtgaaccaggaataaaatgaaatcctgaacagaccaataatgagtttcagaactgaatcagtaatacaatcctaccaaccagaaatagccctggagaagaattcacagctgaattctaccagacatataaaacacaactagcacaattctactggaattattccaagatttcaagaagagactcctccctaactcattctatgaggccagcatcatcctgctaccaaaacctggcagagacacaatgaagaaagtaaacttcaggccaatatccctgatgaacacagatgcaaaaattctccaccaaatgctagcaaactgaatccagcagcacagcaaaaagctaaaccaccacgatcaagtaggttttattcctgggatgcaaagttggttccacatatgcaaacccatgcaaataatacgaaaatcaataaatgtgattcacataaacagaattaaaaacaaaaaccatatcatctcaatacaggtggaaaaagatttcagtaaatttcaacatcccttcataataatgaccctcaacaaactagttattaaaggaacatacctcaaaataataaaagccttctatgacaaacccacagccaacatcatactaagtgggcataagctagaagcattccccttgagaaggggaacaagacaaggatgcccactctcaccagtcctattaaagataatattgtaagttgtagccagagtaatcagacaagagaaagaaataaaaggcaaccaaataggaaaagaagtcaaactctctctcttcgctgatgatataattttatcccaggaataccctaaagatttcaataaaagactcttggaactgataaaagacttcagtaaactttcaggacacaaaatcaatgtaaaaaattcagtagaatttgtaaataccaataaagttcaagctgagaaccaaatcaagaatgcaatcctatttacaatagccaaaaataaataaaatacctaggaatacattcaagcaaggaggtaaaagacttctacagaagaactacaaaatactgcaaaaaaataaataaaaaaacaacagatgacaaaaacgaatggaataatcttcaatgctcatagattggaagaatcaatatcattaaaatggccatactgcctaaagtggtctatagattcaatgctatttctatcaaacgaccaacattctttttcccagaattaaaaaaagactattctaaaatccatatggaacaacacaacaaaaagtccaaatagccaaaataatcctaagcaaaaagaacaaagcttaaagcattgcatcacctgacttcaaactatactgtaaggctacattaaccaaaacagtatggcactggtacaaaaacagaaacatagaccaatggggccgagaacgcagaaataaagctgcacaactacagccacctgctcttgacaaagtcaacaaaaataagcaatggagagaggactttctagtcaataaatggtgctgagatacttgctatccatatgcagaagaataaacctggacccctacttttcatcatgtacaaaaattaactcaagattgatttaaatgtaagaccttaaactctaagaatcctaaataaaacataggaagcaccattttggaaatcacccttgggaaagaatttatgactacatcctcaaaagcaaccgcaataaaaagaaaaattgacaaatgggatccaattaaactaaagatcttttgcacagcaaaagaaactaccaacagagtaaagaggcaacctacatattgtagaaaatattcacaaactatgcatctaacaaaggtctaatatccagaatctataagaaacttaattcaaccaacgaaaagctaataacctcattaaaaaatgagaaaaggacatgaatagacacttctcaaaagaatacatacaagcagccaacaaacatgaaaaaatgctcatcactaatcaccacgaaaatgcacatcaaaaccacaatgagataccatctcatacccatcagaatggctattattaaaaagtaaaaatcaacagatgttgatgagcttgtggagaaaagggaatgcttgtacacctttggtgggaatgtaaattagtccagccactgtggaaagcagttaggagatgtctgaaagaacttaatacagaactactattcaacccagcagtcgcattagtgggtatatatccaagagaaaataaatcatcctaccaaaaagacacatgtgtgttcattgcagcactattcacaatagcaaaaacatggaataaacttaagtgtccatcaatgccggactggataaagaaaatggggtacatatacaccatgaaataccaggcagccataaaaaaagtgaaatcatgttctttgcagcaacatggatgcagctgaaggtcataattttagacaaattaacagaaaatgaaagctaaataccacatgttctcacttctaagtgggagttatacatggcaacaatagacactgggtactactggagggggatggtacagcaaggggcaaggttgaaaaactaactattgggtactatgcttgctctttgggtaacataattaattgtaccataaacctcacacagtatactcatgtaacaagcttgcccatgtacccgcagaatctaaaataaaagttaaaattattttaaaaaggaattaggaaaggagtgagtccatttaaaacttctgttggatgtatgtgcgaagagctcttttgtttgtttcaatatcttattgctgggcttataatactgtaatttctgataactgatatttcttatgtttttcaaatattggtgatcaaatatgcctgattatttaacctattaagtattttatcccctcctttttgtttattgaggtacacctttttaggcatgtacaattctatcactttttgttgttgttgtttgaggcaagttattggtctgtttcctaggctggagtgcagttgtgtgatcacagctcactgcagtcttgatcttctgggcttaattaatccttccacctaatcctaagtagctggggccacaggcacacacgaccatgcctggctaattttttaaaacatttttttgtactgacagggtctccttatgttgcccaggctggtcttgaactcctgggctctagcaatcccccagccttggcctctaaaataatgggattacaggcataagccactttgcctggcctgtgatgtttgattaacatttctactcatgtaatcactgctacaggcaatcgagatagaacatttacctcatcccaaaagttcttttatgtatgtttataattcatagcctctcccaatccatatgtcctggcaaccactgatctgatttctgtccaaaaagttttctaatttccataatggcatattagtgaaaacgatataatatatagtattttgagtctggtttgagttaacataatccatttgagagtcatccatgttgtcatgtataccaatatttcatttgcttatattgcagaggggtattccattatatggatataccacactttatccattaattacctgatggacatttggtatctttccagctatagaagattagggataaatctgctataagtattattaaaatatattgtgcaaagatatatttttcttttttatttgtataaattactgggtagaagtgtaattttgttataagcatagattgttatagtgctcaagtcagggcttttagggtatccatcactcaaataacatacattgtacccattaagtaatttcttatcatccagctctctcacttcctcacctttgcgagtcttgggtgtctgtcatttcactctgtatgtccgtatgtacacttttttaagcacccatttatgagtgagaacatgcaatatttgactttctgtgtttgactttctgtgtttcacttaatgacctccagttccatccatgttgctgcaaaagatgtaatttcattctttttgctgtctaaatagtatccattgtgtgtgtatgtatatgtgtgtgtgtatatatatatatatatatatatatatatatatatatatatatacgttttctttacccagtcatccactgatggatgcttatgtttattctgtatctttgctattgtgaatagtgctgtgataaacgtaacagtgtaggtatctttttgatatattgatttcttctcctctgagcagatagcttagagtgggattgctgtatctaatagtagctgttttttagatttttttgagaaaactccatactgttttccatagaggttggactaatttacgctcccactaacagtgtataagagttcccttttatttgcatcctcaccaacatttgttattttatttatttatttatttattttgtttctttaaaaacagccattctgactggggtaagatatctcactgtggttttaatttgcttttcttgataagtgacgttgagcattatttcatataccagttgtatgtcttcttttgaaaaatgtctattcatgtcctttgcccactttttaatgggattatttgttgattttgttcagttgtttgagttccttgtaaattctgaatattagttccctgttggatgaatagtttataaatatttgctcccattttgcaggctgtctgttcactctgtcaattatttcctttgctgtgcagaagatttttagtttaattaagccccatttgtctatttttggttttgttgcctgtgcttttcaggagttagtcataaattctttgcctagaccgatatccagaagagttttccctaggtattcttctagcatttttatagtttcaggtcttatgtttacgtctttaatccatcttgagttgattttggtatacggccagagatatggatccaatttcattcatctgcatatggtaatccgattttcccagtaccatttattgaaaagagtatccttttcccaatgtatgttcttgtcaggtctatcaaagatcagttggttgtagttatgtggcttcatttctggattctctattctgttctattgatccatgtgtctttttatttttataccagtatcatgctggtttgattattatagccttggaatataaaatcaggtaatgtgattctctcagttttgttcttcttgcttaagacgttttgagtcttctggttcatttttgattccataaaatttttaaattgctttttctaattctgtgcaaaattgttggtattttgataaaaaatgcattgaatctgtagattgctttgagcagtatagtcatgttaacaatattaattcttccagtccgtgagaatgagattttttatttgtgttatctacaatttatttcatcattgttttgtagttttccttgtagacatctttcaccttctgtgatggttaatattgtgtcaagctgattggattgaaggagggaaattattgtttttggatgtatctgggtgttgccagaagagattaacatttgagtcagtgaactgagagaggaagactcaccctcaagaagacccactcccattatgtgtgagcaccatccaatcaactatcagcatggctagagaaagcaggcagaagaaggtgaaagaagctgacttgctgagtcttcccgcctttctatttctcctgtgagggatgcttcctgctcttgaacatcagactccaagttctttggtttttggactcttgaacctacgccagtggtttgccaggggctctcaggccttcagccactgatgaaagcctgcactgtcggcttccctacttttgaggttttgggactcagactgagccactactggcttccttgcccctcaacttgcagatggcctactgtgggacttcacgttgtgattgtgtgagtaattctccttaataaattccctttctcatatatatatatgtgcgcacacacacacacacacacatatatatgtatatatacacacacacatatcctattagttcggtccctctggagaaccctaatataactttttttgtgaaatttattctcaggtactctttttttgttgctattgtaaataatactgctttctttatttctttatctgctagatcttttggtttctacaaatgctacttatttttatacattgattttatatcctacaactttactaaattcacttatcaaatctaggagtttttttgtggagtcattagttttttctaaatacaagatcatatcatcagcaaacaggaataacttgacttcctcctttccaatttggatgccttttctttctttctcttgcctgatcgttctggctaggacttccagtgctatgttaaataggagagaggcaaaactgataaacttctagctagactaaccaagaggagagaataaccaaataaacaaaatcagaaatgaaaaaggagacattaaaattaatgccacagaaacatgaaagttcatcagagactattatgaacaactacatgctcataaaatagaaaacttagaggaaatggataaatttctggaaatgtacaacctccccgtattgagccaggaagaaatagaaaatctgaacagatcaataataagataggatcaataacaaaacaatctctcaacaaaaaaaaaagcccaggaccaggaccaggaccagattgtgatattcacaaccaaattctaccagatatacaaagaagaactaataccaatcctcctaaaatcgttcaaatcaaagaagagaaaattcttcctaatacattctaccatgccagtatcatcctgataccaaaacgaggcaaggacacaacaaaaatagaaaattataaaccaattttcctaatgaacaaagatgcaaaaatctttgttcattactagcaaacccaatccaacatcacatcaaaaagattatacaccatgatcaaatggtttttatgctagggatgcaaagatggctcaatattctcaaattaataaatatgatacatcacataaaattaagacaaaaacgatatgatcatctcaatagacaaagaaaaagcatttaataaaattcagcatgacttcatgataaaaaaattaaaaaactatacatagaagcaacatacctcaaaaaaatataggccatatataatatacacacaggaaacatcacactgaataggaaaaagttgaaaacatttcctgtaagaactggaacaaagatatatttctcagattgctggatttatggtaagtttatgtttaactttataagaaactgccaaactgttttcctgagtggctgtaacattttttcattctcatcagcagtgtgtgtgaattctgattgcctaacatccttatccacatttggtactgtcatttgttattgttgttgttgtatcattctaataggtatgtggtgacatcttattgtggttataattttctcttacattgaattgaaaacatttttaaaattcagatatttccctatagctccaatatacacatttagtaacaaatgatactattatcgcaaaatttgtggatggatttaacttccttcttccaggtatattcatcttaatgattgttttgaattcagcttcctttatgccattatagttttttcccactagatggcaactgctcagttgtttagaacggctgagtagctaaaagcaaggaacataaaggatagagtcaagctatgaattgtgaagtgctttactccaggattgtacaaaaaaaaaaaaaaaaagcgacaagacttcattgtctgccaaaagttcatcataacttaatgtgtgtgtgtgtgtgtgtgtgtgtgtgtgtatactttctaagtaatttcaatctaagtttggaactaccaaatgtggatggagcacagaatataaaaatacaaaacaaggtatcttttgaatgtaagttagtgtcacaaagtaaacaaatagtttgtagaaaacattcagaaactatctagtttcttcagacagtatatacttctggagaatataatttgaaacacagatattttagtagttttgacataccaaacatatattttctggaatacctgtaggtaaactgagaagttagttaagggttttctgattgctttttgctgttattttagcaccacataggacctcctccctgagttgatttcattcattaatcaaatatttactaagtttctattctgtttcaagctttgtggtagcatcaagaatactaagaggaaaacgacctaatacatgataataaaataataatataataataataatagaaattgtcctttaagtgccagaaagtattctaagacatttataaacatactacttcttattaccacaatcttatgaaatgttattgctcctctttaggagacacaaattgaagactgagaccctctgacaaccgcagtagttatagttgagacaaaaatgattttaaagaatattcatgtttagagtggaccagagatgtcaccccaaaattactctttgcagccatgtagtatggaaggaaacaagatatttccatgtcctcagtgctgaacaacttttagtagtcgagagattccaagcctacccatgcagcttctatagtgatatacaacagagatggcagagggcagggtctaagacagaggctggatggaggacagacctaggatgcaagaagcagaattgaagcccaaataggaatcaagatagagccaagtcatcgatctctagccatgccaaaagaagatgcttggaataccattagcagccacaatcttcacttgacaatatcagtatgattcttggaaatcaagacaagaaacacttccatggatacctgcaaaaccccacgggtaacagacacacacatgtagcccaggtgtttactcccattataaagacatgtaaacttccccacactccaagatactatccggggtggattagatgggaaagacaaacttttgagaggagagaaatataacttgattaaatatttatccaaaataatattgctttaaatatatcactaggtacctttaagtttttaagttttggggaatcaaagataactttgaggatttagtaaaagttatgaacattctttcccactggcttcctacccacccacctacatacacacattctctttcccactaactacccctaccacacacacacacacacacacacacacattaaaatgagtaattcaaaatatttgcgtatatctctatagggcttagtgaataactgaagcttagtcattaactcctggaagatctatgaatcccgggttaagaaatcctaggttgtggaaatggcactagacttgagttttgactcaatcatttgccacctatgagaacttgaataaatcaactcttctctctgaatctcaggtttctcactgtttgtgaaatatctattacatggaggagtgggatagggatggctctatcataaaaaacatatcttctttacactcttctttgcaaaattttataatatatgaatacacttacagtcctacatggtcctatatagttattttggatctgtcattgatcacttttaattttcctcttaagagtgtcactctttttctctatcccaccagcatcagcgtacctttctggcagtcctcatcctcacatatgagaaactgcagtagcatcgtgtagcatcttgctgtttcaacctttagtccttcctatgtatgaagcacattattctcaacccactgcttcttcctataactctcttgcttaaaatctaccaagactctcaattacataagagataatatctaaaatctaacagtcaaagacttaaaaaaaatcaattgatctcaccctgcttaatcaatcttacatcctcagctctagtagtctaaattttactactaagaggaagctttcataggaggaaaaatgatgtgatttgaagtcgttggctcagtcacttactagctattttcatcctgggtaaaacacttatcctatcacggccttagttttctcaacacttaaataaagtatttgttctggacaatttctaagatccctttcagttctgacactgtctgactccatcaccctgtgccccttaaatgctaaattcattcctactctgaatccttgatctttctgtgttctctttctgtagcatcctttctgccagactaagcattttctgttctccaaggttcaacttatgtacttgctcatccatgaaatcttcagagctccaaagtttgtgagaatcatttccttctctgcggtctcatggcatctaaattttgtactaatcaataagagtatcttacactgatataacactatagctttagtagagatgtttacatacaatatttcactggagcctctcaaaagatctataaaggtaattactattcctactcaaactcagagaagcctaaaatgtctcaactctaatgcaactgatctagagtcagaattaaaggtttttgattcctgtttcagagtttttcctccatacatgttcaacatgtcaaataattattggtatctgtatgtttcacctatatagctattatttagctcagtaaacatatatgttaagctcccatcatataaaatctgcttaggtataagctatggctaagggagttgggaagcaaatggagttttctagcatgggtgcttgtaattcttattttgtctggtaacccttaacaatgagcttattaaaaataagggtataggctgggcacagtggctcacacctataatcccagcactttgggaggctgaggcgggtggatcgcctgaggtcaggagttcaagaccagcctggccaatatagtgaaaccccatctctactaaaaatgcaaaaaaaaaaaaaaaaaaaaaaaaaaaagcttagctgagcatggtggcaggcacctgtaatcccagctactcaggaggctgaggcataattgcttgatcccgggtggtggaggtttcagtgagccgagattgcaccattgcatttcagcctgggcaacaagagcgaaactccacctcaaaataaataaataaataaataaataaataaataaataaataaataaattaaacaagagtatagaacataaaataagaacattgtccgtggagtcagaaatatctgggtcctctctcattctttgtattaaggaaaatttcaaatacattaaaataagactgtgtacctcctcattcatcttcaataatgatcaacttgcaaccaactttatgtcatctatactcctaaccactccctcagattattttgaagcaaaatcagacatcatttcacttcatctgtaaatattttaagaagatctacatataaagactcttgcttttaaaaataactctagtaccaacaaaaattctttaaaatcatgaaatagttaatgaagattcaacatttcttggttttccaatttaaaaaaaaagcttgctcaaaaaaatgatcttatataaatagagagtagactggtggttactagagactggggtgatgtggtggccgttggggagatgttggtcaaagtataaaaaatttcagataggaggagtaaatttcaacagatctcttgtacaacatgttgactatagttaataatacattgtatttttgaaaaaagccaagagagttggtgtaaagtattctcatcacagaaatgataactatgtgaggtaatgcatatgttaattagctagatttaatcattctacgatgtatgtatactttaaaacatcgcatggttcacataaatacatacaattttgtgtcaatttaaaaataaataaataaatgtatgatgagaaaaaaagtttgttcagatcaggctgcaaaacaaggctatatatggtttgcatgtctcttacgtttcttttaatctacaggatctcctcattctatcactctcctcttgcaatgtatttgtttaaaaatatgctttttttaaataaaaaaaaattctcctgtagtgcttctgacagtataatttttttctgatcatattatcttatgttatggttccctatatctcccatgaattggaagttaaatctagatttgatcaaactgaggagcaatattttacgcaagactcctcatgagttgttaggtatacttccattagaagtcacatgatgtctaattgtctttttatgatgttgtaaccatggacaaatattttgcagatctagtaatttaaaatggtgatattctattattccttcataattgattaggtacaagaccactataaagagaaatttcatttcacttatttggtaaccttgaatttgaaattgtatagaaccaacaaggtaaatgttttattcttcctattgattcgttttcaaaacaaaaaataggttccctagtatttccaaatctagtaatcaggtgatttttaaataatatctttatgaaatcatggatctaaacatttttattatgttttaacccattataattattatctttattgatgctcagattgccttattttgaccagtggaagctggtaggctttcgagtccttttatgatgacactccatatcttggtggataggttaattgctttctgacataacaaaatatttcagttccatcttgtcattttcctacctaagacctagaataagtctttttcttgaaaatcattttttttcccaagaagatctgttaccttttattaggaaatggtatttggaaaccacactggaaacactacagatgttcatatctactatgctatcattacttctagctcttttaagtggacaaaactaggaaatattcttaaagataaaatatatcatcatcatgattcattctgaacttattcaaattttacttaacattagtcatagaagaagtttggtttttatcccagctcccccagttgcctatagaacaagtgatataaactgtaactaccctaagccctcaattttgtacctgaaaaattagaataataaaaccaactactcacttgaacactcataagaagatagttggtctatcctgaccatatggaaaataatgaagtatcataaaccacagatatatagaactaaccatttggttttattataagaaaacgtagaaattctgaaagccacaaaattatcaattccaagctaggacattccagaagttaatagctaaatacagctagaaagaactactagaaactacaggatgactgatcacttttataacaagcttctaagatagagcactgagctccctatttctctgttccgccttccgtccactcatgtaaacactggcttcccccaaaaaacatcaattccattgttaggccttcttcctgtaagatctgaataaagctccaatgagccataaccaatctcttctgaagcattccacccattgataagagctgcctcaattgaatatttccattgcagcagcaatagggcagacagttgcagaaaatcctcaaaagaactaccatagacacaaagttaactggcagtaaaaatcgctctgtgacaccaccaccctatgttcagaaagataggcaaagctctcctctttgtctagaccttcctttaattagggtcccgggggccaggaaaattctctgaagtaagtctgtgcactgctccggcttttgaagagtaatggctttggtgggaagaaacatttgtaaaaattcagatctaatctaggaacccaaaccaatctaattagagtgtctgtgcactgagatgttcactaatgagactcaaagaaccaacacaggagaaacaatgacttttttgcagcaggcattatcaggctgccttaaatgtgacccacattcactcatgccccagtaccccaggagtagagccatgtcctttttctagattgactcttggcaagtgtctctggtaagttttccattagggggcttctgtactttctattgcttctccataagactccattgttctcttttcttctgcttagtgtctgacctggcgtgctccagattcctatggtttgaattctgtctttttaactcatgtcctactctagccaaatccaattacttgtcctgtgcctctgtgcctttgcaaatgctgttccctatgcacagaaggcctttccttctctaaataattaatttattctttctaaactctcatagctccactacaaagtttttctgaaatccctctctctactccatctctactatgaggaagaaataaatgcttattccctctgttccacctctttacccaatatatatctctaccacctcacttagtatggcaattatgcacctatatgtgtatttcctctataatattctgagccttgtgtctaaagaatatatgcctaatttatttttctgtgtccaatttctatctgagttcctgcacatcatagtacattcacaaatacttgaaggccctcaccactggaagataaattgcagaacatccattaaactagtggttcatacaaaattatgtgggaatgtgaagaagggagaaactgacctggcacagtggctcatgcctgtaatcccagcactttgggaggccgagacaggtggatcacttgaggctaggagttcaagaccagcctggccaatatggtgaaaccctgtctctacttacaaaaaaaaaaaaattagctgggtgtgatggtgcatgcctgtagtcccagttacttgggagactgaggcataagaatcagttgaaccagggaggtagaggttgaatgagctgagactgagccactgcattccagcctgggtgacagagtgtgaatatgtctcaaaaaaaaaaaaaaaaaaaaaaaaagaagaagaagaaaccacatcaatctccacaagacacatccagataaaggacaaagtagccagcaggtaaaaacaaaaatagtaaaacaaaatcagtcacaaataatgggggtctttccccattacacttctcactttctctgctgagagagggtcagaaagcaagagcctcctatgtaagtactacgacctatattcaacatgaggcacattacttggaacacaacaggtgttcaaaaactacttactgaataaataaagtaggtatgcgctactttcagaaatgtctctgtcactgcgacctaataatatcaatcagggtaataaaatgcatgcctgtggtcctgagtcattctccacatacattcatacctttgagtgcattttctctttcatttatattacttttcttagtattccaatgtataatgtagttataatacattttataacgtatatacaatgtttccctctactacttgtgtatatttattataaatatagatttataggtgtatgtcatatactaaataatacagttaaaattatttgattacttatctctcctactacagtgggacctccatgagaaagggaagattgtcattatttcgtccaaacattttgctcttcaatcacctagcagaaacctagaaacagtagcatcacataataatgtatgttgactcaataaacaaatgtatcaaagttagcagatttgatcctccagggtttcctcatattatggtccttttccagcctcatcactaaatgatatcatggcgactcagggaagctctgttttcctcactaagaccagaacagaagatggtgctatcaaatagagtttttaaatccagaatgaattcatccctatgccttgtctacagaatcactcagaaaataatgcaaggaagtgaaacaaagagagacatgcaaaagaaataatcttggcacagcaccttgcaaatcaattttctatgcccttgtttctgaactttcctgtaaggtggaggcttagaaactgcagtgttttcatgatgattggatagcatgttctgccactcactgcctttcctggagtttctaacaggactgctactatttatcctccagtttcacccaatctgcagtctttctcataatggctgcagtgatccttccctaaagttatgtacagcactcaaaaaccttccttaagactcacttactgtttatcaaactttgttaaatagcattaagacaatgattgagtaaacattttaggacaaagctttattttttttcctaatttttattttttgtgggtatatagtaggcacatatatttatggggtacatgagatactttaatgtagttatgcaatactttataatcacatcacggtaaatgaagtatctatcccctcaagcctttatcccttgtgttacaaacaatcgaattatactttttagttatttttaaatgtgcaattaaattattattgactacagtcaccttgctgtgctatcaaataccatcttttattcattctttctaacttttctattttttctatttttttaaccattaaccatctctacatccccccattaaccctcactacccttcccagtctctggtaactatccttctaatctcaattgaatttaaacagtaagttcaattgttttaatttttagctcccacaaaaaagtgagaccatgctaaggttttctttctgtgcctggcctatttcacttaatataatgacctccaattctatccatgttatttgaagtgtcaggatctcattcctttttatagttgaacagtactccattgtgtatatgtaccacattttctttatcaattgatctgttcatgaacacttaggctactcccaaaccttggctattgtgaagagtgctgcagtaaacatggaagtgcagatatcttttcgatattcctgtttcctttcttttcagtatatagcgagcagtacgattgctggattatatggtagctctatatttagttttttttaggaactctaaaatgttctccaaagaggttgtactaatttacattcccactaacaatgtaggagagttctcttttccactgatcctctccagcatttgttattgcctgccttttggataaaagccattttaactggggtgagatgatatctcattgtagttttgatttgcatttctctgatgatcaatgatgttgagcaccttttcatatacctctttaccatttgtatgttttcttttaagaaatgtctattcaaatcttttgcccatttttaatcaaattattgaatgttttctatagagttgtttgagctccttatatattcaggttattaatatcttgttagatgtgtagtttgcaaatattttctcccattctgtgggttttctcttcactttgttgattgcttcctttgctgttgagaagctttttaacttgatgtgattgcatttgtccatttttgctttggttgcctgtgcttgtaagatattagtcaagacatctttgcacagatcaatgtcctggagggtttcccttatgtttccttgtagtagttgcaaagactgaggtcttagatttaagcctctaatccattttgatttgatttttgtatacgatgagagacagtagtctagttttattcttttgcatatggatatccagttttcctggcaccattcattgaaaagactgtccttcccccagtgtatgttcttggcacctttgttgaaaatgacttcactgtaggtgtatggatttatttctttgttctctattctgttctattggtctatgtattagtctgttcttacactgctataaagaactgcctgagactgggtaacttataagtgactcacagttccgcatgactggggaggcctcaggaaacttacagtcatggtggaaggggaagcaggcatgtcttatgtggtggcaggtgagatcgagtatgtgaaggaggaactgtcaaacacttacaaaaccatcaggtctcatgagaactcactcactatccggataacagcatggggaaaactgcccccataaaccaatcacctgtcacccagttccctccctcaacaccagctgaagattacaatttgagataagatttggctgaggacccagagccaaacagtatcagtctatgcatctgcttttatggcagtaccgtgctattgtggttactataactctgtagtacaatttgaagtcaggtaatgtgattcctccagttttgttcttttgctcagaatagttttggctattcaggtcttttgtgatttcatataaattttaggatttttttctatttatgtgaagaatatcattgctattttgatagggattgcattgaatctgtagattgctttggctggtatggacattttaacaacattgattcttccaatccatgaacatggaatatctttttatgtttttgtgttctcttaaatttctttcatcagtgttttatacttttcattgtggagatcttttgcttctttgactaattcctagatatttaattttatttatggctactacaaatgggattacttttaaatatctttttctgattgttcagtgttgccatatagaaatgctaccgatttttgtatgttgattttgtattcttcaattttattgaatttatcagttccgatagctctttcggtggagtcatttggtttttccccatgtaagattatatcatctacaaacaaggataatttggtatctgcttttccaacttgaatgccttttatatctttctattgtctgattgctgtagctaaggagttccagtactatgctgaataacagtgatgaaagtgagcatccttatcatgttgcagatcttagaggaaaggctttcagtttttccccattcattatgatactagctttgtgtctgacatatatgacttttattatgttgtagtatgttccttctatacccagttttttgagggtttttatcatgaagagatgttgaattttatcaaatgctttttagcatcaattgaaaagatcatgtggtttttgtccttcattctgtttatatggtgtatcacaatgattgatttgtatatgttgaaacgtccttgtgtcactgggataaatcccacttggtcatcatgaatgatattcttaacatattgcttaatttggtttgctagtattttgctgagtatttttgcatcaatattcatcaggaatattagtgtacagttttattgatgtgtctgtctgatttttgtatgaggttaatactggccgtatagaatgaaattggaagtattcctttctcttctttttttttggaatactttgagtagaattggtattacttctttaaatcttggtagaattaagtagtgaaaccattgggtaccaggtttttctttatgggagacttttaattatgaattttatcttgttacttgtcattgctctgttcaggttttggatttcttaatagttcaatattggtaggttctatgtgtctaggaatgtatacattgcctctagatttaccagtttattgacatatagttgctcatggtagccactaatgatcttttgaattttggcaatatcagttttaatgttttcttttcatctctgattttatttatttgggtcttctctcttttgctcttagtctggataaaggtttgttaattgcatttatcttttcaaaaacatctttaatttcatttatcttttgcattgttttctttgtttcaatttcatttatttgtgcttgtatctttattattacttttcttttactaattttgggtttggtctgctcttgctattctagttcttgaaggtgtatcattaaataatttgaagtttttctctttttttgaggtaggcacttatagctataaatttcccacttagtactgctttcactgtatcccataggttttggtatgttgtgtttccattatcatttctttcaaaaaaattttcggtttccttctaaatgtcttcattcatacactgatcattcagaagcacattgtttaatttccatgtgttgtaatgtttcaaaattcgtcctttgatttctagtttgttttcattgtaatcagagaagatgaatactattatttcaattttttaaatgttttaaggcttgttttgtgacctaacatatggtctttgagaattatctgtgcgctgaggaaaataatgtgtatttttggccactggatgaaatgttttgtaaatatctattaggtccatttgtcctaaagtgcaggttaagtctgatgtctctttgttgattttctttctgggagatctgtccaatgttgacagtggagtgttgaagtctccagctattattgtactgaggtctatctctttatttagctctgatgaatatttgctttacatatctgggtgctcaagcattggctgcatatatattcacaattgtcatatcctcttgctgtacggacccctttatcattatataattaccttccttgtttctccttacagtttttgtcttgaagtctattttgtctgatattagtatagctactactgctctttttttggtttccattagcatggaatatctttttctatttttattctatgtgtttctttagaaaggaagtgtgtttcttatagggaacagataaatgagtcttgctttttatgcattcagccattctatgtcttttcattggaaagcttagttcatttatctttgatgttattactgatgagcaagatcttactcctgctattttgttatttgtttttgggttgttttgtgttcttctcttctttctttccttcatttctgccttccttgtagtgaaagtgattttctctggtggtatgatttaatttctaatttgtgtgtttatgtatctgttgtatgttttttgatgtgaagttaccatgaggcttgcaagtactatcttataacccattcgtatgataatttatcactgattacataaacaaactaataaggaaaaagaaaactatttagaaagaataagacctactattgatagcccagcaaggtgaatatagtcaagaataacttcattgcacattttaaaatgattaaaagagtgtaacgggattgtaacacaaaggataaatgtttgagagaatctgatggcagtggtggcctggctggagcagctactgccataacgccaactgcaataggggaggtacagctggggctgtgtactccatggagccagtgggagctgggaacaggcagaagacccaactccttccgagttggcagagtaggagcctcatgctccctgggtgcagctgcagccacccagcaatggttcaacacctgggcatccctgtgctcttgggggcagggagcaggcagaagcctcacctcccaggatgcagctgcagccacccaggggtggttatgggcccaggtatctctgcactgttgggtgtccaggaagcccctctgcccttgcaggctccgaagtgcctgctcccgctccctggtctctccccactcctggcacccactttgatttcagaggaaaattgaggccaagcccaggtgctgtcacaacccaactgggtgtgcacatgctcagggcagcactgacatgccagcccctgctgactcagccccctctggactttggctgctgaccagcacagaaaggatgccgaggtggggctgagggcagctcggcaagagcctgcaggcaccgcttggcatgaacagcctgtgtgccgtgggcaccatcgatagacagcaggttgatggcagcaggaggcagataagctcctgggcagaaaggagcaggtccctagtgaagccctaccatcaggcctgggacagcctgaagcctggggaccaggctaccagttccatggacaagagtgaaaacacatggtgctttttcccaccccacccatcactgcctgtggaccaatcagcatgcacttcctccactctttagcccataaaaaccccagacttcgccggacttgggcagatgtcaggatgacctgcctgtggagaggagctccccactgtgggtctcctctttgcttagagctgaacactcaggacactctgcctgcagagaggagcttcccaaggtgagtctcttctctgctgggagctgaacagatgccaggacaacctacctgcggacaggagctacccactgtgggtccaatctctgctgaaagctgaacacttgacacgacaccttgtctgtggaggggagctacccactgtgggtttcctccctgctgagagctggacactcatcaggatgacctgcctgcagagaggagctacccactgcaggtctcctctgagctgttctgtcactcagtaaagcacctcttcaccttgatcatcctccgcttgtctgtgtacctagacaggggacaagaactcaggacccaccaaattgtggagctgaaagagctgtaacacaaacagggctgaaacacatcctttgcctgccatgttgtggacaatgagaagaagagaagagagaaggagagaagagctccagccctttggggagcctggatgtagacgcttccggagccagggctgccaaaccctctttgaggctctatggtttctggcatctccaagcttccaagtgccaccatgttccccggtgcccaccgtgaaagccacttgtggtacacctggttcaaccacaggctcgcaggaagccagcacgcacgctgacacctggagctgccctccccaccacagctggtgtgcctagctttgcgcagtgcctggaccccatgctcacttgctcacacaccccttgccattctgtgcctggctcaacctggctcaagtgcagcctgccaggccagatgggcagaacaaacccagtgggcccaagcaaaacttgggcaaaggtaccactagtcaaagaggtttccagctggaaaaacgataccccaagtatctcgtgacagatggataccctattctccaagatgtgactattattcattgtatgcctgtatcaaaacatctcttgaattccataaatatatacactactatgtaccaacaaaaattaaaaataaatttaaaaactaataaaaaatggatcattttaactttgtctccctgctttttatctttttgctgtttctgtttatgtcttactgtattgtctatgtcttgaaaagttgcagctattattttttattagttcattgtttcatctttctacttaagatattagtagtttgcatgccacagttgcagtgttataatattctgtgtttttctgtgtgcttactattaccagtgagttttgtacttttggaagatttcttactgctcattaacatccgtttccttcaggttgaagaactccctttagcatttcttgtaagacagatctggtgttaatgaaatccctcagcttttgtttgtctgggaaggtctttatttctccttcatgcttgaaagatatttttgcggataaactattctagggtaatttttttccccctgcagcactttaaatatgtcatgccactctctcccggcctataaggttcccattgaaaagtatgttaccagacatattggagctcctttgtatgttatttgtgtcttttcttttgttgtttttatgattttttattttttattatattttatttatttatttatttatttagagacagagtttagctcttgttgcccaggctggagtgcaatggtgcaatttcggctcactgcaacctctgcctcctgggttcaagcgattctcctacctcagcctcctgagtagctgggattacaggatgcatcaccacacctggctaattttttctatttttagtagagacggggtttctccatgttggtcaggctggtctagcactcctgacctcaggtgatccgcctgcctcagcctcctaaagtgctgggattacaggcgtgagccaccatgcccggcctatgattttttatttatccttgacttttggtagtttaatttttaaatgtcttgaggtagtcttctttgggttaaatctgcttggtattctgtaaccttctaggacttgaatgtttatatctttctctagatttgggaagttctctgttactatctctttgaatacactttctaccccaaactctctatcttcctccaatttaaggctaataatacttagatttacccttatgagggtatttctacatcttaggcatgcttcattcttttttgtatgtttgtttcctctgactgtgaattttcaaatagcctgtcttcaagctcacgatttctttcttctttttgatcaattctgctgttgagatgctgtgatgcattctttagtatgtcagttgaatttttcagctccagaatttctgcttgcttctttttaattattcagtctctgttaagtttgtctaataggattgtgaattccttctccgtattttcttgaattagattgagcttcctcaaagaagctattttggattgtctgaaaggttacatatttttgtcactctgggtttagtcactggtgttttgttcaagtcatgttttcctggaggttttgatgtttatggatgtttgtcattgtctgggcattgaagagctcgggatttcttgtattcttcacaattttatgcttgtttgtacctgtctttcttgggaagtctttccaagtattcaaagagacttgggccccaatctcagtaatgctgtgcttcctggagactcacagaggtaccactatggtggtcttggataaaattcagaagaattctctggattaccaggcagatactcttgctctcttgctctcttcattttctcccaaacagagtctctctctttgcgctgagccacctggagctgggggtagggtaacacaagcaccactatagccatgacgactggaactgccctgggtcagatctgaagagaatagagcactgtaccttgtccaagaccactgtaaccactgcttggctaccacctgtgttcatatgaggtcctaaggctctagaatcagcagatggcaaagccattcaggtttgtgttcttcccttcagtgtgacaagttgctctaggctcaagaagtttcagtgatgctatctgaaagccagggactgaagtaaaaaaaaccatcaaaattttcctggtattctattctactgtcactaagctggccctcaaacaacacaaagtccttccccctctttcctctcttttccacaggcaaaggaggctctctccatgatcatcaccaccaccactggcccatggggcattctggcaggccactgccaacattttcttagactcaggggctcttcagtcagcttgtggaggatgctgtcagatctgagactcacccttcaggacagaaggctctcctctggcccagggaatgtccagaaatgctgtccaagagccttggcctggactcaggaaccccaatagcctgcttggtgttctatcctactgtagccaagctggtccctgaggccagcacatctcagtccaacctaaggcccaaagcatactacctggctattactgttggttattcagggcccaagggcactttagccatcaggtgacatatactgccaggactacatccttcccttcaaggcaggtgggttcccttctggcccagaatgtgtctagaaatgttgtctgggagctcgggcctggtatgggggctagctgcctgtcaccccatcctagtgtgcctaagctggtatccaagatgcaagacaacgtcctctttactcttctcctcttctcaagcagaggaaaggagtcactttcattgctagaagctgcactgcctggaggcgaggatggcacaagtactccctgagccatcccatctggtgtctcactaggtcacacattgccccagtccactggctctaggcccacaacggcctcaaggcttgcctaagaattacagtccttgtgtcccagactgcctttcaagttcatttatgatcccagagcactttatctcatggtggcgagccttgctaagaaattcaaattctaaatgctgggaagggctcttcctctcttgctgttctggtccagatgctttctctgtgggactgggcagcactgagttcaatgcaaatccctccagctgctgtgctcttcctcccccaagtgcacagattctctcttggcaccatgcagctgctgccggaggttggaagaggggtggaagaggggtgtctttcccagcctcttcagtgcctctttcagtaatataaaattaaaaccaggtattgtgattgctcacctgattttttattcttatgaaggtgcatttttgtatgtagacagctgttaaaatttggtgttcctcttacgaggacaatcagtggaggcttcttttctgctgtctttctccacactcaaggctttatttgtaatcctctatcaatttcttacgtctagaggaaagataattttgagactctcttcttcttcataatttttttttaaacttctcaattttacttgtcaaacggcactgtaaagtgttaaatccaaaggcgtccaggaaatattcaagaggtagttatttcctgagtagccttctctgttctattcccaccctcctgctttctaactttggtctctaagtgttttcatttgtttttctattttaaagcagtaacagtaataaataatgtcctggaaccagtgtctagctgaatattaataataatactttccatttgcatatgctttatgagaagctctttctcacatcttgtctgattctcaaaatacctctatagaataaatggggcatcaataaaagagccaagtaataccaaaccatctagtctgatggggtgaatgcattatggatatcaaaggatcaggttttaccctaagttgagtggagactaaaattttaaaaatctgtatgtacaaaattgaacaagagagtaagacccaatacacagcaacataaaagagctagagaaattttagaagagaacacagctgactcaggcattgctctccctttctctccattctttacatatatttcctataaatataaatttataggtgtttgtatatcattttagttttaaaatacacagcatgcatgtaaaaataattttaaagatagtgtttcaaaatgcagcatacagagcctctgaaatttttaattagctggttgtacagtttaacattttctagctggaaattgcatggtataattaagaggatttaaagcataatttaacaaaatattactctatacttgacattttttaaaatgacaaattaaaatagaaatcatgcccttgttttgcagataaggatgctgaagctaaaaacaatgtccaaggccaaataactgacaagaagaaggccaaggcatctagaaaccatgtcttctgattcacagttgatcatatttttctatcacctttgataaggcataaaatattattttgatgagtaaataaaaagactttggacacctgctgtttgtctaatttatggtttccttctcttttctctagttgatatgactatattaagccaagaaaaaagttagatttgacaaacggattttaacaattttatgcacagaatattttttaaagttatttttacgagtctacagttttacaagtttaatgacatgttcagagggactagaaaatttacaaataacatgatttataaaatccatgatttcccaggaatatttttgccaccacatgggggtgtagtgttcttaatatgtactttgcaggaattctgagcatctcagctgagcaagcctggggagcagcagggagaactggattttatgtgcaagtttgtcttatctgcaccaagcatgaggccaggaataggagtcgatcttaattcatcctccaagtgtctcaaatataaaattggctttgtgatattaatttgtttaaattgttcaatctcaggaaaaacttcacagtatgtatgagttacccacatacagcagcaatttcaacaaaagcagccatattagtatgtgccatgctatattctccagtccaagaaggttattagaaaattgtttaattgaggccaggcgccatgactcacgcctgtattcctagcactttgaggccgaggcgggcggatcacgaggtcaggagatcaagaccatcctggctaacactgtgaaaccccgtctctactaaaaaaatacgaaaaactagccgggtgtggtggcgggcgcctgtagtcccagctacgcaggaggctgaggcaggagaatggcgtgaagggcgcttgcagtgagcggagatgcaccactgcactccaccctgggagacagagtgagactccgtctaaaaaataattgcttaattgagaaaaagttgcttttgtcgctggaattactgtgagataattgaccgtgatgggagctgtgtcccccagatgaaagcaaatcatgggagccagggtcaatcatattaatgtctgcagtgaaaagaggtgttgtgatcatcataagacataaccataaaatacttaaagtcttaaatggccaaagcctttaaactacattataatgattacagatccaataaagtttaattaaaacaaaactactacattgaacatccataatgattagaaaggtttctaattggggacaaatttggtattgagaacacatcaaaagaatttcccacgttctttgttacatctgtttgtgctggttttctgcttctgcatctgtacagggcacatttctaaaaaactgaccagtttaaaaattactttttaagtttataatgctcattttaggtaagtcattaactctttccataatttaggtgatcatttaatgttttagggattgggaagcacagcttacttttagttaaaaaaaaaaagcaaaaaaaaaaaagcatgagctttggaatcaggcagcctggggattctaggctagaattctaggtttctcatgtactaattgtgcaatttaactgcataatctctctgtgtccatagggtcctcaaagaaaataataggaaattatggataggaaataggaataataggaaagatggaattccaaagataatgtaataaagggaggtatgataggttaggggaattaacaaggaataatgaagcactccggaacccagcagcagcagcagcagcagcagcagcagcaagaaacctttactatccctaaggattagggcaagagagaagaaatagggagttacagtctgatgagaagaggagccttggaagaagtgttgactgacaggagctacggttatggagtgaccaaccccagtcactactatggcagaaaataaataccctggtatttttcttctcttctcttctgatctcttgcaggaatcaccctttggccaaacccaattagacaaccagaaacaagtcagcaaaaaaaaaaaaaaaaactctgggtggtgcagtcaatagtggtaagccctctaggcactgaaaaaaggccagagatgagcagaggaattgttctgtgttaggggggatgaaagtagaaaaaagcaatttacgctctttgtttctttttcctcatcttttcttttctttctttcttttatgaggcagagcctagctgtgtcaccaggctggagtacagaggcgcgatctcggctcactgcaacctccacctcccgggttcaagcgattctcctccctcagccacctaagtagctgggacaacaggcacgtaccaccacacctggctaattttttgtatttttggtagagacgggtttcacagtgttagccaggattgcctcaatctcctgaccctcgtgatctgcccgcctcggcctcccaaagttctgtgtttactggcataagccacagcgcccggccctttttccttgtttctaagtggagatatgaatcaactcttgtccaacaaaattgtaaagataaaatgaaatatacataaagaatataatgcagtgtagaatatattgtagatgctcaataaatagctagtgctgatcttatttttaacagtaaccaataattgtgaagttgaatgtatattctctattaaaacccaacaaccatccaatcaatttatcacttagggagctattctgtgtcttctttaatgaaagctgttttgttttcttctttacaaaaataggagactatgaatagagagattaaacactagaaaaattaattctctaatactgtcaattatatgtttacttggactttgatatgagggccctgaaaacgcagtaagttatatatttctgataagcacaatcctccacaaagagcacatgggcaggcagtgatttagactcagggttctaacattttacaccttacactacatgactaccctatgaaatatctgaaatgaaactatgattccaatagaaagcaaaagcttgcctttttgaggatataaatgtgcctttaggttttacatttaaagttacgagtaatcatcaaaagcattgatgtttgacaaatgactatgttgcacaggtctgcctcgactagcccataaaggagtccttactacctcaagcattctctgccacatcttaagtttttattgtccttaaggcatgtttctctatctgaaatgttgctttctgacttcttcatgagaacagagacctaggctatcctgttctgctttatgtctagtatttcctagaacagagcctgatagataactaaatgatcacacaggtacagaaaagcatgcatataaaagtggtagatgtgagaattaaatgacatgatatactcaaactacttttaaaaatgcattttactatggtagcaattattattgttgtttgcattattattgctactattaagaatgatggatacagtggttcacacacagtaaatattttggtgatgacaaatattattatttttcaaattgactagtctttgccatacatgcctgcacttaggacaagactggcagcctttgcattcagactgtgactactgccaactttatgtttacagtgactttgccagccagaatttgtagcttggaatgatatctctcaaatattagaggcaataatgtctcagattccagaacaaaatgccaagtgctaaatgccaagtgctaaacaaatcagaaaaggcaaaaggaaaacccacgtacttccacttccaagaacatgaagtagaagagattttctcaattcttcctactatgtacaaataaaacccctgggcattatatataaaacaagcatgagaatactctaaaagttggaaggaagcagttaaaacaactagtgaccctgggacccaaggaacaacatagcagtaacttctctaggttttcttttgcttcaaatattccagggttgaagctgaacaagcccaaaactcagaaacatcaacagaggcacacaagaacagccctaactaaagcctgtcttctttagccaaaggtccaggaaaaggcagaaagaacatttttacattataactgtcctcctccagaaaaacactgcacaacaatctgtgaccctaaccccacccaaaaagaccaaatgagagcctggagttgtacccttgtcagcctgtaaggaggttccccatcccccttgctcagacagtatcagaaggagcctagtagggagctgaaactttcatagacactaggcagtagtaaagccatccctccaacattgtaaccgtggagaaaaattagggagcttagatctccactcccacctgatggcaacaatatccatccctttcctggctagggtggtatcagaagaggccttctggagagtcagaactttcatacctgcccaagagtaaaagtattgcaccttcccacctttgcccctcattgtgtcagtagaggccacatgcacagtagcagtaaaagtgtattactaccccttccagccacagagctaacaatggaggcttagtgggaaacgggaactcccacttccactcagcagtattgaggagccatgcccccttgagtgtcaacagagacagcatgggaaactgggaattttatccccatttgacagtgataaggcagtatccactcctccctttctcctgccccaaaatgtacagaattacatagaaaatcagtcatattaccaagaaccaaaaagacctaaagtagagaaaaaaaaatagagaatcaataaatgctgatatcgtttagatctgcgtctccacccaaatctcatgttcaactgtaatctccagtgttgaaggaggggcctggtgggaggtgagtggatcatgggagtggtttcttatgaatgacttagcaccatctctttggtgctgttctcatgataaattcctcaagagatcgggttggttgttttaaagtgtgtagcctccccccatctctgtcttcctcctgctccagcaatatgaattaactggctcctcctttgcctgtcacagtgattgtaattactggctccaactttgcctttcatcatgattgaggcctcctcagaagccaagcagatgctagcatcatgcttcatatacagcctgcagaaccatgagacattcaaacatttttttttaaataaattaccaagtctcaggtatttctttacagcagtgtgagaatgaactaatacaaatgccaataccaaggtgaaagttaatgtcataaaaatgcttcaaagagcaattttgaacatacttgaaacaaatggaaacatagaaagtctctgcaaagaaagaaagtttcaataaaaataaaaggtatgcaaaaaccaaactggaattttagaaatgaaaaacacgataaatgaaataccatacaaaactccatggatgggttctgtaaatgaataaaagagacaaaagaaacaatcagtgaactggaagataaagcaatatgaattaaaacaatatattgacctaaaaaatcacaagagcctcagggatctgtagcattatttaaaaaatctagtatttgtgtcatcagggttccagaatgaaaggagaaagagtggagaatgaaaaaagcactcaaagaaaacatggctgaaaatgctttgaaataaccaaacaaatcataacaaacagattcaagaagctgagcaaaacccaaataggataaatggaaagaaatctgtgcaggcaatgatacattatagtcaattttatgaaaactaaagataaaaaattcatgaaagcagcaagagagaaatgacattttacctatagggaaaaatcactttgaatgacagcagatttctcatcagaaaacattttagaggttatatggaagtgatacaatattttcgactgctgaaagaaaagaactgtcaaccaagaatactatactcagtgaaaatattcttcaggaattaaaaggaatttaagacattctcagataaaggaaaactaagagaatttgtcaccagaggacctatgataaaatggcttctagagaaagatttctaaacagcaagaaaataaggaaagaagaatgcttcgaacatcaaaaaataatgataagaaaaagccatagtaaaccttctgggcaaatacagtagattttccttcttctcttggatttcctacattatatttgatggtagaaacttaaatagcaacagtctaatgtagatgaaatattttttaaaaaatatatagggaagactaagggaatataaatgaaaataaggtttctatgcttcactcaaactggtagaaagacaacacagtacactgtcatatataatgtgatattaatacttagcccaacacctaagaggaggaattaaacaaaaaggtggacccaaacatactctaggaaaataaaacgggattgcaaaaattgttcaagtaacccactggaaggcaaaataaaaaagcagagaaataaaaaacagagagaacaaatagaaaattagaaataaaacagaaggccaggtgtggtggctcacatctgtaatcccagcactttgggagaccaaggcaggcagatcacctgaggtcaggactttgagaccagcctggctaacgtggtgaaacctcgtctctaccaaaaatacaaaaattagtcaggcatggtggtgggtgcctgtaatcccagctactcaggagactgaggcaggagaatcgcttgaacccgggaggcagatgttgcagtgagccgagattgtgccattgcactccagcctgggcgacaagagtgaaactccatctcaaaaaaacaaaaaacaaaaaagcaaaaaaagaataaaacaaaagatttaagccttaacatattaataattaccttaaatgtaaatgatctaactttatcaattcacagtcacggattatcagaatgggttaaaaaaaataagccaactctatgctgcctagaagaaattcactttcaaatgtaatcgaggcaggttgaaagtgaaaaataggaaaggtgtatcaggtaaatatcaatatttttaaagtagaattatctattgtaataccagataaagtatacttcagagcaaagaaagttaccagatcagaaagagacattatttaaaaataatagaatcaatccacaaagaagacagcagtcctttacatgtatgtacaaataagagttgtaaaatatatgaagcaaaagcaatagaactaaaaggacaaatagacaaacacataattataattggagacttcaacactcctttattgacaattcacaaaatacctacgccaaaaatcagaatgcatatagaataataacaccatcagccatcagaatccaattgacatttatagaattctccataaaaaactagaagaatacatattttttctcaagtgcccatagaacatttacaatgcattgtatccagagccacaatgcaaatctcaataaatttaaaataacttaaatcatagagagtgtgttatctgaccagaaaaaagcaaaattaaagataacacaaagaaaaatctccaagtgcttggaaactaaaaaccatactactaaataatacatgtgtcaagagaaagtctcaaggcaaattaaaaaatacacatttcagtgactgaaaatcagaatacaatatatcaacatttatgggacacagttaaagtcaccctaaagtgaaattgaaggcattaaatgtatatattcgaaaagataaaagtctcaaataattagtctaagctcccacctaggaaatagtaaaataaaaccaacgcgaacagaaggaaagaaataacaaagagcagaaacaaatgtaatttaaatcagataatcaagagataaaatcaatgaaacaaagaatttgttgtttaataagatcaataaaattaacaaacctctagcaagactgataaagaaaagaaatagtataaattacaaatatcagaaatgaaataattactaaagaccctggagacatccagaggacaagaagtgagtactacaaacagttctatacacataaatttgacaacttagataaaatgtaccaattacccaaaaaacacaaactaccacaagcaacccaatatgtgatagataatataaatagctccattacctttaaaagacttgactttattattttaaaaattcccaaacaaaaaaagaaatctttaggctcagatgattttactggagaactctacaaacatttaaaaataattaagatcaatttgatacaatcttttacagaaaacagaagaggagagaacacattcctattcctttctaatattattaaaatacttcagacaaaagacaaaagaagaaaactacaggtcaatatccctcatgaatatggacccacaaatcccttaaaattagcaaataaatttcgacaatatataaaatagtggataccatgatcaagtggaggtcatccaagcatgcaagactgcttcagtatttgaaaatcaatccgtgtactcaacaatataaacaggctaaagaagagcaaccacatattcatttcaatctatgcagaaaatacagttaataaatttcaacacacattgataaaaagtcttaaaaactgggaatagaaggaaactttctcaactcaataaagtgcatctataaaaaatctgtacctaacattagatttaagggtgtaagatgaattattttgtactatgattaggagcaagacaaggatatctttcccaccactcttatttaccataatgctttaaattcttgccataaagaaaaaaaaaataaaagtcataagaaagaaagaaataagactgttcctatttgcatatgacatgatcatctacaaaaaaagaaaagaaatcctaatgaacctacaaagaaaaaaatcttctagaaccaataaataagttcagtagggtaacactataaaagcatacataatcagttgtgtttctacatattatcaatcaacatgtggacacccaaattaaaaatataataccttttacaattgctcaaaaatacttattctaaataaatactgtatatcaaaaactataaaataatgataaaataaaccaaacaattttattctgaagtgtatatgaaaatacaaaagaactagaacacttaaaacaatttaagaatgaagtgagagaaatcattccacctgatttcaacacttacagagctacagtaattaaaactatgtggggtccaaggcaaaatggacacatagatcagtggaacagaaaagacatgcccaattggcttttgacaagggtataaaagtcactgaaagagaaataatcttttcaacaaataatgctggagcaataaacaccaataagcaaaaatagaaataaaataaaatctcaacctaaatcttatgatataaaatttaacttaaaatggatcattgatttcataaaaagaaaaaactgataaactggatttaatcaaaattgaaaacactgcactggaaaaatcatattaagaagatggaaatacaaactacagcataggagaaaatatttgtaaagcacatatccaaaaaagatttggtgttgagaatatataaagaactgtcaaaactcaacaaagtaaaataatccaattggaaattaggtgaagataggaagagatatttcaccagaggaaatacagattgcaacataagcatgtgaaaagatgttcaatatcttctacctgatttcaagacacataacagccacagtaattagacactaaggacatgcaaattaaaatcacagtgagacatcactacatacaaaatggttaaagtaaaaacatatgacagcaattgctatttaggacatggagaaactggatcgctcacattcctggtgggaatataaaatggtacaaccactcttgaaaacagtgtggaggtttctttgaaaacaaaacatgcaactattaacaaataacctagtagttaacctagagaaataaaaacttatgttcaaatagttttattcacaatagccaaaagcctgaaataactcagacaacctcagagagaataattaaacaagctgcagtgtgtcagtaccatggaatactgttcagcaataaaaagtaacagactactgatacacatatcttaaatgaaattccaaaatattatgctgagttaaaaaaaatctcaaatgtatgatgatttcatttgtataacattatttaaagtgacgatattatagaaatggagaacagatcagtggttcccagagattaagaagagactaaaagtagagaagggggtgtggcaatgaaaggacaacatgtggggtccttgtgataaagaaagttatcttcatcttgactgtgtaaatattttgattgtaatattgtgctgtagacattaccattgggggaaacagggttaagggtataggggatctaacgctctgtattatttctgacaactgcatgtgaatgtataggtatctcaaaataaacttaatttactaaagtgatgacttaaataaaatttccttccctgtcattccccaacttccacctcacctcctgtacttcttgtagctgattcaaccaccagctggtatataaggtatgcatgtgtgcatatgcatgagtatgtttctgtgacagagtgaaaaagaggggagcaagaggatggctcttccaatgctagccctgctgtgcacacacagtaggggagtaggagaaagtgcaataaggacctcaagtgagtttaggtgcattctgccttcattatagtaacataaacctttggatatgagagtgccaaggagggaaagcagtgtcattttattcagtcagtcttacttttttttgttttgtacatggaaaataacattaggatgaggatactaacaacaaagacaattaggccattcccctagtctcatcatcttataagggagatgtaggctattttaaaaaagagaaaataggagatcctgaataacatttctcccccacatgattatatgtagctatatgactgataggcttaccattcattcacttatttatatatccatttatttatttaaaaaatatgtactgcatgcctactctgtgatagaaactatgctaggccatagatattcaaatgtgaaaaagacacatattctttctataaagtagctcagaatctattagagaggcagattcttcaaaactgtcaattttagaacaatgtagaattgttctgctttattcaggagctatgaacagagtatcacaggaagatacagtgagtggggaacctaacccagccaggcacaagggtgtcgtggaatgctcccagagaacatggccccagaactgagcttatttataattccacagttattctctgtctaccatgtgtaagtcattattctaggttaagatatagataaaagcgtttcagacactgaagatagaaacagcatgatccagacaaatatgatccagcattatccagcagcacctcaaatatttattaaattaagttgaattaaatttgtggaaaactaatagaaatgtacttaaatctttctcatgttgagaagaagaggcttaagactttgaactccagataaataaaatgttactgtaaaatactggaataattgaactttataaactcacaaacatacttgcacctttataggcacatactgtgtggattgatgcctggtcagagatgagtcaacaactaacttacaatgtaaaagcacagaatagtatctgatacttttgtgtgcacaataaaatttttttaaagcctcagattgcttagcctcctatgcacagattgcactgttcactaaaatgctcaaattagttatgcaaatcctgtgtcatgtgatgcctctccaccatatgtgactagttaccatagcagtcagcttaagtgcatattttccatagcaacgtaggaatctttaccatacagagacctaagtgagacagaaatgaaagcaattccacagcaatatgaaatataaatgttggcaacatcccctgaatgcttctttaaaacaacattgacttttaaatgtcacagcctctgggtggttctcttttagcctatatcagcacctctctcctgttggaaatgtgaaactctttgagaacacacaacatttatgattgggttaagaagactgagcagtggtatctgcaatctgcaaattgaagttccatatggtggtgtgatgtgatgcaattgtcgttttcattggctcactgtgtggccacaattcctgcctcatactacaaggctggaaccaaacggagctgaaattttcccttgtcttgttggtcttttgagagcggttatccacccagttacatcaatctcattcttgatgtttaataggaaggctgtttatccttaaaaaggcttctagatccactggcatatataagagtgaatatatagatgagaaacaggattccagaaactccattcatttattgtaggtttaatctttttacaaaattaaatacatacacacacacacacacatacacacacacacaaatgtaggcctgaggagtggtcctggtgttgagctaaatttacctgtgggtaacactatgagaggttgccattgagcactaatgtgccaggcactatcctagccttctagatccattataatgaaccttcatagcaaccccttgagaaatggcagcaactctgaacttcccggaggagataactgaggtacagagaagatgattaacaccctcccaaccacaaagatacctgattagaaaataatagcactaacattgaaagtcatgtttttctactctaagacccaaactcattccactattctttgcaatgtataggaaaataaaaaagagaaaagagctaagactgagaagaaaaaggctggtgtgggactcaaagatatgtccagattgatggggaatcgctgacagagaatgcaggtggaataacagatattgagacaaccccaggcaggtctcagaatgacatagaatgggtcttttggggatgttgtcctcattaagcactggctccatccatggttctcctggattctttacacattacgtatttaaacgatgtgaagacacatagcttctctaatggtgattacaaacctaatagaacactttttctattactcagcttctcagtaccccagtgttaatttcccccctccctctacacctctcactggaaagagactaacttttcttgctcttctatcatttggaaataggatggtgctcatttcagagccagaagctgtaacagaaaggaaaagaaaatacatttttcttgtttctacactatattcctgcagagtaaccccttaggagaaatagtctatttgattcctaaaacattattatgaaaaagtaacctcttaaaattacactgctgtggctttagcgaaatgcgcttgtagattttttacatttgtttctcattttccaagactcccctcaaagaaagtttgcagtggattgctgagctgtgatcattcatgtgaattagttagagactgtgccaaggagtctctgagcctacacccagcacgttgagcagtggatgagcatactagtgtaactggtatgcaatggagaaagtcgctatcgggacctcaaatctttccttttaaaagtaaactggttatgaactagacagtaatctaggctttttctgctctagatcactggatttcagacacccatagctaccagagtgatcaatccaaaacagaaatctcaccatgtctctccaatacgcaagcccatagggcatggctccccactgcctttctaacatgagagtctaggccttccctgacccagccctttttgccttccagcccccactgttaccactccctccctccacagccttcatactctgaaacaccttaaattacgtgcagttctctccatgcatcatgcttctcatctctgaatagatgtttatgtttgttcatgtttgttcctctgcttagaaggatctacttccccacttcacccccacctcctgcatttgtctagccaacttcactcattcattagggtcaccctgagttaaatatgccttctctgtgctttgctatactcttacattgctattcattacactcacactgtcgtattataataataacaatatggaaagaggttatttgctcaggaaaatctctcatagtaaaaggtctgctttattttttgaagacatgctttgatgagcctatttaacatatagatgctttgcctgatggggctgctttctgggagacatgtagagaaggggagtatatgctgaaagagaagtaagagaaggctttggaagaggaagaggagcattagggaaccagcaccagaggcaaaggtggagagcaagacagtaggaaagtctcatgatctcaaatttgacctcctcctcactgtgactatttagttcacaaagtcactcaactctcaaactgtttgtaggaaatacaatttaaggaataaactaagaaagaggctttgctttatatctgcactcactaggagagaggaaaacagccatatggatacagaaaacactagaggaataaaggaatagaaagtaacttagagaaactagaagaaattgtgaggagagtttttgactgtcccaggacatggaatcctggtttagtcaaaatttgatgacatctccaaggggcagaaggtgtcagtaatatctggcttacataattacatgaaacgtttctgcttccatcaccaacctggggaatctttacctgctgcatcaccgaagctatcctagcacctggtatattgtagatgttccataagcagtaggtaaatcaatattattcatatgctatatgaatcgctagtttaaagtaaatttaaaagaatgacatcttgagaattgtttcctggatcctagagacagctagagatatccttcattaagaagaaaattacttgaaaattaagagtctaaggaaaactaaattaagaaggtcaatttgccgaaaaatgcatttaatgattttcaaagccatatataaatgaatcttggattatctgccccagtgctcacatctattaactgggaggaatgcataaaatgggttatgatgagagggtctggagctgttaaacatagtgtgccacctcatagtggggtctcaagccatttccttctctcatcttgagcctaaagtgcatccattgcatttttcatgtatcaggctccaatgtagcaattgcccaatagggatgacgctgatattggctgttactctttcagtttgctgcaaacaactttcatttgtcctgccaggatgcctgtgtttgggggtaaggacaaatgagtggaagtaacacatctcaacagttatactgtctcaaaagctctgcatcatagagtggcaccagggggttgctggctcattttagattacaaatgcaacacctttttgagttgctccatacgttttctgccacctgaagcaaaaggaacttgattcaatagtaggatgagtttgatttattaaagttgtagacagagtaggggctgcctccagaggagcagagaaaagaaacaactggtaccattttattattcctgtctccattcatctgaaaactaaactggccactggaaaaccttggagtacaatttgttaaataccttcatctcagatcaaatagagccaagaatcttggtaacatacacagagactgttttatcttaaggccgtttgaaatctaatgaattttcttcttcttttccacatggtctcggtgttctaattttcaaagtggtctaacattttttgattcatagaatggttaataacaaaaatggcagctactatttttgagcatttactgggtgcaagaatctgtactatgtaccttatatacagaatctctaattcatataacagccctgcaagaaagctgttattaccctcacttcactaagaaggaaacagagttcagtgaagtgaggtatcttgctcaagatcacattgctagtaaataatgatgctggaactaaaataaagatctaactcatatccccaaccattacagtcaaattgcctcagaaataataatatacatgaaatctctgtgtaaactgtaaaccaaaagcaaaactatgtataatgaaatgagaattattttggacttcaatagcttatatacaacatttactgccattctgttaccatatggtctttgccaagtcatctaaccttcctgagagtcagtttctgcatctgtaaaataggtatcccattacccattttattacctacttcctattacattatactacagaagaactagtcctaagagcacattagataatggatgtgaaagtaatttgtaaactgtaaagcaccatgcaaacatgagtttcgcttaatgaagtatggaatcataaattaggcactcagagcaatcttttaaaagaggacaagcactctctctgattggtgcctaatttgatgcttacattgtgcaggaaccatttcagttgaactgtttgagtggctcaaagcaagttactttttctaggcagcttccatttcaatataagtgccagtaaaagatcatgcaaagcaaaagggccctcctgaaggtgatgcggagtcaaagctgtctgtacaccaaggacctacctaggtcctgaaaaaagcagcccctttaggcttagagtaaggactcatattatgttgttgtttttcaatccaggaagagctctagatgtgcccagcatgaaagaaaacaagtgatacacattcttaagcttacatctcagatttagggggttgttttagagagaacatctataaaactctcttggattctagccagtagattctgaatactagttgacaaagaagattactccagccacctgcagcttatgagtctgggagagaatgatcatattattctacttttaggttaatgcatattatgtattctctacagtaatttgctagtgaaggtataacaatggtttcaactagtaatgggtgaagacgattactttggcaggaagatgtcctcaccttgaatgtcatcaaaaaatcatctcctgcttagatgggaggaatttcccttcaacaagacatttctgaaaccagagggaaagagaaagggttgggtgctaatacaagtaaatctgtgatcacataattcagtggacaataggaagaggtcttcttctgagaatattttcttctctaaaataatcataacaattatatattaatattactaataacagattcctagtgctcccctcaatcctgagtactagcatatgccaaacagatgatgaatatatgaaaaaataaatacatcttcctaacaatcttaactgatgcctcacaactcttgagctctgaaatatttctatactatttcataatacttctctatcagaggagaatgacttcaaggcacactgcagaattcaaacacttccacgtagaggacaatgactggcaggcattctgcccttaggaaattctgtctctatttattactcatccaagaaatattctattcttcctatgcctagcacagtgccgagcacttacatagtcagtaaatgtatgtttcgaaatggaagtgccctgcataaagctataggaaacttttttggtttagattttttaagaaataaaaaccctcaatagagttctttctctcttcttcccataactttcccatttattatttataagccttaggcttgttatattaataaatttatatttattttccattaacatctccaataaatatttcttacattaaatatattatataaatatacttaacaagccagaagttcagagacatttaccatgaagctaaagaaggtctcttacttgcatgaaccccttacaaagccctgtatctaattttgtaattacaatttgtgctctttttcttaaagttttctatgccaagttatagaaagctcaggcacacaaaaattaggtctatctctagagaaacttcactgtgtattttaatcctataaggtacatatgttatagacacagggcttgagaattacagaggtatatgacttgcccaaatactcatcttgagtggcagactaatgaatcaagctaagatcttcagcctctaaattcagaactttttgattgagccacaatgccttcttctcggatatggatgagactgtcatgttcataatttccaggcagtccattatcatcattgctgagatcagccatctgtttcacaggtgggcagaagctaatacatttaatgagagcccacgactcaccaggcactccaccagggcctttttacacatacatacactggcccacactccctcactcacaaatacacacacacacacacacacacacacacacaatttcgtttgatgcttacaacaatctagtaaaggtacacagagaacagaagaaagcctctaaaagatcaacttgctgtaagtctcacaatagaaagtatgtggtatttaaacctatatctacctgactctgaagtctatgatgtttctgttatataaagctactgcttcttcctgtgtcaaaactgggcaaactagtcacctcacagaaaaagccaactctcttaagtcttggaagcctgccaggacttccagtgcatgtcagcagtggtttttcttcagtgacactgagaagagaaaagccttcaccagtcctcttcagattcaaatgtcacaggtgaatatttgagattctaacatcactctctaacactccatcggctgaaaatgagcccttttcatgcctatatgcctggcattgtcatgatctcttagacaatggagataacctgataaaaaaaaaatcactctacaatccgagcctgctgtaatacccagattcactcttcaaatccagataaaatgaagcatcaactaaattacccattgacctgccaaggagaagaatttaacaggaaacctcagatagctgagttaccgcctcactggggatgttagaaacactgacagcacatgcccagatttagccaaatggctttgaagctcaggaatgaaagtggcagcagctgaattccacagcttgacaagtgatcacatggggtgtaccatacagccatgaggagaaacctgaacagagctgcagcatcattactgtaggagtgaaagctccccagcacatctggagacctgtctgggtaagtgtccacatagtcttacctggagatttatgaatctgctacaaagaggtaggatttccaggaaaaattctacttttcagaaccagggtttccaggccagagcagcccctcatactagatgtagggcctcttctcattgtggatttaaaagcacagagatccacaagacaatgtacaactgtaaattaaatacaactgcaattaaggccattataccaaatactggaaataccagcaggactcccttcttctacctcccaagattaaaatctaggatattcagaaccattatcagggctcaagctgattttaatataaaggcatggagcaatacaatctattacttttcaataacctccttgtgatggccttacttcacaatgacccttaactctcaattgaactatagttacagcctcataaccagtatccctttccagtttctttctgttccactttatcttctacattgctgctggagtgcttttgaaaagtgtacaggtaatcacgctttgcccctcttaggatctctgttggctctctattgcccaaaggatacaggaaaaatcccctggactcacagacaatgctttacacaatcttttcctccaaattccaaacttatcctcaaatttttcccttgatgaaatttgtactccagccatatagtcttccttgacattccctggacacccatattcttttatgtctctgtccagtgcaccttggtttctgttcctaaaatgatattttctactttcaagcatgcagaatcagtatttatccttcagataaagtgaaatacctttttttttttgagaagccgagccccactcttctgtaaggaattattcttttccttatgatcctatgggattttcacatagaataagagaaacacttctcacagtacattgtaattacttgttccaatgagtctcttcttccatagtctgtgaatttagcaagggctgagttctttctcattctactttgtgttaccctgaattgtttctcagccttttggctaagatcaagtgttctaccaccctagaaacttggcatggagtagatagactgtaaatgcagtagattataatagaatgaatgaatgaacaaataaaatataaggaaatgcagaaaaaaatcaaatgtgacacaagaatgtaccgtataaattagtatgttttaaatttttacttaatgataatcatttttccaaagcaatttcatttgagtgctaaacaatagttctcctccaaagtaaaagagacaacagacgaacaactgtgtcttcccaaagacagaccactttcacttactacaatcttatgattcatgaatataaagaactctgatcatgatctgtactaggggccaaaaaactttatgaaacgcagatagaaaacagtttaggctttctgggccctatgtctccatcgtaactgttctaccttgtcattatagagtagaagaagccatatataaatgaataaacgtgaccatattccaataaaactttatttatgggcactgaaacttgaatgttatgtcacattcatgtttcacaaaatattattttagattgtttttcaacaatttagaagtgtaaagacatgtctagcctacagagtgtacaaaaacaggtggtgggccagatttagctcctatgtatagtttgctcacctatggttcatacaatgtaaaaaaaaaaaaaacaacaacaacaaaaaaaacaaaaaaacaactttggttaaacttctagtcattttttgttgttgttgagttcctttccaatgtagaagattctttgccactggaactgataacccattgtgtattacaaagagttagaaacataaaagaaaaagcaagataaatgatttgtcttactgaatatagatagggcttgtctggcttggtatatggagattacaggatggaaaacaatgctaactttttttaatcatatcaaacaagaaacaagcagatgatcagtctaggttgattagatgactatttgatgaaaaattcaaaatatcctataaaaaattcactgccaaatgctattgttatttttgattagatgtgctacatactggtaaacagaagcaatattttactattcagcaaaattatgagagaaagccattttggtaaataatatcctttgccctccaaaagatacggcccataagtggcaactctgtcacagtagtttacctctgcacaagagccacatctagtctctttgaatgtccaaaacactttatgtggcaaagtgttttcaattatttattagttaattaaactaattaactcctcctcctactcccagttgcattgatacagcattttataaatggtaaaatcaagacatttattacctatttaaggtaactgaaatgactggcaaatgataattggaaggaggggtaagcttattttttaaaacagattaataggaaaagagtatgaataattaattagataaggattgtgaaagtggtttaaatgtgataaagcactaaactcaattattaaagtccatttagttattttccaaaaatttaaactcgcctcaaaagttgtttatgaaacattaggaatcatcttaatctagacttcatttcagaagctgagatctgtgaagtttaaagaaactgtcaagcttaaatggcagggtcacaggaactagctttcaaagaactatgtttctctcttaagatgttaagatggtagtatttataaactacattgtattttcttatggagagagaaggactggtctttggaaaccttgacacatgtctacacttttcagaaatacaatgaggatataaaaaatactttcaccagaattatattttcaagggattaaatgggtaaaaggtactgttatttgatcctctgtctaaattctcctaacttaattgagccacagtatttataaactgttttgtacactacgtgtataattatctcaattcccttgtaaaataatgaagcctttgaagacagataatatatttaaaagtagttttgatatatcagtttcctcatctgaaaatagcagcacatataaaagtagttactttattaggttatataagggtaatttaaaaatgcatgtatgtaaaacatctttttagcatatagtgagtgttcaataaatataagttctaattaaaggtgttcaataaacactcatcaaatagtaaattgatgaagaggaaggaataaacaaattaatgaatgaataacattgtgcatctgatatgcaaattttcacctgacttttagaaatctactaaagaatgccatcaagtccttaaaatgacctactagtattatagaattgaatatattaaaggaatacatacatttctatatataataagaataggaatataataggagtttgtctcttactgtgttcatacttacccctctcctccagccacaccagcctggcctgtttgctccttgaaaatgccaaacatactccagcctctaacctttttacttgctattccctctactttctcctaggtaatatgtggcttgacctctcacttcctgcagatctttactcaaatcttatcttcttagagtggccttcctgaaccatcctgttagaatgggatggttgtatatccacacacacacacacacacacacacacacacacacacacacacacacttcatattcccctgccgagcccagttattttctccatagcacatatatcatcactcaacataaaaaaaagttccatatttctttttatttggaatgtaacttccatcatctgggatttttgtttgtttcgttcactgctttagaacataagtcatttgaatagtgtctagctcatagtagatactcaatgatatttgctgaatgaataaaccacacaaagatacaattttaatataaaattggtagcatgactatataagatataaaaatataaaaaggtggcacggctctgtccattactgcaaaaaatattgattgagtgattactatgttctaggcattgtgagaagcacttgagtgagttactaataggagtaaaacaatctctgtatagaggttggaactaacaaactggcattgggggtttcaacagcattctttccttcttgtccaaaactcaactcttgttgtatgtccctctcaccaatagcaaatctaaaatcctagcaatcctagcaaccaaacactttgcaggcagaactgcagcctagcaagagaaacactaacttcaagctgtgtccttatcttctgctcacatctttacaaattcaggcagctgataaacatttaatgaggtcctcattctatactaggtgctatggaggattcagaggatttgaggcacagctactgatctctaagagaagagaacaatgttaaaattagaaacacatagctaacaaaaaaagagattttcagtaactgtgaaatgtttgattttaaacagtaaatactatggggtttacaaagataaatttctttatttgggatgatttatgggcagaaatttagtaagtgatgttggaggtgttgtatgctctattcttgagaaggttgctttttattcatgaaaatcagaagaaagctaccaactgataagtcatcctgctgggtaccttcacctgttttcacaggatctttatgacagctcagcaaacttggtcatattgttcccatttgtatggaaaaactgaggctcagaaaggttttgcatcttgtcagaggctcttcagagttgcttgatgccactggccatgttgtgaagaccacataggctgtgtatggtcataggcaaaatgtgtggctcaggcttaagtgtcgcaacactcagagctaacaattaccagacgcccacagtgcatgtgtggcaacataccagggctctctttttagcaggtggcctccccctcagccacatctcccatattatagggaattaagcatttgttctccacgagacacattgctcctatccaaactgaccttgattgtgggctcttgacatttggaatctttagaactgtaaggaaaaatcactgtgggtgtgagaaacactattgaaaatcctacttattaccattaactcacttcatcacctatttattatggtttactcttctgagagacagtctccgggaagaaacaatgtttggtggggaatcatctgctcaagctctgggcacagtgtgatatagcacaccctggactggacttcaggcccaggtgttaggagacctgagtttgaatgtcagcttaatgctcacatgctgaagtcttgtgatcagatcatcttactgtatttgtattggtacaatgaggaagtgaaggtagacagaatttactgtcctttcacattcctaaggcccgagctgacaaactacacacactcaacagaggcttctgcaagtcatgaggaccttggaaattttccatgggttcttgacttaataagatccttttaatgaccctgtttcttcttaaagagacaccatctctgagaaatgaactatttaaaaaatccaaaagcaattaagttcaggaatgccgtaagctgtgataaagttgtatttcttgactcccgctggtgtttatattgctatttctcttctgcctgtcagacacatttcagactcctataattactgagggcaaccatctcatccagagatatcctcactgtgtagtctgtttggattagcaggtgattccagcaactcctcttcagcatcattgttgtttcaaattacattataaaccagcaggatgcaaaaattatattggttcatatagcatttcaattactgttattccatagacatatcccttgcctcacttgttcaccttcttcatcagtcagtcacagaatgttttctttctcttcttttattaccctgtaaatgctgttttgttaccctttctcatacaggatctaatccatcctttcccttatctcagcatctccagtcccactcctccaaaccagaaaaacatttaatggtttgatatataacatacaccctcagtgtttatttttggggggtttgttgttgttttttgctcctcaccatgcattctatcttttcttaatttttaatttttctgggtagatagtaggtatatatatttatgggttacatgaaatattttgacacaggcatgcaacatgtaataatcatattaggttaaatacggtacccatcacctcaagcatttatcctttgtgtttcaaacaatccaattacactctttcagttattttaaaatgtacaattaaattagaatttactatagtcattcttttgtgctagcaaatagtaggccttatttattctttctaactatttttttgtacctattagccttcccccttttaacttccactaacttgcttaaatctttgacttccagaatccattccacatcaacagccttgctaaagtgtaagagatggtctaggagagcctcggaggcaaaaatacaaactcgttccaatcacatagcttgtagttctgtgctcccattgccaaacaaacaactgcaatttccttctggaattgttctttaattcctcagtatcagaaatattatttctcagcaagctatgctctatttacctttattaacttgaacatttatgcccaagctacttagtccaggcctattttggggccctggtagagtctagagacagtgctctattcatttgtgcctcacatggtagagaacttgattgcatagagggcacactggcactgccatggtgtgaggtgccatgttttctaaccaggacaacctctgctgctgccttgcctctactctcaattttctttggtccttcctccacacaataaccagactaaccttctcaacaggaaatcttatttatttttctaattacttcttcaaaatctttcaatatttctccttgtctatatggtaaagtctaagcctggatgttcagtaaagaatggagatagactttctaacaaggtttttctgtgtgacaggggagagactggattgaagagtattaacaaaactcaatttttttactatcttcaatatagctggcactgtggtgtggtacggcctctaaagaaaccacctgcttcatcactaataataccgcagagcacagtaactcaatatatagttgaggaaaatggaaatgatcatacaagtaaggagtgaccatataaattgaccaaagtcacacagatagtaagtgatggggtcaacattcaaactttccttatgttaaagtctctcactacaccgtgttcgagggggcatcatggtaataaaatgggctagataggacagtgattacacagagacaggaatgggaatttacaatgactagaagacagctcagaaaccagctagaaaaactaaaaaaaaaaaatttatgtctgatgcaattctgatgtgatttcatggggtgtttaaaatccagacagtgttcattctttagtcaataggaagcacagaagcaatttagatttttgaacttaggaggataatattgattgatcaaagtagaatttttggaagagtagactgggtataggagatgaaatccccattccaagagttaggcagaagagcatggcaggatggcagccagagggtaaagctttgggaacggtggaagttgatggaagcactgggaacatgataataaggctggaactgagtacatacagtcaaaaaaaaaaaaaaaaaaaaaagcccaggtcagaaatacaaacttagagactttgaaacaaagaccaagagccatttttttctattcactggtggtcataaaaaaaaattccatcatttccaacgacatggatgaaactggagatcattatattatatgaaacaagtcaggcccagaaagacaaatattgcatgttctcacttattagtgggatctaaaaatcaaaacaattgaactcatggacatagggagtagaaaggtgcataggtttttattttactattatgcttcataatgtagatatatgccatgtgtatgctcttatatacatgccttaaatacgtcagacatttaaaataaaataataaaggttgatagacaacttttgacatggcggtggaaacgtttgtaaaattgaatgtccaatagccatgccaagatggaaaactgagaataatggtgggctccaaaaggactggataggcaggggcaggagagaaagaaagcagggaagtgtcattaggtaaaacagacagggtgggataggctggctttcattggagctgctaacattttacatctatatgttcagtgaggaattttgtaactttggttcttaaagccaaaacaattctccagccatttctgttatctttcatgaataaggatggaggaagatactcaagacaggaagacaagctaggagactttcactttattcaaggactaaagtgttgaagaccagaataagaatagctgatgagacagtagaaagaaatgaaatgagaattccattttaaagggataaatagcagtaagtaaaaataaaagaaaagagcacttacagaagaatcacatgaaagattttcctctgactttactctcttgttaccacctatactcatctcctgtcattgatcttctcatatttaatctgccagtgaagccaaaagaattctcctttggtgagagtagtgaggaaaaataaagacatggaggtgccaaagctaaggcacaatagaatcaccttaataccatcagcttggtttgaattgaaaatacaattctagcccagtacataatctcagaaacacaatttaagctctactgaatgctgtaaaaatgcagaataatcatttattgtacggctatgtgttggtatgctcaaaaatggcttagagcactgaaagaaatgaactcaggaaatggcaggacagtccctatgtactaatgctgccaatgcaatttccatagtatcacttcccaataatactgtagtccattagacagaccaaatcaatggtgagtctctggctgagtctcttttcaacagaacccgcctcaggctctctgtcccctaccacactcagtagtggatatttcaggttacacaaagacatttttatataagcctgagtaaaacataattagacaagaaaaataatgatatataatcttatggtagattattgtaattcccaaataatcactgtccttcttcctgtgtgaggaatatacctccctgccccactcacataggacttgaccatgtgatttgttttgattaatggaatgtgagcagaagtgacatatgccacttctgacaagaagctttaagactcatcatacagttgcattcttgctatttttctctgcctgaagactttcacagccaccataggggctgtttctttagcctggataccagaataatgattcataatgaacatattacataggtgagatgtatacttttgtggttataaggcattacaactctggataaactgtgctgacaaaaatgatcatgaattataaaggtaattttacattattcttagatatggaaaggcagcgtagtaaagtggaaagaccacgggcttaacagttaaacaggtctatattttaatcctgctttagctccttaagcctaggtgactttggtcattaattaacctctctgaactctagattcctttccaatcccaaagttaataataattatttctttcagaagggtcgaagataatgaggtgtctcatgtagtgtacttagtacagataaagccttcaataagtgctagttaaatcaaaagatacttgagacattttctgtttttattatttatggaaaaagtgatcacattttctgcagtaaaatttgggacatacatttaaaaataaatagaatagaatagaatatcctaactcaggtctacattaagaatgtacaatcctttaatttacaacataagtccaaagataggatttgaggcagagagtttaagtcatcaatgcttcattagaaaaacttacaacaaagttgggtaaccgctaactgcacaggaaacatcagtgaaaaacatctatcattatatataatatacaaatatcaaacattaattactaccatgtattcagagcttttacatgttacatattatgcttagtgatatttactcttacattttttccttaccccttcattttagaattaagggcactggtgctcagagagagaaacagatagagaacattccctgtcctggtatgaggaggcaagtatgaatgaggcttaactattctgtgccatagatcatatgaccttcacagaataaaaatgtagggggtctctaccttttaaacagtatagctctctgtctaaatgaaattttgacagcaggcgtcatctacgtttttttttttttggcaagtggaggaacttaaaggaacaggcagaagccattctaaaaggaaagtgtgttggaggtgaagtgagaaagagtgaaaaatggttttcagttaatttatctaagtttatcttccagctgaggagtgaactcttgtcaccttgtgaaattaggcaaaacaaaagccttcccacacaagtcccaagtgactccaatatgcaaagtactctccttcacccttcatacttgtagcattaaactgggtcaggaggaagaagcttgtatccaagatttaaatgcaggatgctctgactgaagcctgcataaatgtaaaatgagaggaacttggtaataagcaagcaaggtattaattagtacatatgtagattcctagagaaaaccaaccaaatttaatcttagaatatctttacttttcaatgtataagataataagataatatttagcctggcctcactttaaaaattacctctcttaatgaaatacaagaatacttgcaagaaataacagtacagttgtgtataaaacttataacattaagcaaaggaagcagtctctctctctcctccccccaccccccccagctctgtctctatttcttttccccccatattgaaaaaagaagcacttcataatacaatacattttaaagaaccaaaaaggggcaacagatctcctaaaaaaaactgttctctctttgagaacatgcatttctaggagttgcacagatatagaattctgaatatcaaagtaacacagatgtccatatttgctttcaactctatagtggctgacagaacaaagaagcagaaaggcaatttagagaaagacagtttaggtcatttaaaaagggcaagtgagagattagacacgtttggggcatgggtgtatttctattttacgttgtttctatgtcatctcttacgaatagctgctacttatctactcaccccctcctccaatgtgaacagtaaaaaacagaaatgtgttacctatgttatatcattagattttctcaaaaataaactgagataactatcatatctactttaaatctttgtgaactgggtaaaggagagtataacaattccaaatctcattcaagatcacacagcaagtaagtaaaataaaatgaagtcacgaatataaactgacttcaaaacttatgttctcttcactttacaggaaaaaattaaaggaataaaaagaaggcaaaagataactttctccctacccctgaattaggtttctgatggtttactgttctactaattcaacactgcctaataaacatctacactctgcatttctggctgcctttaccacctcatttaataagccacgccccttcaatatttaaatggaaggcaaatactcatattcaactgtttcccctcacagaaaaaaagtttaactattttaaaataatgtttgaactatttagaagtgcagtttcgtgggatgaactgcatttaatagagcagatacagtgacgacctgctctcagagggcttgcaactcacttcaggaaacagagcacaagctcattaattgaacaattagttaacagcctcttaaatggcaggtactgttcaagttcctaagaactgcaggaaataaaaagtattgtggctaagcagtatctgccataggcacaggaaaagcaacttcaacacatgatatatatttgccagccctatcctaacccatacatgaagaggaattctggattcttcttttcttcctttctgttttttactgctttaagctcacagttagaaactttattaaaaacaagaattccaaagacaactcagaggaagaaatcaaatgaaataaatttgcaccagaaacttaaatctttggtcagcactaatctaatatcaaatactagctgaaacactcaggttttgtaagactgatttaggttcagaagcaacaaacccttttggtcttttgggttaaagtacattttacaggtaataaaaagaaatgcttttgaagtaggacaaacaaaagcctggtgcttctagaaatcttaggagtggcctttcttgacttccaaaaggttagtaacttaactacaacataaaacagagacaactccagagacaaagcacggaaaagtgcagaggaaggtgcccatgatttcagcaaaggaaggcaggacaacaaccattaagtacttttttttattcaaccatgggataactgtaataattcttaggcctgaaaagcaacataaataagtaatcatacattatgggatcagtgacatacactctgattctatttatgaatcacagtacttgactgtattacttatttatgttatttaccgacctaagattgaaagccaaatattctgctgatagaaatttcttaagcttacaaaactgctgaagttcagcactccagaaagcaattcccccctccgcccccagtttggattatatccgtggcatttaacacaagtgattaaactgctaatagcaattttgctcagcaacttccaccagcttttactgtctatatcccaaagtcttatctgtgccagggtatatcacctaaagatgaagaacgagagttgtatgtgagtttaaagcatatattttgcttatttggtatgttggactatgatttttaataagcaaagtcaaacttttcaaaatgaactatagaaaaattttataaatttgctctaattgaatcctcactcccaaagaaggtaattgaaagccttctctatttagtgaaatctaaatttaaaaagaaaaaaagaaattatcattgattttcctccatgccacagagtgccctctgcccccaacccttcactttcccaacaacctgaaactactgagcttactgagctaataaattcacatcagcaggcagaggtagctgaaagccaataccagttcaacgtctctcagagcttcacttcagcaggatgcttatttactgctcctagcacaagaaagggaatagaatggaatgaaaactggtttttatctcacccctaaaatgtgtctcacccctacaatacatttatctcacccctacaatacttagacaatgctctaagtattttacacacatcctatagaactgtgacttagaccacactgggttttcacattgacatcatcaactccttagtatgtaatttagcttctctgagccccacttttatcacatttaaaaaggaactatcagcaccataacaacagggtgatgaaaaaaaaaagagcagggagtggtggcagttgtgggggggtgggcaattattcttaccttagtgggttgttatgaaaccaaactaagataatggaaagttggtttaaatccagaagccacaaacacctgttagctcatgcattaaggtccattttaaaggcaataaaaactattgttttttgcacagaacagacttcagatttttcctgaagtcaagtggcatttctggacttccaaatagctgtgaacttctcaacggcaacttgcatagagttatgtacatacttgtaaaattggatgtcaagggaatggggcaaatatttgttacaacgcctaccatatgctaacttggcaatttacactccttacaaaatagagtaggcacaagtttaagggcatttccttcataaaataataaatacacttctctggatagaaactgtgttagatatttctaaaaactataattttaggaaaaccctttagagaggacagtagaaataatttctaatattaattaaataaccatttcaaatagcagtttttactttgaatgtgataaggaaaataaatcatttcccttagttatttacaaactaaaagtttagaccccaaatctattctgaaaactcaataaagctaagcaaagaaaaaaataaactacccacaatacctcacttctcaatctccatcacctgggaatgatcttttccagctgaggtaaacttttatttttggttctacttgttcacagacaactttaaaggtaaacagctcatctcttttctatcctcttccctaatgttaaaaattccttgaaattttatttgcctattgaacaacctctgcaaatccctccaaattgctcctcctcagccttcaccacacaactgaacctattaggcaggcagaaaagaacatattgtgaaaaaaataaaaatgaatggtgaagtaatggggaaagcacaactctaaagaaaaatagcaatgaaaggaagagaagcagggggttaggactgaatatggagtcttttttatcatgaggtgcagggcaaacattttggaggaataagtcattaccataacttcataggagagctgctgtaagatacactgtatgagatttggagtactaggaaaacacaaatgccaagaattttagtcttttctcagaaaaaaaaaaaaatcaacaaaaggattaaatatcaaagaatttctccagggcaacatttcctaacctatgtttcatggaatactggtgtctttcagggtgttaatgaaaaaaaaaaatttttgggaaaaaatctgacatcaattaagtttggaaaatgctaatacttcctaataataagacttctcattgactttagtaagctaatgtgtgatgtgcacctacctctaagacagtgatacagcatgcagagtgtcctaaagttattagagtttggattactttttcatttaaaagcaaaaacagaaacactgaagatacccttggtaatattatttaggaaattctgttttatatttactctgggctatttgtgctgtatttagagccagatttcaaatccaagagggcagggatacttttgttttgaaaatttttttaatctcaggaactaatatatagataacatgcaataaacatttataggagtagtatatagaactttagttctggaggtagacagacctacattttaatcttcctgtgtttgctttatgatagatgcaaatttgggtaactcatttagactctctatggctatgatttcttatctacaaaatggagttaataatattttcttcatagggctatagaaaaattggagatcaatttatatagtgcatatgaaaaggttagcataataaccagaagccaggaattgtgcaataaattctatcaccattattgttgttatgcagtgatttgtcttagtacatatgactttccgcactaaatcttgcctattgaacaacatgtacaaatgcccacaaattctccttctcagccttcatcatacagctggctgtactggctatatacattttgattaatatatttttacgaatgaaaactttttcaaatggtagctatctatatacatcatagtcatttatttatttcaaaggctattatattaaatatattttaatgctatttaatcaatgaatatagatgtaataataaggagattatgtaaatcatggtaaacagtgatctaaattgatgtctagttgcctcttatttaagctggaaaaatgtagaatttaataacagaaactcaaataaccttaaatttctttaggcctgcaaatcatcttttttactaaaataaactgaagaattacagtatggctgcacagcctgagaagaaagaaaacaggagagcaggaactctgaactcaaaattccacctctcagtgtttgcttcactgacttaccctgaggcagttactcagtgtctttaagctcagctctctcattatctctgtaaaatatggatgatttttacaagattccagtaagagaattggtaattaattgtacaatagggtctgaaaatacaagctggtataaaatatttaatacttagtcagaaatttacaagtaacttaaatactgtatttttgttataacactgaatggttcatattagaaggaattggtggcgcaggagtgggaaaaataatattttttgagtgccaatgtacccgtcacttacttcatttaaattccaccacaatgatcttagacaaggaatagtatccagtgctcattttataaaccagaaaactgggttcagaaaaattgataaagtcatccaaggacactcatacaataaaaccaggatttaaaatgtcccatggacatcaaagcccttgtctttttattggactactctaacattccttatcattattttctattcattcctttaacactttctctatgtaagggattatctttaacaagggttattcaaaaataaggaagacagcttttgccctcaaggatcttacaggcaaagtatacagaaacctgcctcacctttatacagtgctgattgcaatataagaaatcttttatatgttctatttctaacaacctataatgttatgccataacattgattttatttttgttgttaaaaatcagtaatattttatttacagtgtaccataaacagggctctcaaatgattaatttatacccagtgtccataaagcatatacttttttttattacactttcagttttagggtacatgtgcacaacgtgcaggtttgttacagatgtatacatgtgccatgttggtgtgctgcacccattaactcgtcatttaacattaggtatatctcctaatgctatccctcccgcctctccccaccccacaacaggccccagtgtgtgatgttccccttcctgtgtccatgtgttctcattgttcaattcccacctatgagtgagaacatataacatatacttcttagcaagcctatgaccatgactgtattagctatatacatttcaatcaaaacagttttacaaataaaaacttttttcaaatggaaggcataggaagaaatggtctaaaatgtgtacctgttgaagtaggtaggttcccagaatttcaccttgcttctctttggtatagtattgaaattctcaaatttaagtgaagaataactgtaaatattatgtaaacaccattgtttaaataaggaagatcactgaatatctcagtttgaagacactgatgagaaggcaaggtgctggaaaggagggcaaggtggataacctaaaatcaaaataagaatacctggcaacccctgcccattctcctagatggctcctagtacgaagtagctccctattagtaaaaactgccctaaatctcaacctgcttattttagctcatttgtaatcagagtcagacacacaaaaagaggcaatgaaattcaaccattgtgtgattttatgattttatgaatcatcagggaaatatgctgagtaaagaaggaaggtagaacattatcccattgctataggaattttcacccaaataaagcataagggcattcaagggagccccaatattacatagagagcaatatcagtgccttgataagtggaataataatgtaattctgaaaacactcattccgcaatctccagtgacacaccactcttgctgatgcatatggattaggttctcaaagtgtggtttgccagaccagcatcaagagcaaataacctgggagcttgtaagaaatgcaaactcccaggccccacaccagactcaccgaatcagaaactcagtcagagcttgtgccttaacaaatgctacaagggatcatgatgcatgtcaaagcttgatatcactgatctaagaatatttacacacataaacaaagaaaagtgtacttagtgattatgttgagtacttcttaaaatagggaaataaaacaaagcaatattaactaagctcctattacaaatcagacatctgatatttaatttctataacctaattatgtacatattagaatatttatatacctcaaattaccatgacatgaacctccactgagtttgctctcactaacaagcctccttcaaagtgttctccagctatttactaggagttccaagaggaggtcttatgtctgcctcagaaaatgtttcttcaccaacaattgatactgggcttaagctagtggatcctgtctttatgtgttttagccgaagcacaagacagattgaatgactgaaaaaaaaaaggaggatgccatgttgcatctatcaaatagacaaaaatcactgaagtattggtgaggatgaagggaaacatatacattgctgttgacattgtcaactgctacaaccacttgacaaagaaatttggcaatatgcgtgaagttaaaggtgcacatacctagtgtttcatttttattcataatccctagaaactctggcacaactgcacaaggaaatgtatataagaatgttcactgcagaattgtttataaaagtataaaatcaaggctggttcaacatatgcaaatcaacaaacgtaatccatcacataaacggaaccaaagacaaaaatcacatgattatctcaatagatgcagaaaaggcctttgacaaaattcaacaacgcttcatgctaaaaactctcaataaattaggtattgatgggacatatatcaaaatattaagagctatgtatgacaaacccaaagccaatatcatactgaatgggcaaaaactggaagcattccctttgaaaactggtacaagacagggatgccctctctcaccactgctattcagtgtaatgttggatgttctggccagggcagtaaggcaagagaaagaaatacagggtattcaattaggaaaagaggaagtcaaattgtccctgtttgcagatgacatgagtggatatttagaaaaccccatcgtctcagcccaaaatctccttaagctgataaacaacttcagcaaagtctcaggatacaaaatcaatgtgcaaaaatcgcaagcattcctatacaacaataaaagacaaacagagagctgaatcatgagtgaattcccattcacaattgctgcaaagagaataaaatacctaagaatccaacttacaaaagatgcgaaggacctcttcaaggagaactacaaaccactgctcaatgaaataaaagaggacacaaacaaatggaagaacattccatgctcatggataggaagaatcaatatcatgaaaatggccatacttcccaaggtaatttatagattcaatgccatccccatcaagctaccaatgactttcttcacagaatcggaaaaaactactttaaagttcatatggaaccaaaaaagagcccgcattgccaagacaatcctaagcaaaaagaacaaagctggaggcatcatgcaacctgacttcaaactatattacaaggctacagtaaccaacatagcatggtactagtaccaaaacagttatctagaccaatagaacagaacagaggcctcagaaataacaccacacatctacatctgatctttgacaaacctcacaaaaacacgaaatggggaaaggattccctatttaataaatgatgctgggaaaactggctacccatatgtagaaagctgaaactggatcccttccttacaccttatacaaaaattaattcgagatagattaaatacttaaatgttaggcctataaccataaaaaccctagaagaaaacctaggcaataccattcaggacataggcatgggcaagggcttcatgactaaaacaccaaaagcaatggcaacaaaagccaaaattgacagatgagatccaattaaactagagagcttctgtacatcaaaagaaactaccatcgagtgaacaggcaacctacagaatgggagaaaatttttgcaatctacccatctgacaaagggctaatatccagaatccacaaagaacttaaacaaatttacaagaaaaaatcaaacaacctcatcaaaaaggggggaaaggatatgaacaggtgcttctcaaaagaagacgtttatgcagccaacagacacatgaaaaaatgctcatcattactggccatcagagaaatgcaaatcaaaaccacagtgagataccacttcacaccagttagaatggcaatcattaaaaagtcaggaaacaacaggtgctggagaggatgtggagatataggaatgcttttacactgttgatggtagtgtaaactagttccaccattgtggaagacagtgtgactaattcctcaaggatctagaaatagaaataccatttgactcagtgatcccattactgggtatatacccaaaggattataaatcatgctactataaatacacatgcacacatatgtttattgtggcactattcacaatagcaaagacttggaaccaacccaaatgtcaatcaataatagactggattaagaaaatgtggcacatatacaccatggaatactatgcagccattaaaaaggatgagtttatgtcctttgtagggacatggatgaagctggaaaccatcattctgagcaaactatcacaaggacagaaaagcaaacactacatgttctcactcatagctgggaattgaacaatgagaacacttggacacaggtcggggacatcacacaccagagcctgtcctggggtagggggcagggggagggatagcattagcagaatacctagtgtaaatgacgagttaatgggtacagcacaccaacatggcacatgtataaatatgtaacaaacctacgtgttgtgctcatgtacctttgaacttaaagtataatagtaaaaaaaaaaaaatagtaaaaaaaaaaatggaaacagtaagtaggggggataaactcttcatttattgccacactatgcagcaataaaaagagtgcagtaaaaatgatcacataagaatgaacatcacatgacaccatttatgtaaagctttaaaatccgtaaaataacaccatatatgttccgttatataagaaaaattaaaacctggatgagtatgatacatagctgtaccaagagcaggattacttttatataagaaaggagaaggggatgaggagatcccagttttgctgtgcctattttgtttcccgaaagttgggttgtgaaagaaataaaaaataataacatctgttagctctgtgtttgaagtatatgcatgagaattttgttgttttccatgtttctatatatgcttgcaatattggataatttaaaaattcttaattgaaaaatcaaatgctaatttagacataacaattatctgaaaaattaaacattactctgataacatcagtataaatttctaagtttttcatctgttttgtttacctatttttagttattccttgtagctagaacagtacctggtagatggtaggcatccataaatatttattctatgaacaaatgaatctcatttttgaacagattaaaattttctgaaaaacacaccactgaacagttccatttttccacattcctttatggtcttttccaatgtgcacattatgttacagtataatcaaagtgcatatatcatttttattatttttcacttcacactatagcataaatacaattccctgttttagtcttaggtcttcctaagaatatgctcatttgatgcatcataatttttttaaccattcctctacaggtttctaaatttttattattacagataatgttgcagtaaacattgctatatggacagctttgtgcttgtatctttcttcttatgatatattatttcctaatgataaactcccaaaattgagattcctagatctatgggccttgaacacctttatggctatttttacttactatattctgaaatggttatatgtatttatactgccaccaatatcatataacacatcatcccttcctttacctatcaatcttgctagattcccagtctcagaatcatgagatcaagagggactatagagatgaggaaatctaaccttccaataataaagacactaaccaggtttctactataaaccagacattattcaaaatactttacctgaattatctctgcttctcataacaatcttgcttggtaggcattcttatcgccactttacagatgttaaaactgagattcaagtaatttatccagggccaccaattaatgcatgatgtgcaggattcaatgtcccccgtatgtccattatttaacttacctcctaaatgaataaagtttgaggtatgattccaaaacacattcactactgagcagggtgatgtcaaagaaataagttctagaagttcctaactaccacaagcagggtagaaaaaatcaatagttcatcctttgctctcaaacgcactttacttcatagggccatacacaaatgccccgtccagagcacttcaatagttagagaaatttgctccagttttacctacctaccagctcaagtgccatttccacagaaaggttgtgcgtagtagtaggaggatctaaataaatggttcccgagattttgcaatggaagagaaatatctagtataccagaagttttaggatcattaaaggagagggtataatgaatatctggacagatatttgtgtgtgtgtgcatgcatgtgtggatgcacacatatatgtgtgtatacagactctttcttggtatattttaccaccaccatttctatcccaaaccccaacacacacagcaaaaattggccgagttatgtaagtggcaagggctctggaaaacatagatatattcctaccagttatcttgacttcatagtaagaacaaagaatactgttcaatgggtataaagtttaagttatgaaatgtgaatatattctagatatctgctgtacaacatagtgcctatagttaaccatatagtattgtgcactgaaaaatgtgtaaagaagatacatctttaaaagagggatagcagtgcaaaacttttggaagtaatggatatgttgattagcttgattatggtgatggtttcacaggtgtatgcatagattcaaacccttaaattgtatacatcaaatacatgccattgtttgtatatcaattacaccttaatagtactgttaaaaaaaaaaaacagagcaagggattcggtactggatctgtcttaaattcttattccaccacttactcactatatgactgttgatagttacttgagtgagcttcttcatctatgtgtataataatatgaatattactggaatatgataaacatattccccagaatgtactaagcacgttaagtacattttagccacctccatcatcatcatcattattcctttgtataatagggagagatataaaaagtgtccttggggagttggttccaggaaccctcccagacaccaacattcacagatgctcaagtcctttatataaaatggtatagtatttgcatataacctatacacatcctctcatatactttaaatcatctctaggttacttataatacctaatacgatggtaatgctatggaaatagttgttatactgcattgtttagggaatgatgacaagaaaaaaagtctatacatgttcaatacggacacaaccatcctttttccccaaatatttttgattcacagcaggttgaatccatggatgtggaaccaaagaatacagaaagctgactgtgtgtgtatatacttatttctttatttatctctataatatttgtatgtgtgtatatatatgttcccattatatgtcctatttatatacatatatccccattatatgtaatagatacatatataaaggtgatatatatattatgttcccatacatatttttatgtatatgtacgtctgtgtgtacatatatatatatgtttgtgtgtgtgtgtgtgtgtgtatatatatatatatatgtttgtgtgtgtgtgtgtgtgtgtgtgtgtgtgtatatatatatatatatatatatatatatatatatatgtatctccccattatacaaatgaatatgatgatgatgatggtggtagtgcccaaaatgtatttaatgtgctttgtacatactagggaatatatacacacacacattacttttttttgcagggatcttgatacataaagattacatgtgtaaagtggctaggcacaatgcctagcacagaatacatacaaaatgggtatatctgttatgattagtattggtaatctcaggtagatgagaggacggtcccctccccacattccacaatttctcttcatccctccagggactacccatcttcaagtacctgtattctctctggatcatttctatctctacctcttcctcacttttctcaaatggcttccttgtttatccccatccttctcacctgtctgctacctcacactttttctctttcttgctctatttttatttctcctttcagactctaggtaacttcttcccataccagttgtcttatatctaggtctctagacagtataaattaaatttggaagtagaagcaaccaagtaaattaagcagtgtgtatgctcattttaagttaaatctcttgcatgttacgtgtatgacataaaattgtgcatttaaaagatacatataacaggttaaattatttgttgttttgcattgcatatgtttaaaagactgttttggttatatcatttaatgtattacttatgtgaacatcttccctgttacttgaagtgcaaaatgaatggattgatatgcaaatgataagcaaatccagtgaatatgcatattaacattgttttgaagaacacttgcattttaagatagaacttccacagaagcaaatacaaattttattattccaatcatagagttaatcaaacagcaatgactattacattgctttttaaaaatatgcctaagggttaaccactagaatattctcagttaacctacaactgtgtgacagaatatctcaggagacaagggttggtttagtaaaaagaacaggaaacttgtgattcagacaactaaatttgaaatttggttatccaatttatctcccatgtgaatctaacatttctgatcaagtgtccttttcagtataatgagaataattatagttacttcctaggattatgaataaatgaatgaatggtacatattatgggccaggtacaattttaggtgttggggtacaacgatacacaaaacaaacaaaattctctgctctcctggcacttagattctaacagaggacaaagacaataaacaaataatgatataatgaatatatggaaataatatatatcactgaacaacttttcaggatgaaatgagatcatcactactaacatccagtgaacatgtctatgtccttatcttatagatcattgatgaaatctaatggacatctgtttgtctttatcttatagatctattggcagaattttaatcagataacccatccttccctattgaaacacttccttcatttgaattctgtgatcgtcactcttttttttttttttttgacacaggatctcactctgtcacccagtctggagtgcagtggccaatctcagctcactgcaaccttcacctcttgggttcaggtgatatccctgcctcagcctcttgagtagctgggactagagatgcacaccaacacacccagctaatttttgtatttttagtagagatagggtttcaccacgttggccaggctggtctcgaactcctgatccacctgcctcagcctcccaaagtgctgagattacaggtgtgagctactgcaccaggcctgatatttactcttttgattatcattgtacctcaaggtcttctcgtcttctttgctgtctttttttcctcttcctgacctttaaaagttggagttttctaggttcagtcctaggttctcttatctgtaactcctttcaaggtgatctcatctagaatcttatcctcttaaatatcatacatattcttatgaggatgaaatatatatctctatccctgacctccttttctgtcctgcaggtttctatatatatctactttttgacttgaaatcttcacttatgtgtctaacatatctcttaaacttaacaagtccaaaacagaactataggttaccaatgcctcaaacctcttttctaccccatgtagaggtaaatggaaccatctttcattctgttacatacgcctgtaaactaagaatcactcctagtcttccctattactcatccttcacaaccaatacatcaacaggtccttccaaatctatctccaattatttcttgaatagtttactgctctctatctccattgtttctgctctgtaataaactacaactactctcacctgtgatacatcaaaaatgtcaccctccaatccattctctccctagcaatcacagtaatgtttaggaaactgaagttataacgtgtggtagctggtttccaaatattgcccccaatcaatcctgttgcttcttattagaaccctatgtagtcccttcccacaaggaactttgactggtctgtggcttattttaactaatgtaatgtatcagaagttactttatgccagttttgagcctaagccttaagaaagcttgtcaacttctgatttggagagtcatgagtgtccatgtaagaattatgccactatttaaaaatatccatgtataaatatcatatgcatatctatatatgtgagatttttttatatgtgagaaggcaagccctgagactacatatagagaaaaagagactcagccatctcagcatcacagtcaggcttccatatgagtgcagtcccagctgctatttgaatactgtcaatttagagaccctcagaagaatttcttggctgagcctacttaactcacagaaacatgagagagaataataaatagttgttataagtcattatatccacatagcaatgaataatcaaaacagaaattgatatttgaaagagagccctaccgaaacaaaaatataaaatatatagcattggctttggaaccggatagcatgcagaagccaagaagggcctacaggagatggttaatgatgactggaagaaaagtgggggagcactgctatcagaggctagagaaaaggttgtttgcatgacagtgtaaagtatgacattatctcttgcattaacatgaaaagtagaaaatatagccaatgaacttgtctatttagttaagaagatttccaggaagaatactgaaattgtccagtttgttttggagtttgggagttttatgggttttttagtgatgtacaataaataccaatagctatgagctaatgaaggaactgtccagttttcaagcacaatctagaaaaatatgaccaatctaggacttgctaggttggagaagaaaaccatttcttcttcatagctttgccagaccagcagaagattctcaaagtaagaaacggctttagctcaagaaacaattccaaggtgctgccaataaagcatggcctaaggataaatatttgattaagtctcagaaaaatttgaggccatgcctgatacactcttttgactgggaaaaatagcttgtaagattctcaatgatattgccccacagacctcagattctaatcccaaggtagaagggggcctatttcaaaaatgtatgggtgtgccttctgtctcataaagtacattaagatcttaatatacaggaagctgacaaagttttcaaaagaattatataagcttagactgggagggacagaggccatcaaagaaaagggacatttgggtctccaactccctagagacagaaagaagatgaggaagctactcaactgtaaacattggtcattttttatggaaaagtgaaaatgagtcagaggatggagccagaagcccagagaacagcgaaaagaactgaagagaactattcccggagagcacaactattctctaatcaacatgcattccttgcccccagaacagtgagttggtaacatgtgccaacctagatttcagaattattaaaagccagtgacggcctggtgtggtggctcacgcttgtaatcccagcactttgggaggctgaggtgggtgcatcacttgaggccaggagttcaagactagcctggacaacatagtgaagacccatctctactaaaaatacaaaaattagccaggcatggtggtgcatgcctgtaatcccagctactcgggaggctgaggcaggagaatcacttgaacccaagaggcggaggttgcagtgagccgagattgcaccactgcactccagcatgttcgacagagtgagactccatctcagaaaaataaaaaataaaataaaagccagagaatgctatgtttactccccaactccagctttttacatggaagtgtatattagcgtacacctatccctgtctcaccattttacgatgggtatgtgggagaaagataacttgtgtccctggttcatagttctatagatccatctgtaccaatacataatttagctgataagatcttggactttaaatctatgcctgctgctttaatggatgagacttaaggctttggggtagaaggaaaggatattttgcatgtggaagggacatgggtcacttggggccagaagtccaactgtgttagctagtcttaatgatggtacttaattaagcctaacttctggtatccatacccttatgcggtccctttttccacactgactcaggactggtctgggacttatattaatcaatatacataacagaggtaatacagtgccagctctaggcctatgccttaagaaggcctgacaacttctaattttgtgttttagggaggcctgaagtcaccatttaagatgcctagttacttagctggagagcctacctggcaaggtcacatggagaaacaagtggaaagatgaggttatgagaggaacctcatagagatggagagaggccaaattgtccagcttctgaaccaacagtcaaacagcgtaagagactcaaaattagactaaagaactacatagctgaaacaagtcaactcatagaacactgagagataataaaatggtggttgttttaagcaattatattttagagtagtttgctatatacaacaataaaacgtgaaacagcatgtcaagcatgtcgctcattcacctaacatcaatgacttctcattaacagatagaataccatccaaaatctaaaatccttcccattacatttaagttcctccataatacttgtcctttcctacatatacaacctcatcttttgccatattcctctccatgctataatctagccatattatctcctttttttttcctagaccctaacaaggtgttgttgttgctgttgttctgccatagtctttgcacttgtggttgcttcattcttgaattatttctcatcatctcttagcacaactggttccttcttaccctctagatgttagttcaaatgtcacttcctcagacaggtctttcttacctatgttttcttcagttacgatatgtcacattttctaaggcatttcttttatagcacttacaacgacactgttgcaagtatttgtgtactttggtgctgtttccatcttagaaagcttgaacatcaaaagacctatgacattatctatctttttcactgctgtgtgtccccacttctacacctagacaggttttggcatgtagttggcagtaacatattgctattgagagaatgatttaattaaagtgaagaaatgggtattatttataaaatatttattatgatatctaactgcctccagaaaacgattttcttttacaaaatattccatttctaattatttattcaattttgccttactttgactgattaaaaattccttgatggtaaaaaaccatgttatttctgactaattaatgccccttggtcttgggcaactaggatggttggtcattctatctgccacacactaatgctgcttgaagatatatgttgccctgttactgaattctgaccaatggtatgagaaaagaaatcatgtacctcttttccagacctagcccttaaaaatttgctatgcaacatcttattatttccccaaatggcagttgaacagagagaagtctgaagacttagaggaggaagagtctgaattgctaaatgactagctgtagcggaccttaccacccacttcgactttagcaaaacatacaggactgtgatctgagcaataaataaacttttatgggatactcacagctaacatcacacctaatgctgaaagaatggatgcgtttccactagggtgaggaataagacaagggtgtttgctcttaccacttgtatccaacaatgtactggaatatctagccagggcaattagtcaagaatataaaataaaaagcatctggattgaaaaggatgaagtaaacttaactctatttgcagatgacataatttatacagagtatcttaaagaatccacaaaaagctaatagaataaacagattcagcaaggttgcaggatgcaagatgaacatacaaaaatcagttatatttttatacactaacaatgaataatccaaaaatgaaattaagaaaacaattttatttttaattacatagaaagaataaaatatttaggaataaatttagcaaaataagtaaaagacttgtataccaaaattacaaaatatcattgaaaaaataaaagttctgaccaactaaaaagacaggtcatgtttatgggctgcaaggcttaatactgttaagataacagtgctcttcaaactaatctacaaatttcatgcaatctttttcaaaatcccagttacttttattcccccagaaattgatatgactcaaattaataggaataagtgaatgaatattcaaaaacagaacatatcatgtaatcagcatccagaacattacttgcatcccagaatacctccatatgctgccatccagtcacttctttccaagagtagccattatacagcaatgtgacaggatggattaattttagctgcttttgtacttgacagaatagaatcatgttgtgtgtactctttaatgtctgtcttccttcacatgttattatatttgagagtttcatgcatattgttgcacatattttctggcagtttatttttattgctatatagtattccactatatgagtatatgacctgtaatacagtgagcctggctctggtcccttgacatatggttctctcagttcctattaactcactggaattgaattcctgcccaaattggagcccaggagttttgtggcttcagcccccactgttagctgtatgtttctattccatttctgccctgaagaaagatgattatcagtcttacatgagcaatgcaatgctattatctttgtaccacctatgaccatgggtttagagcagtaagatgtaaactcataaaaccaactttttggggagttgatggagggtgtagtctttctgattttatcataaagaaagtctcatttggtgtgagtaaatctcaactatacacacacatatatattttttaaatacagagataatatgtttcttagagtcattaacagacaaggtttctagctataatttaataatatcgttttcaaagtatttttatttaaattatattctatatatgttaaatgatatagatttttattatgatagttatatacaattttgtatttaagtaaacatgaagtaaaattgggtcacaataaaaatattaattaaataatatttcagatggtaaatgaacatgtcaaaaatcattaaggtggtaagtaaatgatttaagcttgggatacttttaatgaaccgatttgacagctcagctttcatttatttatttagaatacaaattccagatctatatttaccttttggatcaatgggtgagcctacctgcaggaaatctgcagctatagctgcttctttttatacatcatcccttgctctaatctcctccatagcaatcagagctaatgagctgcaactgattacatagggtcattgtgttaataattccatggagtaaaaacattttcaaaaagatccttggatctaagacatgataagacaatccaaggaaagtgcaccagatgatataatttcaggcacaacatcaagaaaacgtgatgcaagtctgaaccttacttatggtttaatccatgaagggcaaataggtgtaaactcacatgctaacaccagcctattgatacttgcctctgtagtgttgtgttcagaaggattctgaaggaaaacctgcaatattaggaaagaatgtcaccggcatgggtgtgggaagtgtcagaatttgtggtatgcgtttgccatctttgatttagagagtaataaatagtcctgatctttgatgatctcagataccagaaaaaaagttcttcactagaatgctgaagtataagacagtatatacttaaggtaactacaaaataaatgaaatataacctggttcattgtaccaaacatatgtttattgggacaaatcaacttcaagagtaaaataaaatgaaaatactagaagacaaatgggttaataaggatggaataaaaaagggatttggcagatatctggtagcttttaaggagaacagtttaatcttcaaaattaacaacactagagaaaatgtctttccagaaaaaaataaaataaaaaagttgccatagtaactagtgctagaacctccacacagaccaaatttagcaaagctaaacttactttttaattgtataaaatattcaattgaaaaaggaagaaaagcaaaattggatttattttgcacctactatgttccaggtgcttcacacagtttcctcagtaattatcatgagaatccagtaaagaaggaagtattaacttcagttttattgatgaaaaacttgaggttcagagtggttatttgctttgaactacactaaaattggaggagcaaggtttcctgagtctgtgtttttaaaagactctgaataaccctatttgcttctttgatagactacattatttgtctggaggctacagaaagacactattgccattttgaaaggcaaacgtgacccagtgaacatcagggtcttttatactaaagagataatataacgtgaaaagggaaagtttctttttcaataatattactcactggggaactggtggactgcccaattcttcctgaggacagtcagacttgtaagagaggcatctggacaatttcttatttgtcttgttcaaacattatccaaatacttaccaaacttctctcaaatcatatatcttaaaataagataaatatcataatttccattccaatttcagtttatctgttctctcatgtattaaagaaacatttatttagtgcctaccctgcatcgagcactgtgctaggtcttaggaattggagaaaatcagtccagcaagataatgctttcctctgccacatgacattagcaacaatccttaactttactgagggcaaacaagaccattgaaaacccctagtcttccttcttctcacagcaaaccattccacaattagcccaagtctttgttcagaaattgaatcatttgtactcaagggaaattccaatataagccctctgaaatttggttatctgaggatttttatcagacagggaagtaaagcaagctgactgaataccaataaagaatttgatccgagtgggagttagatgatctttctcattttaagatgtcttaaggaatcagtaagagaacaattgaaatgtggtatgtgagctctggaggcctgcaattgtccctaacagccatggaggatggggaaatcccattgacctagtttgctacagactcataatactggggattaactaagccattgcttatatgttgacaggatgaggtgaattgggttccagcctagttcccacaaggcattaaggacagaaatgtcttcaacaaccatccacaaacaatggaataaaatccaaacttcttagactaactttcagcatcaaatcactggccctcttacaatctcttgttattgcccaatataaacctgcctaacaagtagaacaaaagtgtatctgtgaccatggaaaagtttttcttttttttttaaacccctctgagcatcagtttcctcatttgcaagactggaatggtattagtatttgcctctagacattcctggatgattaaataagttaacacatacaaaacctgtgaagtagcagatgatgctaccaccactaccaatcatactacttttggtaacagctagactcactgttcagcattaagtttaccaaaggcaaaaacatccactgaaaacccctgtcttctattttcatgaagccaactatttcccagttaacccaaatctttgttcagaagttgtattatttgtactcacggggaattccagtgagagccattttgaaattcagtcacttatgggcatctgcatgatttatacattcctgtttccatgtctgtccctgcccaaaatgccttcttcattcctcattatcgaggcaagttcaaaccgtgtattaaagcctactataaatcctacccacccatgaattgtggactgctctctgtaccccatagtgattcttttattgtgaaatgccacttactgtgacactcatcacatatttctattatatattggtgcaaaaatcttctctcattgagaagacttagctctgtgagggcagttgctaaactgtctactttatttttaaacctctctaagtatctacctagcacaattcatatctagaaggtgctcaggaaataatagttggttgacagattcaaatggaggacaggaagccttgtagttccatggttgtgtcagatgacgggctcagaggattaaggctttaaaactactagagaggcttattcatgaggcctgagcttcaactggccaatcatgtttctgccccatgttaactgctactggcataaacagataatttggttatggaatttgaatctcacacttggatttaacatcaagtattatacaagctagtacctgtttctgctcataaatgtgactcccattttgcttcatgagcaaggttttggtatcaaagtgataaccgggaataatgaatgcagctccttactatatttattgacagaattgctattttaatgtgaacaacagctaaaaaatgaaatgccttgtttcttacttaaacagcagacaggcatgagacaatgtagctagagagtaaaatatctgaagagaacattattttccccttatctctctggcactcaaaactctcccatatttctagaagcaaacaattcccttgtttgggtcataaaaacaagaaacatcttctctcattattaaaacatgcagctcttccaaggtggtcactccttgctagctaagaaaggcagagttcatactgcagaagaattatgcatgagttagggctaggagttacacttgggtaaaatcctcaattactgtagcttcattaatacattcttggtgtcttactgctgagtgactgttctgaataaattttcctttcatgcatgcactcaaagaaatgacaaaattctgaatgaattagcagtcagcatccaggagagattcttcaggtcatagttattcagaacttcctttatttgtcataatgggaagaaaagaaacgtggaaatttcatagaaccacagaatctcagagttggaacagaggctagcgatcatctatcaggtcacccccttcccagatcctcttccatctgatgtgtaaatcctctctaaaataattcccctgaaatggtcacagagggttgcataaaaaattccaattgcaagggccttactaacatctcctgatgcattccttttcattactcattacaaagtcatttatgcttaactaaaatctgccttcccataggtcctcattgtcctctctagggccacacaaagtcattctaatccttcttcgaaaaaacagtcttttcaatatttaaagggatgtcacatatttcatcctgtgaaagtacgttcatcaatgataaggagactgagggctgcaaaaagtcatggcacttctccattgggaaagctattgggaaataaggacagttgggtcccattagcatggaagagaaggagatatcatgcaggttcccttcagccaccagcttcactggcttccttccttgtgttgtaccctaaactttctcctctctctgaagatgactctgccatttaccaggtgttcaagctataaactaccactgtgttacccttcacatataatccattacctgtcctaaatataccttgaatatattcacttatttccatctttatcactatttatactagtctaagctattatccttctttatctaaactcattttaattttctcatggctagtcacctcacttccatgcttgtcagtctgtattctaaattgaaaatcagatcatatcccactcctgcttcaaacccttcaaaggtttcctgctcctctaaagactgagacgaaagtccctaacataactttcaaggctctgcctctcctagtgtctgccttctctcagcctctttctgcctcttctctatactagccttgctgcggttcttgttaaataagaaaagagtaaagaaaataaatctgaggaggctgaaaaagtaatataaacaagtaatatgaagaagttattgaggaagtaaaagaaccaaaagtatgttttgtcacaagccaagggaagagatcatttctataggagaggagtgtcaacaaattcaaaggctgcaagaaggtcaaagtaagaagaagtttggcatctttgaagccattggtaaaattaccaatggcttcaaagatgccaaataaaaataccaacttttctgggcaaaaacagttagagatacagacaggttacaatgaagtgaagcaaatatagaggggagaaagcagagtaagaaaagtaggaagtatctagaaggagaagcaaagtcgaaaagaaaatctgtttgtttcttttttaaatgggcaggtcctatcaggattgaagaggttaaagaaacaataaaggagttaactgattaaacaaggttccagaagagatgagaaggtaagatcaaggcaacacatgattatgcaaaatagctagcacagtgagtcctcagtgagtaatttgaatatatgaagaagtagtattgatttttttttaatgagctggaaactagtatgtttcaaaggcacaggaggaatcagtctatggaaaagagaaggaattcttatttcatttttaagtatgtaatatacaatggatttaaataagttttctgtgaaacataagcaaatgttttaaatatttttagtaagtgtacttttaacactaaattggtatgcatttaacatattcttcatactttatttagtccctattttaaaaattattcccactttgctatgtctccccatctaatccagaattatactcatctcaacattgataaattacagtctaagttggattctgtactttcacatcttgtcttaaaggaggaaccaagatctttggcctgttgtttggatctgtagcttgacatcttgttatttcaattctaaagttgttaccaataaaatatgctgttattcacccaatatttgtagccactaactttttttttttttctttgagacaaggtctcactgtgtgtcatgcaggctggagtgcagtgattcagtcaatgctcactgtagcctggactttccagactcaagctatccaccttttttagcctcttgaatagctgggaccacaggtacatgccatcacagctggctaatttttgtattttttgtagagataaggtttctccatgctgcccaggctggtcatgaactcttgagctcaagtgatctgcctgcctcagcctcctaaagtgctgggattacaggcgtgagccaccatgcccagctaacctaaaaatgttttctttttttttatttgcatatccttaagggccaagtttagaaacagcagtaggtttatagttgcccagaaaagtcattcctactattaacaagtagaaaagtgcaagtctgattttaaaaaaaaaaattaagttacacaaagtgcaacttctgataggagtacctgttgcttgaaagagtggaaatctgggaagatggtagagtgagattttctttcaaacaatggctctgaaattgtgcatttgtcaaagatttggttaaaataaagcattgaggaccttaccagagctctcttcttactgatagagatgaattaagaaacttcccaattgtctcatatcttatttctacttactggtaatctctactgtctttcctctttagaatcccaaactcctggcacatggcaggatatttttgtgaattaattaacacatgagacatgtttttgtgaattagacaagtactcaattacttgagacaagtactcaaacaagtctcaagaattacatgagacaagtactcaaacaaaaagaaacaattagttgtctttttaataaaaatatacacactttaaaactaacatcatgggaaatagtttgtacttgtttgtttgacaagtactcaaacaaaaagaaacaattagttctctttttaataaaaatatacacattttaaaactaacatcatgggaaatagtagaaagaggagaggaagcagataaccaaggtctaaatcacatttcaggcacttattgtttagctatataactttggtcaagatgcttaatctttttataactttttatacgcttcatctttttataccttagtttacacgtctacgaaatgagttaatacaacctacttcataggactcctgcagggactaaagtgccagatacgaagcacctagcataattcttgcaacctagtaggtaataaataaatgtttcttcacttctacttcttcccctgaaaaagtataaaatgtaatttgttgctcttaaagaaatacaaaccaataggaggatatgtgtatatatacatatatatacatgttttatatatgtatatatgtacatttcataaacatatatacctatatatgtatatctacatatataggtatatatgtagattttataaacatatatgtatatatacacatatatatgcatacatatatatgtatatatacatatatatgtatacatatacatatatatgtatatatacatacatatatacatatatatatatcctcctattgggttgtatatattttatatatatctaaacttatattgaaaaagtcaaaatatgttataaccaacatactaaaatacaagtaatgttagaagatcaaaggaaagaatgctagataataatgaatttgtggaaataacaagtagtaaacatagcagaatatgcagaagtaatataaagccactattttcctctttttccttttatctttccattctacaaagttcttctataaactgtgacacttgtagcaaaatacctctgatctcttcattttcctcagcaccatataatttaacatccactgctgataataacagtcatgaatcagcacactcaaagagaagtagaggcaagtttaaaaaaaatcaactgtttcactttcctcttagaaagtgcaaactgcccttcaaaattcaagacttaagttaaaagtcacctcctctacgcagcctctctgacttcttgaacaaagccttctgtatgcttccttgtacactgtccctcacattattgttacaacagccatgcattgtaatcttaacaggctggtagcccttcagcagcagaaactgattatattaatcttggcatccccaggatctagcacaatgttttacgtataaccagaaatcaacaaacatttgttgaatgaacaaataaataaatttcaacctcttcgacttaaaaaaatatttattgtattggctcataagctagtgctaaatgatacgcctcctcaacctcataattgtttcacatttgctaattatattcctaaaagaatactgtaaactcctcaggtatgacccacaatctatgtttctttgtttctgtcaccacctcaacactaatcccagtggggacaagtacaatagcagagaatgttcattaagtactttctgactgacttatctttagaaagtaattttctgacaatgaagctagggcttcatttgtaggtagaatgtattttatgtgtatggactgggattttctattgttgaaaataaaaagctatattaatggtgactttcatttacaccattaattaaattcctttccacctcctgtcaaaaagccctgtcatgcatatactgtacttccaagttgactggtaaagaaattcatctgatgaatcacataatagtgtctgtaaaataataataaaggacacctgtgttagtaataacacacataggtagaccaaactctgccttcttttcattgtcagtttactggcacttggcaagtagctaatgttttggaatattatgcattagtatctaatccagaagatttaacaaaagatataagtcaagcaagaaaaatgaaaacactgaagacaagagaattcccaaagccaagggggaactgcaatagccatgaaaggaaggggggaggggtgataaataaatactaagaatgaaaaaaaaaataagctttgagttagaaagaacatgcacttatttttttatccagtaaatatttactgaacatctactatgtgttcatacactacaccgtatgctagggacttttaaggagctcacaattagtaagaggaaggcaaagaagtaaacaaccacaatacagtatgagaaataccactaaaatggtacttggtaacagcacaggctgctataggaacaaaaaaggacatacgcttctgttgcttgagggtcagggaacaatttccagtggtgggaatataagctgagagataaaagaactggcttcctaaaggagatcatatgaggaaaaagaaagggggataagcatgtgaagaaaaatcttggtttgttcacgggcctgagagaagtttgtagaaacagcagtaggtttatagttgctagactggtatggctagattcagatccaacctctgcctccagctacgtaacttctgacattaccgaccctttctgaatcttgatttcctatcatttgaatactttatattcatactactggcatagtaactgtcacctagaggaggcttaagggatattagttccaaatggtattgcctaagttttcttctagggtttttatggctttaggctaaaacaccaaaagcaatggcaataaaagccaaaattgacaaataggatctaattaaactaaagagcttctacacagcaaaaaaaaaaaaaaaaaaaaacaaaaaaaaaaacctatcagagggaacaggcaacctacagaatgggagaaaattctgcaatcaatccatctgacaaagggctaatatccagaatctataaggaacaaaaacaaatttacaagaaaaaataaacaactccatcaaaaagtgggcaaagaatatgaacagacacttctcaaaagaagacatttatgagaacaacaaacatatgaagaaaagctcatcatcgagttcatgtcctttgtagggacatggatgaaattggaaatcatcattctcagtaaactatcgcaagaacaaaaaaccaaacaccgcatattctcactcacaggtgggaattgaacaatgagaacacatggacacaggaaagggaacatcacactctggggactgttgtggggtggggggaggggggagggatagcactgggagatatacctaatgctagatgacgagttagtgcgtgcagcgcaccagcatggcacatgtatacacatgtaactaacctgcacattgtgcacatgtaccctaaaacttaaagtataataataataaataaaaaataaaaaataaaaagaaaagctcattatcactggtcattagagaaatgcaaaccaaaaccacaatgagataccacctcatgccagttagaatggtgatcattataaagtcaggaaacaacagatgctggagaggatgtggagaaataggaatgcttttacactgttggtgggagtgtaaattagttcaaccgttgtggaagacagtgtggcgattcctcaaggatctagaaccagaaataccatttgacccagcaatcccattactgggtatatacccaaaggattataaatcattctacaataaagacacatgcacacgtatgtttattgcagcactattcacaatagcaaagacttgaaaccaacccaaatgaccatcaatgatagactggataaagaaaatgtggcacatagacaccatagaatagcatgcagtcataaaaaagaagaattcatgtcctttgcagggacctggatgaagctggaaaccatcattttcagcaaactaacacaggaacagaaaaccaaacgtcgcatgttctcactcataaataggagctgaaaaatgagaacacatggacacagggagggggacatcacacaccaggtcctgtcggggggggggggtgggggactaggggaggaatagcattaggagaaatacctaatgtacgtgacgggttgacaggtgcagcaaaccaccatggcacatgtatacctaggtacaaatctgcacgatctgcacatctatcccagaacttaaagtataatcttaaaaagagatattagttccgtcctgcttctctcccaccaactctgcttgctatccttgtcttccctaaggaatttattagccagttcatgtgaactcaggattcacctgaccaatgaaatagctgtacgtatttaatgtagatccttttatcacaatttaaagctgacctttaattgtccaggcccagctgtttatgcggctgcaaaagttcacaattccagttttaaaagcctgcagtctaatggattgtccagtttcattcttctaatagcttctgacccagtgccagctcttgccatttagatctttactatggctgtcctttccatcttaaattccctatttgaggaagtttgacaattttcctggataaacctctgtattatcttcttttccttcataatgttttctcagttaagtgagtgtctcagatgcgcttttccttatcctgtgacatatattaatttgttgtagaaaatggaaaccatctatattgataacattgtgaaattaattttatttcttattatttaatccatcccttcctttactctctcattacaccaacacacatattgaacaaacaccatacttgcttaaaatacacataaagaaatctggcactatttctttgcaaagaacaaggcaacatcctagcaccaaatgggcttccatggaagaaaaaggcaaggaaggagcttagactctgatgaagagataaaatggaaagataaatacagttaataaaataaaagaaatgatgactgtggtaaaagaaataaagcaaaaactctggaagttcaaataaaagagcatgggatttgcagtgcactgaggatctaggaataaagcccagctgggttgttttctgcagcctcggaccagttgcttaacctctctgagttacttcatatttaaaatggatacagctccatgtctgtatggtttgagtttttaaaaaaatactgctggtaaggattcagtgaaataaaatacatgggatttctttataaactgtgaagtttcaggtaattttaatgaaataggctactacctgggaagagatactttattcaagacagtggagaggaatatattggacaggttacatacttctacacaaccttattaaagactggtggacatgggttgcagctcaattctctgactacatgtttggttttatgtacacagtacgttaaaaagagaatttggaaacctttagaagggatgtgtgcttctcagttgatttagtccccacctatttcccttctgaccaggcaagaatttattaatgttctcagatacttgcaaagaagccttagatctaccatatatgtccatctaggaaaaagtaaactctgtcctcagtctgaggacatgcagaacctatacatacacttctatggattagcctggatcaatttcctcattcttcctgttaatgttcttctttggccacacatagttttactgttttctttgttggattctacatcaaatatatatttctcttttctttactatctccttccctctaccctctcagcctccattgccaccatatttgcacccactgtattctttataagcttcagaaatccagtaactttaaataaggaactatgggtttttctgaacaatgttcgatccacttcaagtctacaaacatatgtataatattcagggctagattctgggatgtaaacaagtaattacagagcaacatggcagtgtaacaatagagattcaactaattgttatggatagatgaaaaagggagccatttatactacccgggaaggtcgggaaagctttacggaggaagagacaatatttcgggcagcccatgaatagtgagaaaattttctctaaatgagaaaagaaaggacagtatttttaggtagaagagatggcttaagcaaaggcatggagatatgaaaattcataggtgttggggagtgaattatttataattcttggtacacaggagtaatataccaagacagagtaatacactacattaggcatatacaaagaaaaatctgactaaagatctttaaaaagggcttgacagtggccagaggtaccctgcttaggattctattcataacaaatatataaaaggttactctctattacgaagcaacatcatataacataaaattgtccagcccaaacagagatgatggccagggtaggaccactcctgactcttgctgtatccgtggaacacactgctaatcaatcaaaacatttgtcttactaaggctggatatggcctcagaatcctccccagtagagatttatataaggcctataactactgaaatgaaacatatttccaacactgttgtaggttatgcattgagagtgaggaatgaccctaaaagatatattgataagccagtagaaattatttcattatacctcacatttacacatgtagagcccaggaatgcatttctgctatatttatcttggactatgtccatcagtgactcagaatggccctatgctttgggtcagagagtttggacactaaatttatgagagaaaatgacaagcttcaatcacaccaaattctaaatgtagccaaaaaccacataattaactgcagatttttcaaaggtaacagttattgattttaaattaattttaagttagcccacactgcttaacaaaagtatcctaacacaacaaatagcatagacaggctgcatagaacaaagccccgaaaacaatcttcaatgctcttatatgtgaattagccatcaaagctgaaaatgtttggaaaaaaatccactttcacaagttgattaaattatttccttcataagcataaacagtttagagaagaaaaacccaagactgattgctcagaatctccagggtaaaagaaacaaacacatttttaaaatcttcagcctcacaaggtatcctttgccaaccccctaaggagcaaccttagaatctgctacaggctgcagcagctgcctgcccactttctcagcagcaagaaatatgctaagcagtgattatcaacagggaagaggatcaaaaggttgagggaatgattaagcaagataccatttcttctaaaaaccagtttcctatagaggttgtaaatgatagaagccagggtaatctcaaatttcaatcaattacatgtgaaacacatctattctgtgctccttctgtgggagctcccactagtgtagtcttctgacaacaggagcagcatcaaagccaaggtgatttgctgctggagcctgatcaagtatgtgtctgtcccttccaaaccattaaaaacaacaacaacaacaaccacaaaaaccacaacccacaaacccatgtgaggagaccaaagccaaagccagagccagattctcagtcttccttgcaaaaagcttgtagtaagatttcacttggaagttatcattggtacaagcaatgttacactgagggaaggcaatgacttgcagaaaagaatcagagtgcgaggaggtgtgagatgtagaatggaaatccctctcaatctgcagatgctaggtagagtcttgtcttgctacttactggctatttgagcctggctatttgagcctggaatcactgctaacttcactgaactacactgttctcattggggtgaatgaaatccatttcttgctctatttacaggatagttatgaagaaatagaagggagggaagattataataactgaagacacaacttatctcatattgtctcatttaatctttattataatcctatgcggtagttataccatttttttgaaaaaagtgaagaaacttaaaaagtgaagaatccagagaggctgtgaaatgtctaaagtgatagctgataagtggcacgagaagagttcaagtcttgactcaaaagttaatattcttttctctgtgttatatctgtctttttagactgtaacatttttaaaggcaggggccatagttgtatttttcttgtatcccttgcacacattcattacatagtaggtaagcagtaaagattttatgaataataaataatgtctttaagtatataaactggttcagctcagtttagctaaataaacattgagtatattttattgtcagacaccttgtttctaactgggagctagggattcaaagataaataacagtcatttccggccctcaagggagtcacagtagagtgagagacacatacagaaacaaaatcaaccttccacaggttttagttttatcttctgaggtttcagagaattcatgaactcctatttgaacacgtgctggaagtgtctgaagttacctctctgctagccattggcctcactcagagtgggagtatggactcctttagcttgttgcagagaatgagccatggtgaacagagacagttgttttcggttcccactttggaatttccaggtaagtaatctttgagtctcaaggttcaagttttggaaggtatgaggacccaaatactcaccatgcttctaaagctagcttttctgtctctagttagcctttgttttttaaggctaaacatcagcagcattattagaacaaagaagagatttgaacaaagtaaaaacttacagaggattcaaaatgcagggaattagaaaacactgccaagcacagagtaataataatacggccacttagtagaaagaaacataggtgtctctaggactaacatgggcatcaaggagactcttatgctgacaaatcctgagaatgtaaacacatcaagggtaccagagtaaacacaaaattgtcaggaccttgtttcataataattatggggccggacgtggtggctcacgcctgtaatcccaccactttgggaggccaaggcgggtggatcacgaagtcaggagatggagaccatcctggccaacacggtgaaaccccatctctactaaaaatacaaaaaattagccaggcgtggtagccggcgcctgcagtcccagctactcgggaggccgaggcaggagaatggcgtgaacccgggcggcggagcttgcagtgagctgagatcgcgccactgcactccagcctgggcaacaaagcgaggttccgtctcaaaataataataattcttattaataatatattattatatattaataattatatttattaatattttattattatatttattaatatattatattattattattattgttatggaagcatgtaactatcatggccattgaaggtttattttattaggtctcttcctgacctagacagagtatccaataaggctatcaagtctcctcttgttcaaattcgaggcttgccaagaaatttgcagtagtaaataagtaaataagcctttttaaacatatgcattttcttaaacacatgccctttgatctattcagtcagcaaggtcattctgcattcattgcttcaagtaagagatagttccaaaacaaacaaactgggattcaatttttggcttttgagttttaaaagtctatttcgtaaccagagaaacagaaataactccctgtagatttgggggaatatgggatgagaaatgacaacttttcccacctctgtaaaaatctcctaggctaggaggcagttgacttttgaaaggaaataggagtgtgtagatgttgtaaacatctgacgaggcaggaacttctcagtctcagcacaatgatgagtcgggcagacacagacccccgacatagactcgtaggattcattcacagaagagatctgtagctcagcgacgttgccaatatctcagacaaaacaaatgactacaaaggtcatttactaggaaaacttgataacaaagtaaaatttactagcaaaatttatcagcaaggtgctgggcatatagtacaagcaaataattattgaataactggataaagtcatatctgactatactatgagttttcaaattctacagctggagaccaggctttgacaagagtgactaaactatgtcaagctagcatattgttaataccccctaaaggatgtgatatgaaaaattttacatatctctaacaaatgttatcaattaagaacaggacagagtaaaatgtacatttaggttcctacttgcctatttgttacagctgctgtaatatcactatttctctgcatctggcttatttctaatctgtccacaatgcacatcatacggaattgaacatacaagtcactgatactgttcttatttcttttctgggctttataggctggaaatagtcattacgtggtagctactgagtgatctgtggtgccatggaccttcctatttagtaagaggcttgcttgaattttagaatatcagatgcaacaggcggtacctaatggatagctggattcaatggctgagccttttactgccttcacatgtcacgggcaagatgacaaggatgagttaagatagttctgtttcatgccattttttaaattagtgtggctctgtcaatctctgaaaggttgaaccttatatataatcaaagtgaacaaaaagcttcttcctcttcaatttgaactaactcagctatggaatctacaaatattacatattttatgcatctgatggacaacctaagcatgtagagaagatgctatataaatcaaaagatatattaaaggctcctgacaaaattgccactaagagaaaccctacaataaatcattttgtataacgattttctccatttgtctcttctagactatactctctgaggaaaggggctgtctcttctcaactcctgaacttcagagcccagtaccacgcctgggttggtagaggacgaataggcagtggttggtaataaacctaaataaccaacaactaacttatgcaatttgtgaatttaaattaggtatttcagggttttcctaaactagaatacttaagagtattttggaatattcccttccgtttggcagaaaatatgtttttggaaaaatgccagtggagatgtacatgtgtcagcacaaagatggaaggactcaattccactggcttcctggtttattgcatgggtttttgaaaacataaaaggataacccatgaagctgagaaatacactaaatagagcaggttttgatgaaaatatattaagttcaatgttgtacatgcaaagtatggagtacatatatgccatcaaggtggacatatagatttgtgtgtcattagcatcattttatgcataatatgagtgaattacatcacccaaagagaatagataaagtgtatccagccccgggaagagcgatgttttagcagtaagtggaaaaagaggagcctgtgaaccaggatgagaacaattagagatgtcagaggttaaattgaaaaacactcttcctctcattttctttccagcaagatcctgttattcttcaagcttaacaagtgacctagaggaagaaaagactaagatattccaactggttttttgaaaaggcctgttatggttcctttcctccccgattaataggattatgagagaatgacataagaatgcttttttcttaagagaaaaatgcctattttaatattattcctattgatcacttctgaatcactctccaagtaactcgcaatagctgttgacaatgaagaagtgaaatgccatacagatagatgggcatatgtgtgtcttcctgcctatttacatatattcatcactgtgtacataatacacacatttatatatttacatatacacataccttcccacttagtaacatgaactcttttgacccttcctatttgtagtgtgacagaatataaatgtgatcaagttcagactattaatatcatcctcttctttcaggggaagacatgcccatgacagaagagattattacagtttttggacctgaatttacaacaaaaaccaaacaaacaaaaacgaagtgaactaacatttattcagaatctattatgtaaaagaactgttctaggttcattatatttattatttcatttaaccatccttttacaaaatgcactggcattgtatgtatcatgattgcagctaacaaataggaaacagccttcggaggataatggctgggacatgttctgtttcagatatgcctcttcacacttttctctgccttcaactactcaatttatgggcataatcactccaaacttaaagacaggccatagatttccaacaccactggtgcgtatgagaatttacagtggaacttctgaaagctactcagacccttttccaggcttcctgcataaggatctcagatagctccctagaatcttatttttctaaagaaccacaagtgattctgatgctgagtcagtatcggaaatcactggctgtggtgttctcaggacttccagaaagcatatgacagtgtggtttggaaagccattaaaactatagtggcttaacaaccttcacaacctattacccagattctggaagtttggggaccactatttgtaacataggctttttgtttgtgtgcttgaaccttgaggaaagctatagtgaagcttgaggaaaccataagattgttgctaaataaccaaagggatgaagaagactcttaagtagacattaaaagcatatgattttttaatctgcaaaaaagcaagctgaaaagaaatataattgggtataaacattactggtgggatagagaactgaattagattcatatgctctgaatctagtatataactacatcatttcattgtttatttatttatttatttatttatttaatgagacagagtctcctctatcgcccagcctggagtgcagtaccacgatcctggctcactgcaacttccgccttgtgggttcaagcgagcatgtgcggctaatctttgtatttttagtagagacggggtttcaccatgttggccaggctgctctcaaactcctgacctcaggtgatccgcctacctctgcctccagcagtgctgggatttcaagcgtgagccaccatgcctggcctgattaagatttaagttaatctaattaactcagttaatgcagtattttaaatgttcactaacaagtttatatcctatctaattcctctgaaggtacatttacttttctttaccagtactcgtgaatacatggctatgaatctgtactgatcaggtattggagtgcactttatgctgggaaataatgctactgactcatcattagtaagggcatgtgttcagatttgctttctcaggaatggaagtagattcctattgtttcatctttactctttcaagcagtcttattattgtgctcctcagtcaatcttgaaaactaactagccaattaattagtagaggaatataaaacaggcttgcaaagggattcattcccttataaaacatcattaaaacaccagccatgtgtctgacagtgtaataggcagcatcagtactaagaaaaatgaaacagagtccttgcccttgaggatcttaagggtagtttgggagatagtcatgtagctagatcaatacaacactgtggaatgctataatagagttgtacacacaatgccctcgtagcaaagtgtaagtattgcccagttttattaaggaagtcatcaataatttcacaaaagagataacatttaggttgtatcttgaaagttgagttggatgtgcttagttacctctaatctttgttgctttttagtcagctataatgtgcccgaatttcacatgtaagcaaggaaaaccatagtctcacatttttaaacagtcttactctctttacagtttcacaaggtaatttctattagatcagagattgtaatttaagttaacaaattatgcttcacatttgagcaatgatggaaacttaattaaagacactaactataagcaactgcgatacatacatggctttttatgtgggaaaaatcaagaccttaagtgaggcaccaaagagaaaaagacatgctacaaatttttgtttctggactcaaatcctacctgattagcatttttagaaatatggaattgttacatctatttcacatggtagacagaataatagccctttcaaagatacctatgtatcaattgccagaacctttgactattcccttacatggcaaaagggatttcatatacgtgattaagctaaggagcttaacatgggaagattatcattagcttgggttatccaggtaagcccaatgtaatcacaagggcctttataagagggaggtaggagagagtcagagttagaaaagaagatgtgatgacagaagcagaggttggagcaatgcactgtcaaggtggaggaaaaagccacaagcaaagaaatgcaggcagcctctagaagctggaaaagacaagaaaacagattctctcccagaacctccaaaaggaacacagccctgctggcaccttgattttatacctgtaagactcatttttgacttctgacttcaggaaatgtagataataagtttgtgttgttttaaaccactgagttgtaattcattacattagcactaataactaatatatttaccaaagccttgaaaggataactagagcagtaagcatgtaagtaagtaagcatggaaagccatacaatcctgtgtcaggtatgccaattctacatgagagaacaaagatttcctgaaagattagggagagagttactcctgatcatcactcaggaattttgtcattttcagcaaagctacagcatccctgctcttttccttaaaattttcaaaaaccgtgttgaggttcattgagcaataataccctgcctttaggctctttaaccatctttcctgaaaataataacttgaatcttaacaatctattgataagccaactgctccttatctgaataaaattagcagatcaactggaaactgaaagatgactaatggtctaatgacagtccacaagatatggagcggaatcatttatcatgatggtcaaatctgaacgacatcacccttcaccttactgatcttgcatataaagctcaaagaaagtgtcaaagcacaaggaaaaacacagagattaaaaaccctaggggaaactaaaccctcacatcttttgtcatttttcttaggaacaaggatgtggatgaaaattattggtctcaacaacttcaccaccactggcaggtgtcttagtttgcagaaaagattgttggggcataacacacatgagggtattaataaaatcataggatcctatgaggaagtacctttatgagaatcctgactatcttataaatagtcaaggaaggcttcctttgaagaaatgtgaattaagctgacaatagaataaaagtagaaaatccttgggagaaagagaggcagaatattccaaataaggcaagaagcatgtgcaaagattctattatgggaaggagcttgataatattcaaggaactgaaagaagagcagtgaggctgcagtacaaggagagagagagggattggcctgagataaggctggcagggggtaatcacccagcattttgtgggctatcattaaaggttatgaactatctctttaaaatgaaatgctgtcaacaactttaagtggggacaaattgtggtaagatttatctcttagaaatctcactctagcttctatgtggaagatggattggcatggaataagaattgaatatggagagactagttagcaattcatgtgagagatgattccttgaattagactgatagaaggaaatggagattgaaagacatacataagaaagatttaggccgagcactgtggctcatatctgtaatcccagcacttccggaggccgaggcgagctgattacctgaggtcaggcattcaagaccagcctagccaatatggtgaaaccccgtctccactaaaaatacaaaaactagccacacatggtgtcaggcacctgtaatcccacctacttgggaggctgaggcaggagaattgcttgaaccgggaggtggacattatagtgagtcgagattgcaccactgtaccccagcctgggcaacagaccaatacttcatctcaaaaaaaaaaaaaaaaaaagagaaagatttaggagtcaatattgactgatgcatgaaagctgataaggcagaaaagtgagtcatggtatctgacatgaccaaatgtcaaatgatggggccaattcgtgatattaagaatgacggaggaggggatttttcaataaaaaattataaacttagttatggatacattggtttaatacttttgtaaggcatcaaagtgaaaatgctgagaaggcagttggatatataggttaagagttcagaatagaagtttcagtggcagatacaaatttggggtaaaaagtaaataaatgataactaatttcatgcaaagaaattatcccaccttgggagaatgtttaaaataagggtactgaggccctcatctacaaggaaaatgtacacatggacatgactaaacagcctattaggagctcaagggctttgaatccaatatgaattcttgatttcctggtggaaaaaaaaaaaaactccactgatgattcttcatcaactatgtacatcatggttttcctttctcccaccaaacaatcctatgttacctcacatttcctaattcactttaggttttttgccattattacctatcatcatcaatcaagaagatagcaatatttttcattgttgctgtcatataagatctaaaaagaggagcaactggacctcaataaaagtagaagaaaaatcttatttccttctcctttttttttgagatggagtttcacttttgtcgcccaggctggagtacagtggtggcgatctcagctcactgaaatctccacctcccaggttcaagcgattcttctgcctcagcctcctgagtaacgaggattacaggtgtccgccaccatacctggctaatttttgtatttttagtagagacggggtttcaccatgttagccaggctggtctcgaatgcctgacctcaagtgatccacctgccttggcctcccaaagtgctgggattacaggagtgatccaccatgcctggcctttcttccccttttcacttgcgttattattactgttattattctccttgacattttccagaattctatgttttagatgaagcccttgaaaatgagacaagttaagcaacttacccaagaacgcacagctaatctaaatatctctttttgatatagcaagctgtgagctccctgtgttggctgataagaaataaattgtttggaatagtttcagaaggaatgataccagctcctctttgtacctctggtagaatttggctatgaatccatctggtcctagacttttttgattggtaggctattaattactgcctcaatttcagaacttgttattggtctactcagggatttgacttctttctgatttagtcttgggagggtgtatgtgtccaggaatttatctatttcttctagatcttctagtttatttgtgtagaggtgtttatagtattctctgatggtagtttgtatttctgtgggatcagtggtgatatcccctttatcttttttaatgtgtctatttgattattttctcttttcttctttattagtctgggtagctgtctatttgttttgttaatcttttcaaaaaaacagctcctggattcattgattttttgaagggttttccctgtctctatctccttcagttctgctctgatcttagttatttcttgtcttctgctagcttttgaatttgtttgctcttgcttctctagttcttttaattgtgatggtagggtgttgaatttagatctttcctgctttctccagtgggcatttagtgctatcaatttccctctaaacactgctttagctgtgtcccagagattctggtacattgtgtgtttgttctcattggtttcaaagaaattatttatttctgccttaattttgttatttacacagcagtcattcaggagcaggttgttcagtttctatgtagttgtgtgattttttgagtgagtttcttaatcttgagttctaatttgattgcactgtggtctgagagactgttttttatgatttccattcttttgcatttgctgagaagtgttttacttccaattatgtggtcaattttagaataagcgtgatgtggtgctgagaagaatgtatattctgttgatttggggtggagacttctgtagatgcctattaggtctgcttggtccagagctgagttcaagtcctgaatattcttgttaattttctgtctcattgatctgtctaatattgacagtggggtgtaaaagtctcccaatattattgtgtgggagtgtaagcctctttttaagtctctaagaactgacttatgaatctgggtgctcctatagtgggggcatatatatttaggataattagctcttcttgttgcattgatccctttaccattatgtaatgcccttctttgtcttttttgatatttgttggtttaaagtctgttttatcagagactaggattgcaacccctgcttttttttttttttttttttttgctttccatttgcttggcaaatattcctccatccatgtatttggagcccaggtgtgtctttgcacatgagatgggtctcctgaatacagcacactgatgggtcttgactttttaccgatttgccagtccatgtcttttaatgagggcatttagcccgtttatatttaaagttaatattgttatgtgtgaattaaactaaagagcttctgcatagcaaaagaaactgtcatcagagtgaacaggcaacctacagaatgggagaaaaattttgcaatctgtccatctgacaaagggctgatgtccagaatctacaaggaacttaaacaaatttacaagaaaaaaacaaccccatcaaaaagtgggagaagaatataaacagacacttctcaaaagaagacatttatgtggccaacaaacatatgaaaaaaagcttgtcatcactggtcattagagaaatgcaaatcaaaacacaatgagataccatctcatgccagtgagaatggcaatcattaaaaagtcaggaaacaacagatgctggagagtatgtgaagaaataggaatgtttttacactgtttgcgggagtgcaaattagttcagccattgtggaagacagtgtggtgactcctcaaggatctagaaacagaaatgccatgtgacccagcaatcccattactgggtatatacccaaagaattataaatcattctactataaagacatatgcacatgcatgttcattgcagcactattcacaatagcaaggataaaaacccaaatgcccatcaatgatagactggataaagaaaatgtggcacatatacaccatagaatagtatgaagccgtaaaaaggatgagttaatgtcctttgcagggacatggatgaagctggaaaccatcattctcagcaaactaacacaggaacaggaaaccaaacacttcatgttctcactcataagtgggagttgaacaatgagaacacatggacacagggagggggacatcacacactgggtcctgtcggtgggtgggtggctaggggagggatagcattaggagaaatacctaatgtagataatgggtggatgggtgcagcaaactacatggcacatttatacctatgtaacaaagctgcacgttctgcacatgtataccagaacttaaagtatagaaaaaaaatccaaaaaagaagaaataaattatattcagtcattgtggaaacagatcttctctaacagaaaaatataagtgagctacaagacaacattttctgtatcaaattagaagacaaggataattcagttttttccattgacttactattttttgaaagatggtttcaccatgctaaagcctgatatttgccccctgtggcaaagcaaggactagaattcctgtttgtctagagactggaagcaaaattattgtgtggttgaggtaggattacatttgtaaaatatgaaattgctagatcttctctgctaatcagcaggggtgtagagcttcccacaaagtaatgagaatgagtcccccactaaactatagttgtgaagcatttgtgttccttcaggctgtacatctggtttctctagcttcttagcaactagttgtaatggccaggagcttctcggagtctctgtcaatcactctaatggctgcaagtcaatcaccaaagataagttgcttctttaatgactccataaaatacctactgctcacaaacaggataaaatttctggttcaattagactcttagaaatcaccaaatatttattgagtgccaaaaccccatgatatatttaacactgtagactactaagaaatataagataattcttggctttcagaaacttacaatttagtgatagctcaaaatgattttacaaaactataggttggaagggcatttaagcttatgtattcaggacagagtggttagcagggacacttgggaggaggcctgatctttgtttgtgtgtgggtggtattccaatgatgaagatgtcaagagacagggtcagaggaaaagcacattttcagtctgattaggaatgtacaatatggttttgggatgttgtaaggcaggatggaggtctgttggtatgaagcaaaagtactggtttttagggctaggacgttcaattgtcaataatcattatctgttggtgatacctatgactgcctgacagtatctcagaatcatatgtatgtcatctatcaaaaatagaggaccactactgttcatttattacaaagttttaaatctatgaggttcaaaatacattttgatcaaagtgtaaaagatatcaagctccgctaatcccaacttcttttttgtggcagtgaattctggcacttaaatagacaaaaacgcagcctagcataatttatactaacagatgtttctagaaaaattccaaatcagtgacagcctaggaaaataaccaatttcaaaggctgttaacaagcaagctggaaataagaatagtactataaagtgattttttaaaaaagcacaagaatcatactattaatatgaatcacttgggacaaagagatgatgtagtagtcatagtgaatgagaataaatggaggggaagcatctcaccagacagagagatcaaatactggagaaagaaatcaccatgaggatgcacaaggataaccctaagcctgactaaggaaataagcaggaaaagtaaaggaaggaaagttggctctcccctgcctacaaaacagagccagccttcattggaattgagagcacacttaaaacatgaataatttccaactgggaatctgtattgaaacacagacattaaagtgcccagccaccgggtgacttatttcagagccccttcctatgtcagtcaccatacacctagcaaattaaatggtgcacaagtttagagctggaacagcctgagacatggttgctttgtcccgaatattttgaaaggtatatttttcacacttccaatttgaataaatataaaataattaaaagataaatatatggccttgcagatgcttatgctacagatgatgaagattctttgaacaaataagcagtatgataatataccctatctcccatgttataagtacttcaaatataacatttccttctttcaaagtagaatatctaacaagcttaggacatggtgtagctgaaattttaaactttggcatttttgtacataatagtcaactgtgttcagaatgcttattgcattggtattggttgacttttaggagagtacacataaaaattcaatatggtctaagctctttcaataatttactatcttttgacttgtactgtgaaataattaattaaggaaataaatcattcatttattcatttaacaagaatttgttgagcacctattatgcaaggcatgtttctaatagtagggttacagagattaaaaactaacagatctttacgttttcgtgggtcagatataattgtaaataattatacgaggaatgtgagatatatcaaaaaataagactgtagcatattgtaaccaaactgaaatatagaatttgtcatcatattttcaaactaacctaccagtgttggaataagtgggggacaacaaaaattagtaagtgcctgctgatcagacctggagatgtgacctttcccatgacatttgcaaagcctcctattatctcttcctgataacaggttataagatttggttttgaaaatattacaagatgtaactaattccatgttctccatgtcagcttcccaacagaagggaatggagttcaccaagacaagcaagtttcatgaatttctctttgccaaatactcctcctctctctcaggctgaagccaacaagggagatcacagcctgatcactgacttagacttgaagcatgttgtaggaatcccagataaataacatgtctcaaaggcaaaagccaccttagtcaacccaaaactggggtgccaattcaaagggtccagtatttcttaacgggggtgctactgacatttggggcacatgattgtgcacaattgtctcacaccctgttggatgcttattacccctggcctcctctcactaaatgcccatagctttccccagtcattgcaacaaacaaaaacttgaccaaacatttccaaaaagtgcctagggggattgcattgcctccagatgtaaaccaccattcaaggcagactgtgatactgtaatgatgcctggtggagaaatcagaaaggcagatggtaaagtaataaagtaagcaactggaagtgacacaaagaaaccccaaaggctgtaggcctacacctcttataacttttaatgctatcctgaactaggttagccccaaatgctgtccaggattaattaaagtttcaaaaactcagcacatattctaccttttattctgtttaaagttcttaatatactttcaaaatataattttaaaatgtttgctttaattgatttgtggctattgttctcagatttgagttttgctaataggatgctggtcactttatggaattcttgctgattctaaaggaattattttaatccttgaaattaaatgaaattactactactctaaatctcttgtccttaaatgagacagtacaccttctttaaggtgggagatcactataagaagaaagaaagctgtgtcaacaccaaactttctgaaggaaatgtaaatcatactcccaaggcacagcaaatgtcaagtgcctaggaaaacaggttcttgtggggaaagggtttgtgacttaaacaaacaaaaggcaaaaaagaaaaaaaaatgccgtgtgaggacatgtttattttcttctggaatcggggaaagtttgggattttcttttttctcccttaagaagtaacaaaacaagccttctcctacaggtgttcagggcatgaacacttacactaggaaaataaggttaagagaacactgatagggtcatttgcaaaatgtagtaggaagaatcagaggagagttagaaaaacagcaccagagcgcccctgagtcatggagataagagaaatatctactcactcttcttttccagtgattgtgagagatttgagattggactttggaatctgcagccttatttttaaaaatgttttcggtaaatcaaatctatccttattcacttacatgaagtaatgtaagggagatgggtacattctgtgtgcctggatttgtccttttggggcaccagaatcttcattaaaaattaaagaatccttgtattcagatgagtcaacctagttctgtagtagaattttcaacagttctttaaagcctttcttaagatgatgaaagttttagagaggatgactaaatccacactcctaagtgagaattgtatacagaattttcaataggaatttgccatttgacccagcaatcccattcctgggtatatacccaaaggattataaatcattctgttataaagacacatgcacacgtatgtttactgcagcactattcacaatagcaaagacttggaaccaacccaaatgcccatcaatgatagactggataaataaaatgtggcacatatacatcatggaatactatgcagccataaaaaaggatgagttcatgtcctttgcagggacatggatgaagctggaaaccatcattctcagcaaattaacacaggaacagaaaaccaaacaccgcatgttatcactcataagtgggagttgaacaatgagaacacatggacacagggaggggaacctcatacactggggcctgttagggggtgggggacaaggggagggatagcattaagacaaatacctaatgtatgcggggcttaaaacctagatgacgggttgataggtgcagtacaccaccatggcactttatacctgtataacaaaccagcacgttctgcacatgtatcccacaaaagtaaaaaataaaataaaatacatctacatgttgaataattttaaaaaacaaagacattaaaaaaagaaaattaaaaaaatattgttcacatatcaatctccattcctccacttctcctcactaattactgacaatatcccttcacctgtgtgggtagaagaaaaattctagcagttcaaatccttggcctaaaccatcattgctaaaatattcactttttaacttccaagaagttagttaaatcatattctcactcaaaatacaagtaatttaaatgagtttttatcagtgagtttcttctggaggctttgtttctttcattactctcagcagcatgtaagaagcaatagggtgatactaaaatggttttgtctaacctgaacgctgtgtgtctggatcttcattcactctgtggaatctgtattctatggaattttaagtccttttggcaggaaattgtaaagtgaacagaaacatgggtcccatgagacttcttgtgccaaaacactatgcattatcctggtacctttaagtccaaagagaattgtttaacttcttcattcttaatattatgttgataacaataacaaataaaggattctaagctactcacacatgacatataaattaaagagtgttttttgtcacccaaagtcaaaacacaaattaggatatttactctcttgctttccgagggtgatttctattgctgtagacaatttttagagaaaataaaagcttttaattttaagtgacctgatagtctgatgttagttatctctgttgagcattttctgttgaagataggctcactttatctttaggctatgaggtcttagtgtgatggatttgtctaaatgtaaaacaaaacaaaacaaaacaaaactatggtctctaagtaaccactaaattctgatttataaatagaaggctaaaaaatgaagggtgatatgctacttgaattcaattaaaaggaactaaaaaataaattataatattatgcagaagcatcctcagatctatttaagtatttcagctttatagtcctaaggaaattcaaaagcagtgacagtaatgggtgaccattcaatgtaaccttgattggacaactttgactatacaactaacttcagattaatttttagtgagagtttttaaattgctctttgtaaggtggacagtgatgtgagtggtccttttagaagttttttttttcctgatctcaaccactagtatattttattttcattagcatatccaggggatacagtattgccttcttatctgcagattctctttccacaatttcagttacttgtggccaaccatggtccaaaaatattaaatgaaaaattacaacaataaacaattcatcagttttacattgtgtgccttttgagtaacatgctgaaatcatgtgctatcccactctatgccacaaggaatgtaaaatgtccctttgtccagggtattcacactatataaactagctgcccattagccattaacattgtctgatcctgacatctaaccaacaacatcatcatggcttgaagatccaggatcacctaaagctatgtcgcaatgcctgcatcactcacctcacttcttcttatcatacaggcattttgtcatctcatatcatcacaagaaggttgaggactactgtaaaatggaaagcatatccattaacctcacagagatcagtaccctggcaaaggttgtttgcatactggaggacaaatattttatcgtaaagaacttagaaaactttcaaaaatgttttggtaacaatttaatgaaccagaattttttaagcatctaatgattttctggcatgcacaaaggtatgcacattaggaaagcaatacagaataatttttttaagagatggggtcttgctctgtcacccaaggatagattgcagtggcatattcatagcttattgcggcctcaaactcctgggctcaagtgatcctcctgcctcagcctcccaaagtgttgggattacaggtgtgaggtaccatgcctggcctggaataatgttttgtaatgttttatagtatggaaatcagagttggaaataagtgactttaattcttggtcctgcatattactggctctgtgaggtcaggcaaaccacttagttccttaaagcttcagttttcatacctgcaaaatggagattaaaatacccatctcataggataaatgtgtgtagcacagtacctggtgcatagtaggtattcatgaaatgtggctcccgctataagcaatgaaaaccagcaccaccttaacattgacccttttaggatacaacgttccaaggaaaagtttaattttgcactggttagaaggaatttcaaatcattaccaggggaaaagtgtaaaaactgcaagataactcaataatattgagttattctcaatagatacatgaaataatattctacttggaaattcaattaaataagctccacaaatgtttattgaatgcccactattcactaggtattgcattgggttcaggagatttaaagattagttaagacagggatcttgtttccatggggcttacaatctcatgagggagatagactcacaaacacaaaaatcccttaaaggagtttcaaagaaggggaggcaacagcttaacctgggaaggtcaggaaaagctttgaagaatggataatactgaaatataagctaggtttagttgctagagtgtaacaggttttctttatcatcaatctctgtcaactgcctcatcctctgccacaaccccaagatatttcctagagctactttcaaattttcatgtcttttggggagcagaaaagacatatgcttattgattatcatatttatagaagaaacaacaagatcattttctttactgttactcattgtctaccaatctattatggctaatgaatgagaagaaaaaataaggaagatgtttagagttattttccttaaagggagattccacatcctgtgcctgccttgggaagccttgaagaaatgactatgcttacccacaaacatctcttggcaccactgtcaggtttgagtggaccacagccacaactcatgagatcatttatatttgtatattcgttgtgtataaacttggaatttatctaaaaatagcacattagaaggtgcaaaaccatttaatttgccaagtacttgtcataaccttaatgaagcagttcacttggttgggaaccaataataacatagacaggtagaaaacacagtgatcaggtgaggacatgaagaatgtttgacagaatgtatttatttctgttcatcttcacatgcaaccttgtcaaacacggtcaaattttcaatgcaaaagattaagcatgctaatgcataattctgagatacctattttaaactgcaggttgcatgaaattaatctttttaaactactcatcttcaggagttctcacccttctatcaaagtagtatataagctcagattctcattcagattctaattatatcaaacaatcacaagaatgctactaaactgaagagattctctctctgttaagggagaagtgttgatgtggacttgaaactatacagtcacttttccttttccatatattttcagttatacaatgttaaattcatactttaggttctgatatgaaagagatacagagcacctttaaaaagacactgaaaagcaccatctgttcatgctcaaatcttgaagaaaaaatttttaacttgttaatcataaattgctctacaaatagtatactggaaacatccggatgtgaggttataattaaaaatgaaagcaaaacagcttccctgaaaagaaagaaaactcttaattcaaacctaccagatagctgatttatgaaagtgaaaatgctggcatgtatagatattgggaagtcttgggatctggattttatcactgaccatctggttatagtcagagtgaaattttaaaatagcaaaatattcattaaaagcctgaaagaagctcataacaactgacatgccacaattagttatatatccatgtatccccttctgatatcaattatgtcagtttccactggtgacatcacgctaatatttgatgacacataaacgtccagtccacttaattaggatcaagagaatgggcatcaaatgagtatttttccgtcaagctgtggaataataatactttatcaagtaccaccttttgatccctacatgtgggaaaactgaggctcagacagttaaattacttgcccatagtcacatttctagagattgggagaggaggaaatcaaatctaggtctatctgcctccataccgtttcttcacaagaagagactatcgattccctgagctgcataatgggatttgtttgttcctttcagtttcctcaagcatgaccactacatctgctgtaactagtatccacaattacccagctgcatttaactaatttaaagctcctcataccaattcattacctcaaaaactatttgagagttgaagaagtttctcagaaataatgttgtaataaacaacaacaacaacaatactgtggccctctcattgattcatattttcttatttatcccttctccatagaacactgcaaattgataaacaaacagaaatttctctttgtgatagtttattttacatgtcaacttggctgggctaagagatgcccagatagctgataaaacattgtttctgaatgtgtctgtgagggtgtttcggagtaaattagcatttgaatgagtagaatgagtgaaaaagatcgactctcaccaatgtggacaggtattatccaatcgattcagggtctcaataaaacaaaaaggcaaaggaagggtgaatttttgctctcccttcttgagctgggctatctatcttttcctgccctcagacatcagacctgcttgttcttggtcctttggactctaggacttaaaacagcaccattcctacttttcagttcttaggcttttggagtgaaattgaatgataccattttccaacttgcagacagcaagtgatggaatttcttggcctccataatcatgtgagccaattctcataataaatctctttctctcctttttatatatctcctattggctatttctctggaaaaccctaatatactcttgttcatatattttgttacttttaaactcatttgcatctcaggcaaaaaaaaaaatcttttcttattagcttctatcctccaatttctttccctatctccaagaaagatcactatcaaccctcttcttccttcattctttccagagatgtcaacccatgttggctggttctgctatcatctaaatcattctgctattactgtggtcagtggggaggcagaagtgataagcagcaaatatacatcatctagaacttcagttctgacccactggcaaagcgtcttcaccacaactgaaaaggttctgaggtagatctgggtttattatgaaagattgacacaattgaatattaatgtcttccactgaagaagaaaggtaatgatacctatgtcttatgttttctatccttggcataaggcctcaataatctcaattcaaatccaaaagttttcaggaggaaacctctggacacattaaaatctcttaaacttacagatatttatttagaccttttcatggagtctaccatggcttatcactgacaaacggacaaagaaatataaaggcacgatcctcatctctatagttacttaaaagggcaagacaaactctacagcattatggattgttaagcgctaggtaatagcaaatagaataaacagtataagaatgcattagatgataacactactgagggctgtaaaaatctctgaaggcttcatggtgagggggagatttaaactgggccttaactgatttgcaaaactaaaacaagaagacaagatatgggtgttccaagatagagtgggaagctttagcggtggtatttggggaaaattaattggtcagtattcctacaaacaaccattactacagaaaacagacaacagtatagacaaggaactgtctgaagggacaaaagtgaaatgttcagcagggtaaataggggatggtgtgataatgataatttctttgattatagctatctgctaagccctgtgctaatttaattttttaaattaaattaaaactgcataattcagagataattattatcgctttttcttatcagaaaattataaacagttgaggtcttccaaggcaaagcccttgttgttacccatcatgctgagggttagttcaggtgcttgcgcaatggcatgtacatctatctcctttgttttgatacatccatccttgactcaggaatagacctagagacctacaaaagtctcgagtttgccaagacacatggcagatgagggaacacaccactgtggttccctcaggaaacagattctaatctggctttacattttccattgtaatcttgagatgcctcatagtcaaataatagttcctcagtgaaatatatggatagtcatatgatagtagaatgaataaagaccttatatagctacttggcatttcaggccaagttttattgacagactagtttgctacaaacttatgaaaccctttttattttctagatggcaaaatgttaacaattaggggacctgattgaagggtataaaggattgattgaattattgttgcagtttttatctaagcttattttttagtactttttggatattggaaatgtggctaagagactgtggacacttaagcgttcaataactgttagttcccttctcttgtgctgtagaaaaagtacaaaaggtccaagttacctctcagacatcaggcagatgattaattgtactgtgaagcggtcaagtcctccagaatactgcattttgggaacactgattagtcatattcttataagaattgggagctgccatttttaacagtttgaataagaaagttgcattgccaattctgtacctatctgatatgttctctccccggaggagaagaaacaggccttattcatctccccctccccaaccctaaacattcttcccaagtcctgaatatgcctgaaaagacatgtcattatggtttttcctgtggagtctagagttcccccacctgcaccctactgaagtcattcataggaaaaggcaatgacagccagatcttgacagatcacccctagcacagtttcactgtgatcccacaggggctttactgaatatcagtcccagagctgtctgtcttttccatttgggctgtggcagactgagctgagtaggtcagggatatgttttacaggcattacgcaggccagtcttcagaggccagtgtgcatggtgggtccagccatcctcagacatactctgcacatgtcatgctgggggacagagcagcgtgtgtgctgtctggatgattcctcttggaatgttggttgcctagcaacaagatcatgctttgctcttaagtccaattctcaggactttggcttagttacttctgatccttagactttttcttaccatccctcacccgggttcccagaaagtacaggggctccaaattccaaataatgtagttattttagctacgtggtggcagtctatatgttagatttccctttggcatcctacctgtactttatacacaccagcatttctctaacagttttaaatatgctacattttaaaagactacacagttggctttccttttttaacacagacacatgtacagcatatgtatgtattagaaaaagaatggaaggatataccacaatataaaataacagcagctttccctttatggtaggaatattagtatttttaaattatcttcaataaatgtgttaattttgtaataaggataaatattagcataatatatattgggattatatgctattaactgacatttaaaaatatatacaaagtaatggtaaaggaagaaatactgtcacacataagtacaccacaatttcaaccctatatatgtggaaaaatatgacaggaaattaatgaatgaagagggtttcatcaggataacagtaattttttcttaaattcttgaattttaatttaaaaataacaaaccttaaaaatatatagtattggcatatttacagccatatgttttaaaaggcagaggaaatcatctttatcatggcaacaagggtcatttgggcagattcccatagtaaaagattaaaatatattttggacccagagtttgttcaatcattcacttcttcattcactcaaaagccatgtctaagcatctgctttgtgccagatatgtgaacagccctgtgaatacagacctaaagcagagcatctctgccctcaaagaatctatattaaaagtcagatgagggataaaaaaataggatgcaccatttattataatacttctcaaaccatgttttgtgggtgttttcaagtgaattttagatttctctacaagtcttaattttatatttatatggtaatctatttaattaagcaagtttttcagaatcatttaaatggcaccttataactgagtgctaacacaggacttcaaggtctacagttatacttgggaatataattgcatagtactgagtattatttcatagtcttggctaatgagaaagggacctaaatataaatgatatgttgtgacacatgaaaggcaactgatgtcataggatatttgccaataatttgaatagtgacaaatggccagataattgagtcatattgggatgtgcaggatggcatggtcatgccaaactcaaaagctgttagaactatattcatgctgtaatcagagatcttgtttcagcaaaatgtcattctttatattaaataaccattgttaatgttaatttcattccactagaatgcagctctatggcaaaaaaaaggctttatctgttttatctgctgctatacccctagtacctggctcataactgcctattaaacatttgctggatggattaataaataaattgagtatttttatttatttatatatgttttctaaatttatgcttatagtttaataaaagttatgcctgttttgtgttgacatgtgtttaaatatattttataataaaaataacactggtggacttaagagaatttttctcctttaaagaagaaatatttaatattaattaagggtgctgttggccctttaaaaaccatagggttaaacctaactcttcctttttctgtgatatccgttttctggctcttctcttctacttttgcttcccaccaattcacttttcaaaattcccacatgccctttctccctcttacccttttacttcctatacttgccaaccctagcaacttcctcactctatcatcatacactaaaacagaggaagagaagagaagaaaaaacaaaccagagaataaggcaggttttccacagccccccaagaaccctcaagtgaaggtaagagactcagaagttacacagactagggttcaaatgctaatttcaccatttatatactgcccatcagaaaccgagtagacattaaacaattttgacgcgtactcttcttgtcaataaaaattttaagcgcttagcatattacttgccaatagctctgggctggagcatccgtttcctctgttcacatactttagaaggtctcactccgatctttctctgataagaactcctcctcatcaggtgaggagcttgtaggatcaaggggatgtgcccatctggtgcctaagcaccacctcatcaagagttcgaccctgcatcctgcccaaattgtcctgtttctagaccctagatatgtgcctaattcattttttaatggtggaccatctctgcgggtgtgtgtactcctaagtatcacaatgggtttcaaatggtgtggcttaaaagcatgtgctaaagtgtcaatagctctaaatgtgagtcatgagacagtgcagaagaaatcttcatggggagggaagaaaacgaggtggttcttagcccaggagctcaggtcccttcttcctatgctacctccttatggctaggaattctgaagagtctgaaagtttactcagttgagtctcactttgaacgtggatttgcaggttcattttgaaaaaatatttgttaaagtaggaggattaaatatattcagtgacggtttgttagcttgttttagaactttaaaatatttggtatatgacttccatttgaacttttgtttcaagccacataaatgttatgaatgaatctccctgagacatagtaactgtgtaagtagatgctattattattaatatcttacaaggtgattgtatagtcaattaataagtatttacaggaaattgttagcttacagcactgtacaggcacatttgggcagtacaaaagaaagagaagaaacagcataggctttagggtatttatgacctcgctggatattataaattatatacataagaaatttaagaataatctcagaagtgttcagaattttatgaagccagttctctgtaatgactatggaaaacagtctcaaatgaattatggtcactgaggttctataaatctatgtatacaatgccatcctttctttgactgattaaactttctcatctttcaaaggttctcaagcttggcctcctaggtaaagcttcttggttgcccttctctggaatccttgtacagtcaaggtcatcaacaagactttagtttttatttagtctttaatcatttcatgttaatcagtgtatgttcctaggaggacagtatttaaaaagcagaaatcttatcttgcctttcacttaaataattttctttaaattgtcccttccaacttctcccacttcctcttctgctcactcttctttaccactcaagcttcatgaattgccatttcatgaatccgctattcttgtacaattccatgttaagctccaaattatggcgtgtaatttagtatacatacacatactcaccacatgtttacacacacaaactcctgggtctcctacttggtggagtacttagtaaagaagggctttcattaaataagaaaaagaactctacattcttgttccagtgaagacaagaattgtttgagtaaatatgaagttctaaggcagggaattctttgaagagtaagtagccacattgttggaaggagcaggagggaggcattgttgggagttaggttcaatgatactctatatcacatggatcaggcaaggatcactgtttgactagtgcctactgggatagagatggaaggctgactacttaagttacatgctcagagatgctaagaccaatctcctgcctctggcctaggatgtctacaatttatgtcagtgtctttcaccacagcacacctgctgagaccccttgcggattctgagccagcttagtcctgctagtgccctcaccaggcaaagggggctccacggggcaatgtctgtctcactcatacttgaatccctagtacaaactggattttaatattgtttccattattaacacactgtatgacattggataagccacttacatattctcatctaaaatttaatttaaatgaagttaaaatttaattgtagaattattacaaaattgtgtttactcaacttatttacatgatttgcctcattttagagagggtgtaaaatgacgtttaaacataacagaatttaaaattaaaatattaatattagtttaaataaggttgtaaaaaataaatagaagaagaaaagatattagtggaaccacattgatgctattttaaaacaaagcaatggttagttattgaatacaaatatgatactaggcacctcagcagtgggagaaagatataatcagtaacctgtttcactgtgattttattattttttaaaaaagaccaaaaagaccaacgcaaatgactcaagaatcaaataaggtcataaaaatatttcttccatgggttctgataaagattaatacaatggcagaacactactgtagacagagcaatgatatcatagctttgcttttcttaccacctacatctatgacatcatttcaaactacagttcaataaagtaattttgggggcagtgagaagcacaccagtaccaaattaaaaggcagatagttttttagttttattagttttattgtaaggggagtttcacaaagtttaaggcaatcttccaaaaatatctgtttctctgaggcaatatttactagttattgggtattgactaatgtgaagttatagtttgaataagtattttggtcatgtatcaagttaagagcagaggtatgcactataataatcatctgagaatggagattaagtgacatctttgtatgaaatctgagaatccagatagtttataacaacctgtcagtgcatgtaggtgttcaccagggcacctaccacttagcagacttgcagcaaatggctactttattaatatttttgaatttatgaatgtattaatagatatactgtatctatcaatatgtatcatttattaactggttgattagttaggagtgagcacagaaaacaatgaaattaacagtgggcttcagtcagattttctatgaggagaaaatattaactgtgaaatattgactcttcaaattgtttaaatcattagctttatatacattttgtagacttctatttcaatgcagaatgaaaatatgatctttaatatatttatgccagcaacaaatcattatccaaacttatatgcaaattctacaacgagcagagggtccactaatattgtgccaaagatggtgatgaagatggagaatttagtgaaccacctacatgttctcaaacagttagatgcttgttaaagatgtggatgcttaagtgctacaagtttttcctcccaatatttcccacgatgttgttgatatactcatcaacagcaagaaatctgggaaaatctaacacatctttgataagagaaggtgtaatccatttaacaagtatttactgagtaacaatgataaatagtaattgtatcaataataacagaacctgccatttgttgagttctcaccatatgccagactgtcatttttgtcataaaaatgtatgatgcatatgaaaacagcataaacagagatagtagttgccacttatccacagttttgtattccatggtgtcagttacgtacagtcaactctggtcagaaaatagatgagtacaatatagtaagacattttgtgagaaagcaatactatgttcacataatttttattagggtatattattataattgttctattttattaataattgttcatctcttactgtgcataatttataaattaaactttatcacaagtatgtatgtatgcatagctggaaaaaaaaaacatagtctattcaggtactgtctacagttttgggcatccattgggggttttgagcatatcccctgtggctaaggactactgtacatacaatttttttcattataaaatgagtttctatgtaccaaccaaccagcttaagaaatgtattaatacagctgactctgaagcatcttgtgtaccataactaatcaaatcacactccttcaccccacaatattttttgttaatcattcctttgcttttcttgtactagttacatatatatatatatatacccctaaataatactttctaattttgtctgtttctgaactttatgtaaatagaatcaccttatatattgtcttctcttttgtcaattcatccattttatggtctatatgggtaattcattcatttttaccactacatagtatccattgtattaataagtcacaaagtacatacatttatgttgtttctagtttttgcaattatgaacaataatgctataagcaatatagcttaagcatgttctgttaattcaacagttattaaatgaacctagagaaagggcatggccttgtttctctcctattctcccaagtaatttcctagagattaaaataatatttatactcttctcttcaaccatgaatctatcctggtatctggcaaccatgatcattttttccaagaactcacttatcatatatctttctagagtgaacagcattctactgaagatactcatcaaatatattcctagaatttctaggagactataaagattaaattcttctgtgactttcttaaaaagactaaataaaaattagatgctgagttttaaggaaaatatctgtatctcaattacatagtgtttcctaaatcgaggctttgggaagcaggagtcttatgattttataacttctttagagtaaagcatttaaggtaatttaacacttactggatctggccgtgtaaaaaatattgggtaaaatggtccagagataatatggaacacatagtttctacccacatgaactattattgttggaaaaatacataagctcctataaaaaagactgaagtctatttcaaattaactgtgcttttctaccctgaagacagcaaacttgatggtaggtaagtttgagatggatctttacaattccctaaataactcagtgtgaaaaataattttaagttgaaaatatggcttcactttgcaaagatataacaataaaaatggtcactttatataattaaaatgtacttttttcctactcagtttttacatgactttgttaaataagctaagtttgtattagttgagcacagagctaggtgggagagtaaaaaatttctaatcagctgtaatacttcactaatttattaaacaaaaatagtcattttgcttgaatagtatcttcatgtttttgctttattggtttctttccttgttctaaaatatcaaatctacccaatccccaaagacttttataaaccatgcttttttcgttagctaccatcctatcaatctccttccctctaccactttcttgaaagagtactcaaagcctcctgcattatcttcatcatacaatttcatttcttacttcatgtgagagtaaactagcttctgtcctttcccttctactgcaaatgttctttgacattagaaaaccaaatgccaaatttagaattatttctgttactatcccacttaatatttctggaaaatgtgccacaatttcttatcctttcctagaagctctttttttggcttccattcccaagtataccaagatcctctctcccctccactgttctaaactacatggcataccctcttcctagaatgctttttcttaccttacctgccttttcttctaaaaaactatctagctatcttccatggcccagcttaaaacatcacttccttcctctgtatgttcccctccccagcaaagattcagattgaatttagtcatttgtgtagtaagctctgtatatctctattacagctattattacactttataacaattattcattcatatgcctacctctatgtactaaactgtaaaattccttgaaaggtgagattgaattttattcatttttgtattcccagtgcttgtgcagaagctacatggtgggaaatcacaaatttttgtgaatgagtgagtgacttaaaataggcttcaattccggccaacagaatagatcactaaataatcttctataaagagaattaaataaataaaactgatatttcactgaacagagaaaacatcaaaacctatgaaaaatgtatcaaagaatgtgtgatggttcttcagatacaaaaccccctctagtgtcatgcttccccactctgatgaaattacaatagatttgaggaaggtttgctgaaggcaaagtttgatctgctatggttgacctaaagaaaatctaattgtgtagcaaatgtcaaatctgagtcactgccacaattatttcaacactgttgcctcctagctagcccacatgactaaattaaaagacaaagaactaaaaatgttggtaatctcacttgcatctagcaattactggggcccaagggacctcaccgtgcaacaaatgttggtaacatccaaaaacacgtaacatttttcttccataacttctcttcttcccgccacctctgctatctgcttctgcttaaggacagtttggaagcaccaatattattggtttatataaaccattatattacataaatgtcaattttaaataaagctaccccataatctattccaattcccctagaaatggcagtgagcaaaagagaagcagggagcatcttcaccactcagagatacatttacataaagaattgtctgtgtgtgctacaaggtaaagctatgcattagctgtttcctttaagcatcaccttgggaaaatatattctgaaccagatttttccaatgcttaaacttctctctgggaagacacaggcccttctggaggctgcaataactgagtaagaccactggggtaccatttggtaaactgcagcttcagtgcactcaatagtaccttagtggcctgaaagagttaatgcagcatctagtggtacatgacttaattccttgggaattatttccaggctgagagaatttgccttagatcattaagaatatttcctctgaccttcagtatcttacatatgatggctggtggtaagaaatgctctcacctaatttgtaggacaaatagatttgattaatgatttgaatattttgtcagaggcaatactgaatacattactgaaacttttctttctggtaagcaacacctttctaaattatttttcttaaatcattttacttatcaagaacatagatgtgaattttaaaatcaaggattgtaggtaaaacctaacttaaataaaacagctctattcttagcaaattaattaggtaatatagacattaattgaacccacaaatattctgtactatattatgtgttaaactctaacaggcactgggaatacaatcgcaaataagcatccttgtcttcaagatacttttactcttttgggggaatgaaaagtaactagagaatcacattcttctataaaagggatatatccttcagcatactttaacaatgtgaaaatctctattagtcaactattttaatatcataaagcttagtagttaaaatataaagaaatcaaatttagatatcactgtatacatgcagagtactacatttggtggttattttcataataagaaacaacattatgttcatgcataactggatcattgaagatagaactaaatgaaattagctcttcaattcacttttcacacatttaaaaatgatcttctgcaacagaaatgaaaatatatttcttgggagttttattcctttttctatttaccaagcttctgatctacataggttacgtaaggttttaaataatacattattttaacccttgagatcaaaatgtcaacctcagtattaattttcagtacacaatatgcaaggccattgaggatcattataagaatttattataattctctaaagttcatgtttttccttccagcctttcttttattcttcttttcctctttcagatacttagcgagtccatatgtaaattagctaacaaaataaaaggtagaataaaatgtttttaatgtaaaagaaaaagcaattaatagacatttaaaaatccatttaaaagcgaagacataccctctgacaccatgttttcagcttactagaaaagatccccaacaatagccataatatatatttccacatgataaatgctatgagaaattacaacaatcttcagtgggagcaactagagtagtagtcattgagaatcttcttttagtaagcccaaggcttcaggagggtcacaggctgagaaggaagggatgaggaatttaatgaaactgagagctaggtctccgcaatatatcctgacaatcagtgggataagagatgccatagccaagttactcacgcactttactaaagagataagttggttttgagccctgataccacacattcaatattcaatcaggaattttccacgtagttccctcttcttgagacttagaaaaatgaatatccttcaaaattaaacatttggtgaaagttaattaatcttaaactctgttactccattaactagaataaatctttaaaatcaaacttctttcagaataagagagttaactataattttatatttagatactcccttatattaataatgtgttttaacagcttaaaatgttgttatagggtcatttgatttatacagcagaccagtaatttagctattactcacattttgcagatgaagtaactgacattcatgaaaatctagtttgacatcaacaattatcaaaagtagaaaacaaactcttaatatatttgaatccaaattctatagccatttctattgtaccacacagtttactaaacattttcttagtgttgaattaaggggggaaaaaaaggaaggctgagtttgcaacactaaattcaaaatataggaattctggaaatattttgggagataaacatataggttataataagaaattatttaattttcttcctattgccctaataaaaatatctccagtactacaaattcaaaaaaaactatgtacaaatgttaagctaaccttgttaatgaaaatctcttgggctttcttggaaggcaattttgtaaaattcttgaatggaaatctggacgcaggccttgtttctccagcactccatgggagatgactcagtggcaacatacttgcttacagttactacaaattcccagatggcaaatccatggctacagttggaacctgcaaaactaagaactctggctcttgtttagtcttacaaaggcttcttttaccttagcatttgaaatgtttttataaagtatctgcttacagattttcacaatgcctctgaggttaaaatggcaattattcttctgcttcaatgcatcatgtggtagcacttatctctatccccttacagaagccgaatatcttaataataataccttatatctaaaaagtgcattatcactcaaagtgctttcagatatagatctgatcttcacaacatctctccccacaatggtggtatcccccagggttctgtccgtagctattctcctttcacttttcacagttgccctgggaaatgttatccacacctgtgatttcaactgccacttacatagtgatgatggccagatgtctatttccagcttgctattcacaccagagatgcagactggcatgtatagctgtccactgaatgcctctcagggcttacccatagtactcaacacgtgcaaactgttattttcttctccaggtctgtgctgaaattctctaggatagctaacaacaccataatcttttccgctatccaagctgaatgtatgagtctcagcttctccctctctgccactcccgtaactcacataatagctcacagttattgtcttacttttactcccctaaatctttcttcattagggttctttcttcctttcccaagttattttcataggtcaagcctttaccttttcttttctgaagcattacaatagcttcttaactctattcatcatttcctctctgattccatacccaggccatcttccaactctcctgtgaaaatggtcttcctaaaagcacaaatctggtcagaacactcctctatttcaagacataagaaaaattaaactggtgatactataaaacatacaagagaatgaattctaaacctttagcgaatacaaagaccttcacaagattactccaaattatttcttcccttctttactctctgaacacagtagacatatatgctatttcctaaacaagatcagcatctttcaccactttcatgccttatgttttaactaacagatatctcctacctcctactaattctttaagagttgaaaatttccccaacacccctttgcgtagttagctaaggccccaccattcctatagagtatgcttacatcatcataatgatataagcacataggtaccagtatgcccttaagaatataagctactcaggggcaggaatctttcttactcatcttcatatccctgatagttggcattgttcacaaacttagttgaatcaagtaatgtacacatatagtgttatctccatttcatagatgtttcaaaaagtcatattatcatacaggtaaagctagagtcaagttgctgaatatagtttccctcaactacaaaattaggatagttgtgcagttctttctctacttcaaaaagttttagtaagaataaaattttagagagtattaaaagtaaaaggagccacaatacatagaaatgttttttggttcattgagattcatagccaataatgattaaaggcaagttacatccacctcagaaaaattatttccaacaggtgataaaaatcattattattcttaatatgtaaaaaagttttacagataaatgaaaaaatttccagttttttcaataacatgatgtgaaaggcaatttacaaatggagaaatacaaatgactataggcttatgcaatgttcaacattattgagaacgtaagaagtgaatcaacactgagataaaagttttaaccaaactgacaaagattaccataacaaaagtactcagttttaacaataattctttaaaattggcatcatatacccttgataagagtatagaaatcttctagcagagcaactagacccatacgcaccaagtcttaaaatgtcacaccatttcctctggaacataatggtgcaacaaattctatctatattctacctactgtgtaatgatacacttccttttcttcaagatcacattttcttaaatttcattttaattgcaattatatccctttgtttgtgtaattacattgtcagatgcatcatgaacaaaataatattccaaaaacttcataatgttgcttttccactctgaaagctcacctcgatattcatgatatggcctccgtttactttttcagatcttattttttaactaaatcagactatactgtttcctaaatgttttctatgctttcctactgtcacacattgccgttcgctacttcttttgctagaaatggcttttctgctgcccataactgagggtttgaatcccatttgtcctttaagtccagctattgaaactatttccgtcatttagtttttcctgatctgtaaaatgtagataataaaccaatcttaaatggtcattgtgaagttttaataaaacagtgtctaatacacacaaaaaaggcaaaataaacatttatggaacaaagttcttccccatttccctgccaaggccctgccaaagtctgaatacaccacaatttcttacattttcacggtgcaaataatggagaaatttactttaatgagcaccctgatgtttattaggctcattgtaatgtatatctctataaagccaactggcttgacctgaattttttgttttgttttttgagacagggtctcgctctgtcgcccaggctagagtgcagtggtgctatcttagcctcccaagtagcttggattataggcgtgcaccaccatgcccagttaattgttgtattttattttatttttggtagacacaggatttcaccatgttggtcaggctggccttgaactcctggcttcagtgactctcccatcgcagcctcccaaagtgctgggattacaggcatgggccactgcgccctaaaaattcaggcatgacctgaatttttaattgtttagaaaaacatctggaagtttttctatcggtttacatatctgtgtacaagttcttctttttctacttctttagtctctcctccaatgttaaatacttttcaaaactcaaagaattttgtaaaatctaatatccgaatgaagtatccaatgctttctctctctgccattaaaagacagcccccaatagactctatgacttaacacaatacacttctgagatattttaatttggaattcaaaaagattggtaataaaatagattttctctttttttctgcattttaaaaccttttgtattgtaaaataaaacagacacagataaccacaggaaatgtatgatttgatgaattatttaagcacaaactcctgtaaccaccactcacgtcaataaatggaactttgccagccaccacagaagtctccatgtgcctcaggccaatcaaacaccctcctttccttcaaaagtaagcatgggctgacttctataataatccatttcttgtattttttatagtctattcctgaacactatagcttagttttctatgtctcttaaactttacaggtttttactccatctctttctttttcttattattaatctgttgaaaagcctgagccatttgacctttagacttccccaaagtctggattttgttgattgcatacacatggtacagtttaacatgttcctaaaattggtttttagtaccacttccagattgtctaaagtataagcaaatcacaccaatgattaaaaatgccttgtataaacctcatctggcagttaaagcctagtttaaactaagattcctagttcagcaaattcagcacaaataattgctctaatggagtcacatggcatagctagaatatatgatcagtcaaatataattttaaatatttaccttaggaatacactctataatttttattttcttgaacaacagagttaagttcccttttttccttttttttttatctttatcttgaactaatataaaaacaagttttggtttttttgttttttttttttttacatccctaaaaaattaacttttaacatacaccaaaatacagcaggtgaggtatgggcacatgtgtgtgacagggaaaaaagtactcgatgacttgacctgtgttgtccattacccacagcaaggctaacacacacacacacacacacacacacacacacagagagccaaggggtggcaataattagtgtgctttaagtcagggaagacgggatgatggatatattatcaaataaaaacatatgagacaggagacatgataatttggagacaattaactgacagcttattaaaaaaaacaaaaaagcttgcctccttctaccatttatgacgcccataactcctaaggatataatgtaggtaaaactgatatggttcctaccaccatggaatttgaagtctatcagggaggcatgtcgtaatcaaataatcaaagaaatacacatattttagcaaagtgtgggcagggggaaaaaaatggaaatagtgaggccaagggactagggctaggatttatccatattcaaattatctcctatcctgacatagctgcatagaaagagagaaaagaactgaatccaaggcatggaaagctaaaaaattcattcccttcttctttaaactgttgtagatgtttaatgctaaaatgagggtatcagtatacacaggttttataatcaattttctggggaaatggagccatttctaaatcccaccttgagaaagccaaaaggccaaaaggagtatattcttaacacaaatttcaaaatagaatttttaaaacccaaaaggaatgaaagctgaatttgttttcatgagagactaactgctaactggagatgtggcatttaaggcatacaccatggaaatgagactgcatgaatcatggcttcttcaggcctactcaatccgcccctgactgacaagtccgacttcatttatttagagagggtccctttgatgaggcaattcaacatacgactaactgggagattaagaaagagtgaaggaatgatatttccaaaacatgacagcattttccaagtatgagtgattgagaaaaaatatatatgtaaagaaagagaaagttgagggttttgtttactattttaatgaaattgaataacaagaatagaataggaagattcaggacatcaaagggagtctgtgagagttttcccaacaacagttcaattaaactaatatttactgcaggcctaacatgtgcctgatgctaagcccgcaaaacaagcaccttgaattaaggagtttatgtgtgagtcagtcaacacaaaacagtttcttcggagctgaaatagagctatgtaaagaaggaagaatagaaattaactaattttgcctgggataggagggatccaccgaggagattatactagtacataattttgaaagtcaaataagggttctcctctgggaccacttagaacatggcagaggagaaaaatttccattccaagaaaacctgtctgcacccaatgacagagtttgcattctcccaagacaatataaatattgagaagagtggtcatgcacttgagaggctgtacattttaatggaaaaagtgctggacattagccttctgggcaagtcacttaacctccttggactgtagttgagtgttgaaacttggaatctcaaagttcccttttaaatctagcattcaatggttgtgtcaagatccaggactacagagctagaaagattcttacccatcctatctgtctttctcaagatagggaggaagagcacaaaccacactgattataaaaaccctttcagaatatcaatgtcaagggcctctccatccatggaaagaacgagttaccctttagcctccacaacagcaatgtctaaaaaaaatataataagaaccacaaatgagagccatatatgtaattttaaattttctagtagccacattgaaaaaagtggaaaaaaagaggtaagatcaattttaatactacattttatataaactaaaatatacaaaatattatcaattcaacatataatcaaagataaagattaatgagatacttcattttttcatactaaatcttcaaaattcaatgtgttttttacacttacaatgcatctcagttcagactaccaatacctcaagtgctcaacagccacatgtgtccagtcgttactctatcagacagtacgactcaagtgtgtgtcttcagaagctgctggatagccctagggacatccatatttctcttccacatgagggtttagacttgaaatttattgttatggctgaatttgatacagatttttaaggctttgattctcagaaagtttcccctgtgagtagtaacattgcccttatttagacctcatcggaaagaaagactgggaattagttttcacattatgttgtggggaagggtgggacatcactgagaaaagaaggaatctaccattgaatcagattttttttatgtataagacaccatggagggcttgtaagatgggatgctaatgtctatcatataaacaaagattttgttgaaaaacatatgttgaaagcatatttcaacatataagcacttatatgctttcaacatataagtttttcaacaaaatctttgtttatatgatcgacattagtatcccatcttacagctgaagaaacaaaggctaagactggctaaataactagctcatgatcacacagctggtaagaggtagaaataaattcaaacctagggctataagacttaagtggcagggttactaaagctaactctacttgttcacatgtaattccacagcaatcatggtctgaatagtccagaaacctgaaatttcttttctcgtctttgaaaccctgcatcgatgcaccttttaaccagcctgagctaaatctttcctaaatagtatttgaggtttctctctgttcctgctcttccttagctaagctacaaaaccgttcttgctcatttctttacaagattactgaatcaaaacaaattccagtatctttcccttgatctttaaacagaggggtaatgtttccactctttttaattatcatagcttttatataaactctcagaaagaaaagtctgcagttctggaagacagaattgtgtgtatagaaagactagctttgccattttcttgctatgtgactttgggtatgctaatttgcgtttctaagtttcagttttagagtctgtttagtgggggcagtaaccctcacctgacaggttttaatcatgattaaaataaataaaaattaagaaatttctagcatgcaaaaagcaatcattgagtacattcttttcttctgcaatttcttctggtcatctacggcccaattatgtactactgctcttttgacccattttgataggtggcctcttccccaggagtagtgtctatctatccgaataggctcagtaagaattatacatggaaacaggatctcagggctttcactactcagtgaaattgcagtgaacaagatagacattttatgtgcgtttttcctctggaggatatattaccccttaagttaagactatatcaaaaatattctgcccaggatgttcccatgagatttgatggcactgaccatcccccgcatacccagccaaatccctgcatcctgcctctggccattttggttttacaggctctgcagattgtgctgcactccagggaacatggctttgtttagccctgaaggaggggataatgagggaagaggtgagaatcacctagtgctgtaaaaatcaatgttattgactgctggacaaaaggaaaaggaaaacagccttgctgactgcagtggactggaaggaagggaggaaattggaggtgggcagcagatcttcctaatgagaatgggcagacatccctgactgagtgattaaagatcaaccgccttgtctaaccaacctctaccctccttcagcctctactgctccaatcatttctgcaaaactatcttccaaattgtttataagaatgaaaacaatgttttaggcctaagggaaaaagtaagtgctatactggtgaagcttcaatttttctttaatgtattttgaatttttcttatctgctattttcattacctgaatttttttcttgaactagtcaaatgctttcctagaaatttgtattataaaattttttagacagaatgattttttttacttcaaatcaaattaactttaataaataaaaatttaataattcattattacccattacagacagacacaaataacatttcttattaatgactctggcccttgtacagaatacagtgtttagcccataagagagactcaattaatgtttacttttaacaaatgaactggaaaagatatagaatttggccaggtgcagtggctcacgcctataatcccagctgtcagggaggcagaggcaggaggatagtttgagcccaggagttcgagacctgcctgggcaatatagcgagattcccttccacaaaaaggaagaaaaaacaacaacaacaacaacaacaacaacaacaacaacagatacagaattcacattctggtaaagaaaagcagatataaacatctccaaaacaagggatatactagtgttacactaggaatgcaaagtgtattaagtgttacactagaagtacaaagtaataaatgtatagaaaacaaagaagttccatgttagagaagaaactagatggcagggtctggaaggacaagacaattattatgtagaggaaaggaaaggtaaatatttttctgtactgaagtgacagattaagcaaaagcaattagaatgaaaaataattattaatatttttataatattctagaattcacaaagtaatcccacatgttatattgtttatgcttcataacaacccaataaggtgcaatgttaatactttgttgttttaaggcatctttcttggacagaaaagattatgtggagctctttcccttgtgaaattcatatttaatttgtaaagttataaattcaaaagcctacatgttgcttaacttttaaattttaattcataattgtactgttttacttataaacctatcaagttttttacaatcatcattaagggagttttatgacttaattatatcccattaaatattttaacctgtatttataaatttaatatattaaaattttaaaagcattttatctaaacaacaaaaaacttctcaattatttgaatcattcttttaaatctaataaatattaataaaacaaagtgtgaacattttaagcttttttacatgctccaatacaacttacaaatgaataaggttttaaaatatccttaatcttaaaattgcaagtcaaaatcaattccttgacatccaaacaccaatctgttaaatgttctaatctggcaaattatctttaaaaacacaaatatatataaatccaaatgtgtacaaatatcttaacataaaaatattaattaaaaagtttactttcctccattattctgtaattaatctaaatcttttcaggattagtgacctctatgcaccaaagaaacaattaatgcaaactttgtgattgctttcccaagcaatttggggagtggttatatttagatgattactattgtatattacgtagaggtcttggctgggagatatataactgccgatactgcagttaatttttttcatctcctcaactgtaagactaagcatcattttatcatcaatatcccaaaattttacaaaggagttaggtcctagcccatgttcttgggatccaaagtataccataaggaaatgttcagctacataagccagtttgagataaccaccaaatttaaagctaaccttcactgcttcagttaacatttccttggctttcacaatttatttatttatttatttattttaagacggagtctcactctgtcgcccaggctggagcacagcggcgcgatctcgatctcggctcactgcaagcgccacctcctgggttcacgccattctcctgcctcagcctcccgagtaggtgagcctacaggcacccgccaccacgcccggctacttttttgtattttttggtagagacagggtttcaccgtgttagccaggatggtctcgatctcctgatcttgtgatccgcccgcctgggcctcccaaagtgctgggattaccggcgtgagccactgctcccggcctttactgaaatattttaacatcttctgaatgaatcttgcatatatctggggctttttttgtctaaagccttgctcatgatacaaggtagattcttatcattactaaccatttcaattacaccatcttgaaattaagcatcagaaaaactgatttcctcacctagaagcattgcagactactttgtaaatggagatgacggattttcaacccaggctttctaccaaacaccccagtttttccacatctcctatatggcgtgagccgtggatgggaagtatagctggaattgattctggctgtgtggactgaatgaggttacagtaggtctcgcagaaggtaatgatggaaagtgactgaggccatcatgaggatgaaaattttgaaggcagtgagaaacacataagctcttgaacagagaaatggatggccagttcttatctgtatttaacaaaaataagtctggtgccaatatggggaggacaaatttggagaggacagagggagattagggaagccagtcacaatgtttcccggggcaacacagtgagaaaaaatgagagcctccactgaggaaaggagaggcagaaagagacaaagtcgaagaaattacaggtagattctacaggatttgtggattaattagctctccatggtctctggagagtaaaaatgatttcaatgttttcaatctaagtgcctgggagaatagtgatagtaagaaaattgtctggttggcttctgtttaaaagaatcattaaaaccccagctcaaagccattatttggcaggactgggtgttgagacaatgttaggagactagctagagaaacttttgcatgaagtatgtattttttcccctgttagaactacaatggcaattatccttttgaaattcagactcaccatatatatttttttcccaactgcatctcatctcaaagctattccaaggttacacttgaaagctttctaacctctgctgaaaagtaatggtccaagaaaaacaatgctttcagtccctgcttacctgtatttatttacttttcaaaaagagaataaaaaagcttccctattatgcagccactttaaaaagaagcctatgaataattattaatgacatgattcttatcttatcacatagtatgagcaagaacacatgacaaataatacatcttaatccaatagacatgcattcatatacatatatataggataaaagaatatacatttctatatatgaatagcaaggatatgaagaagtatacatttttgtcattttctgtacttctataatttctataataaacatgtattacttttataatgttaaaaacattgaaaaatataatgtattctgacccacttaaaactgattcattagtttacttttcctaacgagtctgaaaaagtgcagttcataaattagtcaactaaacatccaacacaaatgcaaagggctcttttatttgcgccaagattcagaggtccatttcagaaatctcccttactccctcccatccaggctcactgtaaactcctttgggccagtttcctcttccaatgtaagtactccttgaaaaatgaattagacacttttaaaataaataaatgtatgtgtacctttttaaagttgtaaatctagttatacctatagaaataaataacaaataaatttaaaaactcaaaataagcctcccactagtcatctaactttcattttaaagaaaggtattcccttggcttctttcaaattctgcctattttgaaagtgccaaagtctacacagaaagaaaaaacaaaacctccagctgaaatttgagaaatatttaaggccagaccctcccatggtcaaatgactttttattttattgtctacttttctcttgtcaattctcaagagctaggttccccaagacacagtacaatatcacttcatcgtggggagttttattatcatattcactgcattaatactaagtgcagatattagcaaatagatttctttcaacggatgctcaaacttcaatttgttatgaagtcttctaagtataagcaccccaaccctgaccccagatccatgggagaatataggttatcaggcccataagaattcttctggtccctggctaatgaaagaaactgtgacacactcaagtcaggggaacctaagtctaataagggtgaggaatgcccaatgaagtcatcaaaaccaaatggatgcaaagcagtcctttcgaggcactggcctgtcctaagcattggtgcctgagcctagcatttattgtggtttcaccagttacttgctgtgaggcccggaacaaggctctaaacctccatggcccagtcctttcacatgtaaaaataggtttaatagaaaactttctcttggggttattgtgaagatgaaatgagtgatgtacacagtgcctgactcatcataaatactaaacaaacattagttattattattaagaatattgaggtatgtaagtgggtaggctaaatcccaaaggccagggacagggaagtaagcaccgatctatgaattcccagatgaatatgctaatcggcaaatgaaccaggctatatggagaagccctagtgttggcttcttagtgttgtctgactgttgtaattcatcatcttttcatttgcatattcctaattgaggttgtatttttcttaaggcagggaacatgttacagtgtttttcaaattatgagttatgacccattctacaccccttcaaagtcaataaagaaggttaatgaaggaatcttttaagcgggtcaatatgaattgtatttccccccccattatttttctgattataatacatttaatcttgaccaacattataaaaaagaaagaaattgttaaaagttggaacggaaaatatcacaatgcataacttttgctaaaggaggtattgctttttaaaacatactgagttgcaattttaaatttatttcttgctgcatgttgcaatccagcatttggaaaatctttgggtctatatgttacttaaacaactattaacacatagcaatttctgaacacacttgagaattccaaacatatgctatatgacagtgttttccaaacttgtcttatgaatggtttacctagggtcattttcagattcccaggctgctttcctaagattctgatgctggaaacatactatcataatgaacattagagaggaaattaattagagattaattaattaatcttaatttttcattagagaggaaactctccttgttgtgcatctattcttatttggtggtaacacatccagtccaaagaggtactttataaaatatttccagctttctgaacggctaacattcattcattcagtccattattttcaaatatttattaatcatttgtcatgtgcaaggcaatgtgtacaaaaatacatataagagacacagttcctgccctcaagtagcttatagttgactcatttaagaactagggcagcatcccctgaggatcagaagaactgagaccaaaagaaaaggaaatcatgaacgtatacatatgactcaaatctagggtaacctaccttctaaaaatgttcagaggattaagaagcaggccgggcgcggtggctcacgcctgtaatcccagcactttgggaggccgaggcgggcggatcacgaggtcaggagatcgagaccatcccggctaaaacggtgaaaccccgtctctactaaaaatacaaaaaaaaaattagccgggcgtagtggcgggcgcctgtagtcccagctacttgggaggctgaggcaggagaatggcgtgaacccgggaggcggagcatgcagtgagccgagattgcgccactgcactccagcctgggcgacagagcgagactccgtctcaaaaaaaaaaaaaaaaaaaaaaaaaaaaaaagaagcagtaaaatggcatggtaattacttatcaaagtatttttctctaattaatacagcagagctgaaaacccacacaccacacctaaggaggactcaatatcagtgtcgaaaaagacaagaagatagatatcaaaaattataattatatacagaattgaacaacttgtccccagtcccactggcacccatctgatctaagttttcaacatatttcccctggattactgcaggaacttctacctggtctctctgctcctgcccttgctcccttaaagtctcttttcaacatagcaacctgagtgatcctatttaaatgttagctaaatgatgtgacccttccgttcaaaacacagctggcttcccatctcactgggaaagtcctacacgatcttttcactgtgacatgctcttgacctttctctcttcagccacactggcttcttagatgttccctaaaatgccaggcaggcttctagctcagggcctttgcatgtgcactttctgctaccttttccaacatgtatattttgtttatgtgttttaggtctttactccaagccatattctcagtgagaccttcactaaccatcttatctaaaactctaaaccaacccatcccccaatgcacacttccaatatccttccatgattttttgacttagcacttatcactatgtactatgtattttacttaactgtcttatgttctacctacctcactagcaataagttctatgagggtagagattattgtctgttttattttaccctttatttataacacctaggtctgtgcctgacccgtaataggtactatatcaaatatttggtgaaggatgaacgcagaatacaaaagaaagcctcaggcctgactctggccaacatgtattagaaagaagccaagaaaaggaatggcaaggtcatgctatgtaagacatatgcaattttattgtttacttaattccttacctaattttaaaaaaagatttgagatgtctgtaacatattcattgtagttttcatatctatattatctatttaggtagattgctaaaaaggtttccagtggaacagacttggtttagaaggtgacttcactggcacttaatatttgtaatattaggcaagttatttgtgttctctaaactttagtttcctcatatataaaataataatgatcaaaatgcataaatcttaggtcattgggaagcattttgagaaaatacattcaaacttgttgatgtagtctagggtccatactaagagtttgacaaatggtagctattattgttattgttcaatgtgctgttttatcctttacttattaactccttgtttaattttttaagttttgagttaatgggctttgttagaaattgtaaatctaacacgttaagtaggcttagatattataaacccaatataccaaattggtgtccaaatggctcacaaccatttggagaccatactaaaggagtccagtaaggaactaatacgttataggtatcctaaaagagagagttattcaactggaaccctaagaggtaccatctctgacttgttatgagccataggtgttactcgaacggtccatacattgtgattcataattccaagtcctgcctacaacaaattatgtgtttattaaaagcatcaatatgtgggacacatcataggatctagcaaagagtaggtgtcagcagcataaggagacagagtttctggaagtttccctttcaattagtccactgatcattttttgaattcctaaatataaataaactgtaaggaaaaaatcaagaaaatagtttatagttcctgtcttcaaaattcttaaaatttagttggggtgagggcaatacccaaacataagcaaaattaactaccagtataaaataataatgcaagttatgatataaggcagtataagatgtattgccataaatgatggagaaattgtactcactaagtcaaaggagagataaagcactggagttagtgtgactgggttccagttcttcgaagatagatatagacaccctgtactgtttattaaaggaaggacagaatttagacaaatatggtcaatgcagagaaaggattcccatcacaggaaaacaactctagaaaatgatcggggcagagagggtggggtgtttggaaaagagcaatttcactgaataaacctggtgaaaattagcatgataaatgtctgaattctagagtgtttaggcttcaataaattgttttagtgtgaattattgactccctccaaactagctgtacaacctggctgagcagatccaaaagagtatgtgacttagtgtaagtggtttgcgattggcaaatccagtactattcaaactgaagcctatatgacttcaaaggctatgaggttttttcttcctttttttctttctctcaaaataatttaaccagcattaagataaacaaataatctgaaaagaagctgagtgaataaaaaagaaatgtgagattcgcttaatgcattcatttaaagcatctcttgagtacctactgtgtacttagcattgttctttgtgctgatgatataaaggtgaacaaaacaactagaactccaggttccatggagctaacatgtgaatatgcatatatgtcattgtgatggttattatggtgggacaggaaatattatacctaaatgtgtttctaattaattatagccatattttaattgagcccaatttctaatgtgattcttattgaaggcaactctgaagccttactgctacttggtggtcttcattttctcaatgatgagttaatttgattgagttattactatagtctaagaactttttatagggttcacatgccttatctaacttactgcttataacagctaagagctattattaaacctttttcacagatgagaaaaaactaaactttcttaagctatgcaataaatggggaagacaagttcaaagtagttcttttgaaatcccaaaaatccatgctttaaaaccattctgttacactctttttcttaaaagttattgtatttacgctcagtaaattttaaaaataaaggagcagaattcttgaatttatgcagtaggcagcaggatttactctaaagagtagtaagtcaccgctcaagagactctgcttctgacacactgtggaaaagagtaactagtcattgcctctctctaccttagttttcttacctgtgctataggtctaatacttgcaattcatatttcagggattgtggttttgtgagtgtacatgtgggtatgtttgtagtagcaatgaaaaaagggaaatagtgcgatgaggaagataaagttatttagaaaattatcgtcagtatcactaccttcaaaaattgatccatttccaaagacaaaatgatacagacatctgatgcaacaagcttcctgcatattttctcattaaagaggcacttttcctataatatagacaatttcagatggaaactgaactgtgtacgtgatgatcacattgcttctttttagtgagtagactaaaactaaattgtattttgtaaaactaaatcatattttgtaaaaagttaaaataaaaacccaagccaatgtaatgtgaacctttatcaaactctatttaaaactaacaagaaaacacaggacataaataatggacattgattagaagttttcattcatttcatttccttctgttgaaagctctccttctagaaaataggtagcaaagtaaaacaatttacaaagtgttagattgtgatgaccactcagtcaattcaagcagcattggtttatctttcttttatgatttacccattatttcactcttcagccttgtaagaacccatgttctaaccatttcaaactatttgcagctctttgaagtgctctgcttcttagctccatgcttttgccactccctttacccagcatgccttccttactccaagatgcttggcagaagtccattagctgtcaagattcaacttaaaagtgacctcacagcaaaacctttcttgattagtccaggtaaaattagcctgtgattttgtttgtttgttttgtttgcttgtttctttctcctacaacaaaccctgcatagatgtccattatgggtcagaaatacttcaaagcatttatttgtttatagtctgtgtctttttccgactggaagcttcttaaaagcaagcactgtttctatctatcctagtttccaagactctaacatagtgcataaatcatagatgtcattcaaaaaattgtaatagatgaatgaataaatggtgacccaggagtcatattctgatgtttgtaaatatgtgtgtgtgtgtgtctatactagtggtccagatttaatgacttgttacataaaaatatatgaaatatcttaaaacataccactctcaataaaattctttgttatattttataaaggtcctattaacaaaaaagtttattctagaataaaagatcatgacattagtggtctattgtgtgcagagaaaaaaaagacgaaaaatgtttctatcctttgaattttaaccatcttaaagttttggataactgtaacaagaatcatgttaaatcatgttaaaacatgagaaactatataccataagagagaattcaacagaaccaagtgataagtagttcttgtaacaatagaaataaaagcaaacacttttaaaatgtaatataaataaaataaaacaaaagtcaaaatagataaaaatattagatgaaactttattgcaccaatgtgataaaataatagaccgcaaatgaactgcaaactctttggcaaaacttgttgtctcagaaagacaagataaccctaaaaaattatgaattatctaaggaagtgcaagagctaattactgaaaaggtagaagcataattcaaattaaaactaatctactcaaaggaaggttatatatgctgtttgtggcaatgcatatggtctcaatttctatcaatcaatacataagaagtatatctcagtacagattagccaaagtactaggaatttattattcaaaagtaatctgaatttagttaagatattgttagtgaagcttttattactttgcttatgaatttaaatgagaaaaatgtaaagctaaattcataaagacgactgttagtaggtaagagtaaaaagaaatttcccaaagcccattatgaaaggaactttggacttaagttttcctgcacttccaaaatataacaatgaaatagcaaaacaattgttatctctttatctaaattatttatggagcttccgctgaataaagtacttttctcctttcaaaaagatgaggagggaaaacatttacaatttactgagtttacaaaacaatgcatgtcatacccatactttggaacagaagatgataatagagaaaatccaagatgatatttgggcacacttttcatatttttaattatttttttcatgttgtttactgtctacatcttatacatggaggaaaattgactgctaaagttcattttaaaagtagtaaaaagcaaattctatagaactctgcaaaatgatccacagaatgcttccgggttgtagttgtaaaagaattggtcatcaaaacataaatacctacctgtttgaaattcaaatagaaaacagaaaggcttacaaaagagtgagcagcagggagttctttaataaaacttgcaaacacagaaaatgaaactttagtacccagacacattaaaacactcccctagtaaaataaaaaggggaaacactttatattgactttaaaaaaaaaaaaaaaagattcctattttaggttgtcttaactgcttcttaattattttttctcaaaggcaatcactttccttttggacttctttctccaagaaatgtaagcttaaaatgttaaccaaggatgtaattcacttaaattatgcaactggaattccacagctggtctggccggctcagtgctgaatgaacacagtgtcagaaaaccttctcaataataatgccctgttcgtgacaaggggtaaatctcccaaacttgggctcaacttcagaggctcattagctacagcaagtgaatgtcagtggggtgacaacagcgggacagcagcgcccacgcagctgaagcaaccagcccacccagagctgacgatttgtataatcagtatcaccaatttccagtgaaaatcatttgttgatatgcacaggatggtcaggtatcccacagagcacatctaatgccattacagtcactagatttaaccccccggctcttaaacaattcagctgcaagaacacaggaagctcacagcactttttaaaagaaagacaaaatcataattcaaagcatgctttatagctttttaccttctctgatttcttggttctggcctacctaaataattttcatcttttcttcccccctctccaccccccaactatgagcgtgaacctgaattacaaacagttaaacctgaaggtcacttcacagcagcgttccaacatgctcccccagcgaggctgcacggcaacaataaaacaaagcctttgcaaccacctgtaataatctgcctgctcagccagcaatccgaaaagtcctgaagctacacaaggtagacattttctgcagctggtttaacatgtatattgtgcccagttgccggctcgcctcctcttaccttcacgttagtccggagtgcacagtaacatgcaaagaacattgcagtaaataaggagcatatggaccggtattcagcttctcagcacagcgcaagccccacacacacgatcctgggcatgtgctactaaagagcatccgttccctctgtcagtttgaaaatgcattgatctctgttttctctgactacaaaacgacatgtcttgaaggcactgagtgagagctcaaaatctcttcattggctatatatagcattatgcccagtaatttcaattagatgagaattcagcgtctgaaagttaagacctcagttgcttttccttctagcattttaaatcactggattaaaaaaaaaaaagaagaagaagaaggaggggggaatgagctcactcaggaaggagggggggaaaggtgaagaattgaaatttaaccaatgagttacttatatttctggagagccccggtgttatcctattaaatactttacaatgggatcgcatcgcagactgtaaatgaagaggaaacccttcttcctttggaggtttaatatgagctctgcactatattccaggctattctggtgcagcaccctgtttggcaaatactacaaatcaccgcaagcatgtctcattctgcttctccatgtggaacaggaccaggaccagaggatcattgtcatataaagtcccctaaaatgtgaactgggttcctctggggtgatctgtggttaaaggactgagaagtaccaccttctcctacttccctgccctgttacatcttttagagctatctaaagttgccagactccataataaaatgatgtggccaattttccaaaactatgttttattggtacatgacaatcagtaatgagatggggttgaaatggagacagaagatttcaggggataacataacctcagattcagtagcaactgctgctgaatgtaaaatgttcagcaggctccagaagggagagagcaagagagaaaaataaaagcttctgcccctataagtccgtaaggaaaaaaaaaaattaaaaacatccgtcagatccttctatctgttgtcattcctgtcaggcaccggatgctgcaaattaactcaatttttacttaatcaaaaggacaaagtacaatttagggtgctatacccttatttccagccttgggaagccgattctcagctagaattctaaagctatctggcaaaatgcaagcagaaatgaacagttttcactgcagcaaaaatagtgggaggaaaaaaagtggttatgtctttgccacgatgctccccatcagcttccagcaacaaggaagatcagcataactcactagaaaaagctgcagtgacttttaggatctttctttaatatgctttgcataagccacctcccctctggagcctgcagaagtgctgaagcaccatcagagttactgggcatttctcctgggcaatgaggtgaggcagcttcaggaggaagaaaggtatttcagggagagaaattaaaggaagaagaaaagcaggattttctatttctctcttaatgacaagcattcagaaagtgtcgtcagttctgactaaatagctattttgggctgtcattgtttgtgcctttttttaggaagaaaaaggcagtcttatcctaagctggagatccttgggcaacgtaagagaaggcagccacttattttgatttccagttccgtctgtcttaggagcctaggtaatttacaaattataagcacttacaacacaaccagtgacttccaggacattaaaaaatcgacatggatgcccagctctcatcattccacaactttttctacggactttaaatgcaaaactgagtatttcagttaataacactttcccctcccaaggttatagcaggtcacatttcctgcagctcttcctaataaatgaacccaaatataacaactcaatgccatgcaaaacatagaagaacttaaaaatgcctttctccactgaggattcagaggaacttttaaaaacctactttattcaacctgtgaataagtaccatttttttccattagaagctgggaaaatgaaatttacctattttattaatattattttagtagttgccgggatatttggatggcccaggagagagagaccaaaaagaactggaaaatgttacaaatctcagaacagctcgcaagcaaggattaaatgaaacaagttacaggtgaagaagtacatgtaggtttccctgtcaaggctatcagggaggacttctaacagggctttagataccattttaatgtgtatacatttttttaaaaaggcccttagccttaaaaacttctttaaaacacctgagtatacctgtctagcctacaaaatcccagtgctatacctgtagatttactgcctaattttcttaagtggactaggatagccaacttactattctcattttatagatgcaggaaatggggcattaactacaatggcaatgtcccactaaagaatattccatattttaaggcaaggaattcatcagaacagtatatctgcaagaataataacatttgctatagtagaagaaagttataactgcctatgcatatttttgtaggcaatagagtaagtctaggcttccatactgcaagtgagtagtcctggaaaatcacttccatgccagattcccatttgtaaaatggggataacatgtatctcatagtgtccaatgagaatattaatgatgaaccctgccatcaaaataaactctggaaggatcaatgatttaaatataaaaattgaaactgtaaacatactagaagaaaacacagatttgattttgcataatattggaatacaggagcctgaagccatgcaagaaaagatagacaattgtgactatatgaaaatataaaacttctccttgggtaaattatacacaatgacaaacaacaaactgggaaactatttacaacacattccattgggaattgttttaatatacaaagaactttcataaatcactaagagaaaacataaaactgaatgaagcactcaaagaacataaagtagcaattcacaaaaagaccacaaaacacatttaaaatgctcaacctcatatttaagaaaaaacataaaagttagaaaaggttattaaaattgacacatcaagtatttatggagatgcattaattggtaaaaactttttggaaggtagtttggaattatctatcaaatatttaaagaggcaaattatgattgatgtagtgattcaactttcaggaatttatcccagatatatgtgtgtatgtgtatctaaaatatccatcagtatggaatttatttctttaaattacagtttattcataacataggaatataagatatatatacatattcttatgtggaaagatgtccaagttatatataatattatatgtaaaaataagtttgcaaaagaactgatattgtgtgaggctatttgtatttgtatatttacatacacttgtagggagaggtgtggggtgtgggtgtgtgtctgtgcatgtgtgaaattttaacagtgttgctattggcttaggaagggatgcatgacagtttttattttatacctctatactataggaaatcattcacaatgaacaacttatccaatccaactatcccttgtcagtaaatgagagaaatacagatataaggaagaaggaaatactagaaactgtgaggggatttaccccattgcactccatgagcaaaagtcagggaatgattgtgagaggagaaataagaatctatcaatttctgaattgatcttagatctgagtgtctctctgaatgtgaacatctcccagtaatgcatgtaattctagtgtgtatgtatgtttttcttaaagcatagcccttaaatacaagccaactaccttgattcccaaaaggaaaaagtgactatcaagaaaattggactagttgattttcaccttatgcactgaatttaaacctatctacatatatttggcttgtatttttaacagtgggcatgtaatactttaaaaaacataacctggattataaaaaaagttttcaatattaaagcaatatgcaactacaatttgttacaaatacaataacagcaacaccctcttttaatatggacaaataattcatattgctagacatctttttcctaatctataaaataaggagattggactatctagttcttataggtagatagagtagttttgttagataccttgctttttgttttgttttctttagataggacaaattaggtaagtttatacgttaaggattctctagattgtactacaggccaattaagtcagaatttctgagggtgggaatcaggaatcagtattctatagagctccccaagtgattccagtgtccagctaggattgagaattactgccttagagcatgggtcagcaaactgattctgtaaatggccggataataaatatttcaggcttgtaagccatacgatctgtcacaactactccattttaatgttgtagagagaaagtagcctacataaatatctacttaaacagacattacatagtgtgttccaataaaactttattattgataaacattaaaattgaatttcatataatgttcacatgtcagaaaatattatgatgatgattattttaaccatttaaaaatgtacaccatttcttagcttgtaaattgccgacttttttctctaaagtctagagcagtggtactcaaagtgcagtctttgggctaggtgcatcagtgtatgttaggaatttgttagaaatagaaattctccataccccagacctactgaatcaaaaacactaggtatgtggctcaggtatctgtgttaacaagccctccaggtgattttcaagtaagctaaggtttgagaatcactgctctgaagaaagagaggaaaattgatggctttggctctcacaaaaaataggaagatatcaactccagagcacaggtataaaaattaactttatagaagaggaaagtatagaaaacaaacagaaggtaatttctgttgtaaatgagataattttagagtggaggctaaagattctgagatggatgccacttgagaaaggaactatataatacctgataatttagaatcctttctctcttaaaaactctaacagctcttgggcctttgagtaaaaaaataaaataaaataaaaacagaccttggtttaaattccttttcttgcacttgccagctgtgtgaccttgggtaagttacataacttctctctgccacagagtattcctctgtaaaataaaggtaacaaatctacttcatagggatgttgtgagaagtcaaatatataacttgtgcacattgctagtcccattacctagaacatggtaaatgtaataagtggtagtttttagtgaaaagagaactgaaatgatagaggtaaaggtgaaggtaaaaaggtgctatcattccttttgactggcttcttttaaatacctagacgattctttcaggggtttgtagatcatctagaacttccctagtatttccagtcagccataaagaggattctcagaaagtctggcaatctcattataaaccctgaatcaatttactattattggaatttcttgcatcctccttgggattttcctgagataataatacccaatttacaaattaaaaatcatttcagggcttctcaaaaatttccacaaaagtatccctaaagtcataagataatgcatttatatacctggaagtgtataaaatatataaaattggatgtcattttgtttcatttcttatcttaaaaattgatataaatttaacaagccaagaaggctatgcaatacttataatactctctgatatgtgtgtgtgtgtgtgtgtgtgtgtatatatatatatatatatatatatatatatatatatatatattactgtgaatgcctaggggtaggggtattcttgcctcagctcacaagtaaagatatatcccatttgatttttgatccttacataagccctaaagatactgccaccatcccctggtgtccagtgaggaaaactgacacagtgattaagcaaattattcagatttatacagaagctagaggtggaactccaatactaagtcttttaattgtaaagcccagaggaaatttctcaagaccccagtgcctatacagtggttgattaactctttcacacaaaacaattcttttatatataaatatgtttcatattctacttacaaccatgataatataacctacttttacatggaatttaaaaactcaacataacatatgatataaagaattaaacttaaagttgaaattaaaataacgtatacttcaatggcaatactcaggcaaaattccatcaatggcataattaaatgggcaggtgcttgcacccacatgtatagacagatgcaggtatattgaattggctacacaaagcttaaaagcagcactgctatcagtgacacaatattctgaactgttgaaaacttttggtaaagttctgagtaaaacaaagaacattcttcccttatatcagaacggaatttcttatagagaaattgcgttattgaaaacttcagtgtatatcaacttaatgcaagagatgctttgtgttaaatacataaaacgaagtatgattccaggctcaggaaattttatcaagtatctaatataaattaatgtccagtaagatatttaaagagggtagtactggccttaatgagaaccacttgaacgcacagcctgagagtaaatgtagatttaggaatacatacttgcaaagatttttttaaattccttaccacaattactcaccaccctgtaccaaggaagttctacatgtactttcagagtgtaaaaagcctactcttctggataagagaaaagtctaagaatgagtgcctcacaagcaatcacacattctaaattaaaagactgaaaggacaatggaatggacatatcttaaccaataaagaaaaaaagccttcagggagtgaccatctcaaaatcctgttactccttaatggttggatcagaggctatctttttatgagatcagcccctacagagtcttttttctgaatgccttcaacatgtattatttgtattgcccaatttagtacctgattatacagtgtcttgtattgttctcttattgccttttgtgcctaaaattcatctcaaccccacattaagcacttcaaaagtaaaggacaactatgagctggaaaatagttcccttgagcacatagtattgttaattattcttcatgaactgacagattggtgagcagctggaaaaaaattaatgaaaaacctcaaaaaggctccaacactgcctgataatcctaccctgttctttgaacaacctcctccatcctcttttgaaaggcgattgcaaacattctccactctcctcaaacctcacaccttcctccatcctcattccacttagtagatagttgccttctactaagaagaaaacaaaaacaaaacaaacagagaaaacaaaagccaacacacaagtcctcaacttttaccgcaaaataaaagaaaaatcagtgactgcccttccttcttttgctcctctcagtgtatgttcccctctcatcaagactggatctttctctcttcgtgatcctccttatgacaatttatattcatgtgcaagactttcccatctaaaaacaaatgcaaaactataactacttcctctaatcacagttccatatcaagctactactatccttcctcattccttgacacacaacctttttaggaaagccagcccctcactctccatccatttcctcattttccacactgactctgacttcttaacacattgatttatgtcctgtccccagccccttaaaattgggcatcacaaccaacatgtcacttatttaactgtcacttctctatcttcaccctcaccctccacacttctgggcagattccaaacagctgagcttcccctcctcttgaaacacccttaccctacggcttctgaccttaggtttccccaccacaacctttcagtatttttttttaattttaagttcaggggttcatgttgaggtttgttaataggtaaacttgtgtcatgggggtttcttgtacagtttatttcatcacccaggtattaagcctaatatctgttagttacttttcctgatcctctcccttctcccaccctttattttctgatatatgaaattgaatgtctttgtgtcattcccctctatgtgtccgtgttttctcatcatctagctcccacttgtaagtgagagcatgcagtatttgcttttctattcctgtgttagtttgctaaggataatggcctccagctccatccatgttcctgcaaaggacataacaactgttcatttttatggacgcatagtatttcatgtactacatgaagaaaacataccacatttctgcaatgaacatatgcagccatgtgtctttataataaaatgatttatatttctttgggtatatagccagtaatgggattgctgggttaaatggtatttctgtcttgaggtctttgaggaaatgccacactgtcttccaatatggttgaactaatttactactttactctcctagcaatagtgtatgtgttcctttttatccacaaccttgccagcatatgctatgtttttgactttttgataataactattctcaccagtgtgagatggtatctctttgtggttttgacttgcatttctctaataatcagtcatgttgagcttcttttcatgattgctggctgcatacatgtcttcttttgaaaagcgtctgttcatgtcctttgcccactttttaatggggctgtttgctttttttcttgtaaatttgtttaagctccttacacatgcttattattagacctttgttgaatgaatactttgcaaaatttttctcccattctgtaggttgtctgtttactctgttgatggtttcttttgctgtgcagtaggtctttagtttaattcattcccatttgtcaatttttgcttttgttgcaattgcttttggcatctttataatgaaatctttgcccatgcctatgtcctgaatggtactgcctaggttgtcttccagggtttttataattttaggttttacattgaagtatttaatccatcttgagttaatttttctatatggtgtaaggaacaaggtccatcttcaattttctgcatataactagccagttagcaccattatttactgaataaggaatcctttctccattgcttgatttgattattttatgttccggatacatgtgcagaacatgcaggttagttacataggtacacatgtaccatggtggttttttgtacctattgacctgtcctctaagttcccacccctcacccccaccacacaacaggccctggtgtgtgttgttcccgtccctgtgcccacctgttctcattgttcagctcccacttatgagtgagaacatgcagtgtttggttttctgttcctgtgttagtctgctggggatgatggcttccagcttcatccacatccctgtgaaacacatgatctcattccttttttatggctgcacagtattccatggtatatatatatatactacattttctttatccagtctttgatgggcatttgggttggttctatgactttgctattataaatagtgctgcgataaacatgtgtgtgcatgtgtctttatagtagaatgatttatattcctttgggtacgtacccagtaatgggattgctaggtcaaaatgttatttctggttctagatccttgaggaatcaccgtaatatcttccacaatgcttgaactaatttacattcccaccaacagtgtaaacgcattcctatttctccacagcctcaccagcatctattgtttcttgactttttaataattgccattctgactggcatgagatggtatctcattgtgggtttgatttgcatttctctatcagtgatgttgggcttttttatatatgtttgttggccacataaatgtttttgtcagctttgttgaagatcagtaggtgttcagtcttatttctaggttctattctgttctattggtctgtatgtctgttttgtaccagtaccatcctctttcagttactgtagccctctagtatatttttaagtcaaatagtgagttgcctccagctctgctcttttcgcttaggatttccttggctttttgggctcttttttggttccatatgaattttaaaatagttttttctagttctgtgaagaatctaaatggtagttaataagaatagcattgaatccataaattgctttgggcagtatggccattttaatgatattaatttttcctatccatgagcatagaatatttttcatttgtgtcatctctgatttttttgagtagtggtttgcagttctccttctacagatctttcacctctctagttagctgtattcctaggtattttattcttttggtggcagttgtgaatgggagttcattcatgattcggctctcagcttgattgtggttgcagaacaggaatgccagtgatttttgcacattcatgttatatcctgagactttgctgaagttgtttatccactcacaaagcttttgggctgagactatggggttttctagatataagatcatgtcatctgcaaatagaaataatttgacttcttctcttcctgtctggatgcactttatttccttctctttcctcattgccctggcaaggacttctagtactatgttgaacaagagtgatgagaaagggcatccttttattgtgccagtttttacaggggaatgctttcagcttttgcccattcagtacgatgttggttgtcggtttgttctacctggctcttattattttgaggtatgttccttcaacatctagtttattgagtttttaaagaatttttaacatgaatggatgttgaattttattgaaatcctcttctgcacctatttagataatcatgtggtttttgtctttatttctgtttatgcgataaatcacatttattgatttgtgtatgttgaaccaactttgcatcccagatataaagcctactttatcatggtggataagctttttgatgtgctactggattcagtttgctagtattttgttgaaaatatttgcatcaatgttcatcaagaatattggcctgaagttttctttttttaatgttctttttgctaggtttgggtatcagaatgatacgggcctcacagaatgagtcagggaggagtcctgtctcaattttttggagtagtttcagtaggagtgataccagctcttctttgtacatcctctttgtacatctgtgaatctgtatggtcctgggtgttttttttttgttttgttttgtttttttttttttttttttttggtgggtaggctatttattactgtctcaatttcagacctcattattagtctgttacaaccctcagggaatattatgaatacctctatgcacataaactagcaaatctagaagaaatggataaattcctggacacatacgcccttccaagattgaaccagaaagaaattgaatcccttttagtatttttactgtctcttcctgcagtaccagacttttatatgcccgagttccttaagactcagactttgtttctcttgtttttccatttcataccttttcctaggttttcttgttaattccattacatcttattatcacttctgtgatgataacttccaagtctttttctaacccacatccattctctgagctccagacccatttaccaaattgtttgcctgttactggaacttcgaattcattattgccaaaactaaactgaatttctgcctgaaacttcctcttcctcctctctttttcctattttaagaaatggcacttcatttatccagttacataagtcagaaatctagcagtcacctctgacaatctctttccctgtacttccaacagtcagtaaattatcaagtcctactaattttcttagatatttgcagaatgtgtaatgttttcaccagattcacagtaattatccatattcttgagtggttattgcagaaatcacctaaatgttttccttaaatatattcttgacccctctaatccacttttgacccagatctatgaaagagatcttttctagacataaatatgaattatatcattctctgttcctcacaagtttgctagcttctcagtactgtttaaatacagtcccagatatttaacaggatcctcaaggtcctgcatggtataaacccagcctgatttagaatcaggtatcacttcatattctatgatccagccacattgaacttgttttgattcctctaaagtactatgccctcttcaacacaggaccctcctacctgcttttccataggtctggaacagtggctgtcaaccaggagtaatctcacccaccctctagaagacatttggcaatgtctggacacacttttggttattataactggggaagagtgttattggcatctaatgggtagagatcagcaacaatgttgatcctcctgcaatgcataggagagcatatcatgacaaagaattatccagcccaaaacgtcactaatgctgagattagaaaactctaatctagaaagctttcccttctacctgtaccccacatgaccctgcatctagccaaaacatatttaaatatcctgtgtcagcttaagtggcctatcttcagagtaaaacctccctgacttttgtctataggtcaggtctacctcctatttacgcttataatatttttctttacttttttagcccttactaaaatttaaaactagttacttattcagttaatgtttggcttccatgccagattttaagctctgtgaggttaggaaatacatttaatgcaatatccttatcatctggctagatactcaacatacttattaaaaagtaaattaacggatgaatgaatgaagctgttacctagaaagaagaatgttaggcctacgatactgtataagtgatcctagctttggcattaactagatatatctctgaataagtcctttaacccttcatgtggcctcattttaagttatataaacttttactataatgagttttatgaggattaaatattttgataattctaaagtattttgtagtcctattagaaattataggttagcataaaaattggtacaactacatggaagggattaacatgaaacaaaagccttaaacacatatttttacttaaatatttcacttataaaaatttatgaaaaaattactaagcaaaaatatagctatgtggattttatcattagttaaataaataaatgaactatagtgaatattttaaatataatgtatatttgataaggaagatatatatgtgcaatataatacaattctatatacatattttatacacatgtatacacatgtacaataaaaaaatctaaatatcaaaatactggcagtagttatcttaaaattacaggattatgcaagttttaattgtctttttctgtttcaggactttcctaatttttctacaatgagcatggcttttgaaatttaaaaaaaggtaagaaatgagtgcggaaaagcacgtcttacactatgaagggactgtaaggagttgctatgttataaagaataagatataaaccttaccttttagaggttttcaaatgaattataaaaataaaataccggccgggcatggtggctctggcctgtaatcccagcactttaggaggccgaggcagctggatcacttgaggtccggggtttgagaccagcctggccaacatggtaaaaccacgtctgtactaaaacacaaaaattagccaggtgtggtggcagatgcctgtaatcccagctattcaggaggctaaggcaggagaactgcttgaacccaggaggcagagtttgcagtgagccgagatcatgccattgcactccagtctgggcaacagagctaaactccctctttaaataaaacaatccaatcaatacctatctagataactgttagataagaaaaaaagttaagaacagtttccatcataatcatttaatgagcacttactacatcccaggctttccatgcattaatttatgaaatctgtaaaacaaccacattagttaggttttatcatattcatttaatagatgaagaaactgaggccactggggttaaacaaactgctaggtcataccagaccaaaaaaaaaaaaaaaaatcaaattcaaactaaagtctcagtgatatcaaaacttctgttcttttcagcaggtacttataaaagatatataagtcaactgggagtccagagaaggggtggttacttgacagtgagaaggcaaaggaagcgtatatacaggagttaacagtttagctaactctggaggacgagtaggattttaataactgaagatgggggagaggacatgaggaaaggcatttcttaccaagggacacttgaacaaaagtgagaggtaaatggatagttcatgaaattttgggggaagtttgtaggcagactggttagaaatgaattaaatacaggaattttgtttaatcagtaaagggaattgaaatttgataggacttcaaagatcaacagaaagtggggttagaatactagaaaatctataatattttgacatactagaaatatgactagtcttaaaagtacagcatatgatggcacattgcactgtctgtgttttcaaacacagagaaacttagaggtaggaggggacttggagagcatctgagaaaactctggcccagaacagagaaattgttgtcaaaagtcataaaactagactagaatccaagtcagctcagtcctcattctggggtcagttcctagaaaaggaaccttgaaatactgtgtggctttttaacagttctgtgaggtttgtattataataactatttcataccagcagtcactggagctcagagaaattaagtaacttctacaaagttatggaaccaaagctcatctcacccagaactaatgaccttcttatgaatggagatattgccttattctgctattatgtccccatagcatcttccacagggttcttagatacccaacaaaaatcaataaaatatcagccattattcattactcttgataaggatcatatatattgattttatggatagagaatactaggtgactaaagaaggaaaaataattgagaaaatcataaattatgaatttaattacatataaattttaaacatagcttacttttgttaagagttttgccttgattatagatcactagctgccactaaaaaagtaaactgtttagattttgaaagtcttatatttcccactaaagaaattcagccaacagatccctatgggaaatgtttctttcttgtaaagcatacagatttacttaaatccttaaataattagacttcagaaccagaatgcaattagaattaaaattcataaatgtgttgtctttttccattggcaaaatgtatatggaacaatccacagctggccacatctgcatatgctaccttccccaaagccagcaaccatgctttctaattttcgccaggggtgtctaactgtgagtacacaggaaatgagagcaataaggttattaggggaaatgcttcatcttatataagaacatttgattatgggaaatttatctaaaatatagataaattataaacatagataaatataaccctttgtgtgcacatgtttgcatttcttgaagtactcccaaaataaaattaagcacattcaaaattatagttggatggaaactttgtagacaaacggctaaaatttcctttaagtgttcaaaaggagataaattagaaagataaatacataagataaaacaatatgattatctccaaataatacaaatttaatgattacttattaaaaatacaaaattacatgagaagtgaccttatacaactttgactaagtgtccttatagctccccaaagatattataacaagtatacaactcaatttgagagcctgactatacaaaaaaatggccagatcatttacaacaacagatcttaaaaataaatatttatttttaatttttatgggtacttactaggtatatcaatttatggtatataagataccttatagagacatacattgcataataattacatcagagtaaatagggtatctatcacctcaaggatttatcaattctttgtgttataaacattccaattttacttttagttattttgaaatgtataataaatttctgttgactgcaataattccattgtgttatcaaatactagatcttattcattttatctaactatatttttgtacccattaaccattcccatttccaccatcacccttcccaccatcacccttcccaccactatccttcctagccactggtaaccatccttgtactatgtccatgagttcaattgttttcatttttagctcccacaaatgagtaagaacatgtgaagtttgtctctctgtgcttggcttattccactgaacataatgttctccagttctatccatggtattgcaaatgacagtatctcattcttttttagtggatgactagtattccattgtgtatatgtaaaacattttatttatccatttgtctattgatggacatttaagttgcttccaaatcttggctattgtgaatagtgctgcagtaaacatgagaatgcagatatctcattgttacactgatttcccttcttttgggtatatacctatcagtgtgtttgctgggtcatatagtagttctgtttttagctttctgaggatcctgcagacttttctccatagtggctgtactaacatgtatttctgccaacagtatacaagggttcccttttcttcacatccttgccagcattcattattgcctagtttttggataaaagccatttttactggagtgagatgatatcacacattttagttgtgatttgcatttttttaaatggactcttgctctgtctcccaggctggaatgcagttgcacaatctcagctcactgcaacccccgcctcctgggttcaaacgattctcctgcctcagcctcctgagtagctgggactacaggcatgtgccaccacacctggctaatctttttgtatttttagtagagacagggtttcatcattttggccaggctagtcttgaactcctgacctcagatgatccacctgcctaggcctcccaaagtgctgggattacaggcatgagccatgcccagccatgatttacacttctttgacgagcaatgatgttgagcaccttttcaaatacctatttgccatttgtgtgtcttcttttgagaaatgtgtattgagatcttttgcccatttttcaattgaattcttacatttctttcctattgagttatttgagctattgagtatatattctgtctcttaatcccttgtcaaatgggtagtttgcaaacattttatcccattctgtgggttttctcttcagtttgttgattgtttctttgctgtgcagaagctttgtaacttgatgtgatcctattttacatttttacattggttgcctgtgcttttgagatattactcaaaaaattattgcccagaccaatgacctagagagtttcctcaatgttttctttcagtagtttcatattttctggaattagtttgaagtctttcatccattttgaattgccttttgtatatagtaagagatagcatctagtttcattcttctttagatggatattcagttttcccaggactatttattaaagagactgtcctttccccaatgtatgttcttggtgcctttgtcaagaatgagttcactgtaggtatacaaatttatttctgggttttctattatgttccattggtctgtgtgtctgtttctatgccagtaatatgctgttttggttactatagctctgtagtataatttgaagtcaggcaatacgactcctccagttttgttctttttctcagaattgctttaaatattctgtatcttttgtgttttcacataaaatttttaagattgttttagctatttctgtgagaatgtcattggtattttgatagggatttcactgaatgtgtagattgctttgagaagtatggattaattaatagattaacaatattgattcttctaatccatgaacatggaatatctttagatgtttttgtgtcctcttcagtttctttcttcagtgttttgtagttttcattgtagagttaaattttatcaaatcttttttcagcatcaattaaaaggatcatatggtttttatccttcattcaattgatttgatgtatcacactgattgatttgcatatattgaagcatccttgtatccctgagatagatcccccttgatcacaacgagtgatctttttaatgtgttgttgaattcagttttctagtattttgttgagaatttttacatcaatattaattagaaatattagcctgtagttttctttctttctctttttttttttttgatgtgtctttttctggttttgacataaggataatactggcctcacagaatgcatttgaaaagattccctcctcttctctttttcagaatagtttcaataagactggtatcaattctttttcaaatatctggtaaaaatttagcagtgaagacatcacgtcctgggcttttccttgctgggagattttttattatggctaccatctcattacttcttattggtctgttcaggttttagggttttagatttctccatggttcaatctggataggttgtatctgtctaggaatttttgcatttcctccagattttccaatgtacttgcatatagatgctcatagtagtctctaattagactttgaacttcggtggtatcagttgtaatgtctcctttttcatttctgattttatttaattgaatctttttttcttagttggtctggctagaggtttgtcacttgtatcttatgaaaactaacttcttattttgtttatctattgtatttttgtttcaatttcatctatttctggtctgatctttattttattttactaatttggggtttggtttgctcttgcttttcttgttctttaagatgaatcactggttgtttatttgaagtttttctacttgtttaatgtaagagttattgctataaacattccttttagtattgccttcagtgtgttccacagatattggtatattctgtctccatttttattttttaagagattttaacatttcctttattgacacactaggcacattcaagagcatattatttaatttccatgtgtttgcatatttaatacttcccaaagttcctcttattattgatttttagttttatcccattgtggacagggaagatattttaaattattacaattttttaaaattttttaaggcttgtttcatggcccaacatatgggcaattcttaagaatgacccctgtgctaaggtgaagaacatgtactctgcagccaatgggggaactgttctgtaaacgtgtattaggtccatttggtctatggtgcagattgagtctgatttttcctttattttctgtctggatgatctgtttaatgctgaaagtggggtgttgaggtctccagctattactgtattgagatttttccctctctttggctttaataatatttgctttatatatctgggtgctccactgttaggtgcatatatattaacaattactatatcctcttgctgacttgaccccttatcattatataatgacgttctttgtctctttatatagtttttgtcttcaaaaccattttgtctgatacaagtatagtgactcctgctcttttttggtttccatttacattaaatatctttctccatctttttctttcaatccatgtgtgttttataggggaaacatgtttcctgtaggccacagatttttgggtcgtgtgtgtgtgtgcgtgtgtgtgtgtgtgtgtgtgtgtgtgtgtgtgtgtatctattcagctactctgtcttttaattgaagagttttgtccacttacattcaacattcgtagtgataagtgaaggcttattcctgtcaatttgttatttgttttttggttgttttgtagtcatcctttccttcctgccttcctgcctgcctttctgccttcctaactgcctgccttcctgccttcctgcattcccacatcccttcctcccttccttcctgtattccatttagtgaaggtgactttctctggtggtatgttttaatttctttcttttatattttgtgtatctgttgtaggtttttggatttgaggttactaatgaggtttgcaaataatgcctcgtaacatgttattttcaactgatgacaacacaattgcaaaaacaagcagaggagcaaaaagaaaactaatgaaaactcaacactttaacttcatccccccgatttttaactttttattgtttctatttatatcatattatactttctatgtctccaaaagttgttgtagttgtcatttttgatagctttgtcttttagtatttctactcatgatatgaatagtttgtataccataattacagtgttataatattctatacttgtctgtgtgcttactattaccagtgagttttgtaccttcagatgatttcttattgatcattaatgtccttttctttcaggctaaagaactctctttagcatttcttagaagacaaatctattgtatatgaaatccctcaccttttgtttgtctgggaaagtcttcatttctccttcatgtttgaaggatattttcactgtatatattattctaggataaaaagccttgtaaatatgtcgtgccattctcccagcctgtaaagattctaccgagaaatctgctgccagatgtattgaagctcctttgtatgttatttgtttcttttctcttgctgcttttaggatcctttctttatccttgacctttgggagtttgattattaaatgttgtgcagtagtcttctttgagttaaaatggcttggtgttctacaaccttcttggactttagtattgatatctttctctacatttgggaagttctctgttattatcccttcaaataaactttctaccccaaactctccatctacttcctctttaagaccaataactcttagatttggccttttgaggctattttctaggtcttgtaagcttgcttcatcattttttgtttttcttttgtctcctctggccatatattttcaaactgcctgtcttcaagctcactaattttttcttctgcttgatcagttccgctgttgagagactcttatgcattgttcaatatatcaattgaatttttcagctccagaatttatgcttaactgtttttaattatttcagtctctgttaatttttttttttttttttgagacagagtctcactctgttgtccaggctggagtgcagtggcatgatctcggctcaccgcaacctctacctcctgggttcaagtgattctccttcctcagcctcctgagtagctgggactacaggcatgtgccaccatgcccggctaattttttgtatttttggtagagatggggtttcaccatgttagccaggatggtcttgatcgcctgacctcatgatttgcccacctcacctcccaaagtgctgggattaccggcgtgagccatcgtgcccgatcttgttaagtttatctggtaggattctgaattccttttgtgttcttttgagtttcactgagcttcctcaaaacagctattttgaattctttgtctgaaaggtcacgtatctctgtcactgtgggattactctctggtacctgatttagtttatttggtgaggtcatgttttcgtagatggtcttaatgctagtggatgttggtcaatgtctggacattgaagagttaggtatttattgtagtctttacagcctgggcttatttgtacacatccttcttgggaaggttctccaatccaagtattcaaaggtaactgactattgtgatctaagtatttggtcactatagccgtatctgcactaggcgacaccccaaccccaagcccaagaacgctgtgagtcttgcagacctgtagaggtaacaccgtggtgttcttgagtgagatccaggagaattcctgagattaccaagtagaaactcctgctctcttcccttactttccctcaaacaaacaaaccctctctctctgtgctgagctgcctggagctatggagggatgacaaaaacaaccctctggctaccaccactgggactgtgctggatcagacctgaagccagcatggcactgggtctcgcccaagacccatgtcaatcactgactggttaccaccgatgttccctcaaggctcaagtgctttacctcccacagacagaaatccagctaggcttatggccttttctttagggcagcaagcttcccccagcctgccagcccagggcacgtccagaaatgccatgtgttagctatgctgcctgtggttgagaaagaggaaacacaagtgcttcttggccacccttgctggtgtatcactaggtaatgtgcatcccacgtccactgggatccaggatctaggtcatgtgcatccgacatctactgggatccaggatctggatttgggaacctgaagaagccacttggtgctctattcaactgcagctgagctggtaccttagccacaagacaaaacccttctcacttttccctcttctctcctcaagcagaaggagcttcgccctgtggctgcgagtgtctcactcaggcccatggcaagtactgtctggctacttccaatgttcactcaaggccggagggctcttcggtcagcttgtggtgaatgctgacagccctgtgcctctccgttaagggcagtatcctccctttggcccaggatgggaccaaacatttcatccaggaaccaaagtctagaatcagaaaccccaggggtccacttagtgctctacgtcactgtggccaagctggtacccaagctgcaaggcaaagttccctttattcttccctttcctttcttcaaacagaaggaatcccttctccatggccaccacagctggggatgctctgggtcacacctgaagccagcccagcaatgagtctcacccaaggcccatgacacatctggcaacaactgatgcttattcaaggctcaagagctcattagtcagcaggtgttgaattctgccaggactgtgttattcccttcaaggcagcaggttcctttatggcccaggatgtgtccagaaatctctttcaggagctagatcctgaaataggggcttcaggactctgcctagtgccctattatatagttctggagctggtatccaacttacaagacaaagtcctctttactctcccttctcctctcctcaagcagaaggaaggagcaactatagagctgtttgcttatgctgtctgtggttgagagagaggaaacacaagtgcttccttggccaccctagctggtgtatcactaggtcatgtgcatcccacgttcactggctccaagctcagcccagcaccaggacttaccaaggaatttcagttattgtggccttgactgcctttcaaatttatttagagccccagagccctttagcatgcaatggtggtgctagccggaactcaggttctggctgctgagatgaatgattcccctctggctagggctggtctaaattctccttatatgtgtgccagccaatttttgctctgtgttgctttccattattataggacagcactgatttccaatgccaagtccagccatcactttgctctccctctcccaagcacacagattctatgtgccatgcggccagtcgctgccattgccaggggatgggtgagggatgatgttggcaattcaagatgtctttgcttccttctttagtgtctccttccttgataggatttaaaaaccaggtactgtaattgcttacctgatttttggttcttatgagggtgcattcttgtgtggatagttggtcaatgtgttgttccttctggcaggggtagggggcgatcactggagggttctatttggccatcttgcaccactgcctcttcccaatagatctttgacccacagtctctgcagtaactggctcaaaatggtgatgacttggtcaatgactgccagcttccctaatttttgctcatagtaccaacatagaaccagagaagaacaaatattatctgcaaactaatcacataggatgtcccacttatagttaggctgcctccaaattcctccatgccaacaacctccaatctcaacagactagaagccttcccccaccacaccccttgctatgatgctttcctacacccttacccacttttgagtctgccaaatccaagtgatggtggctgactcctttgctatatagaaatttctgaataaatagcctctgcttgttcatatttgagtggtcttcatttacttccacaaatatttgcagaaagtggagattaattttatttaggataagcattattctcaatttaccagggttagttctgggttttgcccattctctctgtgtaattaatagtatgctcttttactctcataagtgtccttggttgaacaataaattacataggtactatgattttaggcaatttattcattagacaatgggagtaacaggcaaactgttattaaataacttgtcctagagcaatgataggtaacaaagagaagtgtactgggccgttaggtagctaacttcctctctgatcataaaatcaattgtcaggttagaaggagagaagtattctaccttttgtatcagagtttttctgatggaatttctagctttagtaaacaggagataggattttaagaggtgtcctcttttccccttgaggcattcctgccacccctgcaggatgatgcaatagttgccatggcaaatacttctcccacgctgctggaaggccttcccatagcagactaacttctgttctgttctgtttctattttcctttttctctctctgttacattgtaagttactcttgagtttagattcagactataaccttctctctagcttctttttttttgaaagcaatttgctgtctgtctgcttttctgcaacctactgtgcatatccagagataagccctgatggcagtcatgtggaaaagtgtggcagacagaagacatgaccaaagaaagcaagggcaggactggaatgagtcaactgaaagcagggattcttcaatttgctaatctcaagtgctctgttttccaatgaaaatacgaaattttgtcatctaaatgcccagtttatgcaaatgcatggattttccctgaagaacagcacattttatcatacagtaatatagattcaagggcttcaatgtcagaaacaccttgttttaaatccgtaaggttcaagatactggaaacaatttcttttttggccaccaatataaacctaacctggatcttgacaggtacaaaatacatatttgttccctgcatgtctgattgatttgtgatccaccacatataagtaccatgaccttggtaagttacatcatttctctgagcctcaatgtttccatgtgtaaaataagaaaaataaagccatcttataggattgctgcacaatttaaatgagacagagtatgagaaattcctagcagatccctgccatgcagtacatatttgacagttactgcgttcattatttctgttgttattgaaaagatcagtttaggagggtcctactgaaaaacatttcagtaaatacttttcggaggacccgccccgaaaatcacgtaggttcttttctattttcctaagcgtcggctggcttgagaaataaagggacagagtacaaaagagagaaattttaaagctgggcatccgggggagacatcacacattggtaggatccgtgatggcccacaagccacaaaaaccagcaagtttttattagggattttcaaaaggggagggagtgtgcgaataggtgtgggtgacagacatcaagtacttaacagggtaatagaatatcacaaggcaagtggaggcagggcgagatcacaggaccacaggaccacaggaccacaggaccgaggtgaaattaaaattgctaatgaagttgagacagggatttgagatcaaccagtctgaccaaaatttattaggcgggaatttcctcttcctaataagcctgggagcgctatgggagactggagtttatttcatccctgcagtctcaaccataagagacaggtacaccctggcgggcggggggtgggcagttcagagacctacccctaggtgcgcattctcttcctcagggatatcccatgctgagaaaaagaattcagcaatatttctcccatttgcttttgaaagaagagaaatatggctctgttctgcctggctcaccggcagtcagagtttaaggttatctctcttattctctgaacaattgctgttatcctgttcatttttcagggtgcccacatttcatattgctcaaacacacatgctgtacaatttgtgtagttaacgcaattattacagggttctgagacaatatacatcctcctcaaccgacaggattaagagattaaattaaagacaggcataggaaatcacaagggtattgactggggaagtgataagtgtccatgaaatctttacaatttatgtttagagactgcagtaaagacgggcataagaaattacaaaactattaatttggggaactaataaatatccataaaatcttcacaatccacgttcttctgccatggcttcagccggaccctccgtttggggtccctgacttcccacaacaaatacgtccaactaatatattctgattatttacacttagttgaatctcaaattagagtacatcatgcttaactgtcactcatatttgtacatttttaaagtttggagcatctgcactgtgctaagaatattcctgatttctggtagatttcatactgctttttcaatgttctaacaactcctaattatgagaagattaataaaaaaaaatctatggctgtctgtgggtgttatctaattccaagccctagtcagagcaaatatggctattttagtctcattactagaaaagtaaaataaagatcttttgaaaatagatataacacagatctattcctcctaacttatacagtgacaaaaattctgaatgacaaatagacttcctgaaagtagaaggctattttaatatatttatgcacatatgcagctacactttaaatatatataaatctatatacattcattaacaaagatttattgagctcctaaaaatgctgtttgttccagacactatagtaggtattgattatatagggtgaataaaacagataacttccttcttgtgtggagtcagtttctttgctcttgctccttttctcttgttcccttgcatatagtcataagcacacacacgcacgtgcatacacacacacacacacgcacccctcccacaagcctacatgcctatctgcggatatctgtgagtatatatgtacacatataaccccaaagcttggtctacataatatgaattccaaggaaaatttggctagaaaaaaaaactaaactgcatattactaaaagaaacaatggagttagtaaccatgagacattacttctttacatatttaattatttactttaaatctatttttactttggtttgtttcacatggtatttaaagtagactctaccagataaaatgaactcttcatttccattaggacagtaaagcctaagggacagctgagcaatgaatatggctttctgttcagtttagttttgccagaagcacatctgcattgaaacttgcatatgctgagagggaatgactgacactttaaaaactgtgcttctagttacactgcaagtacccataccatttagaatgtctcataatatgctagaaatcatgccaagagatttttaaagcattattctaatctttacaagcatcctatatggcaagatcttcatcttaaagatgagacatgaagtttttataaactcatgatacattgtattaaaaatatgaacttcacaattgagagagcatgcttaagtttaggataatagcaactactttatagtgctttgtaaggagtaaattaaatggcaaacacttggtatatgtttgtaattagggtaggacctaattattaagaccagagcataaacagaaataaaatgtttgatttgtcattcttctcttttataaataccgacgagcattaaaattttaactacaataagtcctcatatgtacatggctttaatacatacatatatatatacacatatatatacacatatatatgcattctatatatatatacacatatatatgcattctatatatatatacacacacatatatatgcattctatatatatatacacacacgtatatatataatatttatagtgttttgtgattattttagtttgcatatccagggccacatacaagatatgcaaaaatatatgtggttcattttaaagaatgtataaacatatgcagatcattctgaaatatatataggcattaaattaatatacactaaaattcactcttattcttactgcatttaaaatcttaagagttaatactattgctctgtgttttgaaaatgcttgacttactgggaaaccagtcattgaatatgtggatttagaaactgcataattataaattttctccagagtggtcctcactcacaggtggtaaccttaaaaagcttataatgtgtccttttctaataaacaatgtaacaattaaatgctttttcttatctctcagggtacaaatccaattatgcttacttcttcctgattgtactttgtatcagccattaaatatacaaaagaaatctaagacgtaaagtaactcactgcctctaatgtgcccctccattagcatgacctttttctcagtgcttaagaataaaaccagaactggccgggcgcggtggctcacgcctgtaatcccagcactttgggaggccgaggtcaggagatcgagaccacggtgaaaccccgtctctactaaaaatacaaaaaattagccgggcgcagtggcgggcgcctgtagtcccagctactcgggaggctgaggcaggagaatggcgtgaacccggaaggcggagcttgcagtgagcggagatcgcgccacagcactcccgcctgggcgacagaacgagactccgtctcaaaaagaaaaagaataaaaccagaacttcatttaattctaaacttcaacaagagtgaggtgctgcagtttaatattaaaaaaaaaaaaaagactggacacatgcaggaattgtggctaggcctctatctttaatgtgctcacatgtaaagtaaatagtgagggttgagaatagagattttaaaaaaagaatgtaatatttaaggtcattatgaagcacatgattttatgtttatgtgttaacagtcccagaactacattgctgaaagggtacattgagggttgtaaaatctgttcctacaacccaataccaattcagacctaaagatgatttttccatttgtctttacaaccaattccaaacttaaagtcactagtctccaaggttttccgtgagctgaaacttcttagccttttcaactttattttctaccagtttctcaaagtgctttcagcttgttcattccactttgtaaattaggtttcatgaaatctttcccaccttttcatttctcctgccactaccctagcttagatcttcattttttaaaacctggtccattataataatatcacaattatcatcctggctgtagtctcacacccatctttacattgcctctacaattacctctttgaacaaacaaatcggttcatgtcattttctgaggtggaattgggggtgtttcctatagttcctggtcatctgttggataatatccaaatgcttactgggtcttggattatttcattccaacattatttctccagccatatcttctgctaaaacacaatgacacagtcaagtctgaagttccccggatgtgcaattgattctcatatttctattttttcatagtaattgtctcagcctataatactgttccccctgcctttacctggccagctacttcccatccattccccactgtgccatactgcaggagaaattaggggtaagccatagctattcatcttgagaaacttaattttaattcagctcatccattttttagctttgtaactatggacagtttacttaatctatcaaaatcttattccccttatcaataaaataaaaatacttatctctaatttgcagggtagttgcaaatattaagtgggataatataagtttagcacccggcatatggtattcttcttttaatcatgttccatcctactttattttccatattgcatacaatatgatgtctctagaatgcaaaactaatcatatcatttctttgcttcaagtccttcaatgcattcctatttctacagcctacaagtctccccttgttatccaatacagccttatttctcaccaccgcccttcttcaatgctttgttccaggcagttgaaatgcttcaagttcctcaactgtaccaaattttccctcacctctgggccttagtatgctaaggtgtgccttagtatatacattgttccctcttccatgaacaccattttctatcatgcctctctttacacgtatcctgtatgaaccattatcacatttacctttccgcttgattttattgctcttcccctcactattaggattgggatttatgtcagtcttggtcacggtgactctttagtgccctacatagcttttatttgcaaatctctatctactttaagcctacccttactataagaaaaagtttaagtctcacctggacctctgcattggactctcctctttctactgtctaggtgctttcaccaactgagtcacaacacagtatctctctgtgataaaatagcaatatgagtttcaagaatggggagatcaaggagcaatagtcaagggaggcatcttaaaggataaaaaaaaaaaaaaaaccctcacgtcgacattaaagaatgtatagaatcaaggaaagtagtgaggaatttccagccacagctaataatataatggatcacgttccttttattcattcagtgaatctttagtaagcacttactttgggcaagaagactatgttagcagcctattacacactaaggttggtaaatggataggctttattgagcagaggttataagcaggaattcatattgaatagattttggtggaacctaattacaaatggccgcaatcccatcagacattggtgtagtcatactccaaacactggggtgcctccttgacctttgtgacgctttactcattttctcaggtattgtctagacagtcccctattaggcttctaattccataaggattgagatttttcttgtctgttttattcactaataaatcttcacttcgactgtaatcaagcacaggacacacaattaataagtatacgctaggcaccgtgctaagcctatgtaccatactgcataaaaatgtattagtttatatgtctcttctgtactacacgagggttggcaaccattttctgtaaaggccagttagtaaatatttctggttttgtgagccagataacctctatcacaattaccctactctacccttgaagcatgacaacaatcacagataatatgtaaatgatacaaattactgtgtttcaataaaactttgtttacaaaaacaaatggcaagctagatttggcctatggactgtagcttgcagacctctgttctagattatactccttgagggaagaatattacttgttttacattgcagtattttacccaaagcctggtccataacagtgctcaatagtaaaagctctaagtttttattctgtaccagtcattcttttaaataattgacacgtaatagcatatttaatcttcataacaaacctatgcagctgactttattgtcctcatttacagatgagaagactttggccaagatagattaagtaactggcccaagattacatggccagcaagtggcagagctggaaacctcagagttggacctcagaatttgtgctcttaatcatattttatagcctcacaataaattagaataaattaaccgttccaagcagaggattttagacttcatgcaacatgacagtacttctcaaagttgttcagggaataaaacactcagagaactcttattaatatgtttaatttcatcaaccagattcagcaaaatcaccaacagaaaacaagactatgatacatgtggacaaaaagaatcacagatataaatatcctgtgctttctcaataaatgatgctgccttactgaacttgattgtctctggaatttgtaaatattttctacttctgtatttgtttggtcatcttccagcactctactagctcatagagataacagatgccaaatattcttaaaatactgatgaggaaataacttacaaatgggtacattatatccattaatttatttttggtttgacaattggtaaaagacatattatttgacctttgtggaagtacacattggaacaacacctgaaattaaattctgaggttccaaaacagcacaatattagaaggcttagcagataatgggaagcactgcatgtttccagcagaataagggccggcaaggaaagccctgactacccagccaggtatcatcagcctgtggtttatgatttcagatatctctaaatcccgcctgtctccatttatcagcatagttcttcctgttctaactgataaataattttacaatcccagacacttaagttgaggtctctttaactctggcaataactcaagcaaagcaaaaagctgaacaatatttctaaaaatcaacattgggggaatgtttgtatgaaagctcaaagagagaagcaataccaaattaaaaagaaagaaaagaagaaggaagcccatacttggagacgatctatcctaaacattacattggtattgtcagcctgtttacatttagtatgtgtaaattattcacagtcctgccacaagagaagtaaacagttcagatttgaaccaggtcatatttgagcctaagtcggctacatatgaatacccattatcatttccctacaacacagtaggtcttggccaagatcacatgctaagcctaggtcataatcttgcatctgtcttcaacttcctaggatataatttggcttttctgcctgtgtttttagttctttatttgtaaaatgagaatagtagccttggccctctgctccggaaggcactacatacatttgaaaggaagaaatgtaactcagagaatcacaaaacctcagcctaaaagttaaattatagaacaatttctccaaccaatagattaaaaaatgagggttagataggttatgtgactcaccctaggtcacagaaaacatgctaccatgtgaagtatatgattctaaaataattaaacttcagaagagttggtttatttccctgcaagtttaaaagacagtagtcttcagagaggtaaatctataaaatcagttgcattttcaagtcagtggctcaaggaaataagaaatattttcatatatctttgtagtgaagttcatatattaattgtgctttcaaatgcattgtaattcaacattagttgaatgtctattttgtgccaaaactgtcctaagaactatgaattaactaattttacccttacaacaaccttaggggagagatacaactatgattttcatttgacagatgatgaacttaaagataaaatggttaagtacctgcccaagatcacatgggacaggactcaaacctagacttgctggctccagaatctgtcctcttatccattacactatattacctcaatactataacacactgtctcagtatattttgctgtatcattacatgattgttatttatcacttcatggttataaattgctttcattttcttacctcattaattttattagcatctatttataatttagtccacattatatgtgatatttaaagataaagtagggttttagaaaacaaaagaacactttaatggttcagccttcagtaatttatatagggccacctcacatatctttactctgagtgtattctctctgcctagaaggcagaggccagttcttttgaggcctaactcaaatgccacctcctctttgaagttttcctcaccctctcaggcaaaatgggttactccctcctctgtactctcgaagtgttttatccatttattacattgagttgtttacaaatacatctgcctgcatcagaagagtcccttgcatctagcaccaggactggcagaaaattggcgttctctacctcagtgagtgaatgtgtatatttttcaaaaaaagagagcaaagattagcaattaagactcacgtgtatcatctctcaccattgtcatggtatgattgctgtgtctgtgcaattctggaaagccacatgctaacaaaagataccatattcattggtttggtgccttagtttcctaagtggaggcataaattggaacaatacacttgtgcataaggagactgagggtattaagctttgaaatgagacagatcagtgtttgagtcccatttggctacctagtagatgtctgatggtgggatactaataccatccttatttctggggtgttataaaaataaatgaaaaaaaggtagaatttgtttaatattatgtttgaagcatagaatgcacccaatatgttagtagttattaatattaggactgttctttggaaagattgtgcatttggtacatgccatatccttcttactggccctttattcatatatatttcctgccccaccctggcaaattccagttctctattcccaagcccaagttttttagccaaaggaccaaattctacggagaaagagtagttggaaagtcctcaaattacgttctattggaaagcatttctattgcttacatggaagaccagctctgtgattatgtaacagcatttgctgactgtagcatcccatatgaacccacagtatttatttagctccttggtcaaaaactctttcttggaacatagggcttccaaatttgcctctgggttgtttgtgcttggctccagtaaaaggctaagtaaacattaagctaataagctgtgatctttcaatcaccattatttccagtccccaaagttagctcagtatacagccagaaagacacagacgtgtcttaggggaagtaggaattccacatcaataaaacaccagagtcatatgacagagtaaactctggtgggagtactcttttgggagttctgctcgctgtccaatccaagcatcattaaatggccctgccttgcctacagaatttcagtggccaatatttaggtctctataaaataaaatattcttaactacagaaacatactacttgccagctacaaaccctgacaattcctaaaagacatctatgttctctataactgaccacagacccaagcttcaagcactggtctccaaaagaactttgcctgacaataaacataggttgaatttcagtttgaccataacacacttcttagacttgattttaatatttggcatctgggtcctttggacagcgctacaggtaggcacctgcttatacgtggcttttgctgctgaggctggctcattagagacgcttcccaccagagacaaaattatatatagcctgactttgctttaatgctcaggaacttctgcttcacaaatgcaaatgatggattctaaatgaatcaagggtccatttctatttctaggatttccatgggcttggaggcttcacacggaatcttaatggtgattgcttttgggtaatatttccattcagacatctaaaaatgctatataacattaaaattctccacagaatgattcaaggcaatgaatgtataataattacttaatgctcaactctatgatgaatgttctaggggctcaggaggtttacagcaggaaaatataaaacagagccccttccttgttttaattgggtgaaagggcatgcatctacagtacttggcaaacaccttctagagtatttacacttgtttgtaattacgcctttgtatctgcttcttcaagagtgctatgacttattggatacaagacctcagtcttttacttctgcagatccctaaagcttagcacagtgcctactaccatgttagtttcttaaaaaaataaaataattgtaatatctgtagtaaggtggtgtaaataagaggtaaacataatatatcacattgatgttcagaggaggaagattataatattaatcacttatttaattgcgactataatgttaattagtcacaaaggatcacagaaaaggtgaacttgatttacttgtgaaagaaaaggtcaaccttgtgtatatagaaagatatgagttggatgttctcttgggcgtgggagaactacaggacaaaagaaaaggtagaaatgtatatagacaatgaggaaaaaaaaactggttaagtaaaggcttagaaattagtgactttaaagattggttctgtgggagtggtaattctgaaatattttcaaggggaaagaataagaattagcatataataaatatctactatgttccaggtctttgcaaggtattttgcacataccatctcattttaaagaaaaatattattgtacatacttaacagatgaagacactaaacttagagaaaatagcttgtctaaggacatggtgagtgagtggcaaagtggggatttgaacctacttctactgaactcatgttctttttattcctcatagtgtcttttattcgcccataaaggtgaaaagtcttccccttgggtcttacactattacgaatcatcctggtatactccaaatcctctatctgccgtaaatgaaataaaggaatatttaatgtcagtttttctcctccacacagaaataaacaattttccctaaattccaactcctcttatatttgaatataattctctcacttatttctataacaaaatgtaaattcttttaacttttttttttttttgagatagagtctggctctgtcacccaggctggagtgcactggcgcaatctcggctcactgcaacctccgcctcctgggttcaagctgttctcctgcctcagcctcccgagtagctgggactacaggcacacaccaccatgcctggctaatttcttttgtatttttaggagagatggggtatcaccgtattgcccaggttggtctcaaactcctgagctcaggcaatccacccgccttggcttcccaattaaaatttctttaaaggacataagctttatttcttcatccattatcttttcttttcactccgagaaaagaagttcttatagtaaatactgatttttgatgatgatgatgatggtgatgatgacaatgacaatagttaaataggacaatgaaaacaatttcaagtttttcattgttcaccaaactttgcacagcccctgatgcataatacactggagctctgggctgataaatacagtcctctaacaagttgaggttcttctcaggtcagatataactagcacattcaatatttataaagcaatgtttcccctgttgagaatctgctctgtagttatatattgaaatgtaaatatattgaaatggaactttgcacaacagtgtggggagtaggctcacgctccatgcttccttaattgactggagatgagtaaagcctttatataggacttcagtggtcttctgcttggttggtgcccatcacgtgatctacacaagctcagaattttcagcatgggtctttgaactgaatgtataattgatagtagaagtgggtaaaaattccaacacagggtatcataccagtgtagctcatgcctgacctaccccactacctccctatgttattatgaaagctatttgtagcaaaaatacatggtgtaaatacaaagcagagtgatcaacccagctcaatgcctgagtctcagcatgcaaccatgatcctacatacaggcccaacctttctcctgtatccaattcatttttaatcctggattttgcttagctattgtccctacctccaagttatatcctaagaattgtatctttgtgtgtgtgtgtgtgtgtgtgtgtgtgtgtgtgtgtgtgtatgtgtatgcatgcactaagatgctttgtaagcacttgtttgttcattagttcattcatccattcaccatcatttatgaaactcctgtcatgtgccaaaaatactgtgaaatgataaggacataaatgttaataaaacaaaactgtaaaatctctaaatatgctcctccacccaagcaactttcacttaaaggcagtttttcaagcactacgcaaatgaatgcataagtataatgacagacaaaactaaaaggtctgtagctgaaactgaagaaaggagtcctgcccatgcccacttcatgcccagtctactttccaatcacatcctcctaaaacacttttgtccaactaatccctccttagccccaccccagccccactcccactgccatctctgctctaacagcccctgccactgacagggtgctataagctttagatggaggaaacaaatgaagagacaaattgagaacaacaagaatttacatttcccacttagattattaaccctcacaatggcaatggcaacggcccaggccccacaatgtgctaagcacatacacggtgctttacaatcatcctctcacacaatccttaactaccatttacagatagcatattattgtcttgatctcatagaaaagaaaactgaaacttcacgagggagagtaacttgctccagattaaacacgtagtagagatagagccagacttgaacccaagctgctggactcttctattgccatgagcaaactaggggtaaagaactctgtgatatagtgaaacactatcggacagattgtgattccaatttctattccaccttttattaggtgggtaaccatataccaattacttagctttcctcaccctcagtttcctaatattaaaaaaataaagatactaaaatatcaaatttatatatttactatgaagatcacctgaaatcttatgtgaggcttattaactgcaggggccttgtcttttcactgatgtgttcatgtccctagcacaatgccaggcatgcatttcaataaatatttgacaagaaataccatactgcttagcccactgcaaggcacacaggatgtgctcactaaatattctctcctctaatccacagaatttcctttacaaaaatatcttagagtcatctgtttcaacactccttatcatatggcaaaagaaatagcagtagtagtgataagttgaaagaatgtgggaaagctagctaaagatacttctatttctttctttaatgctgcgtattcaaagctaagtattctggcagctgataacttatttcccccaaaatgcaaaaagcagaggtaaaaataatgtatttcaactaaaattgccttatcaagttctcatctttaacaaacccataggactatcttgaagtagttagagagactcattatctcttatcccttaccttctaaatattctctatagtaaattgcagtggctcccataataacttgccacaagactctagaagagcattgcaggaccaattctcagcaaaaaaggtcaaatgtctaattacctttcacaactaaataatttcaggatctcataaaatacaactttttgagagcctttaggtaaagtgctgctgacataatgtaccgctgacatacttaaaggatgtgtctatggtaacatatgcctattattggaaacttctaactcccacattaattcttgagcattcagtcacagaatcaaatcggagggaaaaatatctgcactatattgtaatttcagaacaaagacaaacatgaagcattttgcccaaggcctcatcagagagagagctgcaagggaacaaattcctgagaataacccatttgcccactctatagactgcctcctggctgtttcaataaggtatctgcagaggaactctgataccattattcattaactgttccagagacagcctacattattataatcctcttttcatttagattaaaaacacatttatagtgaaaggggaaatgtgaatttttagaaagacaggaggatggctatagttaacagcttaatttcaggatctccttggagatatatattcagatgattcatatgaaggcatgctgcacacatgtctacacttaacacaatttatagcacaaaataagtgctcaataaaaggcattcattgtcatgctcgtgattatcatcatcattacaatctttcctacatctgagttgcttactctgcaggtaacttggcatcagagaatatctgaactgaaagaaaacttaaaactcacctggcacaagtccttgactttacacaggggaaacgggaggatgtctttgtgaaggttacccagtaaagtaatggaaacttttagaactaggacctctgttctcttcatacctctaaggtgcattaattaaaatatatctattttgtaaaatatatttccacttaatgaagctaaccgtattaccagtcaaagctttctggaatcactcttaggaaacatggctataaaaataagaaaaaacattaaggcagcctaacttcattattaatttacgattcaaagaaaagatcagtgtataatatatttgttcattttcccttctctggcatatatcagaaaaaaaacagaaaagtatttgattggaaatcatctttgtgacctctttggtttgcccattaaaatgaaattcatatacaaccttcaggtcaatttccagataatatctgatccttggcatttttactgaatttctgctgctaaggagcattagtaattaggttaactgatttttgaaatttaattctgccactactcataaacaatattaccaccattaaattttaattaataaatacattgacaataatgaaaaagctataatgtagccactaagtccaattccattttcatctattctatgccccaaaatattcatttctaactcttaaatgaaatgaagatcctataatattgtttgctttgctatacatggagaaaataaagtacaagacaacatccctctgccgttaatatgtcagagtttgttttttcattcaatgagcattaaatgaatattaaatgtgcaggcactgatgtaaaaatattcatgcactaagtttattgcacttagtctttacacagtttatgtggggtaagcaaaattacacctattgcagatgtgaaaacagaggcttaggttaatagcagctacaggagcctaccccaggtctttctaattttaaaattaatgtagagatagacatttaaaccaaaaatgaaatataatacaaccaacagtatgatagatatgtgaataaaatacacaagaatacacagaaacacatatacgaagtgtgattaattatcaaatggttagaaaattattttcatatccatgtcctcagctggccaaaataattcataattatctttggaaggaaactttgccgtgtatattttaatattatttatacagtaaattttgagcactctatacattgtataaatagatcataagatatctaaatgtttcataaattgcagtactgcacctactactgtaggacaaactgcaagttttcccagtatgttctgtatcacagcatcttgggaaaatattaagccaaattttatccaacacagcagtaaatgtgttcagtgagacctaaggtcagacttcttgatctcccagtggctgggtttttgtgtgtgtgtgtgtgtgcacggttttaaactttagaaaaaaattatgatatcaaatgttctctttagattgcaccctccacttgggaagaggtgccatcacagaagtaaggacacaatatccttactgaagtgaagaaatacagccttggtgaacaccaaacacaagagactaatatctgaagatagaaactgtgcgggacttaaatgatccaattcagaggcattcaagtgctatggatgaggggtcatcaagactaaaagaatttataaaattaactatttttaatttctccattttgttcatgtgttaacttctatttcttctcagtaatcagcaacaaaaccttaaaaggaaatgggcctacggaaagtgaggagtcagaaaaactgcattccattccacagacagccttgtgaggagatgcatttcaattactagaggtagtctctccagctactaaaggtaaggaaaatatgctaagaatctgagatctgcagtcaaattaaataggagaacacggggagatcggcgcctaaaaaagggcctcttatctaaaatctggaaagaaacataggaagcttcctatactgttatcctctgcctccattaacctggcccaggaaagatacgagtcttctaaataaggcagaactcagtttaaattcactttttaaagtttctgtacatacttccaaactgggataatatatcttcttcgaaggacttggagaaagattagtttgctcattcaatatgtgtttaatgaataaagcacatgtttggtatttattggtgaggcagataataggtgtatgttgtatactatctagtagcaagagtaaaggttactcttctttcatcataattagcttaaagctggaaatggtagtagatctatctatctatctaccatgtatctcgctgtctatctatctatctgtctgtctgtttgtatatctatatcacagtgtgtgcattaccaacataccccagttagtattacagttcacataaaaatgaagccattctgattgcagcaggaactgggccagaacccagtagcttaaccatctttctcacataatatgtttcctgaggcaccacaacagaaccctagaactcataggtccatgattcaaaaccatcacagaaaacaatagttattattcctgagagggaaaaacatgacttgaatagtcctatcaaatgaatagttggaaagtattataaaggaaggattggaagacgaatctactggtggcaagaagaccatctgggaggctctggcatagtcttggcatgtgacgaggaaagacagcattgagaattgaaattgaaagatatttttagaaaggcaactttggtgacagacactatgtatggttaattataattttatcttaaccaaaaattgggatcatacatggtctttccgaagatttatgtgcccatgtataagtgaaggatataaaatcagaaattggaaagaacatcacatttctggcatttctgagactttctacagtacacgggaaaacagaaataattttaaagattctgaaagtatggggcgttggatcatcaaacacatagagataaaagagaagctaaggtttttagtctaagagactggaaatccagtaattaaactgagggaaatagaaaaatagaagcgagaaatggtttgccctccattggtctgggatgcaataactctgaggtgatggctggacctactgagccaaaatgcctataggcaactagaattacacattggtaaaacaaaataaaaacatcattttaaataacttccaaagaaatcaacagattataaaccaactgcttgtaattccagctcaatgtttttaagaaggcaagccatactttcttactgtagtatagaaattacaaaatcttgagccatacttggttttttgaagaatgaggcaactatcgggaacacatctttaaaactttaaaaaacaggaattggaaaggtcatttcataaatgaaatatgctggttgccagtgaaaaattactcactaagaaatggataatccacaagccctagaaaggtcaaaaaggctgccaaggtagccctgatagaagagactacaaaacaaacacaaaatgaatgcaagctgttctttggggcaggggctgacaaatattctcaagcaggatgctcaccaaaagtaattttctcttataccaagagaaatgtggcagatagaaaatgtgttgatgtattgtgatttaatttcaattttgtttcatagaagagatagagaaaaagttggacctttatttcagtattattttttaaactcatgatgtggcaaatgacccctttagtgaatcttacttgaagaacatgatatacctgcagataattaagataaaaaactgaggagtcagatcattttaacttccttctaatgttatatttccatgattggaaaaatcctcaaagcaattctcaaagactgaaaattgcataacctggaaaaatcacacaatgagtacatttttgcaatcattaaacctttgttgtttcagtaaacaacatataaactgatcagctatgttcattttcaatatattttctaagaaaataagcttctaaaaggtcctgttcttcagaataagcaatctgtatttcagtggaataacctagaaaagccaataaatggaaaccatattgttagaaataatcaaagaagcaacttttagacaatcatgttaaagaactaaaaagaagtatatgcaaacatttatatgaatagaagtttataaaactttatttataataaccaaatgtaaatattctaaatgttcaaaaaagggaagcaattaaatagccataagacatccatgtagttaaatacaaagcagtcattaaaatcatttttagaataaaattatatatgacaaaattcataacatctaacatatataatagatttagcacaatgcatattttgtaataaatatttgtgtatatgtacatgtacctgtgtgcactgaagagaatggaggagaatataacagaataataacagaggtaacttctgtgtggggagtggttcttaacttttggggagtcagatgctcccttgagtgcctaatgaaagctgtgaactcttgcaaggtcaatacacctaaaacttacctaaagaataaaagtcattacgtatcccttagagtctgtccatgaactccaatccagaatgagccttttgagggtaatggtattataaaaatttttattttagtttctgtacttctgtatgttaagaacaattatactgaaatgtatgttactttcttatggaaattaaccaaaaatgatttttgaagactatggtagaattttatacatgttaaaatgtttgaaagtaatgttctcagctatttctcagtgcaagtcagcaaattattataacttttgttttatacgtgggaaaattaagggagagggcaattttgtgatttattatggctacccaacatgttagtggcagaactgagattacaacacactccttctaggctctgattagcctatagagttacaataactacaaaatgtcataattttaaatgcaatttaacatttttaaaaacacgttttacccttcatctttagttctttcggaaaaatagttctctgctggagcaagactctaacgtgtgtagagcagtatatatacaataattgcttcagttgaaagcctctctacttaaagcctagaaatcaaaaactcaaaggaaactttattcttcacttgcaaaaaaaaaaaaaaaagtacagaactgtcttccctcctttgttctaatctgaaacaagttagattacccataataccttaataacattttggctcatgaaccaaagttatttaagattccttagggagcaccgtcaagaaacaactggaattcagtggcctttgctgctcagcctctgatgcagtatctaaagtgaccatagtgatgtcacctccagccagggccaggaatgtctggagctagtggctgggagtgctgtgtctgagactgctacttacgtctgcttcctaccactgaatcctggcttatctcctcaccaaaaccacagtggctctcattctcttctctatatcttctagaactttatatgaggaatgcattataagcaaaattccagagaaaaatcttttttggaaaatctccatcaatgataaaagcttccaatctgggactccatgtggggagttccgtttatttttccttgttccccaaagaacacaaaagaaactgtcattttggaaaatatcatttctttttctttgagagactagaaaaataagttgtctctagaggaatatatcttatgtcatgctgaaatctatagttaatcagattcagatgtaccaacaagaaaagacacatgcacatgtttactgcagcagtgttcacaatatcaaagacttggaaccaacccaaatacccatcaatgacagactggataaagaaaatgtggcacacatacaccatggaatactatgcagccataaaaaagatgagttcatgtcctttgcagggacatggatgaaggtggaaaccatcattctcagcaaactaacacaggaacagaaaaccaaacaccgcatgttttcactcgtaagtgggagttgaacgatgagaacgcatggacagagagaagggaacatcacataacggggccttttgtggggtggggggctaggagagggatagtgttgggagaaatacctaatgtagatgatagcttgatgggtgcagcaaaccaccatggcacgtgtatacccatgtaacaaacctgcacgttctgcacatgtatcccagaacttacagtataatttaaaaaaaaggaaaaaagaaatataccttctttccattccctctgaccaatactaagccaaattttaaagtagttgaagacaatctcaccagtttatctttcagaacttcccccatcccatctgaacactgtctctactcctcttccttttctccctaccctaaagactgatacatctacagatgctcaaggattccatctgccattcattcattcagtacatttttattgggtgtccctgtcttagtccatttgggctgccataacaaaataccataaaccgcgttgcttataatcaacaaccatttatttcccacagttctggaggctgccaagtctaagatgaagactccagcagatgtgatgactgctgagggctctcttccttataaatggctgtcttcccactgtaacctcacatagcagaagaggtgaaacacccctcaaagcctccatttcctaatagcaaccctttaggggttaggacttcgacatatgaattttggaaggacacaagcattcagatcatagcagcttcctatgtgccaggtactgacattgagaaacacctaatggcttccaccaaaatactcctctttattttcacatttatttttttaactaatgctttaagaaaaatatcctatttagcaaaatattaactatcaatggtggtatattaaccatagcagggaagctttattagaggatagagaatagagaccttcaggctttctggaggagtctaccaactctgccataatctattttcaatacttattgaatatctaagatgcatgagaattgtaattcactagattttaaattacttggggtataaggaagttttccttttagggattaactgtcagagtatctgatgctatggtgatccaagacctgaaagatgaactgatgatgaattgaaagcatcccactgaataacatgagaggtacaaagacggcagtattttaaataaatttaccgttcattcccaatgtttgccacttttacatacaataaacatagcgaaaaaatgtgtcctttgttgactttaaaaggaaaaagaaaatgaaaagcacagaggcaagaaaattttagctatgcttagcaaacagtatgcaatcaagctagacatgtaacgtttctcataaaggagatatagacataaggatgaaaaagtaagatgatgtgttaaaaatctgctctaaaatttatgtaacatttatgaatacattgtgagttatgctgataaaagttgagattagattttacgcacttaagataaaaaaactattctggagaaacgagaattgtagaaacagaagcttatggaagataggagaaaatgagtccttttcctctcaatttcaattgcaggcaaataagattttttacataagaataactgttgagattttaaaatgtcaaatatagatttatttgcagatagagagaaataaaaattagaatgactcctggataacttttttttcaatgtgctaattagtttaaaagggtaattctttgatggtatcaaaagccctacagtcatgttaaatgacctagagaaaacttcaaaatcagcccaatactatatattataatttccactgttaaatttttttctgttgtactgaataaattaaggaagtcaaaaaagcttttggctttgtgataaaatgtaggcgagacactaaaggaagaatgtaggagggaatgtctactagagagaaaataaaatccccaaagaaccaagggagaatttatatttctaaggcactttgcttcttgctgtatagtagctcagacaaacactaaaaataaacctatgtttaagaggaaaaaaaggctttcttgctcagtggtacttacttatgactcagagggggggaaaacataaaattttagatgccacacaacacacacacactgttttaaattcttatcaccctctaatcaatcattttctaaaagacctctttacctgtgcttcttatacaatgaacccttatgttattaagtgaacagaatagagcctcactaaagaccacaagatttatgaggcctcatggtcattgggcttgtgtttccaataggctctgaaggaattgttttacatttgcatacacagtctttcctataaaaaaaaactgagtcttttaatctacttttcccaacactctgattaagttagagatcaagcagttgagctaaaacagcaatacatgctgatgtcagttttgaagggagctggttttgtctattacaagttgtttctaagtttcctttcttgatgaatccttctttgctttgtggtaatttatattaattcaccaaagagctaaaaggactccttgggtgattcaaacaagaaacttttaaagcgaaatggtgcaacttcccaaaccaaaatatgcaaatatggcatctactctcttggttaaacgcttaacactaacagaaggtgctacctgcctcagaagacaacctattgcttttaatgggccgctctgtcaagtgttctcccgaatattaaattaaaagctgacttcctaaaacttcctgctccagatttcttaaatttacatcactcactttccctcatgccatccctcaaacatttaaaaacagctcccctggaccctcttaaatgtttctctcttccagcttgttgagactgcagacttagcaggcagactgcctgggttcaatttttagtcccactgtccattgtattctagctgtgacctttggccaatctaagcctcagttttttgggtttttttttttttcttttttttttgagacagagttttgctctttttgcccaggctggagggcagtggcgcgatctcagctcactgcaatctcctcctcccaggtttaagtgattctcctgcctcagcttccctggtagctgggattacaggtgcatcccaccacacccacctaattttttgtatttttagtagagacggggtttcgccatgttggccaggctggtctcgaactcctaacctcaggtgatctgcctgcctcagcctcccaaagtgctgggattacaggtgtgagccaccacgcctggcctaagcctcagttttaaatttttaatcatagtgacatgagaatatctttttaataatattgtcaggagaactgagaattaaatcagatagtgcaggaggcgtctgtattgtagtaatcatgcagcaaatggcttcttatgttcctcgtgaaatgtaccttctggagccctggccagcaggtatttcgttgtccagatgcactcatgtctgtcaatctctctctcttaattcatggggtcaagaattgaagaagggaaaggtcagcaaaaggtaatccgagttacaatttaaaattaaagtgcattattaatttcattatcactgaggattcacattgatacaaaatgatttgaggaaaatgtcttatacttctttgcatttctagcttagattatgaaaaaatagttatcaataaatgggatcagaaaacttttctaaaaagggctggatagtaaatattctaggctttgcaagctatatggtctccattgccaatactcaactctgctattgtagtacaaagtggccatacataataggtaaatggattcttagggttgtattccatgaatacttaatttatagatactgaaatttgaattatgtataattttcatgtgtcatgaaatatcctattttgtgttttttcccaaccatttaaaccataaaagccattcttagcttgcagatttatagaagttcagcaagctgtatttggcccactagccaccatttatttacttatttaagatgaaagtagatagtcccatttatcatctgcattaaactagagaaattatacagatactgttctcccaaacagaccaaaggaagtaggagagggaaagccaagggtgcaggttggtccaaggcaggacttgactagacagttagaaatgaaaaatttccttgaaagggagaagaaaatgtgattcacacaagattatccttgtataggtgttccttttctgttctgcttcatttgtttgcttcagttgttgatcttttccagaggtgaaattgcttctttgccatcaaacttactggcatatggtggtattaacagttaagaattgggaaactagaatcttcaagccttttgaatcccagttcagccagttactattaatgtgatcttaggtaatttagttaactttctaaatgtcctcacctgtagaatggccataattatagagcctaccactgggttgcaaaataaataattaagataaaacatctggaatggttagcatactgtaagtcctacagtgaggccttcagaagtgttaactgtgtgaagggaataaatggaagagaaaactttgcatgaacaagacacgtcttcagttgattttattgttaaggaatccagaattatgtcttcaaagagtgctactgcatctctaccccactgtgtctagttcttcaagtgcattaaatagcagtatgtgagaacttgttagaaatacactctccagtcccatcccagatttagtgaatcagaaactatggggttaggacccaggaatttgtattttagcaagccccccagataactgtgatgcatgctagagtttgagaatcaaaggtctatgtgaaatttggttaaaataaacaagggcaaccttgaagttataaataggtatagacttcttgataaataaaatgatttaatttgatctccaaaaacctagtgtgagaggtgtgtcagatattattctcagattttatacaaggacattgtaactcaataagagtcagtgatttttgcaggtgtcatagtaagtagccaagtctcacattctacttctgggcactttcaactttacttgatgttaacagtgagaatgggtaaggaggaggggtggggatgaatagggattactgttacaggggtatcaacctaaatgccttaagtggcagactactatttatctatccattatccattttcccttcttctttactaagagaatctaaatttggttcacaaaagcaatgggctcagctaataatatacactttcaagattcctttgcataggtggggtgatgatgctataagttctaagcagtgagataaaaatggaagtcatagtatcagccttctttgaaagttccttcaaaaaagaatggggaaaacttagccgatacatatcttttgcattttccttttactttttaacctggcactggaatgcaatgcccagtacttcaagacacattttgtgatcatgagaaatacaacaaagtgataagcttagcagaattagaaatattcaaggagaatgagttacaatgacatttttgagttgccacatctgccccaaactgtcttatgtgaggggaaaaaatcaatttacttaagccactatttattcagaatttttttgttattcatcaacacaatcttaactgctactccctattaagaagaggggataattgacttcccagacattttcaaaccaaaataaagttactctgaaaatatacaaagtttctgggcttgggacaaattcaaactgtcttcctctcctggtcctccagcttctgcatctggttgatctgcacctcactccccagatttcgttgttttccgccagtcttcatgtttagcacttccattctctcatcttattcttcagctctaccaaactacttggaatctccattctctccacctaaaatgtcatccctttcattcctcactttcttggcaccttgcaaactctttcttattcttcaagagtcagctcaaatatcctgtctccaacaaagctttctgtgactacatctggctgacttagccacatctttctctatcctccctccttgaatgtggctctattataagaatggtgacattatatggcattatgtcttatgactcctttctacactttaaacttgctgaagactggaatttttttgtgtgtatcttcaaaacttaatatattacatggtatacaatgggaagttgatacatgttttctgcaagaataaacagattggggatagatgcaaagagatagtaaagttatttaataccaattgaactaattaaacagttgccagggggtatgctgtacccacgactgtaagactgagtatatcagctctagaaagatgactactaggtcacacataacagagaacctatgtacttgtgataataaatcatattccttgggtggtttcatctatggccttttatagtatatgtgtatatataattagatacataatgcaagaaatatatttaatatttttaaattttcttatcttccttttatcaagtgccagagtaaatgagtggtttcctccagccaaagtcaagggtttctagacttctatttattattttaaagttgttttatgtatttgcttcctttacaataaaaatacactataggaaatatgctggtatgttgccagctgacaaatttattgagctactcctgaccttttaagatacaattttacttatttttagacaggtgcctcaaagacttaaaacacaaatgcattatgaattctactactaacagcaatactcttacaatttttctatattttaatcgattctaaggtctaagtctgaacctctgtaaataaggaaagaaatctgtgctttggaacacatatctcctgttttacattcattagtatttgggttttccatccagtctataagaattccaagaagtgaaactacccaattcctctacaaaccggttacaatgtagctatatagaatatgctattgcttgcttacccatcacctgtgcctctttttttttctgacagaatcgtaattctgttcaagtgtttacttgtctttgaagtaacttaggagaagttgatcccagtcactccaaggggtgtatgctgattagtctgcctattgacacatggcattcccctagtaacaatggctgatctgagaatgggcagatctaagaagggttcaatccttctgaaggaatggctctagttctaactctttctctttctatctctttttctctctcccactctatgtgagtaggcaacatcttgcctgaattactacaggcagtttttataagaacatgcagaatcaaagagacggcaagtcatccttcatgacccctttgagcttctgactcaactagtgcaggaatccaagctacctgtaggctcttgttgtgagatgaagatttttcttatttttaaagccaatcacttttccattacagaaagcatctaactgatacccttatgccctgaccccttagaaattctgatattcattaactcatgttcatctagaccttttgttctaagtgatgaaaaactaaaataaatagaaaaaccaaacgctacccttttctcatgcacatatggataggagtctgtaaaatagcatcaattgtgtccttaagtgtttatagatcacaatcagtgacccacttctcctcatttcctatattttcctattaacacaggttttgtaaaggctatgccttaatgcatatatttaacagggaattcctgataaatattttgtacctggggggtgccatgatggagatttgtatcatttactctgtcaagtatcattaagagtttaatctcatcttaaatttcaatgtctgaaggccaagacccatttgaatactcttccataggtactggagaattatgaagtaactgttcatccaaaccttgagtctggccttgaggagagaagaaatttatctgtattctttttattctaaactttgagttggtaaaaattcccaagatatttagatgtctaaatgtcttgaaggggaaggggaaaatattgtttatatttgttaaggtacactgaaaatgtacttcaaaattgcctacttcctaaaggacttccagagaaatcatttagaaagatttccagagaaaactccgtcagaaagctaaaggagttttctagtcaaagaaacactgaaggagacgtttaaaaactaggcttttcatccccatcaagctaccaatgactttcttcacagaattggaaaaaactattttaaagttcatatggaaccaaaaaagagcccgcattgccaagacaatcctaagccaaaagaacaaagccggaggcatcacgctacctgacttcaaactatactacaaggctacagtaaccaaaacagcatggtactggtaccaaaacagagacatagaccaatggaacagaacagagccctcagaaatggaacacaacagagccctctacaaccatctgatctttgacaaacctgacaaaaacaagaaatggggaaaggattccctatttaataaatggtgctgggaaaactggctagccatatgtagaaagctgaaactggatcccttccttacacgttatacaaaaattaattcaagatggattaaagatttaaatttagacctaaaaccataaaaaccctagaagaaaacctaggcaatacctttcaggacacaggcatgggcaaggacgtcatgtctaaaacaccaaaagcaatggcaacaaaagccaaaattgacaaatgggatctaattaaactaaagagcgtctgcacagcaaaagaaactaccatcagagtgaacaggcaacctacagaatgggggaaaatttttgcaatctactcatctgacaaagggctaatatccagaatctaccaagaacccaaacaaatttacaagaaaaaaacaaccccatcaacaagtgggcaaagatatgaacagacacttctcaaaataagacatttatgcagccaacagacacatgaaaaaatgctcatcatcactgggtatcagagaaatgcaaatcaaaaccacagtgagataccatctcacaccagttagaatggccatcattaaaatgtcaggaaacaacaggtgctggagaggatgtagaaaaataggaactagtttacagtcacacacctgtaaactagttcaaccattgtggtaggcagtgtggcaattcctcagggatctggaactagaaataccatttgacccagccatcccattactgggtatatacccaaaggattataagtcatgctgctataaagacacatgcacatgtatgtttattgcagcactattcacaacagcaaagacttggaaccaacccaaatgtccatcaatgatagactggattaagaaaatgtggcacatatacaccatggaatactatgcagccataaaaaaggatgagttcatgttctttgtagggacatggataaagctggaaaccatcattctcagcaaactatcgcaaggacaaaaaccaaacaccgcatgttctcactcataggtgggaactgaacaatgagaacacttggacacaggaaggggaacgtcacacaccagggcctgttgtggggtgggggagggcggagggatagcattatgagatatacctaatattaaatgacaagttaacgggtgcagcacaccaacatggcacatgtatacatatgtaacaaacctgcatgttgtgcacatgtaccctagaacttaaagtataatcattaacaaaaaaatcctccttcaaaaaaaaaacaaaaaaactaggctttgttattgggtgcacatacaagtatgtgtttacttgtgcagccttcagagatcctcattcccaatccctgcctatgtttccctatctagcaatgcctcttggcatacagacatgctttattatttaggaaccagaaacctgctattaatggcctataaggttttcaagggtttcaaaaatttttggaaaccttagtatcattttcaaaatgcaaaaagatacacttaaaattggaaaactctaaatatttaactaaatagctataaagcataccatcgtgtcaagtagtcagttgtaatacttaaagccaaaatgaataatgtattcctaaaaattaagaaagttattaaaattatttctaattttacttaacagaagtacctctcatatggagtattaatacaataagatgtaggctagaacctgcaaaaataagtctctatcacctacccagcatttaaaatggtcctggtggcagttctcaccaagaataaggcctatcttctactcttaaaacttttagtaactcttgcctgtatgagggtactttctgaagcttaaaacattggaacattcctccccctatacaggccaatcaacactgtatcctaaaaaggctcatcactgccattcacttacccagaataagaaagctttcatcacatcagataagacccttcatgtccccctggaactaggaccttcctagatgcccagaacccaataagaaaccccaaacagggttcttgatacctttcagccaattccagcaccaaaacattataggtaaaagttagaatacctaaggttagtagcttctgaccatgattatcaactttcttttaaccacagtgagccccaagtttctggagataaaagcatccaaatttctttacaacttggcccttgattacctatccagctatgtttcctatgattccgtgtgtattaatttttattctagttatttgcatataatgccttgaagtgctcatgtcacttggtgtgttcctcactttggtacatagctatctctgactctcctggcttggcctgttgagctttcccagagctggttatattggggcatatgcctttcttttgtgctctcatagactctgggcatagctctatcacagcgttcaccacacagttttataagggtctcttcttctggcttatgagcttttaaagagcatagcctcggtctaatgcatctatattactggtatttaataaagtgcctggatatatgcatttaaaatatattggttgaattagtgagtcatggactctatatgctctattaaattattatgaaaatgaactaaactaagaactttgaaaaatataatttttctctagaataaatatattttgagaaaaaatcaatataagttctattactatctgtgcagaaagaaatagcatttatatagcataactgagaaacctttcataagacctggcactcatttccttgaggctgagagttatgaggaagggtcgtgaccgtaggccaaatccaaataatactgaggggctataggaagcagtgttgagtaactctaagcagatctggcactgtaactgtgtatgtctgacagctgctgcaccaaacccagctcagaagagcccattcttgtgttttgagctctgattggaggtctataggctcccatttcccaagttatgtgggatgactcatttttttctgttttgcttataaaacaatagacagcattcctaaagtcgagaaatacttccataaatgaaaacttattaagaagcccaatatagcaccattttaacatgtataagcctttctacctaaaaaaaataaataaataaaagatgctctcatgactattacatcctcacccagttactgccctgcctctctcctccctttcacagccaaaactttgaaatggttgtcaatattcactgtttctacttcctcacctcccactcatctttcactccattcaggcatctaccccctcactccacgcaaagagctctcattaagtttaccagtggctttcctgtcacaaaatccaatgaaaggtttagtcctcattttacctctcctttcagcaccattttataacaactccttttctttttggcaataagaaactccttttcttttggcaatactttctacatttttaccctttaccttccacagtatcatgctttcttggctttaatcctatttctctggctgctaaagtctctctactttgtaggctcttccgcctgtagccacctatttagtccaccaagctcttcttactctatatttgctctactaacaatttcataaatctatataattctaatagctacctcaaattacttcaaacatagtccccttctctgagtacccaactgcctgtgtaacatctctacttagctatcttaaaggtacatcacatacatcatgcctaatactaaactcatgatccatcctttccacccagaacctgacattcctctaaagtctcttacaaagcggatgatatctctatccatcagtgtataaaccaaaaacctatgagtcatttttcacatgttctcctccttaaaaccccatgccccatacatcaacagtttatatatattttcttatattcttaagttaatcagtattctccatctcctcattgattgtcccaactaccttttagtacaaactaccacctataactcatgtgaaccaccccagtagccttgttgttagatctgttatccaacctggaaacacagccagaaaatatatttttatgatactactctgggtagatgcaaaaatccttaaacaaaatatcctcaaatagaattaagcaatatataaaaataattatataccaagatgaagtgaggtttattccagaagtgccagactgattcaatattcaaaaaaaaaatcaatatggtacatcatattaccaggctaaagaacaacaaacacatgatcagatcaatttatgcagaaaaaaagtaacaaaattttacacccactcgtgataataattcttgaaaagtaagaatacaggggaacctcttcaatgaagaaatctaaggaaaacctacagataacattatatctgatggtgaaagactgaatggttttcccctaaggttgactacaggcaaggatgtccaccctcatcctttttattcaatataatgccagaagtcttatccagtgcaacaaggctggacagtaatgcaaattaaaagaatacagatcacggatggacagagcagtgtgtggaggcttgcattgtgaacttttgttccaaaatgactgcaggaatacactaggaaagccaagagaacccacaggccctctgaaggaagcggattgctcctgaaggacccaggagacgccccaaatactgtgctggtatccatggctgagagacccacagacggttcacatcacaggactctatgtagacaacccgcattatcagcccagagcctggtagacttgctgggtggctagatccagaagagagatagcaatcactacagttcggctctcaggaagccacatcctaggaaaagggggagagtactaatacatcaaggaaacacctcatgggagaaaaaaaaatctgaacagcagccttgagccctacactgtccctctgacagagcctacctaaattgagaaggaaccaggaaaacaactctggtgatatgaaaaaacaaggttctttaacactccccaaaaaatcacacaagctaaccagccatgaatccataccaagaattgctgatttttctgaaaaagaattcagaaggttagttattaagctaatcagggaggcaccagagaaaggcaaagcctaatttaaggaaattttttaaaaaataatacaagaagtgaaggaagaaatattcagtgaaatagacagcataaagaaaaaacagtcaaaacttcaggaaataatggatgcatttatagaaatgcaaaatgctctggaaagtctcagcaacagaatcgaagaagcagaagaaagaacttcagagctcaaagacaaggtttttgaattaacccaatccaacaaagacaaagaaaaaagaaaattgaacaaagcctccaagaagtctaggattatgttaagtctaggattatgttaaacaaccaaacttaagaataattggcattcctgagtaaaaagagaaatctgaaagtttggaaaatatatttgggggaataattaagtaaaacttccctggccttgctagagacctagacatctaaatacaagaagctcaaagaacacctgggatattcatcccaaaaagatcatcacctaggcacattgccatcaggttatctaaagttaagatgaaggaaagaatcttaagagctgtaaggcaaaaacaccaggtaacccagatttctatgcagaaactctagaagctagaagggattgggactctatattcagcctccttaaataaaacaattatcagccaagaattttgtatccagtgaaactaagtttcataaatgaaggaaacatacagtctttttcagacaaacaaatgctgagagaatttaccactaccaagccagcactacaagaactgctaaaaggagctctaaatcttgaaacaaatcctggaaacacatcaaaacagaacctctttaaagcataaatctcacaggaccaataaaacaaaaatacaattgaaaaaaaaaaaaaccttccaaggtatacaggcaacaaatagcacaatgaatggaatggtacctcgcatcttaatactaacattgaatgtaaatggcctaaatgctccacttaaaagatacagaattgcagaatggataagaattcattctctgctgccttcaagagacacacctaacataaggactcacataaacttaaggtaaagggatggaaaaagacattccatgcaaattgacaccaaaagcgggcaggagtagctagtcctacatcagacaaaacaaaatttaaagcaacagcagttaaaaaagacatagagggacattatataatgataacaggccttgtccaacaggaaaatatcacactcctaaatatatgcagctaacactggagctcccaaatttgtaaaacaattactcatagatcaaagaaatgagatagacagcaacacaacaatattggaggactttactactacaccactagacagatcatcaagacagaaagttaacgaagaaacaatggacttaaactataccctggaacaaattgacttaacatatttacagaacattttacccaataactgcagaatatccattctattcaatggcacatggaactttctctcaggtagaccatatgataggacacaaactgagcctcaataaatttaagaaaattgaaattatatcaagcatggtctcagaccacagtgcgttaaaactggaaattaactaccaaaggaaccctcaaaaccatgcgaatacatggaaattaaataacctgctcccaaatgatcattggatcaaaaatgaaatcaagatggcaattaaaaaattcttcacactgaacaacaatagtgacacaacctatcaaaacttctgggatacagcaaaggtggtgctaagaggaaaattcatagccctaaacgactacatcaaaaagtctgaaagagcacagacagacaatctaaggtcacacctcaagaaaaaaagacaaacatgaacaaaccaaacacaaacccagcagaagaaaggaaataaccaagatccgagcagaactaaatgaaactgaaacaaaattaaagcaaaagataaatgaaacaaaaagcaggttctttgaaaagataaataggcccatcaaggtggctcatgcctgtaatcccagcacttgggaggccaagttgggcggatcacttgaggtcaggatttcaagaccagcctggccaacatgatgaaacccgatctctacaaaaatacaaaaattagcagggcatgatggcgggtgcctgtaaccccagctgctcaggagggtggggcaggagaatcacttgaatccgggacacgaaggctgcagtgtgccacgattgcaccattgcactccagcctgggcaacggagcaagactccgtctcaaaaaaaaaaaaaaaaaaaaaaaaaaagatgaagagaagataactaaaattgatagaccattagcaagattaaccaagaaaagaagagataaaaatcctaataagcccaattacaaatgaaatgagagatattacaactgacaccacagagttacaaaagatcattcaaggcccctacgaacacctttaggcacataaactagaaaacctagagatggataaattcctggaaacatacaaccttcctagcttaaatcgggaagaactagataccctgaacagaaaaacaacaagcagcgagattgaaatggtaatttaaaaaactccaggaccagatggattcacagcagaatcctgacagacaatcaaagaagaattggtaccaaccctattgacactattccacaagatagagaaagaggggatcctctatgaagccagtatcaccctaataccaaaaccaggaaaggacataaccaaaaaagaagactacagaccaatatccctgatgaacatagatgctaaaatccttaacacaatactagctaatcgaatccaacaacacatcaaaaagataatccaccatgatcaagtgggtttcataccagggatccagggatggttacgtccaatgtgatacaccacataaaaagaattaaaaacaaaaatcacatgatcatctcaatagatgcggaaaaagcatttgacaaaattcagcgtatttttataattaaaactctcagcaaaatcagcatacaagggacatatctcagtgtaataaaagccatctatgacaaacccatggccaacataatactgaatggagaaaagttgaaagcatttcctctgagaactagaacaagacaaggatgcctgctctaatcactcctcttcaacacagtactggaagtcctagccagagcaatcagaaaagagaaagaaatacagagcatccaaattagtaaagaggaagtcaaactgttgctgtttgctgatgatatgattatttacttagaaaaccttaaggcctcctccagaaagctcctagaactgataaaagatttcagcaaagtttctggacacaaaattaatttacacatatcagtagcacttctgtacaccaacagcgaccaagtggagaatcaaatcaagaactcaaccccctttacaatagctgcgaaaaattaaaatacttaggaatatacctaaccaaggaggtgaaagacctctagcaagataaactacaaaacactgctgaaagaaatcacagacaacaccaacaaatggaaacacatcccatgctcatgattaggtagaatcaatattgtgaaaatgacaaatgaccatactgtcaaaagtaatctacaaattcaacaaaattaccatcaaaataacatcatcattcctcacagaattagaaaaaaaaatttaaaattaatatggaagcaaaaaagagcctgcatagccaaagcaagactaagcaaaaagaacaaatctggaggcatcacattacctgatttcaaactatactttaaggccatagtcaccaaaacagcatggttctggtataaaaataggcacatagacgaatggaacagaatacagaactcaaaaataaactcaaatacttacaaccaactgatctttgacaaagcaaacaaaaacataaagtggggaaaagacaccctattcaacaaacagtgctgggataattggcaagccacatgtaagagaatgaaactggatcctcatatctcaccttatagaaaaatcaactcaagatggatcaaggacttaaatgtgagacctgaaactataaaaattctcgatgataacattggaaaatcccttctgggcattggcttatgcaaggatttcatgaccaagaacccaaaagcaaatgcaataaaaacaaagataaatagctgggacttaattaaacaaagagtttttgcatggcaaaaggaatggtcagcagagtaaacatataactcacagagtggcagaaaaatcttcacaatctatacatctggcaaaggactaatatccagaatctacaatgaactcaaacaaatgagcaagaaaaaacaaacatgaatagacaattctcaaaagaagatataaaaatggccaagaaacgtaggaaaaaatgctcaacgtcactaatgatcagggaaatgcacaccaaaaacacaatttgataccaccttactcctgcaagaatggccataatcaaaaaataaaaacagatgttggtgtggatgcagtgaacagggaacacttctacacttctagtgggaatgtaaactaacactacactatggagaactaaatgcagaactaccatttgatccagcgatcccactactggctatctacccagaggaaaagaagtcgttatatgaaaaagatacttgcatatgcatatttatagcagcaaaatttgcaattgcaaaaatgtggaaccaatgtatatgcccataaatcaatgagtgcctaaagaaactgatattatatatattacatatatgatggaatgctactcagccataaaaagaaatgaattaatggctttcgcagcaacctggatgagattggagactatttttctaagtgaagtaactcaggaatggaaaaccaaacatcgtatgctcgctcataagtgggacctaagctatgaggatgcaaaggcataagaatgacacaatgaactttgagaactcagtggggaaaggatgggaagggagtgagggataaaagattacaaattgggtgtaatatatacttctcaggtgatgggtgcaccaaaatctcacaaatcaccactacagaacttactcacgtaaccagacatcaccttttccccaacaacctatggaaacaaaaataataataaagaatacagatcagaaagaaagaaagaaaattctccttatttgtagatgacatcaatttctacataggaaaatcctagtgtataaaaactcctagaactaatgagttcggcaaggtcagaggatacaagataaacataaaaaaaattagaactccacatattagcaatgaacatgcagacacaaaaattaaaaatacactatttacaactgctcaaaaaaatgaaatagtataacaaaacatatacaggacttgtattctaaagactacacacacaaatgaaataaataaaagaagttctttttttgagatggagtttcgctcttttgcccaagctggagtggagtggtgtaatctcagctcactgcaacctctgacccccaggttcaagcaattctcctgtctcagcctcctgagtagctgggattataggcatctgccaccacgcccggctaatttttatatttttagtagagatggggtttcaccatgttggccggggtggtctcaaactcttgacctcaggcgatccacccaccttggcctcccaaagtgccgggattacaggcatgagccaccatgactggccataagttctaaataaatggaaaggtataccattccatggattggaaaactcaacatagcacatctccccaaactgataaagatttaatacaattactatcaaaatctcagcaagactttttggctttgtggatacagacaaggttattttttaaattatatggaaaggcaaaggagctagaatatctaaaacaaattgaaaaaagaatgtaggaagactcattctaccctgagttcattcaagatttactacatagctagagtaatcaagactgtgtgatgttggtacagggacagatacatagattaattgaacagaatggaaaccccttatagaaatagacttacatgaataagtataattgatttttgacaaaggtaaaaaacgatccagtgaaggaagcaattcaaagaagaaagataagacttttctacaaatggtgctggagcaattggacatctaaacctagcattaggcaaaaaattcttagacttaaaaccaaaattacaatccataaaaagaaaaattaacaaattagacttcttaaaaactagaaaattttgctccttgaaagacccgattaagaagatgaaagctacaggacaagagtacgaattatatatccaacaaaggacttgtatccacgatatgtgaagaactccacaactcaacagcaatgaaaaagcccaatttaaaaataggccagtgacttcaacaggtattttatcaaaaagagaatgtaatgatgaaatatcagcacataaagacgttcatcatctgctatgctttgaatgtttgtagccctcttaaattcattttgaaacttaatccccagtgcaatgcattaagaggtagggcctttagaggtgattacatcacaaaggcaaagccctcatgaatgagattagtgcccctataaaagggcttaagggagtctgtttggcccctttttgcttttctgccatgcaagaatgcagcaaatcaccataaaacagaaaatgagccttcatcggacaccaaatctgctgataccatgctcttggaattcccagcttcaaaactacgagaaataaatgtgtattatatagacattatccagcctaaagcattttgttatagcagcaggaatggactaagacatcagcccttagagaaatgcaaattaaaaccatgatgagataccaccacatacctattaaaattcataaaataagaagtagcgacagcactaaatgctggaaagaatgcagagaaactagatcacttaacattgctaatgagaatctaaaaagaaaactggaaagttccatgaagaactaaagttttagtttcgctgctgtttctttgacaactaaacatgcaatgaccatacaacccagaaattgcactcctggttatttatcccaggtaaatgaaaacctatattcacacagaaacctgtatatgactactgatagtagatttattctgaatagccagaactagaaacaacccagatgtttttcaatgggtgaatgttaaactacagtatatccacaccatgggatgctactcagcaataaaaaagaatggactatcagtacaatcaacaaattaccagataaatacacagaatgaaaaaatatataccaaaaggttacatgcatgatttaatttatattgcaaatttgaaaaacaaaattacagaaatggggattcgatcggtggttgccagagattaagtataagatgaagaaaagaagaaagtggggatgttgggcatagtggccagtgcctgtaatcccagcaatttgggggactgaggcgggaggatcgcttgagcccaggagtttgagatggcctgggcaaaattgcaaaaccccgtctctacaaacaatataaaaatgagctgagcagggtggcactcgcctcttgtcccagctactcagaaggctgaagtgggaggatcgatttaccccagaaggaggaggttgcagtgagccatgatcacaccactacatttcagcctgggcaacagagtgagacaccttctcaaaaaaaaaaaaaaaaaagaaagaaagaaaggaagaaagaaaaataaagaaaaggaggaggaggaggagaaaaacaagaagagggaacagaggaaagtgggtattgctataaaaggacaacatgactgagatcatttaggtgatgaaaatgttctgtatctttactgtatcactgtcagtatcctggtgctgatattgtactacagttttacatgatgttactattgcgaaaaactgggtggagggtatggcagatcgtcccatattacttcttacaattgcatgtgaatctacaattatttcaaaataatttttaattaaagctgttatatgtatcatctcttcttatgtttggaatctttcaatagctttacattattcttagaataaagacaaaataactaacttgatatgcaaattctttttggtctaaatttatctctccagcctaatatcatacctttctttcccttattcttttgtattccaatcatgaaggcatctaagttttaaatccatttttctttctaccaatggcctttccacatgctgctctctctctctctggagtgtttctttctctccttcattcatccctcctaaccatcacttcatgtagttaagttctcatgttttctgaacttactcatgcgtctttttcttggggaagtcttctctgaaccacaggtctagttaaattacttcaatattttttaaagaattgtatgccttcctccaaagggcttatctaggtaagtaatatgcattggattgtgtggttatttatgtttgtctcctccattagaccataagctccatgaaccaacccttattgacaaatatgttcccagatcctagactgatatcctgtaactgtttaaaaaatatttttaagtaaatatatcagtaaaataagaagttgttatgcttaaagaagatacttaattccttccatccttctctttagcatctcctgaggcaccttatttaaaccatagggctccatggaacacagtttatttgaaaagtggcacttcatcagcatctgttgtttcctgactttttaataatagccattctaactggtgtgagatggtatctcactgcggttttgatttgcatttatctaatgaccagtgatgatgagctttttttcatatgtttgttggccacataaatgtcttcttttgagaagtgtctgttcatatcatttgcccactttttgatggggttgtttttttctttttgtagatttaagttccttgtagattctggatgttagacctttgtcagatgggtagcttgcaaaaattttctcccattctgtaggttgtctgtcattgtggaagacagtgttgcaaatcctcaaggatctagaaccagaaataccatttgactcagcaatcccattactaggtatatacctaaaggattataaatcattccactgtacagacacctgcacacatatatttattgcagcactacatacaatagcaaagacttggaaccaacccaaatgcccatcaatgatagactggataaagcaaatgtggcacatatataccatggaatactatgcaaccataaaaaagaatgagttcacgtcctttgcagggacatggatgaagctggaagctaactaacagaggaacagaaaaccaaataccacacattctcactcataagtgggagctgaacaatgagaacacatggagacagggaggggaacatcacacactggggcctgtcggagggtggggggcaaggagagggagagtgttagaacactacctaatgcatgcaggccttaaaaccgagatgacaggttgataggtgctggggttcaatcaggctggtgggaaaaatattaaagataggtatagtaatagccaaaaactatcttggaaggcctgagagtttgcatagcttcagatttcttggctgaatgcagccagagtgtctttgcaggagcaagaaagattagggtgcaagtgtaaaggaatgtgggaagtttatcttactaacctgtttacttatatgggcttaagactgtcctttgtcctaccgtgggtactttactgcctcgccactgcctcctactgtcggggaggagggtcagcagaagtttattacctgtaaatggtgtttgctttaggcctaggaacctggcctttaatctttacctctaatggtgtttactcacaacttttgttaattagtcttacagaataaatgcgagcctcactagctaatcagggccaagtcccaactgtttacaggactcagcaggaagcctataagcagcttggactgtcagctggactggcagagcagaatatctatcagtgtacgtttattcatccatctccaaatcaggggtctgcaggaacagaccccgcaccagcagctagtgcccccatgaaaggagcgctccctcagacaggtgcagcaaaccaccgtggcacatgtaaacctaggtaacaaacctgcatgttctgcacttgtatcccagaacttaaagtaaaattagaaaaagaaattaaaaaaataatttaaaaaagtgacactttggagtcccatctattgtagtaaaatctgatggtaaaaactgtggctctttctgtcaacatttgggattggtttgggaccaaacaatatgtagtccaggtttagctactcttagccctaatacaaacgtgagcctcagtctctctctccagctctactcatctctactgtttcctcatgtagccactattttaaattttctgaagcaaagtttgtcatttcatcaaaacagaattggtacttcaagtgggatcattcctgtaacaccagaattatggctatatattaaatgtaagggaaaatggtgctacatacaccacatctaaatacactgcatctaaaatttggagagcagccaactagccactgaagttaaggtggttacttctctgtgctgatgacttacactgttcctctagacatggactaccaccgtcaccaccactcttatgtaccagtatatgaaaacatcacactgtataccacaaatgtatacaatttttgtcatttaaaataaatgaaaaagtaaaaacaaacagagcacagggagctttgggggagattatcacagtgttgtgttttggggggagattatcacagagtgttgtgtttagagaagttattgccaattctcactctaggggagagaggagagcattttcatctccccaaagccaaaaagggaggcatccatagaataatttacagataatgggggttattgaagaaacaaccagccttgtgtttcctggaaacaagcttgttgaaattcagaacatagggcctctctcatgatatcactggagacatcattgatgaaaaaattcttaaggaacttaatatgtgtcctctggagtcttggggtgtgtgtaagcacacagatagattcttctcatctggagacttctgaatgcaagaaatctcctaggagacccatgctaagaaatgctgaaagacctgtggtaccatgtatttgagaagaggagtgcaaccttcacttattccagtttgaatagtgctttcaccatttactagctggataatcctagtcaatttatttaaggatgataaactttattttcttcttttataaatagagtaagtaaggccagtatcttacggtaaagatgaaacatgatgacatttgtaaaactactgagtacctggcaataatttgttgatatttttattagtattagggaggatacctctgtgggctctggagttgtatgttagaatcccagctccaccacttactaagatacatgatcttggagaagtcacttcagctctctacccctcagctgttgctctgaggattagtaaatcaattaacagtgctcatcatagctcttataatcttgttaagcattaaagtcagttatgtacatatttgtctctctccacaggattataaactacttaaacacatgccgtggccttgcatgtcttcttgttgccacttcaactccatcacaatcacaactagcaacactttgaaatatatacacttacatataaataagcattcaataaatactgaatgaatttgaatttttaattcttggaacatttgagagattgtcttattcatattatggttagaaataatagagcccaacttaaagtaacttaagcaatttttttttaaaaaaaaagaggaatggattttattggaatattataaattattatggaagcctaggacaggtgggtctctcaaggggctgaagccaggtcctgggaaatcgttagcaatacagactattctccctgcccatctgtcccttttcttttccacagagatacctgcttcattcattctctctgcttagtggcttgcacatgacaggaagaaaataagtttatttttactctaacatttaatctcctttctattgaccagctcagctgactgatcatctcttcgcatcttctatttctgtcaggaggtctgcttgctgttcctttgtggacaattttttttttctttctggtagcctttaagatcttatttatattatgttgacacaaaagtaatcatgacaacataatataaataacttaatactttatgttgtgtattttcattatgatgtacctaagtgtgagtttgtttttatttatttatcttggaatttgtactttttaatccaaagattaaatcatatatttcttccagaaagttctcagccactatctcctccaaaattccactgatttttcctcttttttcctctctcccttatttaaactcaggccactctttttcctgtcatctatgtctcttaacttctcccttatattttatttatcttaatctctcgtagtatatttcaaatgattcaaatctatctttcaattcagatctgtgtactacttaagtcaccagtggtaattcagtaattaagatctgtctactatttaagtcacctgtagaggctatgtttacttgtttatttgtttcagagactgtatttttttgctaggccaaggtggcctacttatctttttataatgtcctatagcagtgacaaatatcattacaaaatccaattttagaaaaatactaatctaatgtggggtagtttttttggcaaaatacattaaatggcactaattacacagtaaatatgaggtaacatgaaatcacaccactatctgatttacagcaacatggacttggttgtacctttcaggatgagcacatttccaaaaaatgagattaccagtgaaatctaattaggaagaaagctttaaaataatactacatcagagcgtcttgcagctgatatgtgacagataggacatgttatttataaagtagttccagccttattcattaaagttaccagcctttcttctttctaaaaaggagcaagaagttaagaaatgccttgaattggtgtctggtcatgcagtagtgctgagaaggggtagtgagagtagtaaaacaaccctggtggggcagaggggttggatgtaaacgtcattaataatcatggtttgcttctaaatacagtagcaatatgacttctgatttgtaatcttaggtaaagtataaattgaaaaggccagtaatagtacactaagattaataaactgcacatcaaaaattacacgagggctctgtttgcagtgaggtttcacaaaacaagttacctgtatttttctttttacatctggcttgcaaagccactcttgcagacatttcaaaaaattctctccattttcagttttgctgaatcctccaggcacacaaaagtgccaacctggattgttatatctctaggcacccatcaagttttaccaactcttgcttcgtcttggtgagatcctgtcttatgtgcccatccttcagaagatgcatcttgttcccaactagaatgctgtacacattggggcagaaacgcttactctctaaggttctttgtcctgggaggttttctaaactccaaagctattgatgaaggaacacctcaatataacattggtgtctgggtaggaaagagtcctcaggtgatcttgaccttcctgcccaactgtgtcccatatagccaaccccatatactttcctttcacttcaatgtcatctatgttgttctcttgtgtttgtccctgtgaagaccatgagcaagcaggtcttgacataggctctttcacaataatcaccagcctctttagcatggcagggacattgtagagagcaccttctgtgtgcccaatattacgctacgtgatgcagcaggcatcattcaccgagttctgtgagacatggtcagcatgatagagaggtttcacaaagtacattaaacttatcagaaaacaggcaatcaggcagaagtccaaatccagttgctgctctaccagtcatgagtttaaagacacctgtgggttggtacagtgaagagtgcaagcacactttaaaatattaaagataattattttaaaattgtttttagataattttattatttctttttcttcgcatatggtacctcatatttgctgcttagtctaatttcttcctatcatattaggttggtgcaaaagtaattgtttttgcaccaacctaatagattgacatatgtattaatagggtttggctctgtttcctcacccaaatctcaccttgaattgtaatccccataatccccaggtgtcaagggcaggaccaggtggaggtaatcggattatggtggcaatttcccccatcctgtcctcatgatagtcttacaagatctgatgatcttataagcatccgacatttcccatttgcattcattctctctcctgctgctctgtgaagaagtaccttccaccatgattctaagtttcctgaggcctccaagacatgcagaactgtgagtcaattaaacttctctcctttataaattaccatcttgggtatttcttcatagcagtgtgagaatggactaatacacatatataatttttatctctgaatgtatctttagaaagaaatatgttctaaggttctgcatttctaagtggtggtatcatggttgttgatggtacacagtaatttggcaccaagaaaatctgagcaggtacgtaaagtatgtccttttataccttccaagacctggaattattagcctgaaattattataattttcatgttgcctcccaagaccataagcggatttttttttgtcttgtgcatagggtccaattccaactgcccaccatgtatggaacttttggcctcaagtatcatgcctatgaggcataaagccccagttcttgggtatataccagacatgctattcctaaaagtagccctgcttcgccttctacttacagtgaggattctctctgttttcaacatttaaggatttcatttttgtcccttttaacttattattacaattatatatatatatatattttatttctaagtgtttggagtgagagtgcagagttcttgcatcagcttagtctaccatttagatcagaatcttggattcactataccttggtcccaattccaaatatcaggaggggagaatgattggctcagattatatctgaccactcttggatgaatcaattatagtggtgcaacattatgtaatagaaacatgtctgttaggggccacctatgtgtgtgaaagggcatcctacattacaaggttgctaggcagatactcctataaatatttaccatagaaatcctaagaaatatttttactcattttttattctctgcttagatttcctcatctaaaaaatcaagatggcaaattttctgcttattacatgttttaaagttgacttgtttaaaaccatcatgttcaaagagagatatatctggccttatataaattttagatatccttcacaaaaatgaaggaaataatcatcacttgacgtatgatttgggttttctgtagacatccatggaataaaaatgagcaataggctcttattcctaccaaatgataagtgaaaatatgaaaataacaatatataaaatatttccgttaataaggttcactgtgggttgtggtttcagttgttgttgtctgtttttgtggtttttaaaagcttcaaagcagcctgagtgattggttaatgaaagaggtggagcctttatattatgaaatgttcgcatcatcaaattgattactggcaggaatagggtttcaatttagcattccagggttcacacaattggatactctcatgtctataaaaagaaaactcttgcctggggctgaaaattagtgtttgcctaagcttaggtaagggggaaataaaccttgcatacatgtagagataaacaaaatgccttaagaaacatggcagatctgcatcctattccaaagaaaattcaagaatttattcacattggcaagttttttgtaaagagtctttacaaaagatcttaaatatatttcagatcttcccttcagctcttattcctgttaactgagcattatgtctcttatctctaacatacccgtgcattcctttaaaattaccaagtggattttgtccgtttaccttcctttctagtgcacttcaaggactatactgttagaaacaagtcagcaatgtatgtcaggtaaagagtgtgtgctcattataagcctgccaataactcatatttgtacagtatttttttccaaaatatgtttgctacattgctcattcgatcttcaagacagcactgtaagagttaaattttataactaggtccagaaaagcttagaggtctttctggtatttaatccactaacgtaattctccaaaaacatatttgccgaatgaatgaagcagtaggaatactgagttggagttttaaggccttatttttttaaatcctagccttccaatttggtagtttggacaatattgggaaagtcagttaatatttctgaatctctgtttcctcatctatacacacaaaacaataatacttgatttacatgtttcttgtatggatttggtgaattagggaatgtgaataccattttttaggatctggcctatactacatgcttaatatgtatttgtggaataactgaacttacatcaaagtgttgcttgagaattgtctgcttcagaattagcttcaggttaatttgaagatttttaactttcttttacgtatttcatcattaaccatatttatatcctagctctgctctcctctgtggggagcaagggcattgcttcaccaatatggctctgagaaggattaaatattttgaagaataaattacacgtgcaattttaatctcatctgagaacacagcctcatcattgttacaaagactatattaagttatgtaatataagtagatgcatttcataacccaactcctctctgctactattagctgtctggaacactgtattgagaatagttccaaggccaatctggtttaatagaaaagaaccccatgcatttttagcaataattacccttaatacaagacagcaagaagaacccttttgccccacccataataccccctcagttatagaaagaactttttttttgagacagtatctcactctggcaccgagactagagggcagtggcatgattaccgcttcctgcagcctcgatctcccacgttcaagttatcctcctacctcagcctcttgagtaactgggaccacaggtgcacactaccatgcccagcttattattattattatttgttgtagagacagggtctcactatgttgcccacactggttttgaacttctgttcaaagaacttttaagagcttgaataaaccacattaacagatatattatcttagagaggtaacccagcaaagaaatgttgagacatgatgagaatgaggtaagcaattgttaggtcttagaagtctttacagaccatgctatggagcttagatacaactctcagatgctggatgtcatcagagagtatgtaaaaatatgagtgacatggatggttttctttcagttatcagtgattcttaagcctgattgacaattagctttaactgaagagcttttaaaaattactgataaatgggaagagcacagaggattttttaaggcagtgaaagtactgcttatgaaactataatgatggacacatgctactacaaatttgtataaactcatcaaatgtataataccaagagtaaaccctaatgtaaactattgactttgggtgataacgatgtgtcaatataggttcattaactacaacaaatgtaccactcaggtgagggatgttaatcatgcatgtgtggggacaaggagtatatgggaaatctctatatcttctgctcaatatggggtatatgggaaatctattttctgctcaatttggctataaacccaaatctcctctaaaaacaacttccctaaaaaataaattctcttaaaaaatgctgatatcctttgccccacctgagaccaagtaatcataagccctgggtgttgcccaagcaacagtgctttattaaggtgattccaatagatagtcagtgttgaaaactactgagcttgatcaatctttgttttaattatatctacttgcttcatcctgggatacacaggtgtgatttttttttctcaaacccccaaatacatgcagtctccttttgagaagctataatttcctacctctaaaaatatcacatcataaaaataatgccctgatttggctagttgctagtctgtgggaaagaaacttgggattgccttaaaaagaaaggtattacaaaaatgtcaatggctacaacagtctcctatttagaagaaatgaggaaccaagcttagccagttgaaagagaaaatggaaacaatgataatgctttaaagatgatatgctagtctagtgtttctcaaagtagggcccttggactatcagaagtctgtggaggtctacaatctctccatgataattgatctttaatttggccttttccttttttatcatcatctaaaagtactggtagaaccatgtgctggtttacctggatgaccaacttttaagtgaatgtggccttgagattttagtgtccacattggtatttgtgtttacaaccagatgggtgccaaatagtactacagtcgacccttgaacaacatggatttgacctgcagaggtccacttacatggggattttgttttaataaaagttacactgagtgtgccgcttctcctgcctcccctttcacctcctctatctcttctgcttggccacctctgagatagcaagaccgaccttccttttcttctcctcagctcaaaacaatgtgaatatgacagggatgaagacctttatgatatattttctctttcttattatagtctcaataataacattttctattctccagcttaatttattgtaagaatatggtatatgatatgtataacttacaaaatattgttaatatagtatttatattattgagaaggcttccagtcaaatactaacaggctgcttaagtttttaaggaatcaagagttatacacaaattttacatggcatgggggattggcatccttaatctccacatttttcaagggtcaagtatattttaattgttctgagctaataaaaaagaacaggggaaggcttaatatgtaatgatccattcaagccaagtgtatgaaagtgtcaagaaccacttgtttgaatacaacgtaaataacacaaaaaatttctgggagaattgaattgttatatggcacacaccgatgacatcccatgcatttcaaaaaaaatattcagaagtagttaataccacatggaaattgcaagaaggtgacataattacaataaaccgttggatatactaaaataatgattttttatttcgattgtatttgattgcagtttttattatatgtaagttgtaaatctcttttggtttaatatttgtataggaactattagcatatggaacttaagtcatttaatcttatgcatacgtaaataatacaaaaataatttaatttaaatgtaggagttctaggagaattatttttctttgttaagggtatattacttcagcttgagaaaaaaatgagaccttcttttgttcaacagatgatttttgccattgataacttctagtcctatagatagatggataattagtatatttagaatgtctatttttttcattatactttaagttctgggatacatatgcagaacatgcaggtttgttacataggtatatatgtgtcatggtggtttgctgcacccatcaacctgtcatctacatttggtttttctcttaatgctatccctccctctaggactcacccctgacaggctctgatgtgtgatgttctccttactgtgtccatgtgttctcattgttcaactcccacttatgagtgagaacatgcggtatttggttttctgttcctgtgttagtttgctgaaaatgatggtttccagcttcatccatgtccctgcaaaggacatgaactcatccttttttatggctgcatactattccatggtctatatgtgccacattttctttatccagtctatcattgatgggcatttgggttggttccaagtctttgctattacgaacactgggcaataaacatacatgtgcacgtgtctttataatagaatgatttataatcctttgggtatatacccagtaatgggattgctgaggcaaatggtatttctggttctccatctttgaagaatcgccaaactgccttccacaacggttgaactaatttacactcccaccaacagcataaaagcattcctatttctccacgtcctctccagcatctgttgtttcctgactttttaatgatcgccattctagctggtgtgagatggtgtctcattgtggttttgatttgcatttctctaatggccagtgatgatgggctttttttcgtatgtttgttggccacatcagtgtattcttctgagaagtgtctgttcatgtcctttgcctacgttttgatgcggttgattttttcttgtaaatttgtttatattatttgtagattctggatattagccctttgtcagatcgatagattgcaaaacttttctcccattctgtagactgcctgttcactctgataatagttttttttaattattttgctatgcagaagctctttagtttaattagatcctatttgtccattttggcttttattgccattgcttgtggtgcttcagtcatgaaatctttgcccatgcctatgtcctgaatggtattgccaaggttttcttctagggtttttatggttttaggtcttaggtttaagtctttgatccatcttgagctaatttttgtataaggtgaaagggagaggtccagttgcagttctctgcatatggctagctagttttcccaacaccatttattaaatagggaatcctttccccattgcttgttttttgtcaggtttgtctaagatcagatggttgtagatgtgtggtgttatttctgaggcctctgttctgttccattggtctatatatctattttggtaccaataacatgctgttttggttactgtagccttgtagtatagtttgaagtcaaatagcgtgatgactgcagctttgttctttttgcttaggattgttttggctatacaggctgttgtttggttccttatgaaatttaaagtagctttttctaattctgtgaagaaagtcggtgatagcttgatggggatagcatcaaatctataaattactttgggcagtatggccattttcacaatactgattcttcctatccatgagcatggaatgtgtttccatttgtttgtgtcctctcttatttccttgagcagtggtatgtagttctccttgaagagctccttcacatcccttgtaagttggattcctaggtatttaattctctttgtagcaattctgaatgggagttcactcatgatttggctctctgtttgtctattattggtgtataggaatgcttgtgatttttgctcattgattttctatccttagactttgcagaagttgcttattggcttaaagagattttagactgaggtgacggggttttctaaatatataatcatgtcatctgcaaacagagacaatttacttcctctcttcctatttgaataccttttatttctgtctcttgcctgattgccctggccagaacttccaatactatgttgaataggagtggtgagagtgggcattccttgtcttgtgccggatttcaaaggaatgcttccagtttttgcccattcagtatgatattggctatgggtctgtcatacatagctattattttgagatacaatccatcaatacctagttcattgagagtttttagcatgaaggactgttgaattttatcgaaggccttttctgcatctattgagataatcatgtggtttttgtcattggttctgtttatgtgatggactacatttattgatttgcttatgttgaaccagccttgcatcccagggatgaagccaacttgatcttggtggataagcttttttatgtgctgctggattcagtttgcccatagtttattgaggatttttgcattgaagttcatcagggatattggcctgaaattttcgttttttgttgttgtgtctctgccaggttttgctatcaggatgatgctgtcctcataaaattagttagagagaagtccttctttttctattgtttggaatagtttcagaaggaatattaccagctcctctttgtacctctggtagaattcagctgtgaatccatctggtcctgggctttttttggttggcaggctattaattactgcctgaatttcagaacttgttattggcctattcagggacacaacttcttcctggttaattttgggaaggtatatgtgtccagcaatttgtccatttcttctacattttctagtttatttgtgtagaggtgtttctagtattctctgatggtagtttgcatttctgtgagatcagtggtgatgtccccattgtcattttttattgtgtcatttatttcttctctcttttcttctttattagtctggctagcggtctatctattatgttgatctttttcaaaaaaaacagttcctggcttcactgatttttttgaagggtttttcttgtctctatctccttcagttctgctctgatcttagtcatttcttgtcttctgctagcttttgagtttgtttacccttgcttctgtagttctttttaattgtgatgttagggtgtcgactttagatctttcctgctttcctctgtgggcatgtagtgctacaaatttccctctaaatatatttctattttcatacaataagtatagaatcttagcaaataatctttaaaccctagaattttaattaaaaagcccatctccataatattttaagtttctttctactttttgagaacttgatttattttcaataattaaagaatttatagttcataaatcattttaggcaatcatatgatgattttattcttatgaaactccgtgaattagaagtcatggttgcaaatatagtttttagggccagattttcctaagtacaaattcctcatgtgctatttatacttgagtgactttgagctaagtacataactctcaaagaaccttacccatatgaagataatattggtacctttgtcaggcaattgtgaagattaccaagataatctatgtgaaatgacctagataaaagagaaaagtatgatatacattaatatcttttctgtgtgtgacttgatcaaaagttttatggatcagagtaagagatatggccgggcgcagtggctcacgcctgtaatcccagcactttgggaagctaaggcgggtggatcacgaggtcaggagatcgagaccatcctggctaacacggtgaaaccccatctctactaaaaaaaaacacaaaaaaaattagccgggcatggtggcaggtgcctgtagtcccagctactcgggaagctgaggcaggagaatggcgtgaatctgggaggcagagattgcagtgagccgtgattggccactgcactccagcctgggtgacagagcaagactccgtctcaaaaaaaaaaaaaaaaaaaaaaaaaagaaaagaaaagaaaaagaaaaagaagaaaagaaagagtaagagaggagaaaactctctggttttctacttgattttatgtaatacaatctcctagttttctcatctgcaatataagattgttagaccaccctcttttgtgacttcactgatcttaatctcctaattcctcaatgaaaggacatgtgattgaaattatgtctaccctaccttacctgaaatccttagggtcagttgtgtttcaaaattcagaaatatttggattttacaaaggttacacattgtgtgtaccaagtattacagaacagtccccagcaggatctggggcagaactccataatcaaatgttttagtatttctaccataaaatatatgaatagtcacactaagcagagaacacgaaaactattatataaatagcattacattattttatgttaggtttctgccatgaaatgagttttgatatcaagagtatataaaacttttcattttatgaaagttttaaattttagggttaaagataagcatttatgcatctgtgtaaactactccatggattgcttccaccactagaagcatgctgtaataaaaatatgatataataaaactcaaaattctggattcagaaaatctaattccatccttgattcttactgtctagctttgtgaaatcaagtaactatatttctctgaatcgtagtttctgtatttgtaaaatcaaagtttgaataagaaattttacagggttccttgtaagattaatagtatatttcttttagggagaagtgaagggggaaaaagaatataaatgtgtttattatcactgaactgtacattttaaaatggtaaagacagtaaattttatatgtatattttaactcaattaaaaagtgcacaaaaattttaagtagtccatttatcttaaatgaatgaaactatggacactattagtttaactatatataacctaactaattcattcaatgcataaatatttattaagtcttactatatgccagcacttttcaaagtcttgtagacactgtgatgagcaattctgctgtcattaaacttatattccagtggaatggagactaacaaaaaaaacccagcagataaacaaataaacaagaacatttcatatactgattgatgctataatgaaatataaaaagaaaataattatagagagtaacatgggacagatatttcaagttcagtggtagaaaatacttctctgtggagcagagatttgagtttgaatcacaaggatgaggttagttccatgaaaatataggggtagagcattccagaaagaaaagatgacaaatacaaaagtcctaaggcgggaaataggcctgtagaactgaaatatagaaattaataagagagttacaggagatgaaactagaggaaaaggtaaggtcaagattgtgttgggttttgcaagccatagtaagaaaggaatgattgaaaccaaccttttgccttaagaatgcttgtataagacctattaatctccagagacctattataaccagcccaaaggaataaagcctctatttgtctcaaggaaatgttaaaatgaaaataaaattcagtgataccaaataaaagttccagtgaaatatcaaatcaagagctataagaaataaaataaatggaatcatttgattgagctgctaaaacaaattgcttccaatggtttctagaacctttgtacagaaacaagccataaataagtttatcagcaacagttttagaataattatctgacagtacatctttaggtattgtaggccaagtgcaaaatcagacaaataagagaaaaagccagacgctatataaactggaaagatatgaattgtaaatatcaaaagatactcctcaaattcatttaatgtagaaactttttttctgttcttaacaacacagaactattaattattgaaacattttattgtatattactaatacttattggatgtatatcaattccagttatacaaacgccaagaagcttattttaaacgcaaaacccatttttaaacggtcagaactccaaagatggtggctattgctatcgatttctataaatgcagcaattagagtttacatagtttaaaagagaaactgacatattaatacatattgcttaccagattctgtcttccttagggccacataaaaagtccctaaaccagcatatgtaaatgcatctatgctttgccatggttcctgaagacatcctttgtacacatgtaggttgcccaagaatcccagcaatttttaaaataaattcaacttaaagtaatcacactatgaacctagccattgttttcaggtgtgtaggcaataagtacaagctggggtacctatagtcaaaaaaattcaacctttggaggaacggagccaaaacatatagtacaaagatcaatgcaatctgaaatatatctgaatacttagaaatgtgattatcagtaaagtgaaatttatactctgctttctatactataatagcaactagtaaaatcatcgtatgcctttgcttgacacaagataatgtctttccctctttaaaggaaaccgtaaaaacattctttccagtctgcatccaataagataaagacactctgatgacacattttaagttctagtaataaaagaatgtgtcagcatccttaccacctaaagaccataaatagcacagtttgttcagtctcctgaaagatgttctcagagttcagacccaattctattaagcactagtcccaacccaatttatatatgattagaagatacacatgtccttggattgtcctctctataaaacgttctagtgggcgggtaaagatagctctaaactgtaccttttcttctagtattatttctgtttctcttccacctgcattgtccaaagggacagtgatttaggttacatgtatgatgaattctctgaagatctaacattgactcaagtggatgctccagaattcatcctagaacttgacctagagatctgttttgcttggtatttcacttatgggcttccttaaagtccaaactcttacaaaataatttaaagttgcattgaaagaaaaaaaagatgctaattgcttttggtttccaccgcaaaacaaaaaccatccactcaccttttattgacaagtggcatattgagaataagagacattttctcaagcagtttgtcttataaagaaattttagaattagaaaacttagttttagaattataaaaagattttacttaccctcagcaggggcactgctggcatttcagacaagaaagagattcattatataaatctgtcccacccatttgaagactgtttatttttcctggaactttttcactaattgccaatatgcctcagtcatgtgacaaacaaaaaattcccaccaacacttacaaacaagccttgagcattttaacacccttgagttgagaaccacaaaaactacttcattctgcaatgaatagacttggaaacaaaatgctttgctagaggatagaaagacagtaaatgccagaattgtgactatttagtgctttttccataataacagacctgcctctgagaaaaacatacagtaaaaatgagacccattttcctcattttctccatggaaagctagttgataacatcatcaaatatttggcgtgggatgatgtaatctatctaagtcattggcactacatagaaatatactgcaaataagaaacaatcttccaaaactgacaaaaatatttgactgcttctagaaacctatttaacacttagtcaagagtgcattgaaaagagcaaaagagtaagtaaatatagataaaaatactttctttgacttcgactgactgtatgaccttaaattacactatttatatactctctccaggcctcagtttctccatatgttaaataacgcagttgagttaaattattcttaatgatttcctctataagaaatttttcacttcatggttttcaaacagatttcacttaatgcagttcaagtttattttatattatgcaaagataggtaagagaattccagtctcttataagactcctccatctatacagttttatcctactatggacagggagtggagttttctgggtaatcaaataagctggcaaacaaaagaatatatcatgtattaccaatagtataatttattccttcagcaaacatttactattgagtatgctttttactattctaggttctagaggcacatatgaattactcattttccctgatttcaaggaaaccatagactggtcaacaagttaggtatataaacagatcattaaaatacaatgtgggccaggtgcagtggctcatgcctgtaatcccagcactttgagagggcgaggcaggcggatcacctgaggttgggagttcgagaccagcctgaccaacataatctatgtgaaatgacctagataaaagagaaaagtatgatatacattaatatcttttctgtgtgtgacttgatcaaaagttttatggatcagagtaagagatatggccgggcgcagtggctcacgcctgtaatcccagcactttgggaagctaaggcgggtggatcacgaggtcaggagatcgagaccatcctggctaacacggtgaaaccccatttctactaaaaatacaaaattcgctgggtgtggtggtacatgcctgtagtcccagctacttgggaggctgaggcaggagaatcgcttgaacctgggaggtagaggttgcagtgagctgagatcgcgccattgcactacagcctaggcaataagagcaaaactctgtctcaagaaaaaaaaaatacaatgtgataggcattataattacaaatataattattatgctaagcaatgaattgtacttaccattacagtggtaatacaaataatgaaaaaaattatttgctgattaaacaaatagataaatcattgcttttggggttactgttatggatataaaatattaaaataccatagaaagaaggatattctgattaatataggactccatttactaaaatatcaaatgagtattttttcccgaccatttttgctaaagtgattttaagaaaatgaatggattttggagtataaaaaacttgatttgaattccagcactgacacttagatgttaggtgacttttagacaaattttatcaccccttagagcctgtgtcatcatttgtaaaattaagagagttgttgtaagcaataaataaggtaatgcatataaagtggcaagttcatagaaggtcttttatcaatattaaatatcttctcattttcagtgtggaaaaatttaatgtcatgtacctgccttcagagatagtatttaatatcaaattgaattttccagaaatggttgcaatactttttgttccacatgctcttgctaacgtttatcatccctattgagatgcagagtctatgaatccttcccttgaaccttttatagcacttgtagtatagtagcctttgtgactgcttgcctcaattaatagagtatggcagaagttatgttatatttctttcaagatagtctcaaaaggagatgtagcttctgtctgactccctctttcctgaaccatgtatctttggatcctcagataacattaagacttctggttgctctgaagtagccatggtggaagaattgcatggagaaaccacacaaagatagagcaaagatgccccagctagaaagataaataacgattttgtgattcttggctaaaaagtacattcaaaaccctaagtgtcctcattgttactaatgtcctaaatcagagcatatgataaaaacaggagaaaacaaattatcagctcctgttctctgatgatttgaaaagtatgagtgcaattgttctaaataataaataacaggcacaagtaaatatctagctcatgaaatcaaaatcttcaaatatagaaggaaagaaatgcccataagagaagataaaatttttgaaaataagttaagttactaagtatattctttataactattttgtcaagttgcatgtaaaattcttttagaaatctagtgaaaaaaatctatcctaatgtgaaatactggcagatgacgttcatgtgagcagcagttagggtttatagcaaaatggttatttttttaaggtgcatgctattatgctatcaaaagcttaaaatattagaatgagtgatttttctttaaaagactttttttggtaagaatacatagtaagtttctttatttgtatgtcatgttagcactttattactaaattaatttgtatatcaaaatctggattctcctcaaaagagaggactccaatatcaagaaatctagattcttacagtaaaacaaacaaggatatcaacaataaaaatagactggtactgtaaattataagcttaagagttaggcttggtttatactatggcttcactcaaatccagctgcatagccttgggcaaactgcttaacttttctgagccttaatttctacttgtgtaaaagcagtgaaataatacatttacccagtgggttgctgtaaagaataagtgcaacaagatatgcaaagttcttatcacaggacatagtacatatttggtgctcaatatgttttagttccttgtaattcttccttatatatgcagtttttaatttaggaaagagtaggtattacttaaggatgacttgctttcatcagaaactataccagtgcactaaacagatggaaagaaaaagcatctttatagcttcaccccttaatatctcacttcaagccctctcctcagctctttactatagagggagggttacatgcatccctttctcctccatatttctggctctgcccatggtaaggtagctatttctacccagcaagtaaaagtacagtattgatttacttcttttctttggttttaaccctccagaagaagagaactggtaagtaaaatgattcatacttcaaagccccacccggacctaacacacatcagctccacatacctcctttggtacaccccaaacctgtattggttctacaaatggtcctttctacctgtccagggtacctgtcttgggcaccttatgcctctggagaaaatcaaattactttaggaattggtaattgcaccagatttatgatctccaagctctgtgagggcctcactactgccgagttatcccgagtctcctatcgccactcttctgtgtctcttagcagattatgcctcttgaagttatcagacagctttcaacttccatactacctatagaactatttatacctgtacttgtattttaagcctcccctcttgactcagaataatggtgtctcttgtgttcattgaaggcagctaagtcaccaagagcactgaaatgaatgcttgccaatttacagaagaagtagatgccaaaattgtgtgcaattgatgtggcttttcaaactgagtatctccctttgtaacatgttttatttggtctttggaaaattcttaatcatatgctgcacatacattcatttgctatgttttaggttaagtttatacttctaaacacactgtctatttgcagtctaaaatttaacacattagtttatgttctagtccaacattttattctttaattataagagacaacctaatgaaaatacatttctttcagtaggagattagccagtgttatttaaaaaaaaaaaaaaaaacttggcaaaacagaaaaaaaagccaactagctttcctagctgtgacaagtttctgtttttaaaaaagtaatcttaaataaactaccagtccttcataactgagtgcattaattacttcaccttaaaatatgtataagatgatgccttaaattcacagggcaaaaagagcaaaagcttgaaaaagatgaaaagaacacaatttacagatattggcaaacacttaaaactccagcctctatgaactttcccaaataaatctataaagctcatcataccgtgcctgttacttagaaagtatatactcagtaaaccgtagctatttatcttctgtgtcaagaattgtttccacaattcgaatcaagtgttatatggaacttcgtgccatgatttcatctcttaataatcttaaattcaaactcttataatactttatggtaacttatctcatagaaattacagaatggaaatcaatgttatctctgattctatgaaatgaactagatttatgaattgggagcagcacaaaaacaacataatgtctactacaaaaaagtcaatatttgaaaactagttttattacaaatgaagtaattttcaaaagtttaaaaacgttaaaatagaaattaaaaaaaaactataggtaaaaacgtcattgtcaaatccccatgttgctcctactgaaattaagtaagggtaatttcatataataatattgtcattgatgttttaataatcaaaactctaacagttgagaaaataaattgtgtatgtttctcttttgcacctatgttattatcagcctcaggtagtaagctttactcaggatagcaatctatcaaaaatgcatgctgaatatttactaaattactatactttttgacctcaatctcctatcttaatggttattcactcctttttcaactcctatcctttaacctcacagtgatatccatcactttaatcttttcattttttcctcagtttactggtcctttatcatcttgttctttagccagcttgaaactaatgactgttcatttgaactattttctcaccaatacctttgatttcttttactgtgattcttcaggtgcaactcttcagcaaaatccaaatcccagataaatactgcatctggtctctctcaactcacacctaggaaatgaagctctgtgggaaaggaactcacacacacactaagagcaatttctatgtagtcagtttccacactcagctacgcactgtcctttaatcaacttcccctctcatttccctcaaaaaacttctcaatcatccccatctgcctccaagtccttagttgcctttagctcctcattttgacaggttagatagccctcagtctcctaataaaattgaggttattaggtgtgttctccctgcacaggtacaccacagccagacccagaaagctaacccacagccacagccatcctcaccctaggccttttcctactctcttctgttctgctctcccatctatagcagaggttggcaaacctgttggtcaaatctggcttgctacatgttgttataaataaattcttatcgaaaacagccatgcccatttgtttatatattttctgcagctgcttcaatgctacaagggcagagttgggtagttgctacagatatcttatggtcctcaaagcctaaaatatttactctctagccctttactggaaaagtgtcctgatctctgatttatatcattgacatcttcctctttcctaaatcttttccttcagcctgtaaatatggtcaactatgttctagtctaaaaatgttagtttaggtgttttggttttttgttttgttttgctcaaactctctccagttgtataccaatttctgtcttgccctcctcataaaacttgtccagggagtatgtcatattctctttctccacttttttttttattcctttcttcctgtaacctgatttttgcccctactactttgttgaaatttgctcctattaaaattaatgatgaccttctctctgtcaaagttaaattttaaatgcctaatcctaaactaattgactcatctttaggcacactccccttaaaactgtaatccaatattcttagcaaagagcacacaacaggatcatttctagaggcttccgcctttatgctatcactaaccggaattactcttaattattacaagttgttgcttcagagataagggattaattttactattccagtatgagaaaagtaatcaagtcaccacaatattgtggtaaatgggagaagaaaagctactggagatatcagtcaatacacaacctccaccctcaccatataggatgcaaacaaacacttgcccttgaagaacacatttgccccaattacccttccttctctctctcctagggtcatcaccgtcatctgttcactagcgaaaactgaccaaaagatgtccaagacacgttggagtgcaaggctttctcagttatctcttaaagtgaagaaaaaaccacataaggaacacggggccttcatttctcttggaaaactgatatccctatggactaatgatataagtgtgtctggaaaatatgtgagatacccttttagagatgcagatgattaatcacaattttaacttcttataatgatgcttggcacaggataagcaaatagaaattaaatgtagaaaccaacaacacatgttcacttatttaatatggaactcccatattcttgaatataaactaccacattaatgagcaaaagtataacaaaattgaaagaacataatcagctttcttttagggtaggaagacagctatttaggattcttcctcacttatcaattaaaagaaccatgaaactaacaaggagacacaaatatgcaaaatcactgataatcgcagtcaacactttatatgtacctggaagggggaaaaaacctttttagttctgttgtggtagggataaattaactgtctctgtctgacatatgttttgaattttaaaactaaataaaatcagttagaaagctaatggaaagatacatatgtcaacttctactctgtatccctatcaaagattcgtgtgatctttgcctctaagtaaagcagcatagcagccacggatctcacatgggaaagttctttcagattagaacagagatatccctttctcatacctctacctcacactctctcatcccacaaaatcttaactttgggagggactttaacatgaatattcatgctctgatggcccaagtaagtacgattaatatgtaaagattgtaatcatacaattaataaggtagatgtaataaacgtgaatgaaaaattttattccatagaaaacatgccttctttttttttttttttgtccaaattcctggcttaataaggacttgtttattttgaggaaaaaaggtctgaaacatcaggctgttcaaaaaataacccacagtatcaactttagaaaacaaatcttaagactataacactttttctagaggatgcatttgacatgccaactctcattcacagaaatacattgtaacatttgtgttgaactgccccacacagcatactaatgtaggggtgtaacacacatacttgtaactcaaagctgctttaaggagccactcaactaaatgagattgcctttgcagttagggaagaaactactgaacttatgtatgaatgaaaagaaatgtactccctgcataacaagagattactttggagacagttgatgaaaaccatacatcctttttattgttaagtcataaagaggtatcaaaattaaaagcaaaaattacagggtaagacttaacaaaactactaggagtgtcaaaggaagtgaaaatgggactaggcgcagaccaatatgaattaatgaacatgggaaggacaaggataggggaacactgagcatgtgctgaagatactaggggagaggatctggtgaaaaatttcaacttagacaagtgcctaggtaaagaaataatgggataagatttcttttttattattattttattatttatttatttttcattatactttaagttctggggtacttgtgcacaatgtgcaggtttgttacatatgtatatatgtgccatgttggtgtgctgcacccactaactcgtcatttacattaggtatttctcctaatgctatacctcccctctccacccaccccacaacaggcccagtgtgtgatgttccccaccctgtgtccaagtgttgtcattgttcaattcccacctatgagtgagaacatgcggtgtttggttttctgtctttgtgacagtttgcagagaatgatggtttccagcttcatccatgtccctacaaaggacatgaactcatcttttttatagctgcatagtactccatggtgtatatgtgccacattgtcttaatccagtctctcattgatggacatttgggttggttccagttctttgctatcgtgaatagtgccgcagtaaacatacgtgtgcatgtgtctttatagcagcatgatttataatcctttggctatatacccagtaatgggatggctgggtcaaatggtatttctacttctagatccttggggaatcgccacgctgtcttccacaatgtttgaactagtttacagccccaccaacagtgtaaaagtgttcctatttctccacatcctctccagcacctgttgtttcctgactttttaatgattgccattctaactggtgtgagatgggatctcattgtgatttggatttgcatttctctgatggccagtaatgatgagcattttttcatgtgttgttggctgcataaatgtcttcttttgagaagtgtctgttcatgtcctttgcccactttttgatggggttgattttttcttgtaaatttgtttaagttctttgtagattctcgatattagccctttgtcagatgggtagactgcaaaaattttctcccattctgtaggtcgcctgttcactctaatggtggtttcttttgctctacagctctttagtttagttagatcccatttgtctattttggcttttgttcccattgcttttggtgttttagtcatgaagtccttgcccatgcctatgtcctgaatggtactgcctagattttcttccaggatttttatggttttaggtctaacatttaagtctttaatccatcttgaatttttatactgatctttgacaaacctgatacaaacaagaaatggggaaaggattccctatttaataaatggtgctgggaaaactggctagccatatgtggaaagctgaaactggataatgggataagatttctaaaccctgctatgtgcttcaaagtcatcctctccttcctcagcctctttttcatcatccttgatcagctccagctggccatcccccaatcttcattgtcatcatccagtaggtccccctcctcagcagagtcatgtgcatccccctcctcagcagggtcatctgcaccgccctcagactccaacttcacattagtctcatctttcttcacggagctgctgctctgctcctcttctgacttattattcatatctactgcttgtttgttctgttccttttcaatttcttccaggtttcccaggagagaatccactttttgttttatcttggtcaactccttcttaattgcctgaagagtcatctgctttcaactttccagacttagaagatccccgctgcccattcttagaattgaagccagctttttcccttcgtgagttgtttcctgatacacactgacgtttcgagggcactacagcccgagcaataggaggaggaggaggaggtacacgtgctgggtgactgtacatcctatcataataatcccactgaaagtcatagtctaagtcgaaagaagagccatacatctgtgctgcagatcgtttcacacctgcttttcctcggttcacttttggcactggagccaggttaatatctaaaacctggtcagcaatcattctgccatcctctcctgctacagcagcccgggcatttctctcattaacatactgaaagaaggcaaagccgttatgaacagaggagtccacaattttgccatacttcgaaaagattgcctccacatcagatttcttgaccacaagagtgttgagattcccagtgaacacacgggagttcatggagcgaggatctgtcttgttggtaacgttgctagccattgtgtttgatgataaggtttctcacacagctgaaaatgtggctgaagatcaaaaaaaatcccataggagtgaggagggagaagagattcgattctgagtctcctactcctgggttctacgtggagaacctgactgctgctcgaggtgggtaatgcagccacaactgctcagtctttttctcttcacaaaaagaaaatttgccttcttttcacacgtcatggaactatacaaaattttatcatttattatgtcacaaaaaattagtatatattaaaatgcaaaactcataaaggcaaaattctctgaacacagtaatttaaagctagaaactaaaactagctttaaactaatgttttggaataaaactaaatacatcctagcctttcaaaaaattgcataaaaaggaaataaaattaaacacttagtcataaaataggaatgtaatatattatatttatgggacactttcaaacatatttagagactaattaatagacttaaggcactatggttatttctaaaagaatgaaaataaggtgagtctatatatcaagatattagaaaaaatgcaatcagaataaaaataaaacagaaagaatgaaacactaaaaagaaaattagaaaattacttagagcacaaaaaactggtaagaaatagaacacttggttcttaaaatagaaaatgaaatcgataaacttctcacagatctaatgaagacaaaaataatatatactttgcgactaaggaaaataatataaccacaaatacaaagaaagtattttaaaatggtaagggaattatatatatgttactctggattacctataaacataaactaggaactataaaacataaggaggatactatgtcacaaaagcaaagaacacggtttggatgcaagctatactgtgtactagttatagataagttactcaactgctttgagccacgttttgtctgtaaaaaaagaatttaaaatatctttaataatagtgttttcagaagtattgcttatgtcattgtcatctttgttgtaattctcttttcttcctcctcattattaatattcactacctttgaggaaaacttgatatgtacccgaacaagttgaaacttaaaagttatttttccaatcaatactttaatccatccataagaaccaggtgcaatgcataccatttaccttattacttattttttccccaaatgcaagtattagcaacattcactgcatctgagaatataaaaccttaatgacatatcctccaagggaaaaaaatcttacccaacttagaagacctgcaaggattgattgcacttaatgaatgtagtgctcttagagttatataactgtcattaaacaaatacataggcatcaaatttaaagaaaaccaagaagcagagctaaacaacatcgatactaaaaaaatgaaaagttaggagtttttttctctcacttatcagtaaacctgaaggcttaatataagcctataagattctaaaaacaagaagggtgctttatttgtattagtccctaaaaatcttagaatgaggtaaaaataaaaaataaaaaacagtaacactggagctctcagatttatgtatgtccttaggctttttcttacagtttcaatgtggattattattgtcagagtaaagtgaaatgggaaagtaaaatgtaaaattcgatttgcaacccctaacattttcttattttagacctaaataacagttattaccaacttaaaatttgtgtaacagaatctatccagggaaagaaaaacaagtcattttggtgcacaattgcaaaatgccaaaaaattaataactttgtctacttatctccttgtattaagattttgacccattttgaattaatataaatatttagagcacaagataatagagattaaataaatacacaaacaaaatagttttctactctcaagaaacacacagaagacttcagcagaaaagaaaaaatcaattataaaactgtgtaatagaagtatattgtacctatatatctatgtactatatctcgataactattctaaataggatatcagagaatattctatataagatatcataggatagagatatatttaaaaatactagtaacttattgagcatcaaaatatagattgctaagtgcttcatttatattatttcatatcctcattaaattcttgcatgttaagaattattatgcccattttacaaacataaaattgaagtttatggagtttagattggtaaacaaataaagccaaaattaaggtacatttttgtagcttcgccactcatacccttttggccaccccactgttttcattaaattaagataatccgagaatttgtcaaatcgtgaggtgacaaaatatgtatatatacactgttctaagattctggatcttaccatgtcttcgtttcttcatctaaaagtggattataattaaactgtccccattaatttcagggggttgatgggaagatcaaatataatatatgagacagttattgaaaagttaaggcatttgtaaaatgagatgcaggattacagtaatgaagctcttcctcagcattagaaactaggccaagcaacccaagaaccaggagctagttacaggatgggaaatgtatctgacgcacattttacttatttaaaatatttaaacatgacaacctttgttaaacaacctcaaggtaaacggcaccaaaactgtgtttttgtatctaattactgctagagtaacaattaaaacacagaccaagtagaaaactgtgtgacttttttcctcagaattcagtcagcaaagactagaaatttgcataaatgcaggcccccaaagcaactttttgcctctgcagcacattcctgaagcccaaaagaaacgaataattgtctcgactcttcattgcatgttgtctatatagccaccatcgtactttaaatgtgcagaaaaaatagtgccagttgttagcagagaaaatcatctaagccatttgtaagcactctgttgtctctgttcctaccataaccctctccatactggcttaagtttcatgaacgtactccccttggaattctgtcctttctgcaaacactttttttccaagttttgttttaggctttcctaacatattttcaggtctctcagttaacataaattcaggtttctcaaaatgtctgcagagggactaaagttattccttccaaggtggaagtgcgttctgtcaaaataaatcaaacatcagtaagtagataaataaggaaagttagaaagtagaatattccattgattggcaaaataatcctcattcagctctattaatttattattttaaaaatcaccaccatatttacgtctgtgcaatattacatgtaattctgtctcaggaggattaggtgcatgcttagttgtgaatgaatgaccatggagaagcatttttaaattaaacgtattctataattgtagataaattttccattgtatctcgcaagaacacagatacatacactcatcataccatgatagcactgcatttatgtatatttgagtacatagggaatgctagcaaatttatttaacacagaggacaataaacaaatttcctcatattgatgcttcaattcagaatgcgcaatactgttgacatctggcctcaggctctgaccagaactgttaccataaagaagtgttgttggagtctgactttcctcgatgaaatgttagacactatagccaagtgcagcttcatatattaatagatgctaatggttgtaatttagaccaaaccactttgatacaatttgggaaatttagttcttctaaacaaatgatacaactttattgaaagacacaaaagatgtcagcatatatcatgttcttgtataggattacttaatataattaaaatgcctatcatcccaatttaatatatacagttaatgaaattttaattagaattgcaaaaaatgttggagaaaatcattctaaaattcactagaagaataacagtctggtaattgcagagatattctgtaaaagttggctaataagaaggttttgtctattcaaatattaaatcttacttaaacactatcttaattaaactagtatggtaaaagagtatatcagtggaacaaagattaaaaatagatttgaatatgtattagaactcagtatatgataaacataacattctactttagagtgcaaaagataatcaataaatgttttagatacacatgattatctatttgttagtacataaagttagagaccctcttgacattatattcaaaataaatttcaagtagcttagtggtctaaatgtacataagacaataaagattttcaaaaaaattttgaagttatttttataaacttgatggtgcagaagatcttctgaaacataatttaaatatcagaagccaaaaagaaataaaatttacatatttgaacataagaaagttaaaattttcaaacaaaaggcagcaaaaaacaagccaaaatacaaacaataaactggaagaaaatatttatcaaagttatagtagccaaaaggttcttaaatatgaagagttctgcaaactaaaaagtaaagaacatattagaaaatggtaatttaaaaaagcaaagaacatgaaaagaaatttggtagtaacggaattgcaaatcccaacctcagttataaggaagatacgtaaattaaaatatgaagactttttcatacaacagcaatactaaaagcatgttaatactatctagtgttctgagaaatgtgtagaaataacaactttcacagaattttgttgggaatatatattgttaaagctttattgaagggcaatctatgaaatattttaatatttaaaataagcatattctttcggccgggcgcggtagctcacacctataatcccagcactttaggaggccgaggcaggaggatcacaaggtcaggagatcgagaccatcctggctaacacggtgaaaccccatctctactaaaaacacaacaaattagccgggcgtggtggcgggcgcctgtagtcccagctactcaggaggctgaggcagaagaatggcgtgaactggggaggcagagcttacagtgagttgagatcatgccactgcactccagcctgggtgagagagcaagactctgtctcaaaaaaataaaaataaataaataaataaataaaataagcgtattctttcatcttacaatttcactcttacaaatttgttttactgaaatatttgcctatgagtacagagctgtaagtctaaggatgaccaatacaataccgtttctaataacaaaggattataaataatacaaatacttattaatagataaatggttgagcaaattacagtttgtccacattataaaataataggtgtcagtcgctaaaagaaagcagaactactgagttagacagaagctcattatatatttaaaagaagtgaaaagttgtaaagcagcatatacagtgtggtctctttttttttttttttttttttttttttttgctgaaagtgcatttagcaaagaactaagatataaaactgttaaatacacatatgatatacacatacatcagaaagaatttggcaataagttaacaccagcaatgtctggaggttgggttattcgattttttttgtttcccttttctttactctatccagaagcaggggctataattgtcacgggacccttgggatgtcgatttgccagccagaaacctctgtggcaggcagcgccttctgcctgagtattgctcgcgcccacagggctcgttccacccacttggcctggcaggctgcgcttggctcacactactggcctcgatctcacacctgccaagggggagccaggcacggagtggcaaagagtgtatgagcgaatgagcatggggtccagccactgtgcacagccacgcatgctagctgctgtggcaaggcagacagctccaggcaccagcacaagtgccagcttcatgcaaggctgtggctggaccaaatgtaccacacatggcttcagctataggcacctgcatctggataaggggaacacagtggcactgggaagcttggagacaccaggaaccaaagagccccaaagagggtgtcacagccctggcttggggagcccctaggtctgggatccctgaagggctgcagctcttctctccttctcatcacccataatgtggtaagcgggggaggggggtgtttcagccctgtttgtgttgcagctctttcagtcccaccatttggcaggtcctaagttcttgtccacatccaggtagaatgaggtacatggataatttgagggtgaccaaggcggagaggagacagaacagcttcatcaagaggcagaagagccgaagtgggtagctcctttctgcaggcaggttgtcctgagaagtatccagctgtcaatgaagagggatctgcagtgggtggctcctttctgcaggcaggttgtcctgacaagacaacagcaaccgaattgggtagttctttcccacagctcatctccaaggtctctgtgagtctggctgagtctggggttttcatgggcttcagatgggaggaagtgtgtgcggattggtccatgggcagccaagagtaggtcgggaaaaagcaccataagttctcactgtaagccacggactctatgcacagttgacagcctggcccccatgcttcaggccgttcttggcttgaaggtgaggcttcaccgggaacctacccctttctgcccaggagcctgtctgcttcctgccaccattgatcatgtcgtccacagagcctgcaggcccacatcgagctgcctcagtgccccctcagcctccctcccatgctcacgggcacccaaagtccagagggggggctgagggggcagagggctggcctgtcagccctgccgtaagtgcatgcagctgggtcgcgacagtgcctaggctcagcctcaactttgctctaaaatcagagtggacaccgggaacagggagaggccagacagtgggggcaggcacttctgagcctgtgggggccagggctggagagggacacttcccagcccctgaaagcacagggaaatccaggtcactgctgggtggctgcacagttgcacccaggagggggaggcccccacccctccaactctgaaaagggctgggctcctgcctgttcctggctccaactggctctgtggagcgcgcagccccagctgtgcctaccccgctgcagttggcgtcttctcagtggccgctccacacaggctgcagctgccctcataatgtaatatgaaagtatcaatatttatccttttaacttatgaaggggaagcaaatacattagtatttgctaaaagctttcaaaattcttggggtggggatggtatatgaaagcacaaagcagttagttgcaataagttctgatttattagagaaataaacatttactaggcaaagaaccttagaataactggaattcatcaagttaccactcttttttttttttgaaaagaccaaacaattttggaataactccacatagatgaaacaacgtaaactgccatggctaaagccagaactcttgtaatgtctgttaaagtgacaggtaatttgaaagctgaatgaaccagtgcccattcactgatgtaggtgacaatacaggactctccatgtgtccacatgtcttcactgatgattaggaggtacaacatggagaagagtgttccaacccctaaggtgttatctgggtgctaagataacagttgtctattaaaatcattagggaaatttttaaacaaaataaagttgcctaaatatataattgagaattctcagtgctagcaaatatcagaaaagagagtaaagctatcagtatcaggcccctccaatgtgtggggaacagtgcaggtgacatagactgttaaaccaagtttagcctaaagctgcctccttacctatcttaaattcagcccaaagatttttctgtacattatgaactataacaagtggagctgtaaacagaccatagcctacacttctgccaatcactgagttttggccaattaaatgtagccaactctgaactgaaagtctcctttactccttcaagtgattctcctgcctcagcctcccatgtaggtgggcttacaggcctgtgcccctatgactggcttgtgtgtgtgtgtgtatgtgtgtatttttagtagagatgtggtttcaccatgttaaccaggctggtcttgaattcctgacctcaaataaggcaaagagcgagctgtaaccaatccagttgtttctgtacctcacttctgttttatatatgtcactttccttcttctgtccataaatcttcttccaccaattgactgcactggagtctaccctagcggggaaggctgcccacttcgcaaatacttcattgctcaattaaactcctttaaatttaattcagctaaagttttacttttgtcaatatttatcttttcagttgatcctttttaaagatgcactcatgggtgactcagagaggttaaaaggttttgttttgtgggttttggttgttgcttcacataggttcgctaagtcagtaaatggagtatattgaatttccactgactattgactcttttatccagctgactcactaatttcttagagtattactttgctcttcttggaattgctttttctatagtgtcacctacatataatgctaaattttctactgttttattaaaaagttatactgcttatgctattatgtcttgcattattagaatcttcaaaacagtaagagtacaagcagtgatcaaattatgttttctgattttgttattcatgctttaaaagttgtactgttattgtttactgttgcattcaagtaaatagcctttatcataggaagaaagttccctttactcctattttacaataaattaaaaaaattggaaatcgctgccaactttcgtcaaatgttttatctttataatccatatgtaatcatgaaatttttggtattatttatactttaaaatgtacttggtgactttattttctcttacattaatcccacctcatattgatacttaatttccctctagtgtcttttgattcattttattgttccttttttattttcttcagtttaagacaattttattttcgatttttatttttgataataaaagcattacatctgcaatttcctctgaatgaacttttagctgtacccataagtttcttttttaaaatcttttaaattttattttattttagattcaggaagtacatgtgcaggtttgttacatgagtatatcgcataagtttctagatgaaatgttctattttatattgatttcagagtaatctatgatttcagcttttttttatatataggttctattttaaaaagaagtgtcatttcattttcaatggctaaggctttttgtttctttggggctcttcattattttgttttgttttgcttctgtgagtttttcctttgaccttgaaatcaaattaaccagatagtaatagtccattctcttctttcaattagtttgctatttcctgatatgttattcacctacacttttgtttaaaaataatctgtcattggttttaggtatatttatttctaagcagtgtacagctgatatttatttttagactaatttgagagcctatctttttataatagtcatcccactcatattaattttgacaacatatatgatggttttatttttctcatactatacttacttttatatgtttggtttggtcctttcttttttctacttctttgcttttgttatattcttcttaaatattactttccttcttcataatagtgtaggaatcccaccacatatctcaattaactgtagaccatctttcctttttttaataatcatatttaaatcagtggtcttcaaaaattaaataagaccacactcctctatcaactgtttactattatttcactccctttacaatccaatgtttgtttcactaaaataatgtagaattggagtctctgtgttaacttccgagagctacttgaagcaaaccttgtagtcataaatatttatttatttattttgagatggagacttgctttgtcacctgagtggagtgcagtagcagtatcttggctcactgaagcctcagcctcctgggttcaagcaattctcctgccttagcttcctgagaggctggggctacaagtgtgtaccctgacaactggcttttttttttttttttttttttttttgtattttcagtagaggtggtgtttcactatgttggccacggctggtcttgaacacctaacctaaagtgatctgcccaccccagtctcccaaagtgctgggattataggcatgaaccaccatgcctgaccaccatacatatttcaaaaaataaaatgcaatttctgtaacttccctcaagtttatcaatgttgaagtagagcttttcataccatatttattcattattgtcccaacaataatccaggtgattgtacagaagaatctttcaatttcattttaaagttttcaatccatcagttgttttctttcaaacattgattgccttccatgttttatgaagttgaatatttacccttgcctatccagagagaagcattataaacagtttttacaaatgagtgtcctatcctccaaattataagttctaaaaaatgaaaattcatttgaaatatcctgtttgagaatgaatatatggcaaataacaatgtaattttaaagcaatctttaatgagtctctattggatggtcaggtaatatattaatcagtgtagcaggatctattttttcctctttgtaatttgataagtgaaaggtggtctgctctaaagtacaaatatatttttacaaaggcatgaaattctaatactcatttcgtcagaatcattattattggttatccattcagtgataagaagtaaattatagcctatcacttctagtttttaccacctaattggataggtttaaaagtgtgtttagagaaaacaaagaaaaaaaagaaaaactggatgaagactacacaatgtgcaacttactaagtgaaagtcagaggaaggaagcctctgttaatgaactgtaccaagaaatgacttggattcagagagcaatggtagagatgcctcaaaagcctactcttgttcaaactccttacaggctatttctaatgcattaaaagcatctgttaccacatgtcctaccaaacatgccaataagtgagacaagaaaacgtcctaaactttatacattgcatgccaagtgaaaagcaaatcatactcagtcttgcaaaatgcaaagccaacaaaatgaatgaaatattatttatatgtgctttggtgcaaaaagttcccaacagataaaaaaataactgttttttgtctgtggttctgaactgtgaataagattataaaataaagagttgaagctagtaattttattactataaaaatccagcttatttaaatattaatcttttcaaatgaggaaggcaagcattccattaaaagatgttatttgaagactgtgctcaaactatagagaatatcccctggaaattattcctagtcagggacttgtgccccagaaataaaggctagcatgtgctccttactgcatttcaaacaatatatcctagcaaaaaaaaaaaaaaaaaaaaaattcatacaagcatctggtaaggataaaaaaatagaaagcaacttcataaaaatttgaacttaatttcaaaaagattttatatggttcaagcaaggcattttgagatttatctcatcgccaactggcaatagtattgcttgtatttttgtgctgtcctcaaacccagtggcaaatggaaagtcaccctttgagggattcacagcacagtagagtagaaaagtcctccagtgagctctactcagattcataattgtttgaccttggcaatgtcatttaatcactctgagttccagttcttaaatatctaatacacaaatagaggggaaaactatttgaaatattttgcttgaaggatgaatacatggcaaataagaatgtaagtttaaagcaatcctccatgattatctgatattcagatgatgtattaattccactggaatattatgatctatttttttcttctttatcgttagatatgtgaaagaatttttgttaaaaaaaataaaactttttgcagtggcgtacaattggaatactaatttcatgagagatttggtctttacaggtattagcctaattgatgtgaaggactttgggggttcactgttctttctccaggaaaatgcaagaaccatggggtccagctagtattgtcctgagatatattagatttttttttttttttttgagatggagtcttactctgttacccaggctagagtgcagtggcgcaatttcggctcactgcaagctccacctcccaggttcacgccattctcctgcctcagcctcccgagtagctgggaccacaggcgcctgccaccatgcccggctaatttttttgtatttttagtagagacggagtttcaccatgttagccgggatggtctctctcctgacctcgtgatccgcctgcctcggcctccaaagtgctgggattacaagcttgagccacagcatctggcctagatgttcttggttgtaggcgtagagctggaaatgatatccaaagcaaaatcttctacagttttcagatcctatgtcagcatagagcctgactaccaaataaaaatagagtcaatgagaatggtaagccaacgtgaagtaacaggagaaataagagtcaaagtatgccaaggagaaagaagtcgaggctggacagaattccttttttctccagcataagaactgagagtagtttttcaggaaaacttcagagtctaggcttgagcaagcagggaaacaatgaataaaaagacattaatatcttttctgagcatcctcacattctgtaccctatgcttcccctttgctgagactctagtttcagggcgatcctgtggtaaccttttgcccttacagtgcatggaggagtaatgtactcccatttcccagctatatcagaaataccaattttggtatccttgatgattctttttctgattatccattcattttcctgagtttcctgcttattatcattgggattctacatctattgaagcatctgcatttgaattaaggtaaaattctgggccatacgccaaaatctcaacctcaatgcaccagccactagataaataataacagaaggcactcttttgatatgatattttctttttatgtccctcacaaaatacagaggtcagtttgtaatattggaatttctatttcttcctgtaatcttgtccctgtggctttatctggtgtttcagccaatggccagcagtcagacaatcttttgacctaatctgtctagaatacttggccagcctgagtgatgttatttctatcaggttgaactcttacaaatgtgttcagattgaaacagcagatagaagatggaaatgggaaacttaacactcaccccttgaaatagcactatttcttgaaaaatggcactgtatttatgtgtttcacactgttataaagaatacctgagactaggtaatttagaaacaaaagaggtttaattgattcacagttccacatggctgaagaggcttcaggaaacttacaatcatggcagaaggtgaagggaaagcaaggcacgtcttacatggcggcaggcgagaggtgagagagaaggaaaaactcccacttttaaaaccatcagatctcatgacaactcccttgctatcatgaaaccacccccatgatccagtcaccttccaccaagtccctcttttgacacgtgggtattacggttcacaatgagattttgatgggatacagagccaaatcgtatcagatacaaactaaccagcccacccaaatactatctttagtaatttacatagattatctctagaaaattagtgaagacctgcaaatcccaaaatgatcaccatcatagaaactttggctgggcccgatgaggctactgcctttgttagctttgattaagctaaaaagaaacatgcttatcttgagttatgataacccccacccatccgtcatgcatatttggcttctgaatatgtttatttctaaatatgtgtgcagttaactatcttaaagcaggcttctcactctacttcagctttttcttgcttttgttgagaataaaaaaggtttcaaaataaaaagttaggtgcatagagcatgggtttaaatactatttctgtcattttctatttgtatacctgaagcaaattacttagtcttagcttccttatgcataaaatggaagaaaagcatagtgcctatctcaaaatgttatccctctgcctggaattttcttttccctgatatccacaagaatactctcttaccttcttcaggtttttgttgaaatgttaccttatgagaggcttttgattgattataccacttaaaattacctttccaagcacttcagatctctccctctttatttttctctttagcagtcacactacatattttctttatttgttttttgtttttccttctccccatctcccacccccactagaatgtaggcgggatttcatctgtctgttcactgccacatcttcaacattggattatgcctaacacgtggtctcaataaagagaagtacttaacatactatgtagcacagtgaatcaaatagaaactattgataattttaaaattatattatttcatcaagtaagactacatgtagaaataaaatgtttctatagagtccaatcatatagcataaacagagaaaaacaaatgcctataataaccagtaacaactttagttctataaatattaccatgcatttattattcattcattcatttattcaaagagtatgttatgcctactctgtgtacagcacaatatctttctttcttaaaaatttgttgaagtagcattctttgatctttacatggcttatataaaacagcagttctattttggcttgattttctgttctgactatctacaacagggatcagcaatctattaaaaggatgtatcaaggcacttcattttctggggaggagggagtgctgatcagttacaagtactgacatagcttgagagaaagactgcaataatgtaaactccacaaggatttttctctgtttgttctcagaagtacccccaggacttagattagtctgtggaatgtgataaacactcaataatttcttaatatattaatggctgaaggcacgtggtgcagcctgccagctcctctgaaggctgttggcatcactttacagctaggagaaaagatttgtggtacaatccatcaactcacctgagcaatagttttactatgcatccacatgttttcaactcctggtctttgccaccctgagttcactagataagcaattatatgtcccaaaacatcatatcgtcacagtctccagaatcttgatgtggtggaaaatgtataggctttgtagttaggcagacttggatttgaatcctggctccatcacttatttggctaccagcaaaacttcaaatttctctgagactaagtttcttcctttataagttgaggattataatgcctaacttaaagggttctaggtattaaataatggtatgaaaactgacttaaatttaatggagtagacattgttgaatgccatagcagtatttcagaaaagatatataaatatgagcatatcctcaggagagtataatgacagcaaagaattgttagtattaggcattattattacaaatattatctgaacactgcatctagaaaaaattaacctgagtgttatcttaaaacgtaaaccctctctttatagttaaagttaaaatgtggtgggtttttttgcacttacttgaagttcatctattccttacaaaagcagaaaagcagtttagaaaagtaactttaattcagttcaaagaatatgagaatcttaaaattaacctaaatgtaggggtgggaagagacagtttctaaaataagacacatttaccttattttttattacagattgtacatctctgtatgaatacataatagatcttaaaatatcaaacaataatatgggtcatgtctgagtatgtggcatattggaaataatctggttaatgagtcaacccaggttctcagacagcaaacatacatgaaacaaaacctctgagctctgatttaaacccctccaaataggaatctgggtccccttacttgcctgtgaaagataaaaccaatgcatgtaaatattttgtgtagagcctgcatatgaatgacaaggaagtcaactcaaggacatgaatggttcatggggtatgatgattctagacctcatgattcagttcacattagaggagaataaagatctctctttctcacaaaaatcagaagtgatacatattgatcactcagaaagctacagatataatggatcttgtctttttctgaagttccttgagataatttttgtgaagtcacttaatcccattttttttcacagaaggaatacaacaacgttttgacagaaaaaaagttttacttaaatagcataatagtaattgctgacaattcatctctgaactaagtacctgcacccacacagatcatttctttcaagcctcacaacaaccttgtgagaaatactccgtttaaagatggggctactgaggttactgagatatttacacagaagtgacaattaggattcacatgtctttctccatatcgtgcttccacttatggatcattcttgcattatatcccgcctccaactaaaaaaattcaacaaattattgcttgaggacagtgttactttcaagtgttcctttaatcaacttaaaatagttttctaatacatcaagagggatgtcttcatgaagtaaaaatttaaagaaaacaaccatgtgaagaatttctataaagtggccactgatgtccaataagttccaggttgaatgaaggctgtagcatctgcctggacaatgtacaattaaattagacaccacatatggttagaagacaaaattatggtccagtgtgttctgtaagttcaaacatcagagctttccaatgatacaatttttaaaatacctttttttctcagtatacctggaactcctggagattatatgaaatttgacaatatttgttacttccataaaattactgtaaaaaataagaataggtatatatttacataacgttttccccttttgtctgctttgtcattcttttaaaatcacttctaaagagattttaaattacatagtcattttagattctagtaagtagtcagacattgtttatcctaaatttttggaattgctgctttgcctccagtcagcttttggtttattcacacaaaggaccttagtaagaggaatttttcttcctgtaattggtcctactccccctccaactttagagacattcagtctctaaacaagttctacccaaatgtcataattccccaaagtttgccgtctctcaaaattcacccacgatatcttatatccagtctaggtagttgatcagtacacgccaaatgctgaaatacttcttcactagtgatatccaaatgtgaggcaatatagcatagttattatgaacaaggtctcaggctttcatttcttttcctaccattccctagttgtataagcttaagtaggttacttggcatttctgagccatggtttcctcatctgtacaaggaggatattaataacacctatctcatagttatatatgttaaataagtcatatacataataaagtcctaagcatggtttctgcaaaacagtactatattaatgttaaccatgatgttggggacaatgtttgaattagcacgagaaacaggttacctaagagaaagttcaaaaatggataaaaaaaaagtacaaatttgtgggcctcctcatcaccttactctctcattttattgatacactataagccccttgatggtatatatcacttcttatttgactttgtatctttaatatctagcacagtgtctgcaacttggtaagactctttaaattttggttgaatgaatgaatttccatagatactgtctaattcacattggcagtccttagtaattcacaacataagaactatacctttgtgaattctctcctttggaagatggagagaacaccatctgggggagagcctaacaaaggggagaagcaggtgaatccggattccatagcaaaatcgtgctatagatcccaaattcaaaaatgctctgtaacttattcaatgtgcactttccgagacagttccacaaaagatcataaattataaccctattgtagattaattctcaaaccctgggttgcattttcccctttaaacctaccaaggatgaaaagaattgctgaattctcctggaaaagtcaatgttaatataatttttaaccacttcttgtagcatgctcaatcaattcaaaacacaacgaagtaatccaaacaaatgcacatgactcaaaagcaacacaaatacttctttagttacccactgtaccgtgtaatgttatgttatgcttaccacaaaactgaaatacaagtcacatttgactatgtaaagataaaactagaatatctactcatggcatgatgataattctgcaacaaaatgaatgatcttgccaaaataccatttcagccagtgaccagagagtgaggttttctgtggaggaaaattttataatatgagtagcaactaacagatacttccagctataaggtttattcaacacatcccacaattactgctctgccttgtgaacttttataacctcactctgttacagacaccatcaatcttgtaactgataaatgtttagaagcaaacagcaaacatatggcctttctctctcagaaagtatagaagtactactgccagaagttgtatttacctatgttgatttgtttaatcctcatttttcattcttgattggatcattccttttagcatagaaattcaccaagaggaatgtataaagttctaaatacagcaactaaaacctagttagtaccataaagtaggaactagtattattcctattttatagatgaggaaactaagagaaaaacgattttttaaaaaattacacaccactttccagttagtaataggtggagctggtttgtgttcttaactattacattatattgcctctcaacttcatgacatacagtttggggtctttagggaataggcagggggaacaggggtccaattatgcaagaaattctggatccctaatttcatttttctttcaccagtatttcttaattgcttctaattaatattaccttgccaaaacgaaatatatctttacgaagaacttggagggtttaaatagccttcatgggtataatagcagtgcagtagcagtgatactataagatataaaaagagacagactcctttgggatgtggcaactgattagattttattgacactggtgagaagatacttatgaaaataagtgcctctttattgctggattttatattccaagtttctgcttcatcagcctatctgattcactgtcactaaagcaatatatcaagcatggtactttgactcttaaccttattttactcatctaaaaatacaaaggaaaaggcatgtcaatttcatagagttgttgtgaggattaaacagggcatcagagagatttgagcaggggagtggcataaaaaaggctttgtattttaaaagctcactatgggcttccacatagaaaatgttttagagagggataatacaggaaatgaagtcagatttggaaatacatggtttcaataagagatgatgctgattttgcagtacagtagtggtgattaagctggggtaaaatcaatggatattcagctgtacatttggatgcaaaaccaatgacatttagagataaactgagtacaaggagttagcgatagggaagagaaaggaagaactctctgtttttgacataagcatctgagtaaatggaggtaccattcactaacatggacaaaaatcaaagatgagcagctctctatgagcagaagcaaagcaggggcacacagagtggtataatgaacatcggagagtcagaagtgaggcagatgggaggggagaaatgaaaaattacctattgggtacaacgtacactattccagtgacaggtatactaaaagcccacacttcaccactctacaattcatccatgtaaccaaaatcacttttacccctaaatctatcaaaattggaaaaaaaataagttgggttaaaaaaggaatgcaattggagacacattagctttgagacaaccaagaggtgatgtcaagtaagacaatacatgaataggtttgaagcgcaaaagagatctatatgtcagctagatgtatacgtttgagaattgttggcatattcatagcactgaaaactataaaaataaataaggtatccaaaggcacagcttgaaatgagaaaacaggatgaagccctgggaacttcaaacttagttgttgttttaaaagttgctaatatttattcagaatttacttggtactaggcactacactaagtgtttttacatagattatcttaattcttgcaacatccaattttccattttagtgaaaactaagatttaaaatgggttaattaatctgcttaagatcacatggctagtaaatggaagaaaaggactttgctctctgacaaatgacctagtctaacagagtggaagttgacaaaggattaaataaggcatgtgaatctctaagaagaatgcttgacacaaaaaggtacttacaagtagtagctattgttattttcttaataaataagttggggagtaaataaagttagtggattgcccacactctcataagaaatctgtcatgtatgatatatttaaatacctttctgtatataaaggttttaccactccaattagattgccaaacaatttaaagataagctcaaagtcaattaaaattcatatgcttcaaataaaaatgtggtaaggtatttatggaagatattttagaaaataaaggaggaaaataaccaatcagagtctcactgcaaaattatatttttgtatctactgttgatagtacattttttctggttttcatattttgaacttctctatagaataatttgaaccatttcaggcatataattttatattttatttttaaaacctgacattacatcgtcagcctttgctatcttattatagtctttgcaacaacataatgactgccatccctacactaatagattttctagttcatgtaataattcctgtcttattgaacatttaggttatcacaattataggaccttacacaaagttctgttataaataactttattccccagccctttgtacttaaaattatttactgaagagagagttcccaagctgaaattactaggtcaaagatttctaatttgtaccagaatcttaatgtatcaaattttatactgagcttatttttattctccatagtacctaacataatgctgcacacagagtaggtattttataaatacatattgtttaaataaataataaaatagatgagaaagcttcaccaaaccattattatcacatagacttaacctatcattacattaaataaaattaacaaggaagccagcatcattataaatacataacaacagaagatcaacaaaaatatactttaaaagtaaaaggcactgtatgcatgcaaaatgcattatttaaatacatggatctctaatttccaatttagagaattttagcttaaaaagcaaatttacagacttccttagaattccttgccaacaacaaaaacaaacagaagaaatgacagaaaaattgtttttaatgaaatactttaaaataacttttaaaatctaactttctattagctctatttttaatagaaaattacatataaagtagtgattcaatacacaatgaaaatgaatattcagcttacccaaatatgtgctcaatcttttctctccctaatcctcataaccctattgccctgccaccagttccacactgtcataaaccaattttatatatacttattggtatgtaaggttgtaatctcaaattcaaagttcaataagacatttatatatacagaataactttaataaacactggccatattccaggcattctactaggaactaccctaaactatttacaagtttctgaatggcccctgatctttctcttctggacctccatgcacatgctgttactttgccccattcatcttgtttcacttagtaacttctttattttatttcaagtttccattagctataacctctactacagagtttccttttgtgctccaagaatgtgttagatgctgctcctgttgtgctactataagcctgtgcttatttcttatcatattatatcataattgcctattaactttttgtctcctccactatactatcactgcctagaggataaatgatttacctttcctataaattaagaggattcaagttacccttattacgtacactcttttgagtgtgttgtgtgtttataaatgttaactgtcttgagactagatggtatatatggcccaatttcataattataattggctctctagttttccatgcattatattcattcctctgattaactgaaaactttcaggggtcagggttttttgccttaaccttctcacgcaacctccagagtgttattacaaaatagtcattagttaactgttaatgagtagttactttggatacaatcatgatctaatataactaccactggagcccaggtcaggggcagttttaaatcactgcttaaacttgcctatatgaaccagggatttgacacaacgtaatctgtgtaacccatcagaaaagcaatttcttaacattttccagggagccaacaaacactcatattccaaattctcatttctcagaatctcttcaaaaataatttaaaagtcagagactactattttcatgaaaatgtttataggagtttcattttctctttaaaaatagatgaagcttaagtaaatgggaaataagttatctccacctgaaaaatttttcctcctatggcaggatactgatataacttctggcctttctctgcccgttaattcattttgcttttcatgagagctggaaataggaaagtaggatgaattatttgactgtcatttttggcaaaatataaaccaggcatgtgtcgcccacctgcacccttcttcctcttgggaacaagtaagccaaatggagcagctggtctccagtgctctccaagggtctgatcttcctcactgttgagagcaggcctagttcattactggttgcaattgagaaaaggggagggtggagaggtagtctgcctatgtccaaggtttagttagcagaccgatttggctttcataataagctatatgttccaacctaggcttaatgagtaatataggtaatattttggctccatctgccactcagttgttttattctcaagttattcaaagcctaggcagagaagaggaatggcttccctaagaaaccaacagatgggaatatgcaaaagtgaaaatagcttgcttttgtggtagttaaactataagtgattcttcctttctgttttcctaaattttcattactgtaatacaatatcttcattaaaagagagaggttgtaggagggctaaacaacaacaaaagacaaaataaacaaaaaaaatgtccttactaatattaggttaatcttttattattgcacctgcttgaaaataattaaactggatttcaaaagtaaaacaaaatattttaaaagaccaagttttcaacataaaataaaagtaaaaaacatatgcctacttgtaaagttcaagtgcatgagcttaggtgctgtaatttgaatagtctgagttttacagaagggaagaggaaatatgatgactcttttcaactattctagaaggcaaggcattttggaagagaagaataacttctctagcgatgtctgttattctctacaggattttaaacatcattatcactagttggcagaggaaggatccaatatgtcactgaaaaatacgtctctaaacgaatcaaatgatgccagtgaaaagcttcatctaaaactaggcctacaattttgcttctttgagtctcaggtttagtaggaagcaccaaactgcaacctcaaaactctgacagcaaccctgcttcctccatattattagctcccataaaccccctttctatttcttggaaacttgattgcttcagttcaaaggatcccgaacagaatttgcaaaagcgcaacctaattccctctatgataaagaaaataatttagtttctatctgagagctgtgttatctaccacagggcaggagctttgggtggagatccctcagcagtatatcaacagctaccacacagtactccttacttactaaatctcagcaatcttagtttgtattctgatacaggaagaaatacagttagataaatttgagcatagaaatggaattatgaggataggctagaaacttttcagatgaggcaaataattaaattaccttgaccagtgaagcaaaaccaattcattatgaaaatatatcataccctgattactgaattttatgtttttatctttctgcttcatttatctagtagactattcctaatgtaatccaccaggagggcactttgactccaaacatcagtttcataatctgtaaaatggggataatatttcagagtgaagcttaaactaggcaattattttagcaaagcctgttaccttcaacactaatttcacagaaggccaaaaatgacccttatttttcacaattgataggtgtctgtctttctgatcatcggattaacataaattacttccttaaatttcatgcagcctaactattgccaacttgcatttcaaacccctttgaatcctaactctttcttctgctccatcctgtatatgtaatacccaaacttgcacgtcatctccttttcttgaagagtcacaatgcgtcttggcatattagatgcactgagatgctctgcagtaaagagatatgttctttttatttgtttgtttgttgacaatttctaaaaagctttattttaatatttccttggctacttttccatagaacacagtgggaaataagatgctaaaatatagagatagttatctcttagtggcacaaatgtaggtgagttctattttcttctttcttcttctacacaatttccctccaaatctgaaatttccttattttatgatcagggaaattattcttcttataaacagcctagtgacactaagactatatttaccaagtgcttgctgttcctagattgttgtccctcgattttagtgcatatcttaatttcctcattaagtaccttgggcatttcattagtagagtgggcaaatcattaccataatacttctcatggcaaacattttgaaatctaaatacaatgaaatgctagcaaataagacaagaacatttcaattttaagactcctttaaaaattgaaatccaagagttcatatgtagagtcattgtactaaacaatgatcaatttgaccttttcaggttgaggcattctaattcagacttcatagcttttggagtgagaaggtttagcctcaatgaacatgtgggccatttcttagctgtgttatctagaatataatgtattacataatctccctgagtatctgttttctcatctgcaagatgggaacaaagtcactcatacctctgggctattaaaataactgggacaaatctctgtcaaagtacttggtaaatgaaaatataaaattatacagaaattattttaaaataaataaaaagtatcatttttaaaattcaagtaggaaaaaaactaaataaaaaatgaatgtctcatggtagtgctcacatttcttaaggacatatcctaaatacagttttgcaaaaaatcaccagtaaatgtcaaatagacatttcttctctaactaaaagacattctgatcattagtaggtaaaaatacaattctcactaagtgagagttttacctgttatctccacgagaattctactcctgttgcctgagagatcccttttctagctttcattcatagtaagtaaaatgtgcaaaagttgccttcctaatagtctactaatttattttactaaagataattttctcagctttgatagtatcttgttttatagagcaatacctttttttgaccttcaatacatgacacaaagcaattatttcatgatttttaaatataaaagcacctactgtcaaactgtcagactaaaaatgactagatttcaagattaatgaatgttaacaagaaaactaaccatctttctcctgttaattgtccttctatgcaatattagtttttgttataacatgtcaaaccacaggcttaaatcgcttagaaatggatatattccatatgcaacacaagaagtcctcaggaagtctatcaaattaaagacaggatggggaataaaagatcacttactatcgtggtactctacagccatgattaagataaggctgaccagagagagaccttaacaggaccccttgggaatctgcaatcatacattgtcttttccacctgtggagtccagagaaatgtgagaaataacctttagacttctttatattgattatgtatccattttaaaaccactggacactatcaattggacactatcaatttttaaaacattatcctattatttagttgagcgattcaatatctgtggcttcagttttgtcatctgtaaaaatagagtcgggacaatgtaaattagggtccatcaaaacaatgggattttgtgaagtcattaaaataataaatgtgaatacttcaacagaatagaaagcagatttttatgggagaaaatcaagattaaaaaattacttgcatacttaaattaaaactatgcataaatgcattaacatgaacaacaatctgagaacatggagaaatgaataatgtgttcttacgctctttgttatttttatattgcctaaagttcttccctttagccagcaaagttaaataaaggggttaagctactttgattagcattaaaattcaataaccctatacctccatgatatgaatacatatggttgctttgttcttcaagtactttgtatacattcgtcattctctatgagtatattgtgagattcctaaagaagaaaaccatgagttttaccctttcaatctgctgcacataaaaactcagcacgtatgtcaaagttcatagacttagggattcaggacttgcaaaatccatcctatagtgagttaaattatttccagtctcgtggtaccaattatatcgtatatcagaactcagctcataagcccccttggcaaaaggaattagtagattttaggagtatttaaaaaatttgtatcttcctaaatagactatttccgtgagggtaaagatctatctgctgtgttggtcatcctatctctagcacctagcactatgtctgcaatatggaagactggccacaagtatttgctatatcattagataaaaattcctcaatctgaacattattgacattttattttttgttggaggggctgtacactgtaggatgtttagcagaatctctggcctctacacactagatgccagtaattatctgcactaggttctcaataaacatgtgataatagctgaaattgctcaaaattatttttagttgtagtacataattggtagcagaaatgctgctgatactttctcatggcacagaatgttaggaaatataaaccgggacgtaagtgaatattctttacaagaactattaccatcagtaatgtaagaatctaccaaacacccagagtttaaagagttctaggaaagctttccagcatataaagagatgtaaggtttataaccaaaacttagggggtaaaatgatggggaaaatatagttagaagaaagctagttacatcaaaacaaaaagtcattaattcgctaatatctaatatattgccagatttctcattccctttccaataatttacctaatttgaacctatacatctatgatgggaatctctagctatcagaaattgttaggagaccctcttcaccttggctagatgtccagtctttccaattgtcagaacccacaatgcttacattctgaaggaactccaaccttcccaggaagagaactgacccactgtgtcatcacacacacacacacacacacacacacacacacacactgcacacatacatcttctgaactgagggtaaaaaggttcatgaagtctttagtgggaacaaagaaggaattaaaaatgtacactaaaaaattcctaataggctgctgtcctatgtctttgcttgccctcttactctaattacctcggctagaccacatagaagaaaatataaaaaagaatcctttctaaaagcagaaaacagtacttggcctaaagaacaagactttgtctttcgtttctttaggccttacctaggctttccaaagaaagcatcaccaagatcccaagaaaatatcacctccagcttgaagtttcactaccgtaaatgcaggaagaaaggaacaaacaggaagacaatggcatttccaatgccttctcattccactcctctcatgataggtttcaaaacttccctcaagaaagtggccagagttttgttcaatgttggacgagtacatgttagagatgtcttttctgagccctcctctcagagaaggctggtttaagacaagaaaaaatcaaagatatttaatgaacagaagatttatataaaacgatgtgatttgttatgcacttaatatattttatgtcaaacttgattaccactcaatttctatgtggatttcaaagtcagattctttcaatcatgtctcaatgtataaaacctactcatgcttttttaatctcaacaaatttgtgatttgctgggcactcagtctctgtttgctctgcattagcattattgtaaggcttaatagatttccctttttcgtctagctgggtctgagtacccagttaaagcctcaagccactagtggcatcattaatgccacaatgattaagcgagacagccaagcgccagtgcaccatgaagaacaacagatttcaaagtcatcaagtctgaagcattgtcatgcttcttaaacagggtaaaatgcattaagttcctattattttcacattcttcaggtaaatgaagagggttgtttctagcctgtcaatagtgcctcagaactttaactagatgttaggacacaatgatgtataatcatcacattcttaccagtttcagtccagcagtattgacttaactctactggaagaaatatatacttgcagtaaaagcaggcatgtttattctaactctgtaagaagatagaccattggcattcccccaaaatttgcttgattacttatcaaattattcaaatttgcagagatatatactatataaattccctccccaagaaatgaaatataaatttaaaatgtaagttctttcattaatttatcaattcactcattctacaagttgtattcaggtttaactacgtgccaagcactatgctaagggctgggaatatattaataaacaaaacagacacagtttctgctcttgtgctagcagagaaaacagatattgaaaaaaatattacatatgtgatgaatattagaaggaggcgtggaaaatgtttgaatacatttatagtgcggagttgtgaaaaactatgactaagaaattagaccttaatcccaaaatttagcagctgtataaccttggctagtcactcaaagtctcattttttctagtctttaaaatagagttaattatctaattatatcttcctcagagggtgtggtaaaagtaaagtataaattaaattgcatgcaaaagcacccaggatagacttggcacaaaacacgcacctagtaagtgataatagaccctcaagccatctgataagtcatgctttttgagtgtcgtttgaaaatgtagtagcttttgtgctgtaggtcttatcaatcaaagtgattagtaggtaatgtatttaaaattctaaataatgataaaatagctagaaagacacttctcagcaagataaatttttaaaagaatggctagaaaatttctcttttggatcaagaagaaaagactgagcatatttgctccaagaatgaaaatcaatatgcaagaaaagtgaagagaatgttctctaatgttgaaaatgtcattataaagggcaaggaggtataatgaaggttcctaggtgacaaaaatcagacgagcatgggaaagtttggataaatgaacaaacatcatcgttgggagttcatagtctatttctaaataagaaaattccattctgtaatatcaaactgaattcttactactcacgaagtggttgtctttgaaatcaaagtagtccctttgtttaaaacttaaaactcataaaatttaaatattaactgacaaaagaatttcaggagagaatagaggttttcataaagggccaaacattttgcattatataccttgaaaactgtgagccacatttgttctattttaacaacataagcaaaacagaaacttggtaatgaatttataagatatagcagtgaatgttttgatctacttataattacttcactgttgttaaaaggatttggcaatgtaatgactgatataagcactagagtcattaacatgtatttactggtatgcaaattggttgccaaaggaaacatctttgtatctttaccttgtgttgctatgcacaattttaaaaagaagagaaaaatatgcaagccttcccgttattttatcaatttgggaaggtctaagaatcacaacattggaagcatccttagaaatgcacttgcttttgttgcctgtgaactggcaggaaaatggaaattcttcagaccctcctcattgtatagttctgtgtttagtcatctttggagctcagaatcatttcactgttcctagctaaagcctttcttaaatcaatttatttactactctatacgctacttgccctattgtttccactacattacgctttttaaatttttttctacattgtcatatctgctctagtttggcttttattctatcacaagtaaaggaatgaatctggggcctgaactctggttccaatgcagtgacatcctagctaatcgactataaggaaggcacttcacctctatggcctcagttttctctctgtaaattgacaaaaattgaactaaattatcattgaattaccttccagccctgccattccatgatttccataaaggttgatgaggtgccatctgctttaggaggaaaaaaacactaaagaaaaagattcagaatgtagtgtggggtctgccaacttgggaaaccatgttacctctctgagactaatttgtgtcatctgtcaactaggcataattataccttccctgtctaccacataagatgactgatccagtgaggtgaagatacaggttagcatatagtataaactttatccttactaatctcttaaaacctggcagacaggaaaaaatatagtgagtacaggccgggcgtggtggctcacgcctgtaatcccagcactttgggaggcctaggtgggtggatcacaaggtcaggagatcgagaccatcctgcctaacacggtgaaaccccatctctactaaaaatacaaaaaaaaaaaaaaaaaaaattagcctggcgtggtggtgggcgcctgtagtcccagctactcgggaggctgagataggagaatggcgtgaacccaggaggcagagcttgaaccgagatggtgccactgcactccagcctgggcgacagagcaagactctgtctcaaaaaaaaaaaaaaaaaaaaaaaattcatggtgagtacaaaagtcctcatggcctaaagtgtagaacttagagaaaagtacaaaaatatgggtcaattaactaatgaaatagtgattcatttatcttcctagtaacgaacatatgaaaaaattctctacatcagtaatcatcagagaaatgccaatcaggccaggcacggtggctcaggcctgtaatcccagagctttgggaggctgaggcgggtggatcacaacgtcaggagatcgagaccagcctaaccaacatggtgaaaccacatctctaataaaaatacaaaatttagctgggtgtgctggtgcatgcctgtaaccccagatactggggaggctgaggcacgagaatcgcttaaacccaggtggcagagattgcagtgagccgagatcataccactgcactccagcctggcgacagaacgagattccacctaaaaaaaaaaaaaagaaagaaaagaaaaaaagaaatgcaaatcaaaatcacaatgaaatactatctcataccagtcagaatggctattattaaaaagtcaaaaaacaacagacactgacaaggttgcagcataaaggaaatgcttatacactgctcgtgagaatgtaaatgaattcagccactgtggaaagcagtgtggaaatttctcaaaaaactttaaacacaactaccatttaacccagcagtcccattacttggtgtatacccaaaagaaaacaaattgttctaccaaaatatgcacttgtacattcacagcagcactatttgtaacagcaggtgtgaaatcaacctagtgctcaccaacagtgggttggataaagacaatgtgctacatgcacaccatggaatactacacatccacagaaaaaaacaaaatcatgtcctttgcagcaacacggatgcagctagagaccattatcctaagtaaattaacacaggaacagaaaaacaaatactgcatattctcatttataagtgggagctaaagactgggcacttgtagacttaaaaatgccaataatagacactgaggactactagacagggagcaggggagataagggttgaaaaactaactgtttagtactaacctcagtactggggtgatggaatcattcatacccagtacgaacgcagcatcatgcaatatacccatgtaacaaacctgcatgtgtaaccctgaatctaaaataaaagattaaaaataaaaacaatctaaatttggcagcacaatatttagaataaagaacaatggactggattctaacactatttctgtcattaattagatgaatgagtgacttcagacaaatttgtcaaataaagatgctcaaatggacacaatcatataaaaaatttctgcattataacttttcttttggaatacagatttttaaaattaatgagagaagaacaaaccagacaaagagagagagagaaattgagggagagaaaatttccactttgactatgataaactaatttataacattctcttgctaagaacaactcaaaaggatggattataaaaaatatttgaagtcataaacaagtcacgaagtcagccaggacttatgggtccaagatccctgagagaagaaaattcatgaggaaaggtactcaacacatcttttcccctcagctcattttcctgttagaagctagtgctaagcaagagactgtgaagctgaacagagagctgacagagcttttggcagtctcaatggactggggaaacaaaaattagggttcagggttgaaaaggactctatgacttgataattcaagattttgcagtgacaaaaagtacaaagaaatgaatccaacactatgtgctgtttatttttctcaaagcaatagtcaattcattagcaaagtggggaaggagactatgaagttgggaagaaggaagtctctgagaagctaagaactttcaacaatcacacgatgctggagagtaaaaaaatgggttcagggcccaccaataaggaattaacttggtaaacatctaagggttaaggcagagatagggttagggttaaggttggggatagatataggggaacaaactaaaaatagaacttgctcataaaaactgaaacattgtgcttgatccagcccagcccatagttacattaaagtgatatccctgtactctagctgcacttaatttcttttcctctttttttaagtaaaacctctccaaagagagataacattcagattatctacaatttttcatatataataactgtcattcaataaaaatcagctatccaagaaataataaaagaaaaaacagaacagagttgccattgatacagatattagagttattagaaaagatctttgaaataaccataatcgacatggttcagaaaataaatggcatccctaagatatgggtacttttctgtatagatgttatccttcactaaaaagtttattcttaaattttaagatgtagaaagtagcaaatttctccagaaaactatatctttgaaaaagaatcaatgaaaattcaaaaactaaaaaattcaataagtgaaattcagaattcaataggggaatttaaaaatgaatatgtttcagcagaagagagtggcagtaaaccagaagaaatgttaattaatagatccaagcactaaaagattaaaaattattttacaatgccataaaagacatatacatcattatacaaataacgaagtgtgtgtcaatggactctgagtattgaaagagagagaatgtagcagaagcattatatgatgtataatgatcagtacattttcaaaactgacaagaaaaaaagctacagattcaagaagtgctgcaaatcccaagtagggaaagtacaaagaaaacacaccaaaacatacaataatcaaattgctgaaaaccaatgacagagactgactcttaaaagcagacattaattataaagaagcaaagataacactggcagcaataatgaaagccataggcatttttaatgtactgactgcctaacttgaattttatattcactgaaaatacaattcaaaaacgtaggcaaaataaaaacactttcatcaaacaaaaaacaatgaatacaccagcagatctatattttaaaaaatactaaagagagtacttcaggtagaaggaaaatgatactggaaggaagcagaaacatacagaaaggattggagggccaaaaatagggtcaatatatgggtaagtctaagtgaatattggctatgcagtccttagaagaaatttgtagctattatatagcttgtaatacatatatttttaaaaggagaatatctagaaatcaaagtttccatctcaggaagcagtaaaagtaaataaaataaagcccggatatagttgaaggaagaagataattaagatgaaaatcagtaacaaataatatataaatgtaaaattggaattgcttagctattagaaaaggctttaaaatgataaccatctattataaatgatcaagaagagaaatgggacaagttactaatattaggagtaaaaaataaaacatcacttcagatcttaccaaagacaatataaacaactttatgccaattaaagctaaaaatttagttgaaatggagaaagcctagctgcaaaataacttaccaaaaccaatacaagagtaaattttctaatctctgataaataaattgaattactaatttaaaacctttacagaaggaaatatcaagcccaaagacttcagaggtgaattattccaaatattaaaataataatgttaatctaaaacaaactcttccagagaacagcaaaagataaatcatttcccaatttcttttaaggccagcgtatttttgattttaaaaaacacaaaaacagtataggaaaggaaaattacaggccaatctttctcattagcatgaaagcaaaaaaaagtaaaacagctacatatgaaaagaataacaccacataatttaaactttcaaaaatcagccaacacaattcaccacattaagagacaaaaaggaaaaaaaatatggtaattttaatagatacagaaaatatactttataaagttcaacacttatttttaaaaatcatagcaaactaagaacaaaagggaatgactttaaactgaaaaacacttttgaaacattatattaatgtgaaatattagaatattcttgtttaatattagaatgccagctatcatcatgtctattcaatacaatactggagattttagccaggaaaataagaaaagaaaaaaattagaagagaccaaataaaactatcaatattctcaattaattcaaattatttacatagtaaatccaaaagaatctatagacgaagcattagaaatgtaagtgaatttagcaagttgtctacatacaatgtcaatatataaaaatcaattgcatttctttaaatatatcaccaacaattgaaaaataaaatttaaaaatgatacagtttttatcaacatatagcacctctgaacgagtaaatgtaatgagatgttcaagaattctacacagtgaattataaagtattgaaagaaattaaagaagacaaataaatatatgtacacatatatatcatgccattaaattataagctcaaagttttaagaacataaatccttctcaagttggcccacagattcaatgaattcacaaccaaaatcgcataaaggacatctgtggaaattgacaagttgattccgaaatgtatatggaaatgcaaatatacaagaattgctatgaaaattgtgtagaaatatcaaattgtaggacttacactaccagatattaaaaccttatgtacagtaattaagatagtgctcagtttgcataaggacaaatagaccaggtatttgaatagggtttaaaaataggcccactgatataaggttacttaatatacatcaaaggtatactataattaaatgggggaaaaggtgttcttatcaacaaataattaattatatatccatatgagggaaaatgaattgtgaccccttacctcatactatacacaaaatcaattccaagtcaatttagatctaaatgtgaaaaattctaagagagaacataaaaaatattttaacaaacttggagtctgcatagatttcctaaaaaggacacaaaaggcactttatcatttcataaagaaaaagaatgataaattggacaaaattaaaagtaataactttagttcaaaagtcgccgttagaaaaaggaaaatgcaagaaaaagagtgaaataaaatgtttggaatacatacatccaaaataggactcatattcagaatacatataaatcagtaaaataaataagataaaagaaaacccagaccgataaatatatagaaagatcctcaagcttcttaatgagagaaatacaaaattgaaattacaatatttctatggacctaacaaagtagctactgaaaaaaaaaatgtagagcagctggaagtaacatacattgctggtgggagtatagatttgtataatcactttggaaaactctataaaattttctactacagttaaacatatgcttattctaagatctagcaattgtactaccagttgaataaatgaaggcatatcacacccaaagtttacaaaaatgttcttaccagatttagtcataatagcctgaaactggaaagcaaactaatatccatcaacatcagagtgaacaaatagtgaggtgtattcgtacaatggatcaccatatgggaatgaaaagggataaagtgcaataacagtttccaaaagacaaactgcaacaacataaatgaatcttacaaatataattttgagtgaaataagcaaggggaaaaatagtctacgattctaggcatataagtttcacaggtgtaactaatttgtcatgataaaagtcagaggagtggttatttttgcagtgtaactgttagtgattgacaaagtccactagggatatcgatttctctacctgggaagttgtgttcactttgtgaaaattcatcaagctatgcaccctgtgagcttttctgcattgatattttatttcaattttaaaagatacacttgtataaatacgtaaatatactagagcatagtgttttttaattgtagtaaaataaaaataacataaaatctaccctcttaaatttttaagtgtacagtactacattattaactataagcacaatgctgtacagtagatctgtagaactttttcaccttgcatgacaaactttacatccattaaagaaaaactcaccatttccctctctctccagcccctggcaaccaccattttactttctgtttcagtgagtttggcgactttagacacttcacataactggaattatgcagtatttgtcccatcactggcttatttcacttagtataatgtcctaaaggtttatctttgttgtacatattgtagcatatgacaagattttcattttttaaaggctaagtatatgtatataatatataacataagcatattatatacatatatgtatatataatgttataaatgaatctcataatacatcacaagatgttatatatacataacattatatatgtgtgtgtatatatatgtgtatatatatacacgcatatgcatatgtgtgtgtgtgtatatatatgtgtatatatatatacacgcatatgtatatgtgtgtgtgtgtatacatgtatttatatatacacgcgtacatatatataacattttctttatcccaacacccccaatggacatttaggttgtttctacctcatagatattgtgaataatgctgcattgaatgcagaaatgcaaatatctctttaagatccacatttcaaattcttttggataaatacacagacgtgagattggtgggtcatatgaaaattaaattttttatttttttatgaactcaaaactgttttccgtggcaggttcactatcttacattcccagaaacagtgtataagggttctaatttctccacatccttctcaacacttgttatcttctgggtttttctttttttgttgtttttttttgtttgttttgtttttggttttgcttttttgttttgttttttaatggtcatcttaacaagtgtgaagtgatatctccttgtggttttgacttgcatttcgctgatggttagtgatgttgagcatcttttcatatacctgttggccatttgtatgccttctatggagaaatgtctactcaaatcctttgtccattttttaatttttttgcttttgagttatagaagttccttatatattccgaatattaactctttacaagtgatgtgatttgtagatattttctcccattccataggttgccttttcactctgttgtttcctttgctgtgcagaagctttatagtttgatatagtcccacttgtcaatttttgtttttgtagcctgtgctttatttttttaattgaaatttctatctgagttattctgacttcactctttctgcactggcatctttttttctacaaattatttcaagaatacatacacgatttgaactattctgctgttttttgcttagatattatttggcctagatgagttacagaaacaaaatttgcaacttgaatttctcagtcgctgcaacaaatgtgctgcttctgaaggcatatccctcaggaggcaagtatcatatagtttgaagggatgtgtcagtcaaggctcaaaaaaataatgctgtaaaaactgaggaaatttagtattatactaaagctgatggttaagatgtaaatattttatttttgtccttcccagaaacacatacataattttaaacttctctaaaatgaacactattggccaaatcctaagaaattgtgaacgacaaattccatcactaagttatcccatatatgtgtactgtatttttctcatttttattttagtgaatagaaatgttagaaagtctatcaaaataaccaaaatatacaaaataactaaggattgaccccattaactttgccaacagtcttgctctctgagtgttactgaagatcattctatcttgcacaattcaggcaagcactccaattcttcagtcactttactcctaacataccatgtgactctagaaatttcccccagcccattttacactcgcatggctcagttgaaaaatttgaggttaacacaaccagaagattgaagatgaacataatttataaaaagaggggtcactttggaagttatagtaaataggcaagggtttctcattattatactgataaaatctaaagctaggcctctttcattttggttatctgaaattgaacagagcttatattctatatacttataatgctctctgagcaattcagaaaaaaaggaggctcttttatgctatgaagaaaagtacagtttgacatttatgggtaaaaaattatatcaatgcaatagttgaaaaaatgtaggggaaagcttagatttaatttgtgtttgatcattgcattccaggtaaaaatttcatataaaaatattttatttgtaatagatagactttaaacacttatctgcaaatctgggctcatggttcctactttgcccaagagagagggttgttaagaagataataaatattacaggtaacatttattgaaaagtcattaaatgcaaacattgtgttaaatattttatctttataagataggtagtatcacagacaaatgaaaaaaaaaaactgacaggaaagataagtttttaccataggtcatacagcttgttagggcaaagaaagacttttaaataatgtttgttttatttgcaaattcatgttattaacttacctcacagagatctagtaagataatagaaatgagtgctttaaaagttatatgtcactaaacttcagttagtaaactaactgaagaggcagatctgaaactaaaatgggcattttgcatgtatctgcttttgaagcctctgaaaccagaagactaaaagagagttagtactcatcacaactaggttgtggtttttgaaatgaataatcaacataacagagaaataagcacactaagcagtatacaacatttttacaattgttaaaatgcctctgccagcagaggtggggatgactggtataacatcctgaaatgcatgtacatatagtatgtgcatattgtcaaaattctaaatgtagtgctaaagtactaagacggtgataacttaacaaaatcttatattaaagattttgtagtgggtactgagtttactgcacagattccccgcttcagggtcaaagcgctcattctcgcagctgttaggagtgttagccgctaaggcttaccatctcttggaagttgccttgaccaaaattacttcatttcttcactagggcaaactgcatccaatgatccccataggatcagctgaggcctctgttgagtgttctctaataagttcttgcatacaaatctcagagttttgagtctgttttctggggagcctggcctgcaacaatgattaatcccaaattctctcatagtccactgcatatggttcttgctattattacaaaagatgtacttttttctattttcccaatatcaagtaatggagcagtaaatcttctacacagaactgacattactttatggggctcctagaaattttatatagagtctgtacgtaacaaggcaatcacagtgaaaaacggtacaccttatgactaaaagacttttaaagacttatatggttattggcttaggagatttctttctacaaaacaaaagttttaagttataaagcatagacttaagtagaaatgtgctgtatttccctctaacttgcgtgcagctaaatgagttttttttcccattctttcttgaataaaatataaaatctaggctgtaaaatggaaataacccctgctgctttataaatctataaaaagtcatttgataagaagcaatgatttgtagtacttgtgggataatttatatcaaatggtaccagaaacttcacttcaacaaaaatttgacatttattaaccatctattatatgcaaggcactcatctgggttctgtggtgacaaataaggcgatattagactaaatacttgttgactcagttgccactattcctttccttcaggatcccataatttagttgagaaaaaagggaaaataaaaaataacacaaatacaaggcaagcagttattaaatccatgggtatgtttgttaaaaaacaaatacgaggacaaaactgaatgtctgtcatataattaatatgtttgtttgcatatatccaagaagcaggaatacatcataaccaagaaataataccaaatattttcagaggatctgtccagcctgaatgttaaaagtgaagaaaccatgctatcactgagcttatattataaaaacattttatcttttcaaaaatgttctaataaattctattcaattctaggtacaagaagctagagaggcttatgaatgaatacactgaaaggtcactataaaatgcacatttgcctatatataaaatcatcatattgcacatcagacctactccttgttctccttttcctctcagtacgtggcagcagtaattgttcaagctaaaaatctggaaatcaactctgacacttttctatacctcgccacttacatataaacaaatcaatctaatatacagtataacctattttatctcctaattatacattttcaaaagggattataccatcccctagggagtgaaaattgattatgtaggaaaggggtgcgatagttagttttatctcaacttggctaagctgtggtaccaagctgtttggtcaaacactatttgagatgttgctttgaaggtattttttacatatgattagcattcagaatcagttaactctaattaaaacagattacccttcataatatggatgggtcttatccaattaattaaaggccttaagagcaaagactgaggatccccaaagaagagagaattctatctcaagattataacatacaaattctgccttagtttccacccttccagcctctctctctttctctctctctctctttctctccttccccaccccacgtttgacaagcacaaaggtgaaaaatatttttatgtataaagtaccgatataggtactttacataaagagataagtagtatatctgtggtataaaaatttcaagaggggtggagtcaattagtacaaaagtttctaaaaagtctcctggtctctgggcagtggagaggggtgggaggagtagataataaaaaatggtgaagaaacactgttctaaacatttctttagtattagtatgtcctctactgtgtatcttttgaacactaccctagaatagtccactatttattattagaaatattgcttctaaaagggctctctgtggagctatcttaatcccccataaatgcatcttccacattgtctacctagtctatgtaaaatgcaaatttgactatgttactccttttttttaaaaccccttgatggctccaggtttgggaatctctcatttctcctccactagaaacccacaggcatggtaagagtcttcatcatttcacagaggaggatactaagatccagttaggtataatgatttccccaagttgcacaattaaataaaggcaaattccggatttaaaaccaggtttcacaatctacatatccagctttttttaaattttaattttattaaaaattttttttattatactttaagttctgggataaaataacatatcaggcattttattggaccacagtggaataaagctagaaattaataccaagaggaactctcaaaagtataaaaatacatggaaattaaacaatctgctcctgaataatctttgggtgaacaatgaaattaaggtggaaatttaaaaaatatatattaaagaaataaaaatagagataaaatatacccaaatctctggggtacagaaaaagcagtgctaagagaaaagtttatggtgttaaatgcctatgtaaaaaaaatagaaagatctcaaattaacgatttaacatcacacctcaaagaactaaaaaaaggaataaaccaaacccaaagctagcttaagaaagaataaagatcagagcagaactaaacaaaagtgagataataaatgcaatacaacttttcacaaaatgaaaagtgggttctttgaaaagataaacaaaatagccagattaactgagaaggaaacacagaattttcaaataagcaaaatcagaaatgataaaggtgacatcacaactaataactcagaaatagaaaagattatcagagactactatgagcatctctatgaacaaatactagtaaagccagaaaagatgaacaaattcctggaaacaaacaacctcccaagaatgaccaggaagaaatataaatcctaaggagatcaagagccagtagtgaaattaaattagcaataaaaaactcccctcccaaaaaagaccagtgacagagggattcatagctgaattttaccagatgtacaaaagacagtggtacaaacgctattgaaattgttccaaaaatcaagggggagagaatcctccctgactcattctacaaagccagtatcactctgatgacaaagacaggcaagaacacaacaacaacaaaaaattataggccaatatacctgaagatagaggcaaaaattctcaacaaaatactagcaaattgaatccaacagcaaattaaaaagataatacaccatgaccaattgggttttatccagggatgtaagggtagttcaacatacagaaatcaataaatgtgattcaccacataaacaaagttaataaaaaaaactatatgattatatcaacagacaccgaaaaagcattcaatagaattcaatatcctatcataataaaaatcatcaacaaacttagcatcaaaaaacgagcttcaagacaataaaagccatatacaacaaacctacagacaacatggggaaaagttgaaagcattctccctaagaactggaacaaaacaaggatgctcacttttaccacttctatttaacacagtattagaagtcctagttagagccatcaggcaagaagaagaaataaaagggatccaaattagaaaacgggaagtcaaatttttctgttcactgatgatatgtgcctatatctagaagacaatcccattactgagtatatatccaaagggaaagaaatcactacattaaaaagacctgcactccaggaattcatccatttcttctagattttctaatttatttgaggtgtttatagtattctctgatggtagtttgtatttctgtgggatcagtggtgatattccctttatcattttttattgcgtctatttgattcttctctcctttcttctttattagtcttgctagcagtctatcaattttgttgatctttccaaaaaaccagctcctggattcattgattttttgaagggttttttgtgtctctatctccttcagttctgctctcatcttagttatttcttgccttctgcaagcttttgaatgtgtttgcacttgcttctctagttcttttaattgtgatgttagggcgtcaattttagatctttcctgctttctcttgtgggtatttagtgctataaatttccctctacacactgctttaaatgtgtcccagagattctggtatgttgtgtctttgttctcattggtttcaccctcccaagactaaaccaggaagaagttgaatccctgaatagaccaataagaggctctgaaattgaggcaataattaatagccgaccaatcaaaaaaagtccaggaccagatggattcacagccgaattctaccagaggtacaaggaggagctggtacaaggaggaggaggagttttcctactgaaattattccaatcaatagaaaaagagggaatcctccctaactcattttatgaggccagcatcatcctgataccaaagcctgggagagacacaacaaaaaaagagaattttggaccaatatccctgatgaacatcgatgcaaaaatctccaataaaatactggcaaaccgaatatagcagcacatcaaaaagcttatccaccatgatcaagtgggcttcgtccctgggacgcaaggctgtttcaacatatgcaaatcaataaacgtaacccagcatataaacagaaccaaagacaaaaacctcatgattatctcaatagatgcagaaaaggcctttgacaaaattcaacagcccttcattctaaaaactctcaatcaattaggtattgatgagatgtatctcaaaataataagagctatttatgacaaacccacagccaatatcatactgaatggcaaaacctggaagcattccctttgaaaactggcacaagacagggatgccctctctcaccactcctattcaacattgtgttggaagttctggccagggcaatcaggcaggagaaggaaataaagggtattcaattaggaaaagatgaagtcaaagtgtccctgtttgcagatgacatgattatatatgtaggaaaccccatagtctcagcccaaaatctccttaagctgataggcaacttcagcaaagtctcaggatacaaaatcaatgtgcaaaaatcacaagcattcttatacaccaatagcagacaaacagagagccaaatcatgagtgaactcccattcacaactgcttcaaagagaataaaatacctaggaatccaacttacaagggacgtgaaggacctcttcaaggagaactacaaaccactgctcaaggaaataaaagaggatacaaagaaatggaagaacattccatgctcatgggtaggaagaatcagtactgtgaaaatggccatacagcccaaggaaatttacagattcaatgccatccccatcaagctaccaatgactttcttcacagaattggaaaaaactactttaaagttcatatggaaccaaaaaagagaccgcattgccaagaaaatcctaagccaaaagaacaaagctggaggcatcactctacctgacttcaaactatactacaaggctacagtaaccaaaacagcatggtactggtaccaaaacagagatacagagcaatggaacagaacagagccctcagaaataatgctgcatatctacaaccatctgatctctgacaaacctgacaaaaacaagaaatggggaaaggattccctatttaataaatggtgcttggaaaactggctagccatatggagaaagctgaaactggatcccctccttacactttatacaaaaattaattcaagatggattaaagacttaaatgttagacctaaaaccataaaaatcctagaagaaaacctaggcaataccattcaggacataggcatgggcaaggacttcatgtctaaaacaccaaaagcaatggcaacagaagccaaaattgacaaatgggatctgattaaactaaagagcttctgcacagcaaaagaaactaccatcagagtgaacaggcaacctacagaatgggagaaaatttttgcaagctacgcatctgacaaagggctaatatccagaatctaccaagaactcaaacaaacttacaagaaaaaaacaaacaaccccatcaaaaagtgggcgaaggatatgaacagacacttctcaaaggaagacatttatgcagccaaaagacacatgaaaaaatgctcatcatcactggccatcagagaaatgcaaatcaaaaccacaatgagataccatctcacaaccgttagaatggcaatcattaaaaattcaggaaataacagatgctagagaggatgtggagaaataggaacacttttacactgttggtgggactgtaaactagtttaaccattgtggaagtcagtgtggcgattcctcagggatctagaactagaaataccatttgacccagccatcccattactgggtacacacccaaaggattataaatcatgctgctataaagacacgtgcacacgtatgtttattgtggcactattcacaatagcaaagacttggaaccaacccaagtgtccatcaatgatagactggattaagaaaatgtggcacatatacaccatggaatactatgcagccataaaaaatgatgagttcatgtcctttgtagggacatggatgaagctggaaaccatcattctcagcaaactatcgcaaggacaaaaaaccaaacaccgcatgttctcactcataggtgggaattgaacaatgagaacacatggacacaggaaggggaacatcacacaccggggcctgtcgtggggtgggtggagaggggagggatagcattaggagatatacctaatgtaaatgacgagttaatgggtgcagcacaccaacatggcacatgtatacatatgtaacaaacctgcatgttgtgcacatgtaccctagaacttaaagtataataaaaaataaataaataaataaataaataaataaataaaaagacctacactcttatattgactgcagcactattcacaataccacagatatggaatcaacctaagtgtttatcagtagataattggagaaagaaaccgtgtggagaaagaaagaaaatatgaaaaacctactcggtacattcaggtgacaggtacttaaaagcctagacttaaccaatgcacaatatattcatgtaacaaaactgcacttgtatcccctaaatctataaaaatgttttaaaactttaagaagtataagcactaaaccaaaaagtaagtcccatagcctgtatctaggtactggaaattgaacccaggtctattttactacaaagactgtgcttcctcactacactctactgtgctatatataatcacttaccatccaccctctgaagaatgaatcctctcccacctttttcacagagcctgttctgactactctagcccaagccatcttctttgttctaaaatctcatagcattttcaaattttgctttgtgaaatgtctataatgttacaacttttaccttcatgttggtacgtaggtccttgtgaagttgttttcctactcaaaaccaggttggagaggagtacaaaatagcagtgaagagcttggacactggagtcagtctgtctgagctcaaatccaagcacaactgatttttaatctgtgtgaccttgggaaaactacctgatctctctacgcctctgtttcatcatttgtaaaatggacaatagcgtttaacacatagagttgttgggaggattaaatgaattcatctatataaagctatcagaacactgtctagcacattagtcatttaactactgtggacaggagtttgctatcttcattttttataatactctttccagactttgaaattaaaccttagcgttacgtccatggaagctcaaggtagatatgtaaaagaacttcccattaggatgacgcagtcactggggtggagattaccctggttgcataagttgactccaagccaacccagacaaaatgacctaaaagtaaagcagatttggctgtgaattattaatagtaagaaaggctattataatgaccaaatgtgatgtgtagaaaaactactttatagataataacataagtgaatgttgattattatttgaaagcgacaatatgataggcatctcaagaactggatgcatcttgttcatatggaatataaaccttactttctctggaaatatgcaagtgcttcattgatgacatctgtggacatgccaaatcattgttataaactttatgacagccaactccaaaagaatttatatgtttccactaaatgaaaaaaattcaaacataaactgatccttgtatcttgaaaaaaatcaggcactctagggaagaagcatgccttaaggtctaatttcaagagcaatttaaattctggcgattcatatgattagaataaactggaccaagccttgaagccaaagagttctttaagtatccttacatctctctcttgtgttcagaaatggaaaacatttctctaaaaatgcttttctaaaaagaagcaaaaatcatcctacccagtttttatgcaatctaccaaacaggtgaaaattaacttcttcatacaattcagtccatgccgcaacacaaatgaaatgagaacgcatttaatcttagcatccctatgtcactcaaaggtaaaaatgtgagcatttgtagattgcaataaaacatgaatacaaaatgatgtgtattccctcttcagttcattgtcctcattgttacaattgtacctgctacagaaacaagagcttattgttctcttacattctaatttttacaataggccatcttatttacttcccttgtgcctaaggcagtccttggcatatagcagtcactcgtaaatgtggctgaaccagggtatacagcatcaccaccacttcaattcttcctgtgtccatggttctcacacttaagcatgtataaattctttgagtcctactgtgaaaattttactacgctcactctcccctcaaagagattctgaatcaagaggtctggattagaacccagggatataaaactttaaacaaacattctaggtgatccaaatgcaggcattcagcaactatattttgagaaacactatcttttggttaatttcttaagtattgatgataatggctaacatatatttaacacaccctccttgccaagggctttaaatacatttcgtcatttaattatcatggcagtctataaaacagattactttcatcacattttgcaatgaggtaattaggacttggagaggttaagtaatttgtcctaggttacagcactaatggaagagaaagaatacaaacccaagtctatgggattccaaagcccataataaatacacttggttgcaaagagtaggctgcatgggctgccaacagttgtctttagcaacatatcggtaaatgccatctacaaatctggctatgaaaattgatcagtcattcagataaatgacatttcatcatttgatagcatcaacagatattttggatgatgggtcaaaaaggtctcacatcccatcaggctacaaaacaacaacctaatgcattcaaaatgaggccattcagtttttaatgtcaaaaataagagcttttatgtggaatgacaaggtatttattagatactagtatttgtattccattaactaaaatatgaagaacaaagatggccaaaacacattttatcatattaaacatatttcaaaattttaaaaatacatattttccctttgccatattaacatagcacagattaaaaactgatatattcatacagacagacccctaaacctcttctttctcaccctgtttgaggtcagagccttagaaagcacaaggaattcccttccaggtcactccagggtgtcctttgtctcctctgtgatggtgaaaacaaatggtggattttcagcttcactggaaatggcacagagaaagaaggcttgtgccatggtagtggctgaataaccttttaacaagttcttaacctttcttatcaataaaattgaaatacaaatatccatcttaaaagattattatcaggattgcgtaagtaaattcaggcaaaactcttaccagagttcctagtaataaatggtggtagtaagtattgtgttcttggtgtcttcttgcccactcatatccatttgctttcagcctttcactagtaccacctgtaaatctagttgaagttgtaccttcttactacattgtgatatacaaggtagcacatcagtgggattaaaactaaatattagattaagtctttctgtcaaagaatattctttctaaggtttcaagaagtaggatattgaattaccattcaacccagcaatcccactattgggcatatatccaaaggaatataaataattataccacgaagatacatgcatgaatatgtttactgcagcattagtcacaatagcaaagacatacaacctaaatacccatcaatggtagactggataaagaatctgtggtatatatacaccatggagtactatgcagccataaaaaagaacaagataatgtcctttgcagcaacctgaatgtatctgaaggccattatccaagtgaaccaacacaggaacagaaaacaaaatacttcaggttctcacaagtgggagctaaacattgagtatatatggacacaatgcaaagaacaacagacactggagcctacttgagtgtggagagtaggaggaaggtgaggatcaaaaaactacctatcaggtgctatgctcattaccaaggtgatgaaacaatctgtacaccaaacccctgcaacatgcaatttacctagataaaaagcctgaacatgtactgctgaacctaaaataatttttttaaggtagaatcttgagtccccttgggattgaatcttttctctaaaacttctcagacacactttcaccacttctaagcctttatacagcttctcatttctaccacttttttgccagtgaatcagcaggtgcttacaatcaggaagtaatgacctgccttatatataatgagcagggaggaaattaatcccatcaagacacaggctagaaggatgagataattatctacttttccttttattctgtagattcgcaatagctgggaacataccttctaaaaaaggattcatccttatatacatttatctgtaaaaacttgggccataaacaacagaagatcatttctgttaacagtagaagaatactggacatcaaatattctcttaaggaaaagagaatcaaaaacatcaataggtttgtaaaaggtagcaatgctgctctgggaaatgtcttcaagaatataggaggagacttgaggcactggcatatgtttccctctaacttcatgcttttgtgcggaggaaccatgactgttacctactctatccccagccctagtacatgcatgaaaaacagtatgtgctaaatttgaatttgattaataaatggaggaacaaatgaacaagtaaatctagagagagatgctctatggcaataggccctcactgaagttacattaagcctaatttagcctacttgagattaccatgctctcctttccattgtttactaaattagaactaaaaggggaggcaggcaatctaaggaagagaaaatagcaacaggcaataaatgcatgaggatgttcagccttacacatgaggagtaacacaggacattcaaaataaaactaaaatgggatgttattttatctaaaaagaccggtacaaattaaaaacttgtatagcataaaatcgtggtgcatatatgaggaaactgatattgttttacactgttagtgaaaatgtaaatttgtacagccactttgcaggttatctttggcaatatctcttaaaattttaagtatgtatactcagtgacctaataattataattctaggtataagaagacttacctacatactgaaggatgtgtgtctaaggatgttcattgcatcattcctaaaatctgtgaaaacttagaagcaatctaaatatttaaataggaaataggtagaaatgtggtatagccaaaccacttaataagcatgtattcagtcacatataatgtggtaaatccaaatatggccaaatagatcttgaaaacattttactgactgaaataagcaaatttcaaaaaaccccaaattacagagtataccactatttaaataagttactctatctctttctcacatacacatatactcacatatgcacacaactgcacaattatactatatattttctgagagtgtatatatatgcatatatgtgcatatactcccaaaaatatataattttatgtatataggtatgtgcatacactcttacactctcagaaaatatataatataattgtaatgtgcaaaaaccaaggtctggaagaacacatgccaactgatcacagtggtaacctctgggaataaaactgattaggtgttttaatcaagggcaacttgtctacaatgaatttaattattgtaagtagaatgtagtcatgtgttatttgtgaaataaaaattatacaagggggatacaggaacaggaacagcaacacgccttgccattttacttagcaattatatttagagctcccctactttgatgatctcaagtcatctggtaaatgaatttatttactcacacattaagcttgttggtcaatctttcatcaaagtaataatgaatttttaccatgtgtcagaaagtatgctattacagctagagatacacagatgaataaggtatgtcctggatgtcaaaaagcttatcagtcttgcaagagttttgaaattccattccacatatgaaggaatcacagtatttttcctcactctggtaagaagcaacatgtatttgggttagtctgaaaactgttgattaaatgtaccacatgagatcaaaaccatttaaattaagaattactgatacctaaaaaatgggtacatgctggcaaacacttcctgatgagttcaattttcaagtttcattcaggaaacagccaattaactttctaaactttattcatccacctggaggcaacaacccggaaatggtttgacaagtccttcaggcaccaaacctgtctcaaattttaagagtgatgccatgtgtcacagacataatcaaggtctgccagagaagtaactgccttgaagcatcagcttccaaatgtggtcctcctcactgacgctcagcaccctctgggagactagtcatactctggcacactcagctaatctatctagagcattcctctgctaattgctaggcaggcacatgtacataaaagggactacagagaagcagtaaaggcctcattcaaaccacagaagctcacagattctcctctctggtactttaacgttggcttgtcccacaaaccagagtgaaagatgaccccttgactggcattatttaccttccatttaatatctgctgagctttcattatgtgcctggtactgcatttagcactgaagacacagacatgaccttgtcctcagaaactcccactgtaatgaagacacccattaattcattctacatatatttatttagtgttgtgctaattaccaggcacataaagataagcacctcagttattgaacctcaaagaaatcacaatgtaatgaagggaaagagttgccaaaaccatgtctcaaatatctgtgtaaccacagactaggacaatgcttggcacaggctcagcagttcaaagatttttgactgcatgagtaaaaccacatatgaaaaatcatgtctgtacaaaaatataataacaatgatcaccataaaaatgatatgaaaaaaggtgttgtggttagggttagagtttggaaaaaaagaacacctgcgttaaggagcatgtgagttaaggtgataaggaagactcctcataggaggttaatgttcatctggtatatgatttcctattaagaggcccacataggaactaaaaggagtgataggaacaaatttagaccaagactgcttcaaaaagcctatgctagtggagttgtttggcaataaaatttccaagtgcctgcttcttaaatttttttatgttgtgtcttttcttccaacttatttgctggaacttgaaaaaaacagatataaagttaaaagcacaaaatttaaatgccagtgaatggaaagttgaacctcactcaatattaatgcaaatctataggttaaaaatacatttaacatcataattgtcaaaagttataaaaatgaaaaatgtgctactgcacatataatgtcatttttcaagttcaaagctgacactatttttatctctgtgtggggaatatgttcaaagaaaaagagaagaaaaaagaaaagtcaagttcttttttcctgcgttacatatgtagaccagttcttggcttacagtttccatttatatttagagggatagtctccattatatatgaccaagacatgccatctctgacttcaacaaaacagggttgtgctgtctataagaattattttgcatcattcaacaatcatgtagaatccaagaagctgtaaatgctaactaacatgttatagtcctgggctaatatatggaatattattttatttccatttcaactttaattcaggtattattaccttttttacatttccatttattcaacaaacattcatggaacacccactgtgagtcaggtattgttctatggccatagtaaaaaaccgtgcaaaacaatatatcaaatcactgtcctcataaagcctactctattgggggaaataaacaggtaagttaatatctagtatgtcaagtagtgataagtgcaatggagaaaaataaagcaagctgaaaatgacaggcagtgtgtgtggactagaggaagggtaatatataaggttattgaggaaggctctactaacaatgtttaatctgacctgaaggaagtgagcgaactagttatgtgaaaatctgaaagaacattccaggcagaagaaaaagcaagtgtaaaggctttgaggtaggagcaagtctgaaatgctcaaggaggactgcatgactggagtgaagtgaaggaaaagggaaagtagtaagacatatagaaggggtacatcttgagatgtgtaggcaacaataaagacttcagcatttcattttagtgagatggaaactcaggtgaggattcacagaggactgaaataacctttcctgtatttttacagcagattattagggtcaagagctaaaaagcagggaagacattttggtaggagaagaagaaacaggagagagaggaatggtcttgaaaccaaataaagaaatttttcaaagaggtaggaatattaaaccttcataggttaagatgagaactgagaattcatccactggatttgtcaacataaaaattattgttaacctagccaagagtgatttgtcatagtagtagaaacaagatcctaaataaaatgcgttcaagttttgtaaaccaaaagtatctaagacaggtcttaatcaatttagaagtttattttcccaaggttaaggacatgcctgtgacatggcctcaggaagtcctcagaacatgcacccaaggtagtacagcaaaagctttcttttatgtgttttagggggggggtctgagacatcaatcaatacatataagtggtacacttgttcagtctggaaaggcaagacaactggaagtggggagattgttgcagggtggctttcaagtcctaggtggattcaaagattttctgattggcaattgtttgaaagagtttatctaaagatctggcatcagtagaagggagtgtctaggataagataagggattgtggagaacaaggttttcattatgcagatgaagccaccaggtagcaagcttcagagagagtagattgtcttaaggtctctgttttaatgttgatgctggtcacttggtgcctgaattccaagaggaggaggatataatggggcatgtggacaacccattcccatcatggcctgaactcatgtttaaggttaactttggaatgcccttggccaagagaagggatcaattcagttggttgggggaggcttagaattttttttttttttttttttggtttaccttatccccctctggccaagatttgccagaggcaacatcaatggccaaacttttattctgtcccatagcatttccaaggcggcacagctgcctgctctgggtctatcctgtcccttggtgggaccgctatggccaagtgactttgagccaaaagacctatagctaatttaagtgttcaaagccagatgtgaatggaggtggacaggcattcatcaaaccttaagatagaaaagccaacaaattagccagcttaggtttacaggcatgtgccaccacgcctggctaattttttgtacttgtagtagagatggggtttcaccatgttagccaggatagtctcaatctcctgagcttgtgatccacctgtctcagcttcccaaagtgctgggattacagacatgagccaccacacctggcccactaggtatcttgatatcctctcagtaattttctttcagttagaaattccttatgattgagacggatggaaaggggccatgtaaaaacccaggaggcaaagtcccttattttgccagctatttaggcatctatgtgtctatccttgatttgaagaatttcaactaattgtatccctcaaaattggcccttacaatctcacatgcccacctgttctgtgatagtacctgaaccaagagggataggtgcttttatatttttagtagtggggtggggcattagcaatgaaaataaaccaggtccagtaagattttaaaaggttttaaattgggaggatatcagctagaaaggaaagaaggtaatcttttcttgtttgtttgtttgttttcactgattttgtaagctatatagaattagcaatgttttttaaaaaaaggacataagctttgtctagttttgataatgacaggtaaagaaaactcatgggtagctaaacatttaaatgatctaatattaactcatagaacaaattatattaatttagacagaggaaaaattattgaattagcattcacatctttatatagaggcttggctcagtgtcatatgagagcagtttattttagctgtcatcttctcccaggtctgaagatgaggcttcggttaacttgaatttcatgccagatattggtgatgttcaagattcagtagaagtcagtgctcctttctagatgaggtaggtgtatgcagagtcaaaacactgtaacttaataccacaaagggatagttaacaatattttatatagaccctttttaatggggcagagtggagtctctcaattgttgtccaatcatcaagctggaggtggtgtttactgtatcttagttggaaaccatagaagaattctgtaaccttggggtgattaatttttctatttgacaagcctccagcaataagtctaagtcagagagttaatttaggatttgaattgaggatgtttttcaaagatgttaaaaaggctcaaaacattttattaaaactacattatataataataatttgataaagaagttatgtgggtataaattcttaacccttttaaagtttagttgatttttttataattaaaaacctaataaaaacaaacaggaattattttgataaaacattaaagctttgtttctttgtctaattaccaaaaaggaaaaaataaagaccctctgcagtgacttcttttccttatgcggagcccatttatataacctgaaagtcaaacctgctgaaaagagcaattgagttaatcagacatgggaatagtgtgtccggcatcatgagtaaactctatattatagcagccttgagcagagaatacgtgagtcttagcaacagcatgggaagttgcctgattatattgaacacttaggatatatgttgggcctcaaaaacaataccgcaaagtgaaagcctcagaagtaaaagttttactttggccttcttttgcccttctatcttgcagtttctcaaggctggccataaaaactagaatcttgcttctcaaggtgggtcctagaaaccagaactccttttcctcaaagccagtcataaaacctaaaaatattactctaatttttctcaaagtagacgcttaatgtcctgcaggacacccagctaaggacattgaggcaagggtggagacaggtggtggctggtcttgcagtagactgcccaaggtccaattatgagctttttaactgcagcaactttaatgtaagctattggagttggaattactgtggctgctggcaccagaattgccctccaatattccattattcttagatgtgctatccaagcagctagggcctgctgtgaaatcttaatttttcctccatccttctgtatacagctgtctataaagaaatcatctgaccttacttgttgtttgtaaattatgagacccctgtatccaggaggaaggaaatgcatacttggggaggttaagaagaatctagacaaacaggccttgctgagtttccccacacaggctactggcaatgatttatacacttgtgtttcatcatatttttaatggctatccatagtttgttgaacttaaccatttaaaaaaaatgggcaatttctcctgtatcttaggtctttattctgataactcccagatatacatgccaaaaaaaatctatgccttctttttgatcaatttgtcttttatgagttgatacctttagagggctcctgctccctaaacacattaagaaaaaacaagaatacagaattaagttatactggaggaaaatactgctttttttaaaaaaccttcaaactaaagcatttcagcttcaggcaataacaacagacttagaactggaggagggaaagaaaaaaatgttacaggtgccaacaaaaatagaaggggagagttgccattccaggccttctcaaattttctcatagtaaaaggtgatctctggtgcctcccaaagccaacaaggttgggtaaggcaatacaagaaagcagagctttagacgtgagaagaatctccccatgactgtttaaactccaccaaaaaagcagaagaccctaaaaagaggtaagttgcacctttatatgagttctttaaggggtcagagtcattagaagccttctcttgattgttttttcacttggtaacaaagacagcaaaaagggaaggaggaaaaaagtggaagaaaagtaaattaaaaaaacaatttttttgagaaaggaaccaaacagagaaaccaagcacatggttttttcttttctttcttttttttttttttttttttcacctgaggaaaattttagccaactaagaggccttgttccccacaatttagaattcttattctgatttgaacaagtataattggtcaaatccaatgaaagaaagttcaaaacaaacaaacaacaacaaaacaatacaattactgagccattctctaatggtaaagagaaattaagacaagttggttgtttatcttaatttttagccattaaggaaaattttcaagataaaacctcaatttagccacttaccaaggaatggggcccagactcaagaccaagactactgtctaccatctcagtagcaggaagaaactcaaactcaccctccctgttggaagtgagctaaaactccagaaatgagttgcctgccctccataatcatggaagcaggaaaatttgtcttccttgttgggagggagtaaaactgcagaaaagcagttatacagcaaaagaaaccttagatctcaaccaaattttggaagaccagggtttctctgaatgggggagcctcctgggtatcagaacctgtcctattggtttgagcaataaagacagcccaagctggtaccaagcaccaataggagatttgtcaaaggtcagggcctcctccatgcagtgtcccttccattggtcaccaatttgtaaaccaaaagtatctgagactggtttcaatcgatttaaaagtttattgtgccaaggttaaggatattcccatgacatggcttcaggaggtcctgagaacatgtgcccaaggtggtcaggctccagcttggttttatatgttttaggggaacatgagacattaatcaatacatgtaggatgcacagtgacttggtatggaaggtaggacaactcaaagttcggcaggggggcttctaggtcataggtagattcaaagattttctggttagcaattggttttaagagtttatctaaagacctggaatcaacagaagagagtatgtgggttaagatgatgggttgtggaaaacaaggttttcattatgcagatgaagccttcaggtaacaggcctcagagagaatagattgttttaaggtctctgttttaatgttaatgctggtcagttgtgcctaaattctaaggggaggaaggtataatggggcatgttgaccacccattctcaacatggcctaaactcatgtttcagattaactttggaatgcctgtgatcaagaaaaagggtccattcagttggttgggagggggcttggagttttatttttggttgacaaaataaaatgggaagacaagaattatagacacagaattggagtacaggtacttatggattttgctctaaaaaggagcagataaatagagcaacagctgaaagagtatgtgggataaagtgatttttaaaataaaagatattccaagaaacacttaaaggatattatccatagaagaagaaaaattgattatggatgaaagagaagagaaagtagagaatttctggagcaatgttcttatgtaggaaagaggagatgaaacctagcacacgaggtatgggaagtgagctcaagtagggtactagaaggaaagtcagaatatgtggtacagatgcaggcatctaagaaaatatggaagtaggggctggtaaatgttcttttctggtttcttttacattcttagtaaaatagaaagcatgaatttctgttgagagcaagagtgtagttttgaggaaagtgaagatatgttatagtccatttatctgagttgagaatacataagctagaaatataaagtagcattaagggtgaccctcagagtccccctgatatgagtagtatcaactaaaagtgtaaccagtcagcatggttttgacagacaaagatgttactggctaatccaaggactcataactagtgagcagctctatatcggttgccatttttgtcatggtaaatccatatctcctcccattatccttcaacaatagatagacataacctaccattccacctgtgatcacaaatatatgagatcattcagaatagagactgattcacctggtgtttccggtgactggcacaatgcttagcacatagttgtactcaaaaatatctcaaattgagcaaaacacattttcattagagaaagcacgagtttctcaaaatggtataaattttgaatgtcgaagatagcctctcaaagctatgcaaatatagcttgagttgctgaaataacatgttctccataaactgttagtttggtccagagtttgaaggtctacctaccactcacactttgtatatctacctccaaaggaaattttgattctgattctgttggttattttttcacaatcatgcttatacacaatttcttaagacactgcaatagaaacagaataaaaattacaattttgtccactgtattactgagaaatatgaggtagcatttgcagtcttactctggtactgcactgtaccttacttggactgccatcaatccatactgttatcccaactcaacaaagcagtccatcatcctatacaagcctttttagttatgggcttctaaaattagtcttagatatatagaaactcctagatactatctcaaggacatctcatgatgctagaaactgctctttactcctctaaatatctgcagaaaaactgttcaattcccttcctttgtaacttaacatttgttgcctataattgttcattatctttgtgtgtttgtattttaccttcccaattagatcatgaatttatttgtaacacagtgaacatccataatatttataaatattatatttttaccaaatataacctacttattaaaataatgtttattttaaaagtaggaatgagaaaagaactagactaagactatcatttatcaaatacttatcctgtaccaggacctatgttgagagttttacacaatttaattacattaatatggagataacattttacttccatcttaactctttttgcaaggttaaagatttagcaacttgcccaaggtcacacagctaacaggtatttgaactgtgactccaaagtcagtgtccttaaacactcactacattgccttcctagaaaagtgctttttatataacagataataaatatttattggatgagtgaatagttttagcagcattattgtcaattctatgtggttaggttgtaattaaaacaagctctatgtctatcctaagtggttaggttgtaattaaaacaaatatatcatgagtattctctagttcataatgtctttatcccccaaaaaacttttgcagttgaccttaagtgccctagacaaatagaagatatacacttaatcagctattttttaaatcactcatatttttataatttctacctgcctggctttccataattctaatgttttttccatacttgagatctcatttaggctacagtgtaaatcagtagtgccaagggtctggaagccatccatcataatcaatttgatcttatttttagtataattgagtcaaagttacttatccaatttcttttagggtttccctccatgtctgacactatgcatagaatcttactcatcaaataaactcttctgaagaatccaaagtttatggaacatgggatgaaaaacaatagttatagaaagtgaaaaaacatagttatcttcagacacttggtatgagcactacactagctaatctgtaatatgaaatctgaaagtaaaataaaacctagaggaagaaaaaaataaacaattaaatgaagacagagcagccagaagacacaataatgttaccaaatattgcttggcatgaagacctagtagctcccaaaattcaactctgtctgaagataaacaattcagttaagctaaagcaacactccaaaatcaggaaggagaggcaaatcacacatatctataagccctatgcatcttcctagtatgcattactatgtgcatacatacataaatgcacaaatcatctaaaggtcacgggatttgactcttcttttatgaagcagtttgtttcaattaattgactacggcatatcaatcatagcaagagtggcaagtaaatctaaattgtgaaatgccataaattttcttatagcacaaaagcaaattgaaatatgaagcaatgaaacagttcagaatacagtaagtttaacataatacgaaagcttagtacatgtatatgtcttttgttttttaaatatctttgtgttcatttccatatgttattttctcaatagccttttaaggtcaagctgtctcattcctattgctctgttcattcatttgctcattgtgattcatttttggatgaattcatcattaaacaaatatttaatgaactctatgcctcaggcattatgctaggtactaggtatatagtgaacagaatagacaaattcctggccattacagagcttacaacctgtaatgtaatttaaaagctaagcaaataaaggtacaattacaaattgtgataagggtttagggaaataataagtaattaggagtatgagagagtgaaacagtgagagagagagagcccctaggaggaatcccatggatagagaagccatctctaaaatgattaacacttaagttaaaatgtaaagactaaaaggtgccagtctttcagtgtatgaagaatgctccaggcaaatgagacagtgatggccaaagcccttaggcaagaagcccttgagtcttccaaaactgaaagaaaaccatgtggctaaaccaaagggaaagactgtcatgccatgaactagaggagacatgcaaaaaccagatcatgggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaaaaacagatcatggagggatttgaggacactgtgttaaggaatttaaaatgcattcttagtacaataaaaagacattaaaatgttttaagaaaggaaaaagggcaagattattagatttatatttttcaagttaagctagtaggttgatgtgtgaatagtgtattgttgtaaaataaagtgatcaagttaaaatgctattgtttgtagtccaggtaatagatagtggtaacttggactctggtagtattagtaaatatggagacaaatgaatttgagatatgccaaaaatgatgatgggttgaatgaagaaggtaagggaaaaaaagtcattaaaagaaatactcaggttctggctatagcaactaggtaaatggtgaaacaaagcgacctgagcaatgggaaaggtctttcccaagaaatgaaggtaatcgacagaatcaatatatatttctgttgtgtgagcctttcaaatttcatgcatttttattttaagagcctctactgagcatcttataaatgctaaatcctactctagcctctgagaaatggaagctaagtaagattcagcggctttgcactaggattcagactggggaagagaatcatataaacattcaaattttcttccatgtgattcatgttacaataatctggtaggactcaacagagaaactagaggtcaggagagacttcaaagagatgacatctgatcaagtcttcatgaataaaaagaaagcattattttatttgaataaggtgaggatagctacttctgtattttattatattaaacaagaaattttgtatttcccctgcgttcccagtatggaatgtctaatatttgatacatgcttaatatacccctttaagcttgttaaagaaaaatcaaaatagaagcccaagtttagaatacccctattttaagcactagaaccacacagtcaaaacttaagtcatcctaatttcctctaaacactacctctaataataaacaaaacaaaaagcaagctttatgtccttgtcagcatggttcagtaacattaaaccaatcagttatacaaaatcagcttaaatagctctgcttaccataaaataaggggtaatatagtagacaatcacaagaaaacctaaaaatatctcctcttttatgctttataaactatgctgtgagtgttgcgagcagagctccttaccacttgagggtccaaagtctcccagtttgagaactattcttttgtatactcagtaaacttctaattttttttttcaatttcaacttttattttctggacgtacatgtgcaggtatgttacatgcatatattgcatgatgctgatgtttgaggtgtgattcatcccgtcatccaggtagtgactgcagtactcaataggtagttttccaagcctattctcctccttctctccccaattctagtagaccctagtatttattgtccccagttttatgtcaatgtgcatccaatgtttagctcccacttataagtgggaacatggggtatttggttttctgttcctgcattaatttgcttatgataatagtcttcagatacatatgtttctgtaaaggaaatgatttagttcttttttatggctgcatagtattccatgctatatgtacctcattttctttattcagtccactgttgatggacacctaggtggattccgtgcctttgctattatgaatagtactgtaatgaacatacaaatgcatgtgtctttttggtagagcaatttgttttccttagactatatactcaataaagggattgctgggttaaatggtagttccaattttagttatttgagaaatctccaaactgctttccacagtggctgaactaattacattcacatcaacagtgaaaatgggcaaggacatgaacagctgcttctcaaaagaagatacacaagcggccaacaaaaatatgaaaaagtgttcaacatcactaatcaacagagaaatgcaaatcaaacccacaatgagatatcaactcacaccagtcaggatggctattattaaaaagtcaacaagtgacagatgtttgcaagactgcaaagaaaagggaacttctataatgtttaaatttgatctgattttatttctgacaagtttcataaacacttagtaacccctattttgggcataatattctattatgcattatggagctatgttctttgtccctgagttgtcctcttctgttgcagagattaggcacacatgtatataagagtcagagaataatgctaccatgagataaaccagtggggatgatgtgatggagactgcctctatataaaagctgaggggattcaaaacaaaaaacaaacaaacaaaaacactgtagagtgggcttggttagaatgcagtttccctaatgggtaaaactttcatttactctctgaaggaactctaggcagtctcacctcttttctctgtcatcttttcctgctattctctataatgatatttccaacatttgatccccatctctccacatccaatggtcagcaattgacctcccttacttcctatttcaaagagtaaatagaagacatcccactggacgtctctcaatttcccaccataaacatacacatgcactcatattttcacacatctgtacttagatacatgacactaaccatgacaaatactttttggatctcatccattcccatcttctggggaaacatttcttatttgttaggtcttctctcttaacttctcctcaacaatatctcattagcatttttcaatgaagggtaagcttgtattagtctacacatatataggcatacctcagagatacttcaggttcagttctagatcatcacaataaagcaattatcaccaaaaagtgagtcatatgaatttttttgtttcccagttgtcttagcccatttgtgttgttacaaagatacctgacactgagtaatttataaagaaaaaaaggcttattttgctcacaattttgctggtcagaaaactgggcatctgttgaaagcctcaggctgcttccatttatggcagaagacaaaggggagccagcatgcacagagatcatatggtgaaagaggaaacaaagagagacagggtggtgccatgttctctttaacaatcagctctcatgggaactaatagagcaagaactcactcattacagagaggactatgccaagccactcatgatagatttgcccctacaacccaaacacctcccatttggttccacctccaacactggggatcaaatttcaacatgaggtttgcgggagataaacattcaaactatgccaccagtgcatataaaagttacatttatactacactgcagtctattaagtgtgcaatagcattatatctcaaaaagcctttacttaaggtatacatttgaattaaaaaatattttattgctagaaaagtgctaaggatgatctgacccttcagtgagtcacgacctttttgctagtagaaggtctcacttcaatgctgatggctgctgattgatcaggatggtagatgatgaagactggggtggctgtggcaatttttaaaaataagacaacaatgatgtttgccacatttattggaatttcctttcatgaaaaatttctttgtagcacatgacgctgtttgatagcattctacccatagtaaaacttctttgggaattggagtcaatcctcttgaattctgccattattctatcaactaagtttatggaatattctaaagactttgttgtcgtgtctacaatgttcacatcgtcttctttagaagtaaattttgtctcaaaaaaacactttctttgctcatccgtaacaagcaactcttcatctactcaggttttatcatgagattgcagcaattcaatcacatctttaggcaccacttcttagtctagttctcttgctatttccatgtctgcagttacttcctccactaaagtattgatcctctcaaagtcattaatgaaggttggaatcaatttcttccaaacttctgttaatgttgatattttgacctcctccagtgaatcatgaatgttctcaatggcatctagaatggtgaatctttactagaatgttttcaatttactttgcaaagatccctcaaaggaattacaatctatggcagcaataggcttatggaatgcattttttaaataataagacttgaaaattaaaattactccttgatccatgggctgcagaacagatattgcgttagtaggcatgaaaacacattaatctccttgtattcttccatcagaatttttgagtgattaggtgctttatcaataagcagtaatattttgaaagagatctttttttctgagcagattacaaaagtgggcttaaaatattcagaaaaccaggttttggtcataatcccaaaagacacaatctcagatgccttagtcctgaatgttataatcccaaaagataaacatcctgaaagtctaatatcctgataaccacaatcctaacaaattaaaatctcaaaaatataattctgaaaaaataattttaaaatttatttaaaagacacttatttacatttttaaaagtggatttgagaaacatacaaaaacatgacagaacacttcataggaaacattacacaatgaaataggcaataatacatatatattttggcaaacatgaacacttagggatactaaagacagttgcctaggtaatttttgcaagtacatagcaagcgtatatatttattgagtacacgtgactttttttttttttttttcagacagagtttcactctgttgcccaggctggagtgcagtgacacgatctcggctcactacagcctctgcctcctgggttcaagcaattctcctgcctcagcctcccaagtagctgggactacaggcatgcgctgccacgactggctaatttttgtatttttagtagagatgaggttttaccatgttggccaggatggtcttgatctcctgacctcatgatccacctgtcttggcctcccaaagtgctgggattacaggcgtgcaccactacgcccagctacatgtgatgttttgatataggcatgcaatgtgaaataatcatatcatggaaaataggaatatccatcacctcaagcacttatcctttgtgtaacaaacaatccaattacactccttttagacattgattttcgactgtggggtgagttgtcacccctcgccccctcattgttcaagggtcaactgcaacgtgttttgttacactagaagaacttctatatcagcaagtgttattgattcagaaggttgccgggcttgttgaaatatatttattctctgacaaaaaacaattttgaaggcaagcactggcattatgtgtcaaggggcagaagtcatacacaattcaatcatttggcaagggagtttttgttttttttttgtattttttgtgtgcattttcacttctataatcttcaaaaacacttgaaacatcaagagcagatattccccacccagtacactcagactcacacactaatctcctctggaaatatcctcacagacacagcccaaatagtgctttaccagtgtattagtctgttttcacacttctaataaagacatacatgagactgggtaatttataaaggaaagaagtttaatgtactcatagctccacatggctggggaggcctcacaatcatggtggaaggtgaggaagagcaaaggcgtgtcttacctggtgacaggtgaaagaacgtgtgcgggggaactctcgattataaaaccatcagatgtcatgaggtttattcactatcacaagaacagcacaagaaaaacctgcccccatgttcagttacccccgactgggtccctcacatgacttgtgggaattatggtagctacaattcaagatgagatttgggtggggacacagccaaactattatcacccaggttttgaggtgtccattaatccagccaattgaagcctaacactaattccaccccttatcaacttgggatccattgcatctcaaaccatacttaatttccaaataaagacaataacaaggtataataatagttctgccaccatgatgcaactaatatgatgcagctatcctgcatacaactgaaaattcattaatccctttcccagaattaagctttcaagatttcaactttaggattttaatctttttggatttggatcttctgagatttcaacattggaattatggctttcagaactgggactttcaggattatgattggcactacagtaaaccatgctgtcatccaggctttgttcttccaattctagaaaataggcagagtagatttagcataattcttaagggcccacaattttcaatatggtaattaagcagtggcttaattttcagtatggtaattaggcagtggcttccacttaaagtgaccaggtccataagttcctaacaagagagtcagcctgtcctttgaagtgacttttcctctttatctatgaaagttctaggtagcaccttctttcattagaagactttttttcctacattgaaagtctgttgtttagtgtagccaccttcatcaatgatcttagctagatcttctggataacttgctatagcttctgtatccactcttgcttcttcaccttgcagttttatataatatggatggcttctttccttaaacctcatgaagcaacatctgctagcttgcaacttttcctcttggtcttcagagaattaaagaaacttagggccttgctctggattaggctttggtttaagggaatgttgtggctgttttgatctatctagacaattaaaactttctccatatcagcaataaggttgttccactttcttatcattcatgtgcttactggagtagcactattaatttccttcaagaacttttcctttgcattcacaacttggctgtttggtgcaagaggcctagttttcagcctatcttggctttcaacatgccttcctcactaagtttaatcatttctagcttttgattgaaagtgagagaagtgtgactcttcttttcacttgaacacttagaggccattgtaaggttattacctgacctaatttcaatattgttgtgtctcaaaaaacagagaagctcaaggggagatacagagacaggggaatggccacttggtggaggagacagaacacacacttttatcagtgaagttcttgatcctatatgggcacattttatgacaccccaaaccaaccataatagtaacattgaagatactgatcatgtatcaccgtaacagatataataataataataaagtgtgaaatactgcaagaattaccaatatgtgacagagagacatgaagtgagcatatgctgttggaaaaatgttgccaatagacttgctaaacacaagattgtcacaaatctttgatttgtagaaaacacagtatctgtgaaattcagtaaagtgaaggtgcaataaaatgagtcatttttgtattgtaaacattctcttatttgctcttcaatccctaccactttattgaaactactgtaacaatgactttcttgttaaataatctactgaacacttctcagtccttaattcagttgttttttcagtcctatgggctcttaaatatgctcatttttcactctgaaaaaaaaatactttccttgacctagcatttattagctggtaccagctcctatccctcttcacaggccaattgacatctctactttcatcttaaagactcttcaaacttaactttttcaaaatagatttcattatcctcccactaccatacctaaaatgaaccttttccagagttcccaaattcagtaaatgacacttctgcacacagtttcatgcacaccagggagctaggagtaatctctaatactgcccttcctcttacagcactcatataaaattcatctccatgccttggcatgttcactcccaaatatatcaaattaattcatttctcttcttcttcaccagcaccctcattcatgctgacaggtgaagccagctgagcttctgggtcaggtggggacttggagaaccttcgtgtctagctaaaggattgtaaatgcaccaatcagcactctgtaaaatagcaccaatcagcactctgtgtctagctaaatgattgtaaacgtaccaatcagcactctgtaaaatggaataagtcagcactctgtaaaatgggacaatcagcactctgtaaaatggacgaatcagtgctctgtaaagtggaccaatcagcaggatgtgggcggggccaaataagggaataaaagctggccacccgcgccagcagtggcaacctgctcgggtccccttccaggctgtggaagctttgttctttcgctcttcacaataaatcttgctgctgctcactctttgggtccacactacctttatgagctgtaacactcactgcaagggtctgtggcttcattcctgaagttagcaagaccacgaacccaccgggaggaacaaacaactccagacgcgccacctttaagagctgtaacactcactgcaaagggccgcggcttcattcctgaagtcaccgagaccacaaacccaccagaaggaagaaactccaggcacctctgaaggaacaaactctggacacaccatctttaagagctgtaacactcaccgcaaaggtctgtggcttcatttttgaagtcagcgagaccaagaacccaccagaaggaataaactctagtcacattttggcaacccagatgggacacattttggcgaccatgaagggacacattttggcgaccacgaagggactatcccctatcaccaagcgatgagtaccatcagacccttttcgcttgccattctgtcctatttttccttagaatttgggggttaaataccagacacctgtcgaccagttaaaagagattagcgtggccactggactaaagacacgggtgtcaggctatctgggaaagggctctctaacaacccctgatttggtttgcctggaactatcttccgcttttcctgtacttctgggctgagccaagggtcgacaaagaagaaagccattcaactccggggtcccaacaacaagttgattgaccctgcggccatgagcagaactctaaaagtcatgtggcccaaacaagactcacccatctatcctatctattctgagccttgcctcctgggtcctaacgcctgtcagacaaacttcctcttgcctctcttctctcatctcccagggtagttccacttctaaaaaccacttcctgtctctggtgcttttttagtttctcctataagaatgatttctagtataaacctcaagactctattcccttctttaggcacccgggctcaccaatcagaaagacataatttttgcccaaagccccgtcaggcaggggactatctggaattttaggatctctcctcagactagcaggcctaacaaaagttctccaagtccccacccgactcagaagctcagttggcttcacctctcagtaccatgcctgggacatagcaggcaccctgtaaatatatattgaattaataaaggagggaagatagatgtatacacagatttgaatgagcaaaatgaataatggtgatgagctatagaagactcaggctgtttaacaaaggttgcaatgaaaaactagctatgggcaacagaacagttctgaggacaagaaatttaagattttcctcttttccattgttttttcttcagacaattgtaaagagaagattttcctgtatcctacaaaaagctgtatttctgttgccaagggctctcctcagccacaggcttaccagatgtctggtcatgatgactgaagacacttttagtttattctgtatacatagtatgaggctccagaaggccaagaaagtccctagacctgggattttggaggaggaaagtggtgattttctctttgctctaaaattatgtgagttgtccttactctgcatgcaatattttgccctctttaggggtagagtagaattagttgcatcatttgtttgacttaatatgttatgtttgggcaacatacatgaaaggaaagccattctttaaaaataagctctcagaataagtactctaatcaatggataggaaatcaatgaatagcttcaaacaacactataaatcataagataaggactgaagagagtatgtgctggagttttacttttatcatctcattcaatcacagagatgactcaaagaggctaagacatttcctaaattaagtaagcagtggagataggattttaacccggtactgagtgacttcaaagtccatgctctttccagtgtacttcatatagtgcaacgaagaataaaacctaagtaccttgattctacagtttggtgacagagaggattgtattcccttccacagcccagtttctttccagattctgcgcactgtccaaatgcacagggactggattagatgagattctttttttggttttgtatagatcttcctatagacctcaagctttcagagagtcataaaacggccattccgtgtgtactctagaaaactgcttttggacaaagattttagatattaagttttagcccagaatgcatttttgcatcaaagttataaacagagtacaactttttaatgtaaatgccaatacaacttaaagaaaaatggtatatgaccaaatccattgcagaaacaaactgactctttcaacaaagtattagcatctttaaagagaggatatatttaaatgtgattacattatgcaaaaattttgcttctacaaaatgtaaattgaaatagccttcaagatcaattatcatgtttatttttttttaccataggttgataggtttagccaatccagacgtgaatgccattaattattttaattaggtgtttgttctgagttggatgaaaatatatggaccagccaatgaaatattcaaatgtttgtacatattttccctcactgctatcccttctccacctgctccagtcatgctcaggtttggggttttgattagatgcttcttgttgctgaagcaagggagtcagtacattaatctaggcttataattttataaggcaggcaaaggactatgctgcctgctgccaaacaggacctccttgaggagctacagcaactaatgttccattcttgtgtcaagtgctgttaaaagttttcttcgggccaaagtttgtccaaacattttgtacaaatctgcagagctcctgcgtagctggaggctgcttcatgaagtttggcactgagtcctgctttgtattggtagtaggaagctggctgtagctacagacatggccttgtggaacagctttcgctgcgtggactacctgaggctagatctaatgaggtgagtctgagcatagtatgagcacaatcagaaaagcagaacaaaaagtcagaacagtaagcagatgcaagcaagtcattgacaagaaagcctccatgtctcttttatatacttcaggcacattaacaacatctctttgttatttccttgaatttctagctttgatatagataatttataagtacaaaaaacataaagaataaacattttaaaaagtctgtaataattattactaagagtatactcctgttcatatgttgtatggccttctattttaacattaaattgtgtgaagtacccatctcctgaatgttgtaggaaaagctttcttaaagagacataagcagtatgaagttttcaagtgggattattcgcttggaagagctgtcattaatgtccccatatctgtagctggtctataaatagccaccaatacccaaattaagagcacttgatgatgtccgtgtttgttccgcagtggtctaacaataccagataaaagagaacatgatagatagggagagatgcccaggagagttcacaagacattcacctactttgtatctagaaaaaaatcattataattgcactggacctggcactccataaccaaaccaatcacttgcgcttctaaaggctccttcatcaccaaaggctagaacatattttccaaaaatacttttcaggaactcaagtagccaaaaccaaacgtaccaatggttctgagttaggaaatacctttcaaagatatagaaattgtaaaagaaatcaccatcagaaaaaaattaaattctatgctcttattaagtaaattaactcatataaacatctaaacttcatacatttcagttatatcttacactatctgaggtaagtggaagtaagtcaagctgtgagagagttcattgctcaagtgcctttgagaggcaacatagattttaaatgcaaccaccttcagagttctctagtgctgataataataatataataataacaataaaattaacatgaattgagcacctactatgcaacaggaactgatttaggcatatttatatgttgtctctaattctgaaaataatctttcaatgtaggtaattatttttatttcataaatgaggaaagtaaggcaaagagatattgaaaggtcatatggctggtgagaaaaagacgattttaacaaggtctgcttgactccaaaactcatgtccttacttcaatgcaatacgcccttaagtgatggccgaaaagatcaaaagaacaaagatttatctacactgaaaagcccaagtaatgctagtgcatgccaatgcactgttaataaccagtaacagtacaccacccaaggcaaatctccttgcacatattaccagggatctctgctttgccatcagtctctccttccttcaacaccaccccaccatctctaccacaaactcaagccaatgcctcagttacttaggttagagaagagaaaaatctgctactctgagagtttatataaactgaaacatgccagctacctggtcatctaagaactgtcaaagaaagagaggctcataaacgtgaatcatcctgagaattaaggttattggagcattatatagttttgtattttgaatgatttttaaatttgcaaatgtttttggtagctacagttaaaagacacaaaggtaattctgatgtcttctccaaaacagctttagaaataattttagttttttatgtgttgactcatgaccaacatttatgaatgtcagtcaagatataaggttgtaatattccagtgccccagaaccaaattatatcataaagcgtaagagcttgttattgcttttaacacttctttctttccaagctgtcagatgccatttctcttgactgccaatatagcaggcttcagcaatgtcctctcttgaatttccatacacctgctctcattacctggattttctaattggttaggtaataaaatgccatgattatacgagatatatctgaaaagtctctacaaggcattatgggtctctcatgttcaaacatgtatgcctaagaaatattaagaagacaatacagtaaaatcatagaataagttatcagtaaattagttgtgagcactgaaatactgatttagtacacttcaatgccatttttagtatttctcagtttatgctatataattaaggtttgtgggtattaaataagtaaaatattgagtacagcccaaactcctgtaagttgatgttagagagaataagtactctattcttccaggtactttttttgacacagaaacagaagtactgaattggaaaaactatgattccatcccattatggtattttgtactcctaatagcttacaaattattgaatcaccatattctattagtagctttgtacaaacctgtgaaaaaataatgctgtagcacacagctctgtcacgaaaccatctctgggagaacatttcgtattcaattactgcaacaaaggatgaaaccaagaagcagaaagatagagcttagcaaccccttaaagaaagcccattattaaaattccttcagttctgaatggtaggtcatgctgaatttctaaatagtcagtcttgtaaccctctttatacagtggctatatacatggtcttctccaaataaataagatgagattagcagttccaacagtactgtgaagaaagaccttcaaatgtgcttttgtggctgccaagatggtggttcaacactccaatactgtcaaactgcaatgcatagaatccatgtggcatcttccacgatacaaagcatagctaattaaaaaaaagcctcttctaaattcatcatttttacagctaactcaggagcatcaatttgcctatagagatagtaaacaatatcagaaacagagccaaattgggaatccaaaggagtcattctggctcccctacgtgctgatgatatgttgccaaaataagttattttacttctctgagtttcagtttcctcatctgtcaaacaaggtaagaatatgttccctattcaacccagagtaaatataaagtctgtgaaagtattttaaacacttgcaagaaataagcaactcagaatctttaatggtgctatgtcatagaaaaatagcccagagaaagtcaggcatggattatgagtaggtagattatgctctcaggaatcctagaaaagggcttcttaatattctcaatagaaagccaatacattattttagcaaatgaaagttttaagtattaaaaacaaacatcaaaagaaacaaacaaaaattcccctttcataataaaaacaaccaacattagtaattaagggaacttcctcagcttgataaaggacatctacaaaaattgcacagttaacatcatgttcagtgatgaaagactgaatactttccatctaaagtcaaggaggtctgctggtactaattctatttaacattgtactgaagattctagccacatcaattgggcaagaaaattaaataaaaggcatccagattaaaaaggaagaagtaaaactttctctatttgcacatcacatagtctcgtacagtatctagaaaatcctataaaattttctaaaaagctattagaactagtaagtttggtaaggttgctgatacaagattaacaaatgctgattttacttctatacactagaatgaccaatgtaaaagtggaattaagaaaacaactttgtttacaatagcattgaaaagaataaaatattttggaataaatttagcaaaagaagggcaaaacttgtattccaaaaactataaaacattgtagaaaaatttaaagaagactctaataaatggaaggacattcatggatcagaagatataatactgataaacagcaatattcctcaaattgatgtacagagtcaatgaaatctctatgaaaatcccagcaggcttctgtagaaattcataagctaatcctaaaatgcatgcaaaaatgcaatggacccagaatagccaaaacaatcttggaaaagaacagagttggcgtctcacactaccaaatttccaacttactacaaagctaccataatcaagacagtgtggcactggcaaaaggatacacataaagattattgaaacagagttgaaagtccataaatggacacttatacttacagtcagttgattttcaacagaagggaagggacaactcgatggaggaaagaatagatttttcaacaaatgatgctgcgacacttggatatccatatatactatatagaaagactaactcaaaactgatgatagacctaaatgcaagagctaaaactataaaacttttaaaagaaaatgtagaaggaaatctttgtgaccttgggttatgccaagcctttttagatataacatcaaaaatacaggtgaccaaaaaaagataaattagactttatcaaaatgtaaacattttatgcttcaaatgccattaccaaaaagtaaaaagataacccacagaacaggagaaaatatctgcagatcacatatctgataagggactaatatccagaacatgtaaagaactcttacaactcaataataaaaagacaaaagcattaaaaatcggtataggatcttaatagacattttaacaagaagataaacggtaataagtacatgaaaacacggtcacatcactaatcaatagataattcaaaatcaaaaccaaaatgagatactacctcacacctattaggattgttataatacaaaagataggtaataacgagtgtttgtgaaactgtagaaaaattaaaactttcatatattgctagaaggaatgtaaaatggtgcaaatgttatgggaaacagtttgacagggactcaaaaagttaaacatagagttagcatatgacccagaaatttcattcctaggcatatacccaagagaattgaaaatacatgtccacacaaaaacttgcacaaaaatattcatagtagcattattcataacatcaaaaagtggaaacaatccaaatgtctatcaactgatgaatggataaacaaaatatggtatactcatacaatgaaatattattcagcaaaataatgaagaaataatggatggtacaacatggacgaaccttggaaacatcaggctaagtgaaaaaagccggtcacaaaggctgcatattacatacttccgcttataggaaatatctagaaagggcaaatccatagaaacagaaagtagattagtggtttgtaagagctgggaggagaatgggaaattactgctaatggatgtagagtttcttttagggtcataaaaatgtcccagaaatgtcccaaaattgattggagtgatagttgtacaactctgtgaaagaactaacattcattgaattgtatactttaaatgggtgaattgtatggtatgtgaattatattccagagatactgttaaaggattgaaaaacaaaaaaactgatggaaaacaacaataagagcacaaacaaaaaatcccaaacactcataggaagaatgtcataaagttttatattcattctgtgttctattagatctttggctgaatggcaaaaaaaaaaaaaaaaaaaaaaaaaaaacagagagagaaaggagaaagaggtgggtgaatattgaggtccacaaatcagtcaagttgaataaagaggaaattctaaggaaaatattaaaaattacagaaagaggaagctggggacactgagcataaactttgatgacatcaattttaccgtgtgcctatccactattcctccacttagtttctcagatcttgccagcaaccttagggcttgcatcctccatttctttgctcagggcatgctgaatacatgtctatgtgttttctgttttatttcctgtgtaggttttatgtgtgcacactgggaatgccctttcatctttcccatgaaccaatgtccccctccataaatactgtgggttccctttctgggcatatttcaaagatcagtgtaacaaaattattttatatgagtattaccattcccagcagagtctttaaaactagataggaaactggtgtaagtctaaaatactgtaagggccagagcttagggaaaagagcaacatatctattctatcaatctcatcttctctatactttcattgattaagagcccatgactacagcaaaaatgaaattagaggcactctacagaactcacatttcttaaagtaaatcatgccttttctgagataatttcccctctggattcttttccagtcctgtggctaccacccgtatggccaaatgtactctaatcccactgcccaccaatttaaggtcctgtacgctgcaattttctgcaattttcctaaagctatgattatctgataatatcctggcttcgatttataagaggactgctgatagcatgaaaaccttgccctaaaaaataaaaattgtatgtagtctttcgaaagacaactcttcaaagccattctgggtctaatttcccagcagcagaattagtccagagggtgctgccttcatagaagctctggaaacacccagagagcagacacaacactattttataactgggttagatgcttctgagtgccatggtctgtgtatttatgtagggtgtataccaaattaggtcacacaatgcattctgggaaaaaaagggttgggaggaactaccaaaaaaagaaaaaaaaaaaaacctttaggactattgcagaatagcttatgcacactgtattaactggtttcaattagactgaatgatcctgaatgtgggtaatgtgaggcagtctgggagagcatgctggaacaattaacacttcaaaagaacatctcctctggtttctgtgagaagtgtctgtttttactgattcccataaaagagagaaattactttcatattctagagagacatagtaggaagatgttaaagtgtttttaaatgaaaaggaaaacctggccccactccttaaaaatggctgtatacaaacagaaatgaaaatggctgagaatatcaatagcgctcattaatatgacactcctatgtcatcggttcctgccagtcatagaacaaaaagtttctttttcaagaactgcaagattctgctttcaaagtcttaaagagttgtatattaactcctagaacctttttccagaaaaggttctcctacacaggtctaaatgagtacccctgatttactattgggttattgtctgttttttacgctttttctcaccaatttatcctgtcccatgcactcccttctggaatgacctatccttttctttctttccttctagcacttactaagcacttaattatgtgccaggtgctatgttaacacttattatgcattatttcatgtaaatctcaaaatatcctgttgtgtacataaactcagattaggtaaattgtccaaggtcatacagcttactagtagaagagtaatactttactctttccacttactagtggaagagttaatactttaacacaaatttcattcaattctaaagggtgtacccttaactatgaccaaatattgcatcttttgtcttccaaaatccaacttaaggcaacttcccatttggaaaatgtatagtgctttctatagaccattattaaataatgtgttgccaagtataattatgatttatttatacacattgttttctgctatacattgagaaatccaagggtcagttaaaatacgtgttcagtaactacttcttgaataagtaaatgagagttgacatattcagaattcagtgctctaatttataaatgtttatgctatttgagaatttttcacttatctgcttatagtattatatagtgatagaaacctatagatatagcaatgtctatgataagttccataatagcagtcaacttagctttaagaaactcctttcccagcattaatttccagtaactaaggggtgtgcaaatatgcaacaaaacaaaagaatttttgtagccaaatcatgtgtatttatactttgcatgtctaattgataaaaccacacattatagccatttctgagtatacctaataattaagaattgaggatattcagaactgggtttggggatattcctcaaaatgattaaatccatgcatgggccatagccatactgagtggttcacaaatatgctctaaaatgcagcagccactcaagcttcttacagttggtcatatccaaagttctttaattccaagcgccaaatgctaattcttagcctagttcacccagattcagagagctatcattcttcagctgagtcctagaaactgtggacattttctcaattgtttgcagatggcagaagctcaggtagctactgtgttcatattcatggtcatacaaaccaatgaggcatataatcaatttaaatttaaaatgtaagggtaaggaaggctatcattctagtgattaatatagccgcacgataggagagaaacaaactgccacacttttcactagggaagatatttcatgtattcagaaagtttaattatgtccatgtttctaaataattaacggggagtataatttcttttctgctcaaaccccaatctgtacattatagttactactgaaaggacaagtcttaaaaaaaaaaaaaaaaaaaaaaaaaagcctctcagccccattactacataggtgccgagggccaaaaaacaaacaaataaacacacacacacacacacacatccaggaagaaagagaacaaatagttaatagaagccattttcaaggcaatatgtaactggtgacagacatttgcaaagcaatctggaggagccagaaatcaaatgataaaagttctgcacttaaaatgaacttggggcaaatgcagacatgaaaaccaaggcttttttgcaaaatgtaataaagcctaattatgaggatacaatcattccagagtagaacaacaaagagcaagaataggacagtggagaaaggaatgtaggagagaataaactgaatttgaaaaatatacaaggataatagagactatcaatttattaggcctgtaagtatgaattaatttatttataactttcttcagtccttggagaatttatgacagccaagacactctcttaagcacaaggtgaagattttcactatttcctgagagattataaaatgaatattaataccagaatttcatacatatcatagtttttggttatataaatatatgtatgttaattgtagagttaaccgcccattttttttattctataagatgaattaaggtattatcaaattattatttcatcattttttaaatatacccaagtgttgtctgcagtcagatatttgaaatagattataaattatcaaaatcccagtgttagtgcttttttctgagactactacttattacactagctctaggggagactcagtaaacattgctgactagtagtattaaactattttctttttccttttggttgcaagtaaatcaaagaacaaaccctatcaaaaataaataaaacaaaatctaaataattgagaaagaagtaacattgattgtaagttattgaggccatttcacagactccaagagagttttgagtacataatacctaagaagggcagatacaaagcagctttagaggtctaagcaactgagcctcacataactttttccaaactgttctcattcatatgattcaaaattgatgactaccagtttggtatatctccagtacaaatttcaaattcccaggaaaaaaaaattcaactggccctgctggaatcaaatgtcttcctcctggatcagtcagtcctggccaagggcaggctcacataatctaaacatgaccatcgggagcccacctctgtggactgggggttctctgcagagaaagcagatcggtatctgctgcacaactccttcagaaaatatgtgtttcactgggagatataattacttttatgtaaatagcaaagtaaatttatgaaaccagtagcccccagttctatggcagaaatgaaaaagaaacatctactttctgattctctcacctgaccacagcactgagaataagactttaatgctggcgctctgacttgtgatcttcaggaagagtcttaaatgtagttgtttatttgttcctaaggttctacaatacaactaggacctaatctgggattcccagatcccaaggggttcaactccaagggaataatgaaagatgaacgatttataataattcaaaagacagaatcctaattatgcaatttccttgcaacaagactgcacaaagtaataaaatgtgaaagttcttatattaatattttgggctgaaattaccagtgtattagaggatcagaaattcttattggtattatacatgattgtgtttgatttacataggattactgccttattcatgtttatatttccagcaattggcatagtactagacacaactgaatggaattactaaactttgtagcttgaaaacaaaatttctgaaaacacacgttctatggtattctcttaggagaaaagtgttaaagaatgatgaagaggagaaatagaaactaccagcctaagagggtaaaataccattattaatcctctttaccaagaaatctgagagctgtgaaataatttattaaaacttactaaagagaaaaatcaacatataggagattcacatattgaaacttaactcccagaatttctgccatgtaccagggattttactagctgtggatatactaggaccccaaggagcacattgtctccatggagaaacagatgtaggaatcagtagttatgaaatgataccatcagggatacaataaaagaagtgttctatttatgaacaaataatagaattattaaaacacatcctttctcagttcaagatcagcctgttcaacagggcaaaacctcgttatttaccaaaaatacgaaaaaaaaaattagctgggcttagtggcatgcacctgtaatcccagctacttggggaggctgaggcacaagaatcacttgaatccaggaggtggaggctgcagtgagccaagatcatgccactacactccagcctgggcaacagagtaaaactctgtctcaaaaataaaaaccaaaaccaaaaacagaaaaaccacatcctttctctatcataagtagtccctaagcatgcactctcctctgatcatctgctcaaaaattaacatttttattctctgagtctccagcacatctgggctccctctgcactgcaggaatacctccaaaatttagcatcaccatctctccttcactaaaggtgatcccactttctcccccctgccacagataaacaaaaactgaggaaaaaagcttaatctcttacacaatctgagtgaaaatcaggctcccccaggcttactgctaacatagttgtaagacatgttatgtcagtccagtcgtatctttcagcacatggtacctcaacaatagataaagatatttaggaagctccacatattacttttccattgcctacaaggggagtcaaatgaggagaatttccaaaaggtaactttctaattttttgtctccatcatacacaaattatttcatgacagctaaactcatttacagtacacgtaattccaagagacaccactgtcatttctattaggcaatccatgtattacagagtatcatacattcagccactttcttcacacacttcagagtacagaagtagtagcatgagtacatgaaaggagaagtaggatgtctgggatctgttcccagtgctacaattgatgcactattcttactccctttgcattgaaatctcccatctgtagcacaaggataatgacatagtacctgtttgtttctaaggcactggaaaattctctggtagaagatactatgcaaatgcagagactattattacaccaggaagacttgaaaattgcaagttggtgtgctcatgactattaagcagttgacacagtgacaaaagagagagcatctttcttcaaggcatctaaaatcaagtattgctgaatatgcagctattctgaaaaacatatgtgcaaatatattcgttttaatgaccttccaactctaactcatcaataacccatttaaagcaatcctttccaagttatcctgactccaacaaaatgcatggaatccctaatcactgatattttttataatgcaaagctttctgaaagattattctttctccttgcaaaatatttgctttactccagaatttcagagagcattctggctcattccactaagattattccaaaatataaaaacatttatccttcaatctgctaatcttggaataatcaaacttacagtacagtggtggacaggcatccaagcaggggcttccactgaacaattctgggctgggcatctgccttggttttgctgcaaataagtaaaaattatattatattctatttattatgggccagtatgtatatatgctagctgacatgtttattatcaatatgtttattaccttatttataatcatagagagagaatgctttgttggtgcaatgctgcagaaaactaggtacataatttctactcttatcaaagcataagaaattatccttttccttttttgttactctaaggactaggtttctggcaccaggctgtctcagcatctggccttccaggcttcaataccaaccacctgagaactcttacaacccataggctgactgttctcttccaggctcctaatcaaccctgaaacatgctgtactcctgtaagatcacatgagtcaaggtatagaatggctgtttatttgtctctgtttccagactataagctagtgatggtgattctctctagagtgtttcatagaactccagaatgttgggttgaaagggatagatctcagaggccttcttatcacatgaaaaactgaagtgcagagaaataaaacaattttctcaaggagtcagaaatttgacattctaaaccattttccaggcacttctttatacaaaagaaatttatctctagttaacctatacttttgttgtaattcctgtaaatttacttctaattggcttttaaaaataatacagtgctttactttcaccaacaatactgctacacccctttgataatgaaaactgattagtccaaaagggggggaaagattttaataagccatactttatcttttatttttttcattgtattctcagtgataatataggcatacttataatattaataatcgccataaaaaccacagctgtgatttactgaacaactaaatatgcaaggcactattctggacacattatattattactagtccccacaataaacataagtaggagtattatgctcactttctagtggagaaaacagagacttagagaggttaagcaacttggctaaaactcaacctactagacagcagcatctctgagattgcagcaagactctggctgactctggtgcccatgtatgctctttcttttatgagaagttgcctctgttattttagactgtctctttaatgggaggtaagccatgtcatcatccaatctgattttatctaatgaatgatcctaacatttctgatttaactgaataaaatactgaattcagtactcctatcacactaaaatttttgcctgtgatttgtaagctttttagagcaactttatttggttgatctatttttaaggcatcactaagccctaaaatgctgtatgagtgactatggataaagtcatcataaaaataaacttatatcatcaatctccatgatcaatttctttaaagcaaaatatgatatgcagcagcagcagcagagtacagaaggtacactggtcagataaccacaattttaagctaattttggccatgtgcttgctgccatgaaatgctcttgacagtcacaactgtgaaacagtgttagtattttgcctaattcacagataatagatatagattctcctcagatcattatcacaatttgcaaggaagctactaatgagaacacacaacatattcacaaaatatgacgggtgcataaataaggtgtgtttcaacttctgcggtgctcagcatgggataaagaaagatggaaatgtgtgtttctgttttgccttctattattacctgatttctgacactaagatcttctcgtacgtgttttaactaagaaaattaacaatgattttacaaggccagacaaataaaaaagactagtgatgacacatgtcatgtgaacataaattattctttaatcctattgtatgataagcaaaaaacattgaaacagaagttagaaccttggattttagtttagtgttcccattgatctacctgtggaactttggaaaactcactttaacactttagaccacacttttctcatctgtaaaatgagaaagtttcttggatccatcattcaatgtggagagaggaagagccaaatctacccaaagatctttcccaaactttatagttctaccaagaatttaatatttggttttatctaccaaagtggtataccctgcagttgagatcatttatcattctgatatactgatgagacatcttttagggtcttgggaatatgaacaggaaatggttatttccctgtgagtttcagtgctagcaaagatccacaaccactagactagatggtctcaaaagagccttccacttaagtgtggttactgaaaatcctaacctcatgttttgtctaccacttcgctctacttctaaagaaggcaagatctaacatggatcagggaacctaccacagcaggtggagaaggaaagggatttaaaattctttttcctcgaagtcttcattctccttcttcagtatcttttgtttttaacatttaatgtgtacactgtggcataacagagtttgggcctacctcctactcaaaagagtaggaggtcagctccttagaagcccagctagaaccagaataaacactaggggaaaggacactatcatgtctaactcttagttaattcttaagccaaaaatcaagggagaacattagaattccctcaagggagaacctagctctctaagcaaagatttaagatagaagttggtgacaaaaggtaaagctttcccaccttccttctgtctcattcatctatccaggatgtttatacctgtagattagtgatatgtgactagaccaggattcggggatttgcaatgctgaccgttaaaaacatgtcctcttaagagacaaaactatcaatgggtcttagtcttttaaaaacagacaggttgatgtctccaaacctctcatcttccttggttatctgtttctcactttagaatcttgacatatttcattccagaatattctgagaacattagctaaatatgctgaccaattacacctgagattgattgtataaatatgtaactacaaagaactcgaaaagtgacctagagaaccctaaagatgttcttctcaaacaaccccatccctccaaaaacatgggaatatttttttttgtgtatcaggggcttatacacagttagagtgctttggagtttagaaatgcttatatatacattgagccctttcatccccagaaaaagttgtgtgtggcagagtgagagatgattcatacaaataaaattttgacctaaatgtttcattaaaatagcatgttcttttgaaagcagagtaagagctgaaaggttctgttgttctactgttcacagtaaaatgatcctcataaacaaaggagttttttttcggggtgggggtgcggtattgagaagtattgcatgatagaactgtacacatatttgctcattcatttacccatccctcagttaccaaaatacactccatgaatggtacgttaggtatacatatagattttaaatttagaactaaaaaatttaaataatccttattctcctaaagcccccaaccttttaggagatacaatacaatgtgctgagtttaaaacagggttaaataacaggaccattcatccattcatgtagttggtcaacaagcatttattgagcaattactaagtgccagctattgcattaggaataaggatatatcaagagtcagtatctgcctaaaaaagtacttattctaaggagaaagataaactaataaagctgcagttataaagcaatattactgatatgggataaataaaccatttcatgacagatcaaaaatattcactgcactcattcttggggcaggagtaagaaatgaacaagcgtaagggaaaattatacagaggaattgaggcaaaaggtggaagtatttaactctggctgggtaattcagaaatgtctttttgaagagacacttcaggtttccaacacagttttaaggaggcgaaggtgtaagaagagggcgttacaggctaaaggtaactcaaaagaccatctgatagtgcaaagtaaagacattattggccttgtcaagaaactcctcaattctggacctcagaatcccaggactgaggagaaagaatgattttatgctatacagagagctgagttcagcctttccctttatctcttcttcacaagactaaatggacagcagggtgtgggataaatgaatcctaccaggaagtggacatggaaggacccagatctgatcctgtaaaacacacaagaggccctcctgagtttaatctttgaacaagcatttcagctgtcttactcatccgtgagactctaaggtatttgacagatgaagaaaaagaggtcaaaacgtgatgcccaaggagcagaactaagtggctttttgcatgcagaactaaaatgacatgcaataatgtgtatgcaaatggactgtgagttgtaaagtactttagaaatgtaatggataattataaagcattaattatttgaaaattaattttatgagctaattcttgttattaaaattactagaacactttctgacttctagtccaatatactctctagcacatcaagagttaaaaattttttcaaaaagtttgaggaaaaacgactcagaaagtgcctccaaatcatcaatttcatatatttctaaatatagagatataatatatatctatatttgtatgtatgtatctacatacacatcatgtgttcattatgcatcatccacataatgtgtctatagatacatatatacttacaaatatgatttatgtgtgtgtatacaggtgtgtattaaaaaattattctggcaaaataaaggttttcattgaattagttttctaatttcccataaagacatgtaatttcagagtgagatgtttaaaaaaagagaagatcaaatcttgccatgtgctaatgtaaaatacattataggtggaaatatgtgcacaaaatgttacattggaagtcctaagacaccaagatataaaaatgagattccaaaggaggctagaccacgtgtgcaatattcaaataaattaccaagaaccaacttgaggatcctgaatcctatctataatgtaatataatgctggtatacaaaagttagatgactaaagatttagaaagggggagaatatctttgaagaggggttgagaagtcttacatatcacctacaattagcaaaagaaacttcaatgggactgcacctagagcttaacataacttccttgggtttaggaggtcagtatactgggatttgactctcacctaagaagcttaaccagtgagataacgtggcaaattggttcttaagtgagaagtggcttcatatgggttagcctgcactctcagagttcgtcaaggcaaaagattcattctggagccattgtaacacctgtcaagacaaccctccatatagggtgggctgctgtaaaatgtgacgctaaggaaatgcctcatccacatcataggagatttaggcccagaaggggaaacttccaaagactgaggaaagtgtccatgagggaaaaactcaagccagacattttctggctgcgttaaaatcccagatccactgtttgctagctatgtaaccctaggcaagttgctttacctctctttgcattagttatgaagattttaaaagttataagtaaagcacttaaaactatttctatacataatcagcactatttgtcagtaattttcttcctttttggttattcttactgttattatatgtcaggttcggaaggcaaaaaacacaattccagtttaataagaactttccttgtctccttttcttatttccctcttatgctccaaacttggaaggatcaataaccaactagtaaataggtaaatagaaaaaaaaaaaaaagtaatcgtaaataggaataaaaaaaaaaactagtaaaaaaaaaaatgaaaagagaagtctatgacatccccttcccccaaagcagatgtcctgtctgaagaccccacagtggaaaaaagagaatctttcatctggaatgtgttcagaattttgactaatatttgggactgagcaattttaattaatacattgggactgtatttgtgatattaagtgattgtaggacttttcatttcctgtaaatggaaagttatgagaatacccgttttcatttagagggcagggtaaggaccactgacattaagccattttaaacaaacaatggggaatccaaaataaaatgacttctattattacatcccatgagtattccttgttcaatgtgtcaattacagatgccaaacatactcatggttagtgttaacttttttcattcaactttgggcatattcctcaacatatgacttcatcccttcctgggcttatccttccatttgcttctttttattttctcaggcttcaaaagatgtttaaaataagttggcctaatttgtttctgaggaaatccttactaaaactgaagccatgctggggagtcatgaatttgcctcttttgtaaatgaagaaaatgctgctgacctattctccaaaggatgctgagaacaagcgtttttcagtgggcagtgatgatggtgctgagtcatcctcaacacttttcaaaatcctttgtgacttcaggcagacatttgcccaggttaacagaggtgcagtctgtggctaactagtgcataagaggattaaacactctacattaaaatattctaagcacctagctacccagattaacagtaatgagtggaataggctctgagttttcaagctggccacattaaaggattataaatggaaaccattgttgtgacttgatatttcagggtatcaatggggagaggacagcgggctttgacttaggaagcatttcctagatgtatgatgaaataatacattgagcaccattagatcccaggcacttgacatgcattgtcagctcattgtatcatcacattaaccctagatagtagaggagagagtttaataccatgaggaactgactggacccgggttacaatgccagagttttcactttttacatctgtggctttggataaatttcttaatctctgtgagtttcagttttctcatccataaagtggaaaaaataaaacctagcttaaggaattattgtaaggattataaaactatatacattataatatatataacatatatgtctaggggcctgatatatactctaatagtaataagataaatactatataatttacatgttaatatctatcttattaattggggatctttctcctgtttcacttagctcctctgagtctatattcttgtatctgagtataaaatagtaatatttatctcacaaggttactatgaaaattaaatgagaaaaagtacatgaaagcgcttagcaaatgtcaagaactttaaacttaagttttgtttgtaacttttttgtcagtatatagaagatggaaagaatgtctgaaatactgcagcaatttaagataactaaatttgggagccaaaaccgattctgcagtctgggattatttacttgaaatcattggttataaatatttctaaaaaatataatatggtattttagtattttatggaggcatgtcccaatattctctgaagctctgtcagtctccaaagtttgagttattactatgcatagttgaatgcaatagagtaatttaagctactaaatacaagatttaaaagcatagttttgtgaaatatttttaatgtaattaatatttgcattctgtcattgcatcctagtaatcagatgagaaaaacggaatgggctgtaattgtacttttctccttgcaaaaaggaaaatttggatattattactactatagaaaataaatattttttcattggcagatcttatctattataaactacaaagtctcatggaaacataaaagactgtaacttctaaaacaagctacttttttcttccaaacatatttataaattcacttagtaaaaatatatgaaatttcaggaccccaaaataaagtcaaacctttgaagaaagaaatgccattcagaaacaagatgaaagtaattcacttctattctctctgctaccatagagacaaagaaaaaacaaagtaaagagatttagcacacttaattcttcctgaaatttataattaactacatgggaaaggtaacaattaccatatttccaaagaataaagaattttaaaagttgagcttttgataagacataattacaacctattaaatatgcaattcatacaaatttgcttatgatcttcttgaatttcaaaaaatgcatatacattggatagtgttttctgaaaagtacacatggaatgccaccaagttaattgtacagagctttctcttatcggaggattttctcagttacctaaaatcttggcaaaacctaacacaaagaaaagggtcaatggatattacttgcatatatgccctgtcttcctgacacctatgaatatgtattttgggacaaatgttaatcaacaagaaaatgtgcaggcttttgtagatcaagtgccatggccaacatcaagcaatagccagaacggactagcaattagatatgttctcagtttaaacagaactttagatttctaagtaaattatgggtgtattaattcaggacagttttattttaagagacttgcaagaaaacaccatatctagaaatcctaagagattcaaaacaaagaaagggaggaagagtttattttgcttaaaatgtatactttcatttatggtttctttagcaaataaattttttaaatttttatcattaagaatatcaagaaattatccttgtaatgtcctatttagaactctatttaaaaacaaataatttattttattttagggtatcttaaagacagcatcaaaggttatatttctcattgtaaaagcatgaagtatgcgagaggtaagctaaaaaaattaatactttatgaaatgtgttttcatacaaaaatcaaaattcttgctggcatagataataaatggtatgatttatgtcttgaaatttgacttttggatattcttttttgaaacataattaaatggtcttcgaggagactctactgctaactacattgctgcttggtaaagtggtataatagattattctaagtcatttctgtctaggggtttcagaacaattttaagggaacatttgaaagtctgtaaagcttttaactcagatcttaaccacagaataacgtaacatccattcagctcctgtatgcatagtgctggtgtcatctgtggctagttggacaaattccaagtaataattactattatagttttttaagttccttttgtaggttacttgggataaagccatttaatgatactgatacactttgttctctgaaatgtaaaccagtataaaaaagtagccgaactgctgtgaacctcttcctagacaagtttgtatcctgaaagttgagtaaaacataatgtattccacttaaaaaaattatattatttctccaattattttataacctgataatttaggagaataacatcattttttaattttctattgcacacctttctaactcactttaatgttttcatagtaaaatatactacattaatattgttattcttttatagtatatttatgataaatatgttatatatatattataaagtcaaataattttccccaaaaaataccatgctatattaaatcactaagaaattaaatgaacatgagttggcattcttttatcaaactgaaaagcagatctgactgctttagtttttgtttaataaaaaggtgcaattgtcttctaagtattttgtacttaaattttagaaatttcaattatgatcatgataatttggtttatcatagatgtgattcaattgccattttccaggtgtatataaggaattttacctctattagtccatttcttttatacaaaaatgacacttccaagtatcatttcaggctcaccaaatattcacagataagtttaccaattggctgtctcttaactgaatagtttctccatcagagtacaaagatttctttcacaactatttattgtgaaatgcacattatatatacacatgtacatatgtgtgtacatgtatgtatatatgctaaaacatttgtgtatatgtgcacatgagtctatatatacacacacagaagtacatggatatctacataagagtgttgtgtgtgtgtgtagtatgtatgtatgtgtgtgtgtaaattagaggaaggaagaatttcacccactcattcacttattgaacagtgaaatagctatcaaatgtctgttaaatgaaagaatcaatcaacacttgtagtacatctgccagtaccatggtaagtgatcagctataaatacaactaagaacttcccctgtcctcaaggaattcacattctagcaagaaataggcacatggaaaagctaactacacaaccagataaagactataacaaagatgcagacaatgtgcggagaacatggaggctgatgggctcagtctagtaggacaataccaaggaaagtacttaaagagaaatccgcatttagctgaatcttaaaggttaagaaatgtattagggaagtatcaagctaggaagttgagaggtattccaggcataagaaaaaacaggcacaacgaagaaacaagaggatgaaattcaaattatttggggaaaccaaatgttattgattatagttgactaaggcatgaaaggtagtgggatctgagataggcagttaggcaagggatacaacatcgagggccatgtgctgcaggggaaacaatgcagactttatcttgaagggcagtgcttctcaaaccttaatgtgcaaaatcaactaaggatacaaatcaattatcgatcttatgaaaacgcagattctgattcagtagtttcacacggggactaagatcctgcatttccagcagttttctagcagatgatattgcatttggtgaacaaacaaaattttgaataagggagcagtaggggacagggaatccctgaaggattataacgagagttgcagagttgtgatatacatgcaaattatatatatatatacacacacacacataaatgcacacacatatacacacatatatatgtatatttatacacatatacacacacatatttatacacacacatgcatgtatgtgtgtctgtatatatattatatatatatatatatatattttttttttttttttttttttttttgagacagagtctcgctctgtcgcccaagctggagtgccatggtgcgatctcggctcactgcaagctccacctcccgggttcatgccattctcctgcctcagcctcccaagtagctggaactacaggcacctgccaccacactcggctaattttttgtatttttagtgaaaacggggtttcaccgtgttagcaaggatggtctcgatttcctgacctcgtgatccgcccgcctcggcctcccaaagtgctgggattacaggcgtgagccaccatgcccggcctgtatgtatattttttaagggaaggttcaagttaatggtgtggaaaatgtataggagtggaaagataggaaaggtaggaagacaaatagggattctattgtagaaatccaggtaagaattagtgagtctctgaaaaagaccactggtagtagaaattgtaaataaaggacagattataaggaatagaataaataaggattggggctgtgggagatttaggaataaataaaaatcaaggttaactcctacttttctaaccatgacaactgggatagtggcatacaaagaaattgagcacagagcagagtaggagaactgtttatgcttggaagactccagagagtaaacattttccgggaactttcggcttaaatttacttaataggtaaatagaattccaaattccaagaactcattcatttactctcaaacccgtttctcataaaacctgtcatctccaaaaggttagctcgagaactgaattacttagatacaaagaaagtgatatgtgtgggtaagcatattaaaacagagatatgaggggcaaaggttattttcataggcttttgaatctggtactatctttgaacgcacaaatggaagaagaagctaaaacatttggtatctttctctcaccagtaagaggctataaacctgcaaagtattattcactgaagccagaggaaatccccatcaccatgactacacaaatagaaatttgccaccagagtggtaactagctaattgaattagtgaaatttatccttcagtgtcagactcccagaaatgaggaaatgagagagaaagaggagagggaacagaaacaccatcagctgctatttattggctatgtgtatacatagttgctacactaaaccttatgtgtatgttggcactagctactccccttgtctgggatgttctttgccaagaccttcacaaaggtgatcctcttagatcttcttttaacttaagtttgcttaagtatttatgtgacctgtgtcacttaagattacttctaacacatatacagacacagctctcatttttctctaccatacggtgatgctaatggtaatgaaagatgccaatttatgctaggatatcttattttcaataatttctctcatcctttccatgtatagagtacttcgtacttttcaaatatataaactaatttgattctgtacaataatcctgttcaggaactactgataagccagtattattaccccatttcagacttgagaaaaataagggtcagagaggataaagtgagtttactaagattactagtataataaatggaaacctcaagtctatattttctgaatcttgatccaacacatattctcagattgcctttggtgaaacatacatacatgcaacaagacaggtccctcaggtagctataatcatgggtaatctgctttaagaaaatcttatattccaaacattcaaattaaataatggataaatactaaagggcagtgatgaattcttttttgtacatcatgaaagatttataatattttttaaagttttgagcacagtaaaattttttttttttttgagacggagtctcgctgtgtcgcccaggctggagtgcagtggcgcaatcttggctcactgcaagctccgcctcccaggttcacgccattctcctgcctcagcctcccaagtagctgggactacaggcatccgccaccatgccaggctaattttttgtatttttagtagatacggggtttcaccgtgttagccaggatggtctcgatctcctgacctcatgatctgcccgtctcggcctcccaaagtgctgggattacaggcgtgagccaccgtgcccagcctgagcgcagtaaatgtgtaaatgttatctaagttgtaaaatttcatttgcagttgtttcctctgcagacccacatttgtctgagaatataagatttatgtaaaggtcttataaaggacaatactctcagtctcatagctcttcatagcattgtgttgtttttactcacagaatcaaaaagggctaatgttatgaagtaacatcctgtaatcatgtttggagggaaaaccatttactacagatgtgttaacagatgattggtatgattcatataataaagttttattttatttctaaaagtttagttttacagactatggatatatgtctgaaaaactacaaatctacaactaattgtaattttaaattaagccctatataagtgcattgcttttatttaattagatatttaggttgagaaggaatgaaatgcaaagtatattatcaagagtatattttaactaaataataactttgttgtgattcaatcaggagagaataatagtgaatgggaacatggatattagagtcataaagacttgagttggaatccccactataaaacttattatttctgtgaatgcacctcatctttaagatatgaaggatcaccaggttggtctaaagactaaacgtgtttttattaaattcaagtaccttcaatgtcccagacattatacacacacacacacacacacacacacacacacacacacaagaaaaaggaacacagttcctttccttatggagtttctgtctagtcaaaagaaagacaaaataatcacacaaatcagtatgcactatgagttgctatgtgtggaaatgtggcataaaaatcagagtgtactccaagaatacataaaattttaggaaaggtagtgacatgtaaggtgacatctggaatataagtagaatttagatgggtggatggtcatctagaaaaaaaaataacaaatggaagtcgccgaaaccaaaacatggttgacaccttcaaagaacggcgggaagccagcaaggccaatgtgtcctttagtttaatgaaagatagggaaggtaacacagatttaaaagatggtctcgtccatgtattttcaacattcttggagtgtaaaatacaaggtataatgaaagaagataagacatgagagaaatttaggttctaagtcaaaagagaatcgtatactttggtaagaatttgtgtaactactcatctttcaataggttgctgagagtgatgttgttgggtttgtgtattagaatgatcctcttgcagctggatggaatacttaataaaagaaagttaagctattatattaatggcattagtatttcatatgtctgacactattaaatggttaatcccaggttattaagacagtcatagaatctcttctctttctacacaaaaaggtcaggttatgttaaattttccctactattagctgtatttatgctcctctttgccactcaatacattttttttctgatacatcaagccccctgttccaatctcccccacgtagacatgccaccttgcagacatttggttggaatgacaagaattagaaccagtgtcattggcaggataaatacaagaagtgcaccacaaaaaaagatacaaagataaagaagctatagaccctaacaaagaacagagtgcctactccctacaaggtaatatcctaagcattttatagttcttatctcaccgaattcttaaaacaacgctgtgagataggtaccctttcatggatgagaaaactgcagtgctgagaaggtcatccagctagtaaaaggggaaaccattattttactgaacaggtataagaatgggcaacacaggttgtggcagaaaataggagagagctcaaatcagggggatgaaatgggaaagaagtctgggcaagctgggatttggaaccagttttaatgatggatggaatatcctatttcctttaagataacaaatatctcaacttcatgatatttgtgacagggtgctgatctatctctgcatcctctatatcttgttactcatattggacaccttacatcccagccatattgtccttccattcttgaaatgtgcaattcattctctctctctccccccgccccccacccactctctctttctatctctctctctctccccacacacctgccagagctttgcctaaaacattctcccaaccccattgtggctttcattctgcaaatcagcttaattttcacttcctcaggaaagcctcccgatatttatccctgcctaccctgcaacaaagctaatcaggttctttaggtatccctgtatccctatcctcatttccatagcactctatattcattttcttatcagacatcactgctatttctgtaattggttgttttccccattagacgaaaggttccatgagaacagattgcctgttgtatccccacacctttcaacatgtcaagtgcatagtaagcattcaatatatacttgttagattaataaaatgaatgaataaatgtgatgcttctaccatgggagcaactgtacaccagcatgaataaatagctttgtctatgaacacaagaccactcaggaaaccatttgttgccttggtgatttgtttcattttctctacatgaagctctggtggaaaataaaaatcattttagcttttccaaataccttatttgcaaatatttctgttaagaatccacttacaaaaggacaagatgccaccttttaaaaattaaagtcataataaaaaatattatattcaccagctgtgataaaaatatttttaatgcctggcaataacttttatttcctttcagtaattctgagtgatttttaattcttattaaagatagtgggttgacagaggcaaagagtgaaatcatatttacaaaacagatgtagtattaactacatcaagaaaagcttcttttgtgctgcctggtccacttttcactctgctatgtgaattttattatgtacattaacctgttatacataataaaaatgaatagtaccatcatgcctttattaacaaattatagcagtaacttaacatattgcagttttatttgtagattttttttaaactttttcaaatgtataagtatggttaatggatatctgaaattatgccaatgtgtgattcacccactactactatttaagatacttaacctaaacaattttatcttcagagaaaatatagaataatgttagattcaaaatagaaaaggaaatacctcagagatgcaataaaatatactcattttaaagaaaaagacaatggtggccaaatgcctttgggtgcccatggtcagaaagtagagatttacttttcgcagttccacacttttttctgttcttatatcaaatcctttatgttattacatatgatacttgagaattcctaagcagtaaaagaaaaattctattgactccttgcatttcattaaattaggcagaatattctgcctgcgatccagaactattgtcctattgcccaatcatgtaaactcatggctctgcctaacattattttccttatattttagttgtgaaacttattgggattatttatctttcaactactcaaaacatacgtagggaattccattatataaaatgtgttgcattagttattggattgtgtttagccagtgttattgagatgacttcatttacctcaatgatcatactgaggggtattcattaaagttataaattgtgagttgctgaataaattatactatatacacatttttccatataccaggaattgtgctaagtactttacatactccaccacaacatcacttagacataggtaatatatccttttcgaagatgaagaaatcagtgtttgaggaagttaaacaacttatccacatcttaaaactaatacatgtcagaacaacaatttaaatccaagtctcgctccagtatcctgctattcacactaaaacatgttctttctctttctcagaagtgatatctgtgacaaaagagttaaacttgaaactggacagaaacatttgagaaaaagagatgactcaatcttctgaaagtgggttgcctgagcatttgacaagacttgggatccatgtgacagaaactctgtatttatgaatactctgatgatttcctagtctacaagatcttactccaaatctgatacattctgcaaatcaatctaactagactggagctcttaagactttaaacaatctgagttaaatggggtaagatctaaggtgggattattttatcagagcatttacacaaaatccacaatcatttccttccctttatatgtagaaacaaaataaaaatgattctccatcaccattctaactggcatgagatggtatctcattgtggttttgatttgcatttctctaatgaaaagcaatcattgaaaagtcaggaaacaacagaatgtggagaaataggaacgcttttacactgttggtggaagtgtaaattcaaccattgtggaagacagtgtggcaattgttcaaggatctaaaactagaaataccatttgacccagcaatcccattactgtgtatatacccaaaagattataaatcattctactataaagacacatgcacacgtatgtttattgcagcactattcacaatcgcaaagacttggaaccaacccaaatgaccatcaatgatcaaatggataaagaaaatgtggcatatatgcaccatagaatactatgcagccataaaaaagaatgaattaatgtcctttgcagggacatggatgaagctgaaaatcatcattctcagcaaactaacacaggaatagaaaaccaaacaccacatgttatcattcgtaagtgggagttgaacaatgagaacatatgggcacagggaggggagcatcacacaccggggccttttgaggggtggggggcaagaggagaaatagcattaagagaaataccttatgtagatgatgggttgatgggtgtagcaaaccaccatggcacatgtatacctgtgtaacaaacctacacattctgcacatgtatcccagaacttaaagtacaattctaaaaaattattctccagtatgtctaatagatccttttatattaccattatacaattatattttctagatttatcagcatccctctgctcattaatcttcttacaatctttaggaatgtggaacaaagacaaaaggaggaatttatctctatagtatgtccagtaggggaaaatggcagaactcagagctcacagaggtctaggaggagccaaggggacagtgagggactttcatgccaaggaaagggaaggaggaacaaaaatgctattaccaatggaaatatttctgttttcctgccactaaaaacttgacaaaggtagcggtcagctgtggtatcgaaatgtgctgtgaatgaaatggagcttaggacgtatcataattaacagttccagtctcacataaagcttctgtaaagcaataattgaagacagcaccttagccagagctattggaaagtgaacttattgctgggggataaggagatgagtattaaactaagatataattaaaatttccaaattgtgggcaagtttcttgtcaaacagtcccaagaaagtagagcaagggcatcccaagtgcatggccacttggggaaaaacagtaaagtatcaacagtggtagactaaatagataagatttgcagtctaaagtcctctaagaggtctcttcacctatgtccagcttttgaagcaatcatgcattatttaccatttaaatattacaatgtaactttgctgtatgtttgttctttaaagatgttatatacatcactctagaaatgttcgtggatataactaagaaaatgaaatttcatgtgggtctgtgttttgttgattcgtataatttatatgataaatcacaatactggagtaatgacatttatctcttattaagaatttaaagcaaaataataatatgtatcacctatgtacctgtagtcaataatatttttataagtaaatataaggcatatgacattttttattagataatgttttccaaattgaaggcacttggatttcggtattgatttaatttgtataatatagtagacttctagtttgggttctcattaataacttttgataacttatttttacaatattaattatgtttcacagtatctaaaattattataatttgggaataaataatcataaaacacaagtagatcagatttggtagtattgtctcaagaaaagtaacacaagggtaacacctcaggaagagtaacatatttaagaggatatttcctttagtagattacataaggacatacaatttcctacttaagattttttaaaatttattttagttgatttactgatttaactggaatactgcatgagatgtttggcaatttttaaaagtaaaataaggtattcatctaatttagaggcctagtcaactaactcaactagaagttttaggctttaaatccactaacatcaactgaagctgccatgtgatattaggccatatgggaagatatccattatgattttctggggcttcatttgtaaaagtaatatatttaaggtcatactatggggaacttggtttgtggctttgaaattaaataatcttttcttcagtggtaaaaggagatcacaatgggacatctacacttagttaactctcatgtactaagctattaattttgttatgtttaatagtcatctaatcaacgtgagatacaaaaagatatggttcaaattaactcatggtatgcttacatgcaaaatgaaaagggaactaatgaataaatgtctataattagtttttcccaaaaatattaggaatatctattcaaataatcagtgattataaaatttaaatacattatttagaactgatgacagaataaaataaaatgcttttgaaatgttttgctattttctgtaaaacaaatccataaaacgattgcctattgattttatttcattcccacttttatttatacttccaataatgcaaatatttgtgtataattaaaatagaattagctaaatattaaatattgtgtttgttttaactcagggccttgagatttttttcctttaaaataaatcactaaaatgcagaatatcagaattctccaatcagaagcaatatgtcaagtcacagtaaagctgattggcttcttcaaacacagaagacatggtttttaaatgaaaagctaattatcacactcagaaagactgccctgatatgttaagttaaactgatgtgtatgtgctacactactactatagatatttctattatgagctataaatagatgcaaaagcaaatcctgccataaaaaaaaaacaaaaaacaaaaaaacaggcaaattctccttccatttgcacaaacatgcaatatcactttaagaagttaaaatcacataaagacaggaccccccagaccctcagggaacaaaatgcccagcaaagtaaattatactaatcattttctctcatgaactggcagcacctactagaactgtttaattacgggaccagaataataatagaaaaatgctgcacacaataacagccctgtttcctatcctacctttgtggtgacaatgcacaggcaatccatcctggatccctacacaggactcagtacatggaaatcacaccagcaaatcagcaaaggtgagaaaagccttttggaaattgcacacagaaagaagcagagcttggattctgtacagacggcttttccaagggggcccctcatgggaaactcgagccctcctccatacagctcaaggcaagcaggattctgctaggcaccagaaaatcccctagaaatcagctccggcaaaacttcccggtggcttcctgggctccgtggctgcatggtcttttagcggattccttgattggaacaaggctcctgtgagtgccccgcacagttctatcgttgcgatgagtgtaacaccaagcaccagggaatcacatttcagctcttgctcttgtttctgaattctgatgtgctgcttcagtatactcataatattttctttgccaaagtcccccctttgttgccttcctttcttactaacactgagtaacacaaaaaactacccgtcccatctaccaaatggctgtcgttccagtgccagaatagcggctttggataataaaatgctatttattatgagcatgattgccgggagtctaaatgactcgaaagatatgactgaaaagctaaggtgcatgtggtactgcatacatcacatctcaactcacttgcaattacaagggcagcttcttacaaatgactaacagctggataaggaaaatcaagccagtgacataaggaaactgcggatttggaggtttaacttatagaaaagggttacatttctccttttttgtgtttacctatgtgtgtggtccatgacatatgcaaatacacaaacaacctgaacatataaatgaatattatgaaattggggtgggaggaggttctaaagtgtttacaaaacttccacattctgagtgaaaaaatgagttctttcccaaacttttccctcctcacttgctgtctgcaggcacttattaagtgggcagagctttgtgttgccttctgcagcattttaacagccaaatgattagcactctcccctcccccaaatccctccctttcttctagtaaagctgctactacatagacggcctttgaggtgcttgacaagcatcactctggataataatatacttttttttcccatcatcttagacacacaggcagtcacagactgaaacagaaaaacagacacaggagctcagaaaggagagagggggtgggaagggagaatgagggagagtgagggagagtgagggagagtgagagagagtgaatgacagaatggaaagcactgcctgaccaataaaaatcgaaaatcaatgattcgctttcactaggaagaaaatacatagtcaactggaccattgaaatatcaaaaataaatgtctagggacccatacactttatctcctcaggatactggcaggaccatttcccaccccactactaaccaccaccctcttttttttttttcataaaaagtatactttcttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcaacagagcgagactccgtctcaaaaaaaaaaaaaaaaaaaaaaaaagtatactttctatgataaacaatttggaaaaaaataatataaataatatgtaagacttctacttttcatgaattattgaggttctaacctcaatatcccaataacctcctgattgctaaataaatgaatgtctcagaaactgacatgtcattattttacccaaatgagagcactgttcataaagattttaagttcatagcaaatcaaatacgtgttctgaggaaaaaaagaagaaaagacaagctcctaaagttcaatttgatataaaaaccttcaaaagtggctcaaaaaatatttatagttaaaaaatataatttcttctgaactgctatcctactgatgtaagaaatttcaagtaagtttcaagttaaacaccaccaataaaatccatgctctggtccattccattaggtaactctgtcttatggttcagtaatttgaaaaggtcaaagaaacaccagtttgtctattcaccctcatttgttacatcatcacaataattattttaactcaatacttcctaagcttatctaagggtgcgtaaaaccttatatctttatgtaccagcgtgtttccctggcacaactaacatctaataggtaattgagacttactgccatattcatgttcaaaataattagtctttgtgtccctatagcaccttaaagttgacaaagaacttgtaacagtctcacaggcttgggaagtttaaatgacttcctaaaagcctagtaactttcaatagcaacattaaagaccacgtcccttaattccaagtccaggtctttgttagtcatagagacagtcagaatggagacaatcaggggttagacagaggaagtaaataaattggatagcagagtaagatgagtattttcacaaggtatcctggaagatgataccttcggaacttcattccatctttgcagagaggcagacacttagagaaaaattagcaaagggagcctgattagtcttctaacgttggtggatcacagaggaaagcactttgtaaactatagagacttgcagaaataaaacacagcttgtctagcataggttctagaataccttaggcagtccctaagtcattcacctgacacatgtttgttgagcactcattatgtgattatttgattaatgtctatatcaccctctaaaatgcactccttaaagatagttttaactctttatttccattgcctagactagtgtctcattcattcaacaaatatacttgagaatctacttatgtggaaacacaaagtgaggaaaagctagcaaaatccctgcccacaagagaataaaaaactataataccgtacagaaagcatttgggagtgttttacgtctacaaaatagaggcatttaacccagaatggagcagtgagggaaagctttctggagaggggccttgagctaagatgaggaagaaccataggagttaactagaagttaggagaaaagagaattgcgtgcactctattgtatttgaaaaaggaatgaatcagcaatatgttatacctttatacaatcagtttaataaatacatccaataaaagtgcttcagagcaagcattttacagcaagcattttacaaactgaatatgcaatctttatttgagaaagaagagcattgctcatataactttgagtacaagtatactgtaaatgcatgtacaatatgtatgttatatattcatttgtttgtattcgcctcaagtgattaactggataatgtatgtaggtttagatataagtacataacattttgaagtgtagacccatttgggttttccactttgtgtataccttatctttgattgattttcctcagatataaagatgatagaggataattcactcctttgcctcaagggaaacattatgttgtttttataattaacaaggtattgacatgaagcatttttttttttaacagacacagtgctcagttgggcctgtgattttcacaagaagtctttggcaagataaaaagcctcagcctgcaagctgctttacttgatattccttgaggttaatgatctaaaactagaaatatattgattcttagtaaaacctatcattgaaagtttgatatcataaaattactcttgtaaattacttgcactaaacctgtaccttaaccacttaaatccattattacttttattttgtttgtttccaacagggaaaaatatgtttagaagtgaagtccagtcagtgtctattctagaatctaagccccttgagggcagatttaatgtatatatctggcacctaatatggtactggcacttaagaggcacaaaatcaatattagtggaatgaaagaataatcacagctctagttatgctattttttgatagtttttaaaaaatctatttaaacttatgatcccttattcatatgagaaccatatatttatattaattatatacatatatacatatgtgcatacataaaaatttaaaaataaatatattggtgcatgtagctgaaggtatttgcaaataaaaatattttcattggaaaatccagtctgatgtaagaaggtatggtttagaacagtcttatctataatggagaagggcaatttctagctgaagtgttacaagtacaggatgctactgaaactaggtgcttgctattgtgttagaaaaacagtaataaatataagcatgttaataataatagtaatttatcaagtggctattatctgaagtactggggtaaatactttgtaactattatctcatggtcataataccctttaggaaataattataatccctattttatagttaaggaaactgaagttgcttgaggttctatgacctgccgtgacacaaaacctaggtgaccccaacacagagagtggtctatgttatttccgtctcatcacactgcaaatcctgaaatcgtttctgtccctctgggtccaaactgagagtatggcacaaacagatacaaaaggccttctccttagccaaaggtagcctggactccatgcagatgaactataaacaacctgtgatcctcctaaaaagataggttcatctctgggttcctatctgacaccttccatagcttataagggccttgggaataaccccagaaggaatggactccacattagaaagattaggtccaaaggaaataacaagaaatccacccacctggcctcctatccctgtctatctgttccccatatacccagaacagcaggcacacaaatgacatctgcaaagcttgttagcttagtaaaataaatagactgcaggcaggtcatggcaaaatgcctgccctcatttccaaactctccagaggtaagtaagaaattaggatcaactgaaaaaagactgaatttttcagagtttctatcattaaaaaaatcaggacagtaatggatcccgaaaataattcatgaaaagcaggagtctatgtattctgttcaagttaaatgtgtatccttacaaaaaaatataaaaactaaacaagcaaaattttgagtgaaccaataattgctaatgaaatgaattaatttttagttttaacccatcttttaatcatgatattcaattgtatggacctaaattttatgtcagtttttctcatgtgagttggaacatagttaaatgatagccatgtagctctcccagttattatcatcatcaaaatctaaacaacctttgaaattttatataaatggtaggttataatgtaaacattcaataaaaattgtgtccctaacaaatcaaagtttacataaactttgttgaacattaactacatttcttatgaggctcaatttttcctattatacaatgctgtgggttgagtggattccagaaatccaaatagttgtgtgcaagccacaaatctaaaaagctataatggtcaaaaataaaattttgctttcaagtcaatataaataacctcagcagtattgctaaatgccattcccatactccaccttcttataccctgatatggtttggttgtgtccccacccaaatctcaacttgaattctatctcccagaattcccacgtcgtgggagggacccacgggaagtaattgaatcatggatgccggtctttcccatgctatacttgtgttatggaatcagtctcacaagatctgatgggtttatcagggatttatgcttttgcttcttcctcattttctcatactgtcaccatgtaagatgtgtctttcacctcctgccatgattctaaggcctcctcagccaagtggaactataagtccaattaaacctcttgttctttccagtctcgggtatgtctttataagcagcctgaaaacgaactaatacatacccaaagcacactggcctgttacctgttcctcaatatagtgtttcactctaattcttcctccgggccttgaatttgttgtttcttctgccagaaactgtttttccctggatttgcacatggctggctccttctcatcattcaaggctctgctcagatgttaccacctcagcaagaccttcccaaactgatttcccctaattagaatctcttccatcccttctccattacatcatcccagtttatttcctccatatgattatcacaatccaaaattatcttctctattcatctcttactatctcccctatctgaagtttaccagtgagagcaggaaccttatgttttgtccatggcaatctcaccagtgtttagaacataacagatgctaaacagagatttttgaatgagtgaatgaatgaatgagatgcatcacatggaaactctttaaaaagtatatggctagaatcagcagtccaacatgaaatttgcaatgcaagatctttaacatagtttggtttctaaggatctgatttacactaacaatagtatttacaaacatacacataaacaatagttttttggattcaaaattaatttattttgaaataaattgtattgggaataattaaggtatacaacatcatgtaagatatatatacatagtaaaaaggttattatagtgaagcaaattaacatatttatcacttctcatatagttacccattttttgtttttgtgtcaagaacagctaaaatctactcatttagcatgaatcccatatataatacaatgttattacctacagtcctcatggtgtacattagctctttaggcttcttcatagtacatatctgctagtttgtatcctccagcctacatctcttcattcctcccaactcagtaaccactgttttattctgtgtgtgtattttttaaattttattttgtatatggtaagtatgtgtatatgtatacacacacagatagatagattccacatatatgtgagattatgcaatattttcctttctgtgtctggcttatttcacttagcataatgtcctcccaggctcctccatgtcatggcaagtggaaagatctcattcttttttaaagctgaatattattccatattatgtgtgtaccacagtttctttatccattcacccactgacaaacacttatttccccatcttggctattgtgaataataccgcaaaggtcatacgagtgcaaatatttttacaagattgtgctttcatttcctttgtgtatatgcccagaagaggaattgctgggtcatacagtgttgtatcttcagtttctttagggacctccatactgttttccataatggctgtaccaatctccattcccaccaacagtgtacagagttcccatttctccacatcatcaccaacatttgtcatcttttgacttttatttagaaatagtaaacaatttatatgacactcccaaaacaaagaaaggtatgcacagaataatttttgtagaaaatatgcatttgtaacctatctttttaaaaaattatgagtacatgatagttatatatatttatagggtacatgtgatgttctggtacaagcataaaatgtttaatgatcacatcagggtaactgggatatccatcacctcaggaacttatttttttttttgtattagacacattccaattccagtcttagttttttgatatatacaataattattgttgactatagtcaccctgttgtgttatcaaatactagatcttattcattccatctaactatacttttatataaattaaccatccccacttttcccctccatcaccactactcttcccagccttaggtagccatcattatactcttttctctccatgagttcaactgttttaatgtttagccacatatgacacagaacatgtgaaatttgtctttctgtgccaggtttctttcacttaacataatgacctcaagttccatccatgttgttgcaaatgataggagttcattcttttttgtggctaaataatattccaatgtgtaccacattttctttacccattcatcagttgatggacactttgattccaaatcttggctaagtgaataaataataaatacaggagtgtaggtatctcttcaatatgctgatttcttttcttctggataaatacctagcaatgggattgctcaatcatatggtaatttctatttttaatttttgaggaatctccatactcctctccatagtggatgtactaatttatactcccataaacagtgtatgagggttaccctttctccacatcctcaccagaactcattatttcctgccttttggataaaagccattttaactggggtgagatgataccccactgttgttttgatttgcatttcttgatgattaataatgttgagtatttttcatatatctattggctatttacacatcttcttttgagaaatctctgttcagatcttttgtccattttaaaatcagattatttgttttttttcccattgagttgtttgagctccctatatattagggttattaatctattatcacatgaaaatatttcctcccattgtataatttgtctcatttgttgattatttcctttgctatggagaactttttagcttgatgtaatgtcatttttctatttatgctttggttgcctgcacttctgaggtattactcaagaaatttttgcccagaccaatgtcctagagagtttcttcagagttttctttcagtagtttcatagtttcaggtcttatatttaaatctttaatccatttttattttatttttgtatatggtgagatatagggttgtagtttcatttttctgcacatggatatccagttttcctggcacaatttattaaagagactgtccttttcccaaaatatgttcttcacacctttgtcaaaattgagttcatggtagatgtatggatttatttttgcattctctattctgttccattgatctatgtgtctgtttttattccaataccatactggtttggatactatagctctgtagtataatttaaagtcaggtaatgcaattcctccagctttgttctttttgttgcccatgatggctttggctatcctgggtctatactggttccatacaaattttaggattactttgttatttctgtgaagaatgtcattggtattttgatagggatttcactgaacgtgtagattgctttcagcagtatgaacactttaacaatattgatttctccaatctattaacacaaaatatctttccattttttgtgccctcttcaatttcttttactaatgttttatcgttttcattgaagagatcatttacttctgtgattaaaatttattcctaggcatattattttatttgtagttattgtaaatgggagtttttttcttggtttctttttcaggttgttcattgttgacatttagaaatgctaatactttttgtatgttgattttgtatcctgcaattgtattgaatttattcttcagttctattagtatagttttttggtggaatttttaggtttttctaaatagaagatcatatcagctatgaacaagaataatttgacttctttcattccaatttggatgccctttattatttctctcatttaattactctagctaggacttccagtgctatattgaatagcagtggtaaaaatgggcatccttgtcttgttatatatcttagagaaaaggcttttaatttttccccttcagtctggtactgtgtaggagtctagcatacatagcttttaattgtgttgaggtatgttccctctatgccacattttttagcatttttgtcacgaagagatgttgaattttattgaatgcttttcagcatcaaatgaaatatggttttatccttcattcggtcaatatgatatattacattgattgatttctgtatgttgagacatctgtgcatccctggacgaatctcacttggtcttgatgaataatccttttaatttgttattgaatttggtttgtgagtattttgttgaggatttttgcatctatgttcatcagagatatttgcctatagttttcttttttgatgtgtctttctccggttttggcatcgtggtaatactagcctcatgaaatgagtttggaagtgctccttcctcctagattttttcaagtagtttgagtaggattggtattagttctttaaatatttggtagaattcatcagtaaagtcattaggtcttgaatttttctgtgatgggagacttaattatgacttctgtctcattacttgttattggtctattttggtttcagatttttttcatggttgaatcttggtaggttgtatgtgtctagaaatttatttattctagattttccaattctttggcatatagttgttgatagtatctctaatgatcctttgaatttctgtgatatcagttgtaatgtcacgtttttcatctgattttatattgcggtgtcttctctcttttgttctcagtctggctaaaagtttgttgatttactaatttttgcttgttttgcttttgcttttctagttccttacaatgtatcattaggttatttatttgaaatttctctactttttaatgcaggtgcttattggtatacttccatcttacaattgcttttgctatatcccataagtttatgtatgttgtgtttccattttcatttgtttcataaaatcttaaaatttccttcctgatttcttcattgacctgcttgtcactcaggagcatattgtttaatttccatgtgtttgtatagtttccaaagttcctcttcttattgatttttagttctattccatagtggtcagaaaagatatttaatataatttcaatgttttgaatgttttaagactcattttgtactttaacatatggtctatcattgagaatgacccatgtgctgaaagaaagaatgtgcattctgcagcttttggataaaatgttctataatatctattaggcccatttggttgacagtgtagattaagtctgatgtttctttgttgattttctgtctggatgatctgttcaatgctaaaaatgggttgttgagctctccagctagtattgtattgtggtctttctttctctttagccttaataatatttgttttatatatatgggtgctctagtgttgggtgcatatacatttataattgttatatcctcttgccaaatggactcctttatcattatataatgtccttctttgtctcttcctttagttcctatcttagaatttattctatctgatataggtatagctaattcctgctctttcttagtttacatttgtacagaatatctttttccatccctttaatttcactctataggtgaagtgagttttgtaggcagcatataattgggtcttttttttttttttttatcagtttagccactttatgtttttcattggaaagtttagtccatttatagtaaacgttattattgataggtaagaacttactcctcccattttgttatttgttttctggttactttgtggtcttctcttccctccttccttcctgtcttcctttgtgtaaaagtgattttctctggtagtatgttctaatttcttgcttttacttttctgtgtatctgttgtgggttttttgatccgaggttaccatgaagcttgcaaataatatcttgtaaaaaataattttaaactaatgacaacctaactgatttcagaaacaatgcacaagcaaagagaaaacttaaaaaaaaactctacactttatcctccatgttctttgacttttagttgtttctatatatttttatactatctatttcttagaaatatgttgtagttattatttttgattagttcttttactattcctattcaagatatgagtggtttacacaccacaattacagtgttgcagtattctgtatttggctgtgtatttgctgttaccagtgagttttgtaccttcagatttcttattgtttgttaatgtccttttcttttagattaaagaactctctttagcattgctcttaggacaagtccactgttgatgaaatccctcagctgttatttgacttgtaaagttttatttttccttcatgtttgaaggctattttccctggatatgctattctaggataaaagttgtttcattttttttttccttcagcactttaaatatgtcatgcacctctatcttggactgtcagatttccactgaaaaggttgttgccagatgtatgctcccttgcaatgttgcttgtttcttttctcttgcttcatttaggatcctttctttatccttagcctttgggaatttgattattaaatgtgttgaagtagtcttatgtggattaaatctgcttaattttctatgaccttcgtctacccgataatattttttctaggtttggaaatgtctctgttattatttctttaaataaactttcttacctgatctctttctttatttcctccttaaggtcaatacattttacattttcccttttgagactgttttctagatctcataggtttgcttcattctctttattatttttttcttctttcccccatggctgttttttatacagcctgtcttcaatctcaccaacttttccttctgcttgatcaattctactcttcagagattcgaaagcatttttcattttgacaatagaaatttttcagctgcagaacttctgcttgattatttaaaaaattatttcaatctgcttgttaaatttctgggataagattttgaatcccttctctgtgttatcttgatgctcactgaactttctcaaacaactatttttaattctgtttctgaaagttcatctatttccaccactctagaatttgtcactggtgacttatttagtttgtttagtagatcatgttttcctggatgttcttgatgcttgtggatgtttgttaatatctgggtatttagaagttaggtatttattttaagcttgcagtctcagcttgtttgtacctatccttcttgagaagggtttccaggtattcaaatggaattgggtgtggtgatcgaagtctctggtcactgaagccatatcaacactgggagataccgcagaactagtaatgctgtaattcttgcagactcctagaggtaccaccttggtaggcttgggtaagatctggggaattccctggattactgggcagcagtctctgattctcttccctcacttctcactttccccaaacagaagtctgtctgtatgtctgtttctccctctctctctctctctctctctctctctctctctctcctgagcttcctggagttgggggagggatggcacaagcactcccaaagctatcacagccaggactgtgctggataatacctgaaggcatcacagtatttgggtcttatccaaggtccatggctactctttcctggctgctagtgatgtttcttcaatgcccaagggctctttagtcatcaggtggcatatttagccatgaaggggtccctcctgtcaggggagcaggttcccttctagccaagggtaggtctagagatgccatccaggagctaggacctggaattaagggtttcaggatccagcgtggtgctttattttaccgtggctgagctggtacccaggttgcaagatgaagtcctttgtactttttcttctgctttcccaaagtctaaggagtctttcccaagctgaatgcctggaattagggaggggtaacacaaacacttccttgggtgtgacaactagtgtctcactgggtttcatgtaccccaagtccactggccccaagcccagagcagtgccaggacttatccaaggactgcaaaccttgttacctgactgacattcaaatttatctaggacattaggctactttagtcagccaatggtggagctaccccaaactcaggttcctaccactggggtggagaattcccctttgaatggagctagtctaaatgcttcatctgtggacaccggtggaattttgccctatgttgtattctgctgtgagagggcagaattgagttccaatgcaatgtctcacaatcacttcactctctctcctgcgaacacacagattttctgaatacatgccatcggttggggaagggtggtataggcaatgcgaaactgtctttcctaccttctttagtgtctctttccttgatatagtatttaagccagctactgtgatcactcacctaacctttggttcttatgaaggtgctttcttgcacagatagttattcaatttggtgttcctgcaggggggataatcactggaacgttctattcagccatcttcctctgcctccctcctatctattgactttttgataaagccatcctaatgagcgtgaagtggtttctcattgtagttttgatttgcatttccctgatgattgataatgtttagcctctttttatatacctgttggacatttctgtcttctttgaagaaatatccacccaagtcttttgcccatgttttaattagttatttgttccactactgagttgtataagttctttataaattttggatattaaccccttatctaatatatgacttgcaaataaccattaacttttcatttaccaagtataaattttcatatgcataatatcattaagtattcataaccaatgaattaagtataattttacaggtaaagaaactcagactaagaaaaactgacttacccaaagttatttaactactgacttgatgaaccagtatggtcaatattcttttattttattttattttactttatgttccaggatacagacgcagaatgtgcagatttgttacataggtatacgtgtgccatgggttgctgcacctatcaaccaatcatctaggtcttaaatcccacatgcattagctatttgtcctaatgttctccctccccttgccccccaccccctgactggccctggtgtgtgttattccccacactgtgtccatgtgttctcattgtacaactccagctgatgaatgagaacttgtgttgtttggttttctgttcttgtgttagtttgctgaggatgatggtttctagcttcatccatgtccctgcaaaagacattatctcattcctttctatggttgcatattattccatggtgtgtatataccacattttcgttatccagtctgtaattgatgggcatttgggttggttctatgtctttgctattgtgaatagtgctgcaataaacatacatgtgcatgtatctttataacggaatgatttatattcctttgggtatatacctagtaatgggactgctgggtcaaatggtatttctggttgtagatctttgaggaattggcacactgtcttccacaacagttgaactaatttacattcccaccaagagtgtgaaagcattcctgtttctccacagcctcaccagcatctattgtttgttgctttttaataatcaccattctgactggcatgagatggtacctcattgtggttttgattttcatttctctaatgatcagtgatgttgagctttaattcatatgtttgttggctgcataaatgtcgtattttgggaagtgtctgttcatgtcctttgcccactttttaatggggttgcttttttcttgtaaatttctttaagttccttgtagattctggatattagacctttgtcagatgggtagattgcaaaaatttgcccccattctgtaggttgcctgtttgctttgatgatagtttcctttgctgtgcagaagctctgtagtttaattagattccatttgtcaattttggcttttgttgctattgcttttggcatgttcatcatgaagtctttgcccatgcctctgtcttgaatggtattgcctaggtttttatccaaggtttttatggttttgggtttacatttaagtatttaacccatcttgagttaatttttgtataaagtataaggaaggggtcaagtttcagttttctgcctatagctagccagttttcccagcatcatttattaaatacggaatcctttccccattgcttgcttttgtctggtttgttaaagatcagatggttgtagatatgtggtgttgtttctgaggtctctgtcctgttcccttggtctatatgtctgttttggtaccagtaccatgctgttttggctactgtaggcttgtagtatagtttgaagtcaggtagcatgatgcctccagctttgttctttttgctcaggattgtcttggctatatgggctttttttggttccatatgaaatttaaagtagtttttttctaattctgtgaagaatgtcaatagtattttgacgggaatagcattgaatctataaaatactttgagcagtatggccattttcatgctattgattcttcctatccatgaggatggaatgtatacttgtttgagttgtctcttatttcagtatggtgaatattctattgaccaagtggatgaaacaggataaatcttgattatctgatgccacttcccatcccatctttgttctaataatcttctgcactttgaaaatcactgaactcattgatccaggtagtaaatagcataaacttcaatgtttggtcctaagtgctctaaatctgaacagaatatacttcattgttttcaagcaagtataaaaaaacagaatcctaaatacagatgtattcaattaatataatatcatttctgtagtgtttgtgttgctttagagacaacaaaaaaatatattaatattggactgattagttaaataaagctttataaatatatgagacttaacaaaattcaaacttgaccagatggaatgagctacgttgggaggtggtatatatcctacaacttgaggctttccagcagatgacagaatcccttttagcagagtgacaataaacaattaaaaactaaggagagccactactctatattgcctttaaaattacctttaatgctgattctgtaatattttcaaacttggccctctgggaagattaactcaaaaacatcagtttttaatttttttttttttttttttttttttttgagacagagtctcactcagtcgcccaggctggagggcagtggcttaatctcagctcactgcaggttccgcctcccgagttcacgccattctcctgcctcggcctccccagtagctgggactacaggcacctgccactatgctcggctaatttttttgtatttttagtagagacagggtttcaccgtgttagccaggaaggtctcgatctcctgacctcgtgatccgcccgtctcagcctcccaaagtactgggattacaggcgtgagccaccgtgcccggcctccgtttttaaattattattgtatcataagaagaaccacataaccttaaatttataatactgaccactcttaagtgtagagttcaatagtgttaagtatattacattgctgtgaaacacatacctagatgagtttttcatcttgaaaaactgaaactatataaccaataaacattaattccccctccctcatctctccagccctaggcaactacctctctactttgtttttatcagtctgcctactttagatacttcataggagtggaatcatacagtgtttgtccttttgtgactggcttattttgcttagcataatgccctcaaggtccattcatgttagcatatgataggatttccttttgttcctaaggctacatagtgtgtgtgtgtgtgtgtgtgtgtgtgtgtgtgtgtgtgtgtgtgtgtgtgtaacattttctttatccattcttctgttaacggacatttgggttgcttccaccacttgagtattgcaaataaggctgtgatgaccatggctgtgtaaatatttcttcaagatcctgctttgaattcttttggatatttacccagaggtggaattgctggatcgtacggtatttctatttttaaagttttcaagaatctttatactgttttccataatggtggcaccattcccaccaatagcatacaagcatttcaatttctccacatctttatcaacacattattttctgttattttgacagcaggcatcctaatgggtgtgaaatgatttttaattgtggttttgattggcatttccctcatgattagtgggttgaacatttttcatagatgtattggccatttgtatattttctttggagaattttctattcaagtcttttgtccatttttagttgtgttacttgttatttgttgttgagttgtagaagttcttcatatattctggatataaagctttcacatatatatgatttgcaaatacttcctccagttccattggttgtcttttcactctggtcattgttttctttgatgtacagaagtctttaagtttgatgcagtacaatttgtttttttttttttgctttcagtttcctgtgcttctggtgtcatattcaagaaattgttgccaaatccaatgtgtcctgacatttttctattagttttatagtttaaatattacattttctgtaggcattatagagtttaaagtcttacttatatctttaatccatctcgagttaatttttgtatatggtataaagtaagggcccaactttatcttttgcatgtagatatccagttttcccaccaccatttgttaaataaactatcctttccccagtggtagtcctagctcccttatttaaaataatttgccatacatgcaagggtctatttctgggatctacattctctttcactgatgaatatatctgtctttatgccagtaccacaccatcttgattactgttgctttgtagtaagctttgaaatcaggatgtctgaggtttctaagtttgttcttattctccaaaattgattaggctatttagtgtctcggaactaacgcttttaaaataaggatcatgggaagcatttaatgtaaacatatagagacaaagggattctcattctgctctcattccataaaacaaacaaacataaaaacattctttcccacagctgagtggcattcagaaaaagaagctcccttctaaatatcagaaagaacagttaccagaaaaatagagctgagctacaaaattcttgttaattagaaggtgcagctatttaacagagtataaatatacactatagcctaaaaataattaagagcaatgctgaaattctctaaagtacatgatcattctatcaaaatatactaaatgtattataatagaaagaactcataagttatttatttattaattttttttttttttgagatggagtctttccctgtcacccatgctggagtgcagtggcgctatctcagctcactacaacctccacctcccaggttcaagtgattctcctgcctcagcctcccaagtagctgggattacaggcacacaccaccacacttggctaatttttgtatttagtagagatggggtttcaccatgttggccaggctggtctcaaactcgtggcctcaagtgatccacccaccttggcctcccaaagtgctgggattacaccttggcctcccaaagtgctgggatcaccaccttggcctcccaaagtgcatgggctaccgcacccagctccacaaattattaatatctaatcagtctctcactttagattagggtttagattaggaaactgaggcatacagctagtctaagtgacttgcccaagaacattcaaatagtaagtgtataaagacaataatctaacatctgtttccagttatgacttactcttacacgattcttccttctcagtctgatatgtgtcctacagtcaaatgtgtttctaccttgttacctctctgttcttactgaaagaaacctaactttctgccccacccattgtggtacttgcatggtatttacttagtctcttaatcaaccagttttaattcataagattgtctttttcagcagaaaacagagtctagccaaagtatcaaacaactaaaacagtatctaaaacaaaatattcctgaaggcatttagtgctctactcatttctccaattgcatgcaacatctagagcatttacctatcaatcctttcatatataactatcccatttcatcctctttatattactatagtatagtaacaataggtataatctcattttatctcatttcaggcacaataaaaagtcatttaatgtgcctgaggtcacatgactaatttgtgatagagccaagatacaaatcctggtctctgactttggatcttttgttcattccattctatcacactgtcctacttttgatattacacttggttctcaacaaatatgccccatctcctctaaaggtattttcttagttgttcccataattgaattagtcaactctatctatccattagtcagctttcctctaaataaccccatttttgtgctgataccacctaactctcaatttacttagtcaccaagtcctgtcaattatttctttaagattcatcatttctctataagctgattacaattttcattgtttctcactaggactctggaatatcaaatctccaagctttatgctttgcatattaggtttatttaaacacagaagatatccctaaaaaatactcccaattattttaaattgttcaaaggaaataataggaataaaataaagaaagaaaccatattaaatatgaagtatttattcctcattaaaggtctaaagttttcattaatatctttttattttccaaatgttaataaaaatatcaactcaataaaataaatgcaaaacttgcaatttatttcaatagcatgaatatctactatttgccaagcagtactaagcatgttcatattgaggatcacattaaaatttcaaaagtaccctaaaagatgaggaaatggaagcttttagcatttaagcagcataagctagcaatatgctctccaattatgaaaacaagtttctctaatatatttttcagcatttatttaatttagctgcctggaaggttggcatatttgtatcccacttaggactaatgacttcattttcaggaagcaaaaatacaaatatccttgcgaacagccaggaagtacaaaaatgtgttttctaagtattcatgagcccatcatggatgcccaccctccctctcttcttttggagaaaaaaaaaaaaaaaaaaaaaaaaaacagtctcattgccaaattagataacttcctttcctggaagcacatttagtattttattactgtctcaaatagttaacatcttctaggttaaatgaaagtatttttcaagagaggaaaagtgaaatagcttacaaaatgactgtgtgataaccagcacttgaagactacgtactaaaacacagaacccaaaataaaacacacacaactactcaacgtgatacacattcagtgtcagctcagaagcctgagaacccaatatgctgaccaggccaaagctagaaattaggttacacattttcttttctttctttaacactactagcactatccacaaagaacaagacaagtcttacccatgaagcctagtaagaaaagaaaacagtataacacttacagttgtcgtctcatcagtttcattttcaaaactctgattttctttattttgctcaatacatgaagcattttcctttgatccactgcaatctgtaagctaaaataaaagtttaaaaaatcaatactccttttttattttctgcaatgtatattgttttcaaactttgaatatacacattaaaatatctaaggcctgaataaatattagatgttgcttatttcaattttagcatatgaatgtactatctaacccatttttatattgctcccaaagagaaaacataaaatgggacagttattcaaaggccaattttaaatttcaaaggtttccagcagggagtgttgaacatgggctattcaaaagtaaatggatgatctggttaaagctgagcatggttaatgggaagatgaagatagagggctgatttcactttatataagttctcatgcttggagaaatctctatggaagctattggagctctcagaactagcagtggcattgactgcctttgctttgggctgtctttttataactacagctttagatgataaaaataatgtctactttcaaagcaaagggtaggtttgcttactgaccattataaaacagatgttacctaaactgagggaacacaacctacaatatgacccattgaatatgactgtatcatgtgaccatctttgccttgcactgtaaaaattggggcttgagaaattggtacaagaagatgttgatagtctactgctgttgttgcaagtaattagtctctgccctacgattcttttggcagcatcgatgaaattgtggcagactaaattcttagtttgcaagtaggatacaatcttagactcctcacagttcttgagagtgacaaggatggaattctgacagattcatagtgttctggaagaggaaggatcagagacttctaggctgatgaaagggattcgtggaacatctttaggaactgggtagtaaacatgctgaccacactgaatgttcaactgcataataaggattcctcactttaggccaggcacaatgtctcacacctgtaatctcagtactttagaaggccaaggaggatggatcacctgaggtcaggagtttgagaccagcctggccaacgtggtgaaaccctatctctactaaaaatataaaaattagccaggtgtggtggcatgcgcctgtaatcccagctacttgagaggctgaggcaggagagtcacttgaaccagggaggtgcaggttgcagtgagccactgtgctccagcctgggtgactgagcaagactctgtatcaaaaaaaaaaaaaaaaaatcccctcactttaatgcacgttaatgaggagaaatttctaaagtggttgcaggctaggacagctcccaaatggtttttgccaactctcctctggctgggagaacttcctcaccaacctagcagtcggcctcagtttctaagattcactctaaaaggagtgggtgaacagaaatttccactccttttcaggcaatagctatagagacatgtacctgcactgattgtgacaggagagaaatttgcaaccactgtgggcagaaggatttctctgatactagtctattgtagactctcctcttctctgctcccgtagtttacatctatcattgtaattagcatattgtattataaattacataaatgtatatgtatatatatgtgtgtgtgtgtctacatgtatgtgtttatgtatgtttatctgtcccattagagtatcttgtaagacaagcaggatatcttactgtttttcagtctctagaataaatacatatttgtttgatgaatgaaaaataaagattaaattagatgaaaagttgatacatagatagatgaacaaactgagaagatgtgtcatctcatgaagagcagtttcaggctcaaccactttgggatacccaggtagcctctgtatcagaaacatagagctctttattttgtgctcccctctttgggccactcctctttggtcccatgaactatccaaataaatcagggcagtcaatctgactgtatctctcatgtagatgtacatagtaaggacctgtcctctgatgagacccactggaatcaagatgctgattgagcctgcactgtcaccattgctaattggatccatcatcatactgaacacggcggcacatccaccatcatagactaagcgcaaagtaaaagactgcttcccaggcaaaggctacctggttgtcctaaggtgattgagctcggcatttctcttagccagatcagagcccttattcattgtttgtacatttgttcatctatctatgcatctctttgtgatggttaatactgagtgtcaacttgattggactgaaggatgtaaagtattgttcctgaatatgtctgtgaggttgttgccaaaaagattaacatttgagtgagtgggatgggaaaggcagacttatccttaatctgggtgggcaccatctaatcagctgccagtgcagctaggatataaagcaggcagaaaaacacgaaaagattagactggcctagcctcccagcctacatccttctcccatgctggatgcttcctgcccttgaacattggactccaagttcttcagttttgggactcagactggctttccttgctcctcagcttgcagatggccattgtgggaccttgtgatcatatcagttaatacttaataagcacatatatatatatgtgattctagagggacagaatattaaggatgaagtcctttcattggtttgggggtttctggagttggctgcttaacatgattcgacccaaaaatgctaaaggctctacttctagtagtatggagaacactgatagtccttggcatgaactgtttagagagttatgcaagatgaatgcatttgacattcctgattcaccattcgtgagaggcaaggagtttagcgactctatacataatacatttgactatatgtggagaatcaaggaatataatgaagctggttggttgctcctgagttcagtggacaaagtgatgaaaggaaatgatgaaatcagggattctaaataccagcttcagaagcagatacggagcctcaaatctgctaagattaccctgagtgaaagtcttatctcctgtagagaaagatatgaaattgtgggaaaacagacacaagcccttaaagtgagggcactgattggaaaagaatgggaccctgcaacttggaatggcaatgtttgggaggtctctcatgaagctgggaacactgagtttgtaaactctgacgaagctttttttgccagaagaaacagctcccccattcccagtagtggcaacatcccctccccgacccattagcctttccaccgttgtctgaggagataaaccccgcactgcctgagaaaacagtgacaccctcccctgaggcagttgccaggcaagataatgttgattctcctcaggagccacccccaacagccctgtttgcttctagacttataactaggctgacctctcagtgggccctagaggtgaagttcagagtgtgacctataaggaggtacactatactcaaaaagaactacttgaattttctaatttatataaacagaaatctgaagaacaggcatgggaatggatattaagggtgtgcgataatggtggaaggaacatagaactggatcaggctgaatttattgatccggccccactaagtagggactctgcatttaatgttgcagctcgagtgaaaaaaaaggttgtaataatttgtttgtttagctgaaatatggattaaaagataacccactgtgagtgagctggaaatgcctgatctcctttggtttaatgtagaggaagggatccaaaggcttagggagattgggatggtggagtggattagtcactttagatctactcatcccagctgggaggtccagacgatacattcttgaccaatgccttacaaaatagatttgtgagggcagcacctgcatctttgaagggccctgtaattgttctactctgtatgtcagatctaagagtgggaactgcagtcactcaactaaaaaaaatttaaatacagtgtgaataatgggatcccgaggtggcaggggccaagcggtagcactcaacctccaaaggcaaggtaagcatagctaccataatggacagcagaggcaaaatggcaatcagaatagtctgactcgtgtagagctctggcactggctaattaatcatagtgtttctagaagtgaaattgataggaagcctactgcattcatacttaatgtatacaagcagaaaacttctaggtcaaatggacaaaagactaatttgaattataaaaacagaatcatggcccctcaatcaatttccacacttgagtcagtttacagacccagaaccccttgaatgaaggggagaccaggtccccttgaggaaggaccctactacactaccaacaatttatactgttaatttttctctctccttccccaaggagacctccagtcttttaccagggtatctgtgcactggggaaaggaaaatgttcagacagttcagggattactggacactggctctgaactgacatcgatttcaggggacccaaaaggtcattgtggtcctccagttaaagtaggggcttatagagatcaggtaattcatggagctttagcttggatctgacttacagtgtatccggactcatcctgtggtcatttctgcagtgccagaatgcataattggcatagacatacttgcaagctggcagaacctccacattggctccatgactggtagagtgagggctattatggtgggaatgccaaatggaaaccattagatctccctctacctagaaaaacagtaaatcaaaaacaatattgcatccctggagggattgtggagattagtgccaacaccaaggacttgaaagatgcaggggtggcaattcccactacatccccattcaactctcctatttggcctgtgcagaagacagttggatcttggagaaggacagtggattatcataagcttaaccaagtggtgactccaattgcagctgctgtaccagatatggtatcattgcttgagcaaattaactcctggtacctgctatgcagccattggcttggcaaatgactttttctccattcctgttcataagacccatcagaaacaatttgccttcagccagcaaggtcaacaatagacctttactgtcctacctcaggggtatatcaactctccagctctgtgtcataatcttatttggagagaacttgatagctttttgcttccacaagataccacaatggcccattacattgatgacattatgctgattggatccagtgagcaagaagtagcaaacacactggacttattggtgagacatttgcatgccagaggatgggaaataaatccaactaaaattcaaagaacttctacctcagtaaaattcttaggtgtccagtggtgtggggcctgtcaagatattccttctaaggtaaaaaataagttgctgaatttggcccctcctacaaccaagaaggaggcacaatgcctagtgggtgtacttggattttggaagcaacacattcctcatttaggtgcgttactcccgcccatttattgagtgactgccggttttgagtgtgttccagaacaggagaaggctctgcaacaggtccaggctgctgtacaagctgctctgccatttgcgccatatgacccagcagatccaatggtgcttgagatgtcaggggcagatagggatgctgtttggagccttcggcaggcccccataggtgaatcacagcagaggcttctaggattttggagcaaggttctgccatcttctgcagataagtactctccttttgagaaacagctcttggcctgttattgggctttagtggaaactgaacgtttgactataggtcatcaagttgccatgagacctgaactgcctatcatgaactaaatgctttctgacccatctagtcacagagtgggtcatgcacagcagcattccatcagcaaatggaagtggtatatacatgattgagctcaaggatgtcttgacggcacaagtaagttacatgaggaagtggctcaaatgcccatggtgtccactcctgccaccctgccttctctcccccagcctgcaccaatggcctcatggggagttccctatgatcagttgacagaggaaaagactagggcctggttcacagatggttctgcacaattatgcaggcaccatacccctgcatactacagctgcagcactacaacccctttctaggacatcgctgaaggtcagagtgaagggaaatcttcccagtgcacagaagttcaagcagtgtacctcgttccacactttgcatggaaggagaaatgaccagatgtgtgattatatgctgattcatgggctgtagccaatggtttggctagatggtcagggacttggaagaagcatgactggaaaattggtgacaaagaaatctggggaaggggtatgtggatggatatctgagtggtcaaaaaccgtgaagatatttgtatcgcatgggattgctctccaatgagtgacctcagcaaaggaggattttaataattaagtggataggatgacctgttctgtggacatcactcagcctcttttcacagccacctgtcattggccagtgggcccatgaacaaagtggccatggtggtagggttggaggttatacatgggctcagcaacatgcagttccactcaccaaggctgagctgcctggttatggccactgctgagtgtccaatttgccagcagcagagaccaacaccgagccctcgatatggcaccattcctcaggatgatcagccagctacctggtgtcaggttgattatattggacctcttccatcatggaaaaggcagaggtttatcctcactggaatagacagttactccggatatgggtttgcctatcctgcacgtaattcttctgccaagactaccctgtggactcacggaatgccttaaccacagtcatggtattccatatagcattgcctctgaccaaggcactcactttacagctaaagaactgtgattgtgggctcatgctcatgctcactggtcttaccatgttccccatcatcctgaaacagctggattgacagaacggtggaatatccttttgaagtcacaattacaacaccaacaaggtgacaatactttgcagggcttggccaaagttctcaagaaggctttgtatgctctgaatcagcatccaatgtatgctactatttctcccatagccaggattcacaggtccaggaatcaaggggtggaagtggaagtggcaccattcaccatgacccctcgtgatccactagcaaaatttttgcccctgttcctgcaacattacgttctgctggcctagaggtcttagttgaagagtgacaaactctgccaccaggagacacaatgattccattaacctggaattgccacctggacactttgggctcctcccacttttaagtcaacaggctaagaagggagttatagtgttggctggtgtgactgacccggactatcaagatgaaatcagtgtactactccacaacgggaagtaaggaagtgtgtgcgtggaatacaggagatccattagggcctctcttagtattaccatgccctgtgattaaggtcaatgggaaatgacaacagcccaatccaggaaggactacaaatggctcagacccttcaggaatgaaggtttgggtgactccaccaggaaaaacaaaaacaaaacaaaacaaaaaagcaaaacaaaaacacacaacctgctgaggtgcttgctgaaggcaaagggaatacagaatggttagtagaagaaggtagtcatcaataccagctgcaagaatgaggactgtaattgtcatgagtattccctcctacttttgttaaaaacatgtgtaagcatatatacgcttgtattaagaaaatatcttcattttatttcctttttcctttattatgtgacataaaatttattgacttcatatcagcattaaagtattgttaactttatgtagtagtatttgggttggggattggtgcatttccagttgtacaaacaatagttgtattatgttagatgtaattatggccttattattgtctttatttgaagattatgtatgatctcaggagatgtacgtgggttcaagttgacaaggggtggacttgtgatggttaatactgagtgtcaacttaattggattgaagaattcaaagtattgatcctgggtgtgtctgtgaggttgttgccaaaggagatgaacatttgagtcagtgggctgggaaaggcagacccacccttaatctggataggcaccatctaataactgccagcacagctagaatataaagcaggcaaaacaacgtgaaaagactagactggcctagtttcccagcctacatccttctcccatgctggaagcttcctaccctcagacatcagactagaagttcttcagttttgggactctgactggctttcctgtagacaacctattgtgggaccttgtgattgtgtgagttaatacttaataaactcccctttatatatattacacacacacacacacagacacacacacacacacacactattagttctgtccctctagagaaccctaatacactatctgatttaatcttttatttttttcattcattaagcaactatcttttgatctctggagacaaaatgacattaatatggactgcctgtcctctgaagaactctaattggccagagaaatataaaaatacgtaatttatattacatatatagatcatgataatagaaagtataggaggagcatctatattagactgtggaatcatgaaggcttcctgaaagatgtaacattgaaataatactgaagacaaaggaggttatctaggcaagtaggagtattcaatctaatagaaaatagtgtgggcttgaaaggcagcatgctctgaaggaaaaggcatagattttagagtaagaaagaaatggattaaaatcctttcacttccacctactacctatgtggaatggaggcaatatttaaattctatgactatcatcattgaaaatatggagatagtgccacccattgaatagggtcttcttccaccttactaaccaccctatagctgagttggatgccttggattgtaggggagaaaaaaatagctttcctctaccctcctacattctttggctgagctacaaattaaattgacataaggcagcttaactggagagacattattctaataacatgtgtacccatgtatgcatgggagtctcacaaaaatatgaaactcaaataagggacagaattcccttattccccagattgaagcttatttagcattctgagctacagaaagaaataagggcttggggtttctggggctggtgaagccaaattatagaaaggtgaggggaagaaatgtatagtgaataaaggttgccttgttatgcagatcaaagtctctcatctgataaaagttgtcatagactaactctctttctgacacaaatatctttactaatgaaaatctcctatataaatataaatttcctacataaaaggggagtttttcaatgctacttcagtgtctgtagtttcacaaaataaccagctttaaaaaaatcagtatgccacagaggaatatttggggctggtactctggtctcctatagtcatatttttgggtggcataccctgggccccagtgagatttacaaccttcctacctcataccagatgttgtcccatatatacatacatacaaagcactcagtctcaatatcatgactgattctctatttgtttatgtttccaccgttacttcatcccctgataacttgctgtcaattatgctctcatagaaatagtaaatttcttctatgcttctattcttccttcatttaaaaaaagaccctgatcacttcaaaactttaatctatttctgactttctcctccccagagtcaattctgttgaaagacataatagaagtagtaatagcaacaataaaaccgaatcatttaatgaaaagttacaataagctaggcctctcttcaaggatactgatatatattttatgtgcattaactcattagattaaaaagcatcttatgaagtaggcttatgatctttattttctgggtaagaaaacagaacctatttctgcctgaatgaaaagcctacataactaactaatatactaaactcctgagccactttcttactgcccacacatcctttcaaattgtggttcccagaccagcagcatcagcaccacccacaatgtcttagcaagatcaactcttcaacctactgaatcaaaccagtaggggtggggctctaaagtctgtgcttcgatgagctctccaggtgattctgacacatgctagtttgaaaacctctgatctagttaacaaatgttaaactattccaagttagcaaggtataagacacatttacgaagagatagatgattctcggcacaatggaaaattaatgcctgtctaacaagtgcagtctctagtcacttccaaacatttgttgccagatgtttaaaactatcaagagaacttagaagtctgaatttttatgtgaaatagcttgacttctaaatgttgacaacataaaaaaagaggttatgggaggccattgttttggactgagttccttcactaggccccaaaagaccagacgaaatcagaatggagtcattcatgctaggtatcacataatcaaactgacctttaaaatgggacagttttctaaagaacaagagattcacagcaacccattagaagaggccccatggccccatctaagtaaactgacctgataagaatgtctcctctgttttaactctataaggaaagtactttgaaatgaccagtctgctttttattccttagttctgcttctttcagctcctttctgcctgtaaggtcaataggctctgctcagctcatcagaacacctttctacttcatagatggaatgcttcctgatttcaacaaatttaatttaatgatcaaactggttttcaggaaattttgttctttgacagcaactatatatttttaaaatatcatctaagctaacatgcaataggccaaacaaaatataaacctgcactgcagtttccataagggcagccagtttgcaacctctgtattaatcctcaaatgctgccttctcttccctgaatactgaactcttaaaactcaccaagaacctcctagtcctcactgtcttcctagttctgtccaaatgaaaagcctgtgcagctaactactacactaaactcctgaaccacatctttactgcccactcatcctttcaaattgtggtccccagaccagcagcatcagcgccacccagagatttgttagaatctttttctgactttctatactcctcattatcttccactttctctgacatttcacacgattgacctcttcctccttcttgaaagttatacctatattcagaaacatctctctctcctatttgccacccaatctcttgaactctccttctctgtcatttcctcttcttccttttaactcctgaatcagctgttactctgaaattccttttatcgcttctctcactactcactactcaatgattcttcatctaggctttaggaagacattcttcccaatttctggtcctacattttcaattgcatgcttgtatttcctctaaaaaatcacactggtacctcaaatctgttctatctaaatgcaatcatttttttttcagaacccaatttggctacctggcttttggtaattccactacccaaatttcttaagaactatttatgactccctcctccacacagcctgtgctgatcctctttctttatccagctggatgggctctctcaatctataatgccttcaggaaatattcttctcctctacacctttaataatgattagtccacctgatctctttaggaacaacctagaatataaaaaaaaaggaaaaataaacttgtcattgcttatatatttatcttctccattcaagcagatttaaagcttcttcaacacagtaagtttattaccatcttgacatccttcatagtactttaacaaagtgaatgcccatagatattaagttgtttaattatgcagtgtttatacaagtattttctacattacacaatatgtatggacaaatatttgccaactttactttaaatgtattcatcttttatatacatatccgaaaagtttcctatataaaagaatattataataaacttagaaaaatctagatctcttttgtagagtaaataagtactcagtggtttaactgtttggtagattacttttttatttatttatattattttgctcaaacctagaattcttttctttggaaatgaatgtcagtactaatgagcatcatgtacaaaatctgtgtccttgcaggaaccaaaagccatataaactctaaaaatatatgttaaaaaagttaaacagagttctacgatgccaggtcactgggaagcactgccccttcccatcctctaagaatgtcaagtgtacagatcagcctgagtcagatcccagttgtactctggagtaatccaattctattaatatttcctgggtctcatatttatagaatgcctagtttacttaactctatactattctcttcatacaaaagaaatgttacaaactacagaggtatgaggtgaggaggagtctttaggtggggttcagaacatgctaccccaaaatagggcaatgtagcatttgagaaaacagcagaatcaggaagttcactctcactttcccgtcaccctgaagcaagtgataaaaccttcattccagaggaaccctcctaatacccagagggaaagaacatccttgtgctcaaagacacaaagaagacaagaagaacctgaacaaacaggccttaagtctgcctagtttattaccattagatcatatctcttttgccagtcatacttctgcatggctgcccactcttcatcaaattcagcataaaaatacacaggtttccctttttctttaggtcttcacttctctgtcatgtaaaacttatgttaaattaatgcatatgcttttctcttgttaatctgtcttttattataggggtcttagccatggacctagcaatggataaggaaaagatattacttttttcccctacacttttattttacagaaaacagcatgctaccattttatagactacttcaggattacaaacaatgggtaagtttaaactaagtagttctcctctgctgaaataataataaacttcactctcttagcctaaaggcctcaggattccttgaaaaaactgggcacagacaaataaaactaggcacaacctaggagttcaagagaagagagtatcagttatcaagaaaagtgtccaccttatttgttgattcaatatacatgtattaaattgtattacatgcaaagcactaaagaagatgttttggggaaaacacaaagaagacagtgtccaaaaagaatttagtgtaagaaaggaaacaaatatatacaaaagtcactataaaaccatgtggaaagatttgattgtcaaaaatgaagtgcagacaacatgctctgaaacttcaacagaggttcagttcaataaacatttattaaatgctcaatatgccagtcctttaagaaatgtagagtgaaataagtgaaacaagtatataagcagataatttcaatttaattttgaagtattataacagaatgatatagttggacaactacatttttgccatcaaatagttgttagaaatgaaatagaaaaggtaagcagaagccaatttaggagaatcttagacattatgccaaagaattcagattatcccaaaaaatagggaatcaaagaagggttgaggtgagaaatgatagggaagagtagaggggtcaaatgggaaaacattttaaaagtaaagctctcacagacttatttattattttacatttttctttgatttttaaatgtattcaaaataacttaaagcttataaaaattttgcagaaataggacaaaaaatatcatgtacctttcacatgcatttccagctatatagttgtttatggtagctggtcttatctagtaccaggtacttcattatgtcaatgtcttcgtcattgcaaacctttaaaaagtctggctgactactatgcaggtatgcaaataataaaaaaggtttctataaactaacagaatttttttcaggatacactgttaaagtaaaacaagcaaagtgctaaagaacacggtcatcccctcagtacccatgtggagttggttccagaaaccttcacagataccaaaatttgtgtatgctcaagtccctcatataaagtgaagtagtatttgcatataacctacacatatcctcccagatacttttaaacatctctagattacttataataccaaatacaatgggaacgctataaaaatagttgttgtactgtatttttatttgtattattttcattgccatactgttatttttattgtcttttaatattttcgatttcaggttgattgtatatgtggatgcagaacctgtggctaagagaagttcaactgtgtctataatatgctatcttccgtgtaagtgtaggggcaaaggaaattttccgctccctctctgaaggttccagtttgctaaaataaactgataacatgaaaaacggtacgtaaatgtattaacatgcaagtgtgcacatacaaactatgtatgagccatacaaaattgaaacacaaaaaaggatgagatggctaatgcttaaatagcaccctcttcatagaggacaaggagatgagggaatgtaggcaatttttaggggtagtaaatgatttttaggagagttgattgggcccaaagaacagatcatcatttgtgaattgctgtgtttggaaactgaatgggaccttaagaacagacaatagtttgtgacattctgtctagatatgtaatattcctcagtctttcttcctgaaatatgagtttactcctctctaaataataaaatttcagggaaggtatccaaagcaattatgttccttctggagtagcttcagataaagaaccttcagagagttcgaccctgtgcttgggaagagacacagaaggtcaaaaagtccttgattctgaggccttctaatttcctttaattcaagtgctaagcatgtcaaagagctatacttttgggtatcattttctaagccccaacataagaaagaagggaaaataaaaacacatacatgtatcttatttgtcctatggggggaaaagtttccccaagccacctaggattcctggctaagcctaaaaataggagaaaagcacataattttaattcaataaaagtttatatattacatggcagcgagccatcataaggaaatgaagatccaaagacccaaggaaaactgtattttaaaaaataaatctgataaaagcagtgcagagttgtgaagaaacatgactggacaaaaaggggtatgatctaatggtaatagactggagggacaggggagaggagaaggaacttcagtaaggcctgtttgttcagattttttcctgtgtctctgtatgacattctttccccccacatatacagcaggatacttgcctcgtaagaacctttagggtaaaagggaggccagagagtgacctttccaggtttcatgcttgctttggggaagaggaattctagtttctatgactcacccaaggggagagtaattctgctttctatgactcagcttgggcaggaaaaatagtggggaaaggtgaatagaagaaagtcaaagaaactctgagccccttacaatctccttcagttcaaagtactcagcatgacaaagtaccataatttgaggtatcatgttctgagcccaacactacaaaattcaagttaggaaggttaaataatgtcccaggttggcaactatctgaggctggtattgcacaggtggtaaaaagaatttaccaagacagctgtacgtaaagaaaggcaggtttgagaaagtaggaaaatgcattgcaagaaaacaacaggtaggtcagcaggagaggaggtgactgacaggagagagagacttgctggggattttataggatgatgtttgtgctgtgtgctgaagagggctttctctttttgctttcccttggtcccaccagcccaactccccttctctaattaggactccacaaataaggcataacaaataaaaaaaaaaaacaggggagaagggaaagctcttccttacaggaaaatgtcaacaaatacacgtagaagaaatgaggcaatcagaaaactaccaaccggaagacaccatagtaataattgtttggaaaagaaggtgatacacaaaatatttacctaaatgcaaaatatctcaaggggtgccagataagatagccaattagaagcagctgcagtctgcagctgtcacagggaggagtgaaaacaggaagcgaattctgtaccttcaactgaggtatccaggttattgcattaggactgactaggtagacagctggacccatggagagtgaggaaaagcagggtgaagcaatggcccacggagcagcacagagccaggggaacccccacctccagccaagggaggtggtgagtgattatgcaccctcatctgggaaaccatggtttccccatggatctttgcaaactgtagatcaggagatcccctcgtgagccaatgcgaccagggccttggatccgaagcagagagctgtgtggaaactccacataatggccactggggcatgcacagaggcccaagggttttgtataatctggccctgggaattccagtgaggtgggagatccatccacgcattacgctaggaagggggctgaatccaggagttaagtggcttcattctgtgggccctactcctacagcaccttacaggttaagacccactggcttggaattccagccagccagtggcagcaggctggagactgcctgaaacagaccaagttcctggggggaagggcagccaccatctctgaagttaagagtgggccattctaccctgccagctccagggagtccaggctgtctggactggaaggagttccccacaatacagcatagctgccatgccagatcatggccagactgctgctttaactgatccctccctcctcactgggtggggcctccctgtgggaattacagcaacttcagccaagtttttcagacagaactctgatctctccctaggatgaagccccagggggaagtggccactgtccctgtggttcagctggcttagatgttccagcctgctggcactgaagagtccgggcattctggacgagggggggttccgcccagtgcagcacacctgctttgctaaggggcagccatactgcttgtttaagtgggttcctgaatcccttcctccggactgggtgagtcctcccaataagggtctccagacgcctcctacaggagcgttctggccagcatcaggttggtgaccccctgaaatccattagctcccagaggaaggagaaggctaccctctttgctgtttcacagccttcactgatgatatctccaggtgctgaagggaacaaggtgaccagggtctagagtggacccccaggaaactgcagcagctctacagaagagtggcctgaatgttaaaagaaaaacaaacagaaagctacaacaacaacatcaacaagaaagaccccacaaaaaccccattcaaaggtcagcaacctcaaagattgaaggtagagaagcccacaaagatggaacagaatcaatgcaaaaatgctgaaaactcaaaaagccagagtgccttttctcctccaaatgactgcaatacctctcctgcaagggcacagaactgggctgaggttgagatggctgaattgacagaagtaggcttcagagagtggttaataatgaataacaaactttgctgagctaaaggagcatattctaacccaatgcaaagaaggtaagaatcatgatgaaacaatacaagacctgataaccagaacagctagtttagtgggaacataatagatctgatgaagctgaaaaacaacacaagaatgttacaatgcgaccacaagtatcaatagcagcatagaccaagcagaggaaagaatctcagagcttgaagacaatctttctgaaataagacaggcaaaaaaaatagagagtaaagaatgaaaatgaacaaaccaaacctctgagaaatataggattacgtaaagtgaccaaacctatgaatgattggggtacctgaaagagacaaggagaatggaactaagttggaaaacatacttcagaatatcatccaggagaacttccctaacctagcaaatcgggccaacattcaaattcaaaaaatccagggaaccccagtaagatacccaacaagaagataatccccaagatgcataatcgtcagattctcctaggttgaaatgaaagaaaaaaatggttaagagcagccagagagaaaggccaggtgactaacaaagagaagctcagcagactaacagcaaacctctaagcaaaaaccctacaaaccagaagagattggggccaatattcaacattcttaaagaaaagtatttccaacccagaatttcatgtctggccaaactaaactccataagtgaaggagaaataagattcttctcagacaagcaaatgctgatgtaatttatcaccatcaggcctgccttgcaagagttcctgaaggaagcactaaatatggaaaggaaaaacccattaccagcaacaactacaaaaacacactgaagtacacagaccagtgccactatgaagtaaccacataaacaagtctgctaagtaaccagctagcatcatgataacaggatcaaattcacacataacaatagtaaccttaaaaataaatgggctaaatgttccaattagaagacagaatggcaagctggatagagtcaagacccattggcgtgctgtctttaagagacccatctcatgtgtaaagacacacataggctcaaaataaagggatggaggaaaatttaccaagcaaatggaaaacagaaaaaagggggttgcaatcctagtttatgataaaacagactttaaaccaacaaagatcaaaaaagataaagaagggcgttacacaagggtaaagggttcaattcaacaaaaacagctaagtatcctgaatatacatggaccaaatataggagcacccaaattcatgaagaaagttcctagagaactaaaagagacttagactctcaaagaataatagtgggagacttaaacaccctactgtcaatgttagacagatcaccaagacagaaaattaacaaaaatattcaggacctgaactcagctctggatcaagtggacctgataggtatctacagaactctccaaccaaaaacaacagaatatatattcttctcataaccacacggcagttactccaaaattgatcacataaatggaagtaaaacacccttcagtaaatgcctaagaggcgaaataataacaaacagcctttcataccaaagcacactcaaattagagctcaagattaagaaacttatttaaaaccacacgactacatggaaattgaacaacctgctcctgaatgacactttggtcaaaaatgaaattaaggtagaaatcaagaagttctttgaaacaaatgaaaacaataaagtatcagaatctctgggaaacaactaaagcagtgttaaaagggaaatttacagcactaaatgccacattaaaaagctagaaagatctcaaattaacaacctaacatcacaactagaagatctagagaaccaagagaaaatgaaccccaaagttagcagaagacaagaaataaccaagatcagagtggaactaaggagacagagacatgaaaaacccttcaaaaaagtcaataaatccaggagctgattttttgaaactattaataaaatagatagacactagctatactaataaagaagataagagagggcagtaaaatagacacactcagaaatgataagggggatatcaccgctgaccccatagaaatacaaacaaccaagagaaaactataataaacacctctatgcacatcaactagaaaatctagaagaaattgataaattcctggacacatacattctcccaagacagaaccagggcaaaaattaaagccctgaatagaccaataacaagttctgaaattgaggaaggaataaatagcctagcaaccaaaaaaagcccaggaccagataaatttacagctgaattctaccagaggtacaaagaaaatctggtaccatttctaatgaaactattccaaacaaatgaaaggaaagactcctccctaacacattttatgaggctagcatcatcctaatgccaaaacctgatggagatacaacaaaaaaagaaaacttcaggccaatattcctgatgaacatcgatgcaaaaatcctcaataaaatactggcaaactgaatacagcaacacatcaaaaagcttatctaccatgacccgacagttggcttcatccctaggatgcaaggttggttcaacatatgcaaatcaataaatgtgattcatcacataaacagaactaaagaaaccacgtgattttctcaatagacaccaaaaaagtcttcaataacattcaacatccttttatgttaaaaactctgtataaactagatattaaaggaacatacctcaacataagagcaatacatgacaaacccccagccaatatcacactgaatgggcaaaagctggaagcagaacccttgaaaactggcacaagacaaggatgccctctctcaccactcctattcaatgtaatattagaagttctggccagggcaaacaggcaacagaaggaaataaagaataatcaaataggaagagagaaagtcaaattatctttctttgcagatgacataattctatatctagaaaactctgccgtcaccacccaaaagtatcttaagctgataagcaacttcagcaaagtcccagcatacaaaatcaatacgcaaaaatcactagcattcctatacactaacaataggcaagcagagagccaaatcatgaatgaattcccattcacaattgtcacaaagggaataaaatacttaggaatatagctaacaaatgaagtgaagagcttcttcaaggagaactgtaaatcactgctcaaggaaatcagagaggacaaaaacaaatgaaaaaacattccatgctcatggagaggaagaatcaatatcgtgaaaatggccatactgcccaaagtaacttatagattcaatgctattcccattaaactactattgacattcttcacagaattagaagtaactgttttaaaattcatgtggaaccaaaaaggagcctggataaccaacacaatcctacgcaaaaagaacaaagctggagacatcagactacctgacttcaaactatactacagggctacaacaaccaaaacagcatggtacctgtaaaaaagaagacacctagagcaatggaacagaatagagaactcagaaataagacggcacatctgcaaccatctgaccttcgacaaacctgataaaaacaagcaatggggaaaggtttccctatttaacaaatggtgctaggagaactggctagccaaatgtgaaaaattgaaactggaccatttccttacacaatatacaaatttaactcaagatggattaatgatctaaatataaaactcaaaactatgaaaaccctagaagaaaatctagatagtaccatttaggacataggcactggcaaagatttcataataaaaatgccaaaagcaattgcaacaaaagcaaaaattgacaaatgggatctaatttaactaaacagcctctgtgcaacaaaagaaactatcatcagagtgaacagacaacctacaaatgggagaaaatttttgcaaactatccatctgacgaaggtctaatatctagagtttacatggaatttaaacaaatttacaagaaaaaacaactcaattaaaaagtaggcaaaggacatgagcagacacttctcaaaagaaggcattcatgcagccaacaaatatatgaaaaaaagcccaacatcactgatcattaaagaaatgagaatcaaaaccacaatgatataccatttcatgccagtcagaatggcgattattaaagtcaagaaacaacagatgctggcttggttgtggagaaaaagggatactttacactgtgggtgggagtataaaattgttcaaccattgtggaagacagtgcagcaattcctcaaagatctagaagcataaatgccatttgacccagcaatcccattactgagtatatacccaaaggaatataaatcattctattatagagataacatgcacatgtatgttcactgcagcactattcacaatagcaaagacatggaaacagccgaaatactgctccatgatagactgaataaagaaaatgtggtgtgtatgtatatgtatttatatatatatatatatacatatacacacacacacacacacacacatacatacataccagggaatactatgcagccataaaaagaaacaagatcatgtcctttgcagggacatgggtagagttggaatctgttatcctcagcaaactaacacaggaacagaaaaccaaataccacatgttctcacttataagtgggagctgaatgatgagaacacatggacacatgcaggggaacaacacacactggggccttacagtgggtggcagagtgagggagagcatcaggaagaaaagctaatggatgctgggcttgatacctaggtgatgggttgacctgtgcagcaaaccaccatggcacacttttacctatggaacaaacctacacatcctacatatataccccagaacttaaatgttgaagaaaagaaatagtgtctcttatgagattcttattaactactaaaagaaaatagtaactttacagtagataatctggaagctaccttaaccaagtgaacaatgcataatcagtaatttaacaaatatatattttaaataccttctcaaatcatgtaatgagaaggatatatcccttttgtagtacttctgccaaaaatatataacttgaatttaatcataaggaaatagcagaaaaaaaattaaaggctattttacaaaataaatgtcttatatttggggaaaaaaataaattcaaggtcttgaaagacaaaggtagactgagaaatattcttcattgaagatgactaaaaagacatgaaaactaaatgcaatgtataacactagatcagagcctggaccagcaaattttttttataataaagacatttagtggaacatttaatacaattttaataagatctataagaatagacaatatttagaccaatgctaaattcctaattttgatcattgtaccttggttatacaaaagaatatacttggttttagaaaatacacagtgaagtattcagggaaaaaaggcaaattgctctttaaccacacccccaaaaaagtatgcatgtgtttatgcctaaagagaataacacaaatatagtaaatgttaattttggagaatctgagtaaaagttatacaggttattttttactatttttgtaacttttctttgttttagattatttataaataaatagtttttaaaagaaagctacagatccaaaaatccaaactgtttgaagaaagtattatactaaaactatagcaaaattagtaatcagaatgtaaatatgtccaatatgaatataataaaaggaatgaaaaagatcttcaataaacagaatgctcagagatagaagaaaatacaaagtcaattttttaaaagccaaacaaattatgttggaaaacaggaagagagggaacaagaggtagaacaagacagatataacaaagagccattaaaaatggaataaaaaatagtcattgcaacaaaaattaatagatattataaaccatagactaaacatatgcagaaaaattggaagatagcacaagaaatcccctcagaacacaacactaaaatgctgagatctaaaatagataaagagctgtacaaaagcatgaagaatagattgagagggtccaatatacatcttctcagagtatcatgaaaggaggatgaagagaacgctgaaaaagcaatatttgaataaatacagctgagaattttccaggatttcaaaaagagatgagtccaccgatagaaaaagctttctaagaggcagtgtacatacataaaattaaatatgcactcagacacacaagagtaaaactgaaaatcagcaggaataaaaaggaaatcttaggatctacaataggaaacaatctacagaaaaacagcttaattaagcagagaaaccaaaagtaatagaacatatgctcacagtgccatgagaaaataattgctgtcctataagcttatagccagctaaattatcatgcaaaagggagagtgcaagcatacaaatattaagataatttaacaataaatatcctcacaacaataattactaaaggacgtacttcagcaaaaagaaaaataaactcagaggaatatctaagtacaaagataaatagtgagcaaataaataaataaaatatatcataagtcaaatatgaagtattgtatggatatgagagactggagtattcaatgagttattaaaatccatcaaggtccttgtcatatttgagaaagataaatataactttagatttcttagaataatatatagattattatgtatgccaaaaagataaccaattaaagaacagaagacaatcagatgtttccaaccagcagaggaaaaaataagaagaaaacatagaaaaattttcagtacaacaggaggtacaaatgggtgggtgaaggagaaaggaaaaggatggtcaatgaacaatgtccttaaatggcggaataagtctaaagacattaggacccacaataatacaaatgaactaaacctatctatttaagataggtagcaaactgaacaacataaatgttaataacggtagttaatacttcctattctgcaagtgctttacaaagattaactcactgagtcatcacaatagcctatgaagtttatactattagtgcaccattattatggataagcatattgagatttaaagaattttagcaaattgtccaaggacacacagctagtaggtggctgtgatttacaccaggtaggcttattccagagtttaacctttgtgaccattctattctgctaagactcaatatagtcatatgatcaaaagttatgtattattaaatattatactctagaagaagctttatggatgtcaaaatgccagcaggattattttaagtgaaaaagtatgttataaaagaatatatactaataccatccaaagtttgattaaacacacacacacataagcacatatacatactgagaaatccaccagagaacagttgtaattacttctgaatcttgtgataataggtgacatttattctgttctttatatatttctgtattttctacagtgcataactgtatgtcattttgttaaactttttttaatgagccttgtacagtgcctggcacattaatgatcaagggagagagggcaaaccacaaagtcctttcattaactaaagttgagtggaagctacagaaccaacgatgttgtgttatcttactatcacaagctcagatcctagggacaaataaactgcatacttaataaaaagattcagcaacgagaaaatcctaacaagctgcccttttgtgttagtttcaggatgtgattttggaatccaacctcaattgtggcttcaaaagaaacctgaaaataaaagcttcagctgtagaaatgcagttaaatatcagcattaaatagaacatagagcccaggaatgtcagagctgcaaatgtacttatggagattgccacctacagactaaatctctcacttatacatcaggggaaaagatccacaaaagcagagacttgtccaagtttacatagactttcatagatgaacccagactggaactcagtttttctgtcttggataaagaaactgaggtttctgacatgaattacttgcccaaaattacacagctaccaaaaggtagagccagtattctaatttggtttgacaggattccaaaatccattctgtttctgaattataatcaaatagacaattttttaattattcatagaaatcttatttaatcaacaaatttatcaattgtttattatttaatattcttcaagaatatgaaagtattgaatattattcaataatttttattcacctagcacttccattttactagcactaaagaagaaataatttctctcttctttcaggcttcctcttcctgttgcttgaatatctccttctctccatatatatgtatatgtatatgtatacgtatatgtatatgtgtatatatatgtgtatatatgtgtatatatatgtgtgtatatacatagagggagaatcaatccatcacctcaagcatttatcctttgtgttacaaacaatccacttacacccttttagttattttacaatgtacaattaaattagaaaatagatatttttaagttactatgaattggagatggagttttttttaagaattttccctgtgatctctttcctttttaattttctatgacttactctctgaaaagcccaatacttttagaaagcaggtgtcatgtcatataattgcagttctccttttaaaatttaattttgtttccgttcccttgttattttttccctgtcaacactaccaatagttgcactcacaaataggcagtaacccttgcctgcatgcctagtgctgttttcctgtattcattttgcttctgattaaacacatttgtattaagagtgtacttgtagcacagccactttctacatgaaaggagaattttgttgtggtgatgaatattgttttccagtagataaaataatttctaaatatcttctctattagctcgatattttcaaccaggcttcatcctagataaaagatcctaactgaatgtagcaggagatcatcgtcccttacaggcttccaggaaatgctctcttcactgtcaattatttatattgtgaacatccaggcaaggagactgcatagcattctgcttttgtatttttcaaatttgcctcatctttgtgatgtggaaatttgtatggtgatgaagaaagtacacattcatctaatgagtgagaaataaatagtttttattttttgaatacattttggtagttggggttagatgtgatggaattaatgttttgtctctaatgtcctaggacctagtgtaggacctatttattccaagtactctgcctatgttatcccaattcattcttcacaaatatcttacgagggaactgtcaacccattttaacatgaggcttagagtagttaagtaacttgcctgaggttgcatagctaagacatgatggagtctgaatgtaagaccaagttgtccttgtgttctttacactgaaacacacttctcttcacaatctaaacatgttaaagtgatcaagtggagaaaaagaatgaaataagaattatattctttattcagcctgacacattttaattggcaaggaaatactaaatcagttagttgttctagaattgaaccacttacattataatttttatttaagaaacacaaactgctttttaaaaagcaatgaaaggctttagaaatgtatcagttttctaacataattatttgtctgtgtgtgtgagcaagtgtgggagaaaagaaagagaaagagaaatggggtggggtagacttatgggcacgcctgtgtgaacacacacattcagctattattctaaagtggaaatcactccccagcaacatattcagaaatttagctgggagatagaagggtaggaagccacaaaacaacatttaggaaattactagcaaagtaaaaatcctggtgattaaaaacaaaaagaaaaaaaaggggaggcacaaaagacacttgaaaccaagtgcaacaagttaccatggcaactagataatgtgggttgagatttatatgactccattgttccagcagagaaattctaaatgacaccctagtggcctgacagagtcgatgcatctcccagaatgctccggcttattactcaagagtgctttaggcacagagaaagaacaagatcacagtaactttgtcagttccagccttcctaagacacttgtttcttcattctggaggcaaaacattctcaatttctggagccagtcctgaccaagcttagcagaatattagcattcttatatttacctgtggttgaggatagcatttaccttactgtctgaagtacgtgatccagtatgaatggaatcagctttgggcacctaaatccctctttgtttttctgctggaacagtagtctgccctgattcccaggcaactttagctaaggctctaaaattctgactaatcattaccattgttaattaacaacaccatcagcacaacaatctagtattcataacaaatatttgttgaaaatatattacctctaatgctaattaacaaaccccaaagtagttatcatctatagatgctcatatgtttttattactttgctacacatgaatggcaaactgaggctaagaaaacttaagtgaccaaggtcccaaaacagccaaaatttgatttcagaaatgacaacaaaaccattgccagggggatttatcttactacatcaaatcttggctgtggttgggtccaggtccaccattttaacataaacactaacaggaataaaagacacacagaatattatggcttggtcctgttgtaccccatttactgcatgggcaggctgagatatcagggacagcaactccagtccaaattaagtccaaattagccatgctcctattacctctgaatattagatcactagttgagaaaacaggctgccctatttctaggttcattatcttagctggaactccatccgtttcttgcttctcactctttctcactgaccctcaatggaaggaaaaaataaaaaaggaggaggcaattaagatgtttaagcatctattatgtgctgggcactctatttgaatatgttatctcattaaattcctaccaaaaaatctataggctaattattttcctttctgttttacatatatgagaactaagaatcagcagataaataatttccaagggttatacagtaattattagggtttaaccaagtttctttgaccctagtcccttgccttttgtcccttaacccttggcattcctctcaacatagcttgttcagattataattatgtttagagctggaagggaccagagcatgatcaattttaagagatgtaattagtcaatatgaaagtactattaaaagtaatcaaaatagagaaaacagtaggagttagctgcataaattaaaacaaacttatgcatagccttatatcctccaatatgtaattctaaacaaggggatttttttttataaaagagattttcctttttttttttttaggaacaggtgtgcatagattaggaatttctattatgccaaggtttcattcgttgcaataaataagctcccattttgtagagaaacaaggtagttaataagcaaaccagtaatggcagcttttggtgtgactatttcctgataccaccaagcagtttcctccaagtgagactagttgaagccatgcttggagatataactgttattagaactgcccatttccctcatttggtacagtaaaggttagtttcttccctcagagtggaattaggtaatcattagccatcttccatgtcacagaggtaatactattagggcataaattaatacacatagttaaaattttaatataaacttgaacagtattagaagttagaccactatttttcatgttacacttctgtaatatgaacttctttggaaaaaaaaataaaagcaagttaccagtttccagtagagcaaaatgtgaataaatttaacaactatactgtgttatcatagcaaccaatttaaaaaaaaactgatatgataaaaaatgacacaagagaacaaatgtatcaagttgttatggcaactggggaacgtgggttgaaatttatgtatctagaatccaagagaatattctaagcaactaaaataaacatttgcttattaaaacatcccccaaatagcacttacctataagcattgaagtgttttcattattttgtctgctttttcttttatttccaatggatgattttatattgtgagcatttgtattttcagttcagcttactttttggcaacagatacaccaagatgcagtttggtttgcagaaaatggtgcaaaagccaatttcaaaatagcatcctcaatcatgttttacccttttactcttctcttaacaaaatgtctattctatctgctttttctttataaagaagctcttgcttacttgatcaatcaaattcattatgttatctttacctgattttggaagtcttcccattagacaggatatgggttaaagaattatataataaatttggatatttaggaagtcttccactaatttatgcacgcacacttttcttttagtagcataactggttgttttggactaaatgttctaatggcatctgcagtttctacagaactttgcccatgctcatgtagagtatctcattgtgagagcaggaaaggtgagattctctcatgactccatgcatttttgtaaaaccttttcccagtgccactaatactcttttttccacccttctatctgcttggctgattcttaatcataactttccactgtctacccatttgagctaagtgtccctcacctttgtcctcataacaccctctgcatacttacagctaagtgccatcatcctcatcgaaatcaacataattaacataatcattatcacatatattacatattaagcattatctgtatgttagtgactgctaactacttcccaaatatcatttcatttaatcttcacaaaagccatgtaaggtagatataattaccgccacttctctatttcataggtaagggaaaactgaggcctagagtttgtcacttgatttaggtcacatactaagttacagccaagagattttaatccatgtcaacaaaataccaaagctcatttctttatcatttagttagtcactaaaattttttctttagtttgttttgacattaaactatgaactttttgagaatttccatgtgcctacactgtagattttctgaacacatgtcttatctctggtatctcctgcactgttaaatagagacataatatgaaccacaattgtgagccatagtaaaattttgtattttctagtagctgtattaaaaaagtaaaaagaaacaaaattaatttaaataatatatttcatttaactcaatatatgcaaactattaccatttctacatgtaatcaatatataattattaatgaagtattttacatttcttttttagtactaagtctttgaaatctgttgcatattttatatgtatccaacatctcaatttacacatgcagctttagtggctaccatattggacagagcagctttaactcatgcctgataagtagatatgtaaagaatgttcaatacaagttttgtggaatgaataaataaatgggcaaatacatagaaatggagaattttagatttgtatttatagaatgacccaatttacctttatggaacttttaacagtttgtttatgaggaagctaaaagtggctattttaagacagaacatagatacgtagtagtgtattcatgttgtgataattccaggattactgtcacatcctgacctatcatggagaattgcctgcccagacacttgtgtatgctgaaatccatagcggtgtatcattagtcagctcaaaaagcctcccatttttagaacatgtgttttccattctcaggctcgggtttcaagttataattcatcatatatttcattttaaaaactcctttagatcattttaatcaatgcctattaacagtaagttaagaatatacattttaaattaaatcaaaatcagcccatatcgataatgaataaataaagtatatctcagagtatcccccttaaagaatatttttatattaaagccctggatgtgctgacaccacactgaatattactggtagaaataatcaacattttaaaaatccatttacatgataacagatatactgaacattgtaatatctttgcagtcaaaaaaccaacctcgaaatcacatctcagtggcaatactgaatattactaaaacactggcccaggggggaaatctatagaataaaaccggcaattgctaagactttacataataaaattatccttgactaaaaataaaccgaagaaaaacatcagggaatgagaatatggtgattactctagaaaactttaaaaaattcttcagaatacctatatgaaaagccaaagggggagaaaagaacaaataaaaatatggctgtcatgacctaacggttcattgcctattaggatgggacccactgacttatcttacaagggaactgccaattctgcttttaatgttattaatttgagtgctaactataatagacatgattaaaaatatatcgaattagaaaaaaaaggaagtataaaaactagacaaaattgctaaaaataacaatttcaggactctgggaaatgaccaaaagtgtacaacaaattgagaaatgtttattcatgaaaaactactcaactacaggtaagagagtggaaattagtgtcagcgttgactgggcatgctcccatctccactccatccagctcagtttgctagttctattaggatgggaaaagtagtaagaaccagtatctttgcagcctaagggaactcgcttgatttggagtggaacatgagaaaaaaatccacactcagtggcattggcagtaacagtaacagtctcagtggcaagcaaaaggaataaacagtggctccagtgaccttaggttgtagtgctggttggggcatgcaaaacatcagcagactaattggtagttcaacaggaagatccacgaaatgagacggccataaagggccttgataagctattcacaccaccctgctgatgggaaagtcttaaaactgttcaggagagattagagaaggccttagtctctctatgtgtccctggctgaatataatccacaagcgcagaggagacatgggaatagaggacctaaagagagtaaaagttggcaatggcttgtaaactacttgaactatgaatggaatccccaaaccaaacacagatccatcagtagagggtggaagccttgctgattcaagatatttaggcacaaactctaaccaaatattggctgaccactaagctatgctgacataggggtgacccatagaaagccaggatttcaaacaaaagtaaatattaaaatcctgcagggaaagagattacatagattgaatgcaggaaagttgcaaacaaacaaaacacaagcaataacaaccatcagagtgggaggcagaatctagatttgctataatctggtatctaaaatgtctagtttttttaaaaacagacaagcaaagaaacatgaaagcgtgatccatgctcaagagaaaagcagtcaacagaaactctcttaatgaatacacaatagacctaacaatgactttaaagcaaatattacaaatatattataagaattaaagcccatttttaaaaaattaaagtatgactataatgactcaactaacagaaaatctcaataaaaatgaagcaattgttttaaaaatttaagtggaaattctgaagtataacatttaataactgaaatttaaaactcactagagagactcaacaacagttctgaaatgtcagaagaaattatcagtaaacttgaagattagaaatgatctaacctgaagaacaaagagaaaatgaagaaaaattaacagagccttggagacctctaggacaacatcaaacacaccaacacaagtaacgggagtcccaaaaggtgaaaacactgggaaacagacagtaaaaataagccccaagcttttaaaatttgataaaaactgctaatctatagatccatgaaactgaacaaaaccagaatagaaaaaatgcaaagcaatatccatctaaatacatcacagaaaaactgttgaaagaaaaagagaaaatttttaaggcagcaagataaaaaatatgactcattaagtacagagaaacagcaatatgattaatggctgacttcccataagaaagaatggtggctaaaagacagtggaattatatatcaaagtgcttaaagttaaaaacaaaaacaaaacctgtcaaccaaaacctcctcgggaaaattattcttcaaaaaggaaaacaaaataaagtcattcccagatgaacaaaaataaaaaaaattcattcctagagacctaaaaactggaaagaacatttgtccatcagtggccaaatagttatacaaaccatgctgtatctattcaatggaatgctatttggcaatataaaacaacacactattgatacacacgacaacttgaatgtatctcaatggcattatgctgagtgaaagaagctagtctcaaaagattatatagtgtatgcttccatttacatatttttcaaaaacacaaaactatagcaatgaggaagagatcagtggttgtcatagactagatgtggttggagaaggtgattatagagagttagcaaaaggaaagagggtttgaggaattaaaattgtcttatatcttgattacaatgatgattacatatgttaaaattcaaagacccatgtaccaaaaggcatctttactttataataattggaataaaataaaataaaaccaagaaaacccacatagttgaacactacactcacaatgaatgtattttttttttcttagagacagggtctcattctcacccagactggagtacagcagtgtgatcatagctcactgtagtcttaaattcctgagctcaagagatccttgcacctcagcttcctgagtagctaggactacagatgtgagccaccttgactggaggatgtatcttataatgtataaattatacttcagtaaagctgtaaataaataaaagttactgtgaaactgaatctaattcaggcaggacttctaatgctttagacccttcagaaatgaaagtttgttcatcctagcaaaggatcatgaataaatagttcaggtactcaaatatgtgtaatcagtatagaaaatttcacaaaaagaattgagttgatttaatagaatttacctcccaaaacacttccttgaaccaaattactggtatagttttcttaaaagtattcacaatcatacacattgtttaaacattctcagggtcagaatagctcggactaaactaagtagctcctgagtcaaaatgatatatcacataccagaatctctggaagacaactacagatgtgttaagaggaaagtttacagcagtgaacacctacaatgaaaagttaggaagatctaaaatcaacaacctgacatcacccctaaaggagcgaaaaaaaaacaagagcaaatcagctccaaagctagcaaaagaaaagcaaataaccaagataagctacactgaatgaaattgagatgtaaaattcatttgaaaaaaatcaatgaaaccaaaagttggttttctgaaaaaataaacaagattgatagattgctagctagattaataaagaaaaagagaagatccaaataaacacaatcagaaacgacaaaggtgatattaacatcaaccccacagaaatacaaaagctctgttatgaacacccctatgcacataaattagaaaacctaaaagaaaaatgtttgatatcactaatcattacagaaattcaaatcaaaaccacaatgaaataccatcttacactggtcagaatgattattaaaaattcagaaaatgacagatgttggtgatgttgtgaagaaaagggacaattatacacttctggtgggaatgtaaactagttcagccactgtggaaagtactctggatatttctcaaagaacttaaaacaaaactgccattcaacccagcaatctcgttactgtcattactgggtacatacccagaggaatataaatcattctaccaaaaagacacctgcactcatatgttcattgctgcactattcacaatagcaaagacatggaatcaatctgggtgatgaaatcatttgtctatatgcatgcgcgcgcgcgcacgcgcgcacacacacacacacacacacacacacacacacacacacacacgtttggatatattcccaatgaagaacaacaacaaaatggcgtatggtgtatcgtaactttccgtactctttgctaagactttttggacccagtagtggaaggaaataacagaagttaaactctctaccactttttttaagcaaaactatgtaatcgatttcactcccaccacacaccacacccccaccaacacacacacacacgttgttcccccacttcatcctccaccaggttccactggccacacaactcaagatctatggaatgcaaggaagaaaacagtcctggctagcttgaaaaaatttactgacacgctctcagaagaattcatgctaagaaaatccatatcccatcactaattttcagggtatggcaatggctttctcaagaatattacagggaacctttggagtatgacagcaaattgcttcaaagaggctttcttgcttttctccttcaaacatgtgtatctcatgtatgacccaggaagatatatatagattggttttctgggagttttttcctccatccacagatatggcagaaatatactaccattgatgggcaggcagacattccagcaacagatgaatattgaatacttcttataagtctactaagagctttacatacattatctcaattgacccttacaataagtttgagagatggctattattattttcatattatcctgggctttttgaggctcagaagtgtgaaataatttcccccaagtaatgcggttaccttaaaataccctatgaaaaatgtattattgctattttacaaataagagaaatgaagtgacttagcaaaatttacataaatagaaaggagttgaactggaatcaaaatgcaatttgatctgactacaaatttacacgcttatcatggtggaattcgcgtacaggctttggagacaaaaagacttagggttatatcccattctttccacttactagtaccatgaccttgagcacatttcttacttaacttctttgtgcattggtttcctcatctataaaatgagaataaaagtgataaagcatgtattgagttcagtacatactaactactccataaaaacagctggtgttatcattatcattacaatcttgtattattaacttcagctaaattaaattaattcatccaaggaattctgatgggactgtgacatagagatagttatctataaggaattgggaggggaggtcaactacctagaacaaagggaacctgggggagaaaccatagggggagtgcctgattggccaggaacactatgacagatttgagaaccctaaggtagaaacaagtgcaacaggcattggagtacaaactggaggggaattaataggcacttattaaaagtgctaggaaacatgatagctaccttaaattcttcatcttattttatctggaataagaggacccaatttttccttttaatatttccttagattataataaatcaccaaatcctattacttttgcctttgaaatttctctcagattcattgtcccgtatcattcctcttattccttctgtcatctccctgaatcaagtgcctatctttttatattcagatgcttaaaccggcacggtaatagcatgcactccattcttcacttcaatccacccatgttcctgtggcagcatggaaagcacaggatttagattaggacagggctattttgttctctttaggctttgaactgaaatataactttctgttcaaaatatgaacagaaatatgcctttctgaagtgtacaacttcgtggctttcagtatattaccattatccttatataattccagaacattttcatcacctcaaaaagaaaccccatattcattagcagttactgtctattcccccttcctccaggccctggcagcaataatctactttctatctctatgaatttgcctattctggaattttataaattgaatcatatactatatgcactggctttttccacttaggataatgttttcaagcttcatccatgttttagcatgtatcagcagcacacgctttttatggctgattaatactcccttatacagattctatatattgtttatccattcatcagttaatgagcacgagggttatctctatttttggctattatgaataatgctgctatgaacattcatatataagttttcatagaaacatatattttcagttgtcttgaatatatacctagaagtggaattgctgacaactgtgtttaacattttaagggaatagccagactattttccaaagtggctgcactattgtaaatttccaatttctatatgagaattccaatttctccatatcctaatcaaacttcttccttctggtgggtgtgacttggtgtctcattctattttgacttgcatttccctaatgattaatgttatcgatcatctttttgtgtgttttagccatttgttcatcttatttgaagaattacgtattcaaattctttgcccatttttttaaaattggattgtatttttattgttgacttgtaagagttcttatatatgctgaatacttgaccctttcaatatatatgttttgtatattttctaccactctttgggttgtcatttttactttcttaacagtaacctttgaagcacaatacggttgtgctatgtggttcaaatgcagtgtcttggtcattttgtctgtcttaggctctgggtagccagggttatagtgctgcaggcacccatgtgaatgtgatggaataacaatggggcctcagggatggaaaaaattagtgactactggcccccagggcagaatgcactttagcagtggatttagtttcaagatggcaccattctgtaacagcttaggtcatggggatgagaggagtgtttaacatgggctcctactataaggcaatgcagtcatgcaaactcctggctactttcctcccaactgcatttggagtctgtgaagactgcaagactctcatgttggagaactgctagtgtctgtggtagcagtggggaccgtgagagatgtacagcttacttttttctcgtaagaagtcctttccaactccaagccaatcttagtgggggaaagagtatggaaaagctgtacaaggattttgctgctcccttggtactttccagcacacttcagccactgcagtcaaaatatagttatatattcattgttttggtccctctttgtagggggagacaggcttcaaagaacagtatttacccatcttactgatgtcctaaaagctgtttttcagtttaaatgctgcaatatgaatataaagatacaaagggcccagaagtctcagagagtagaatttcatataaagcaaacaagaggaaaacattttccgcactcccctcacccccacccccgccaaagaaaaattcaagcagaatagaaagagtatgggaggattgtggcatgaagttaaatgctggtacatccctcataggggcttataatcctgtccatcctcctggctaagcccctagtagggagaataatgagacaaactcataccgattgggatgggggagtagcacaaagcagatgaattttcatttattaattcagtttatttccttcatttattcattcatatattcatttaaccaacaaataattattgagcacttactatgtgccatgttctgtgtaagcattgggatgcagctaggtctcacttccatcataaagttggaaagtacaaaaagtctggtagagaactgttctatgtcagcctggctctgcaatagtagacataacagaagctaaatctaaaaagagaaggccagagatattccctacctgctattctcaagctctgaagcccaggaagaacaagggacagcatctaaaaattccctatgttcctgagaaaaaggtacgatagtggctgagggtgggagatggcccctggaggaacatcataattaggatgaattgagaggctattgtaatcagtacgaatctagttagcggaggcaaaggggaagaggacattttagtgcactgcagtaagagtcagttccagtgaccaaagatgttaatggtgactatatttttcaacagaaggcagcatgcatggatgcaataaatcatggacacattaacctccccactgaagccagagtaacaaggccctacccctgtggaatttagatcaaaggtctgaggagaagaaaataagtgaaaaggagggaccctgaagtcaccaagtagaaacctagaattgggcaaacttaaatcataaagtgaattattttctctgaaagtgacagtgttttttttttttttttttgagacggagtctcgctctgtggcccaggcgggagtgcagtggcgcaatctcggctcactgcaagctccgcctccagggttcacgtcattctcctgcctcagcctcccgagtagctgggactacaggcgcccaccatcacgcccagctaatttttttttgtatttttagtagagacggggtttcaccgtgttagccaggatggtctcgatcttctgacctcgtgatccgcccgcctcggcctcccaaagtgctgggattacaagcctgagccaccgcgcccggccgacagtgttttaaataatctgctatcactggaaatagggacttaactaaatatttttaaaatagaaacaattttgaaaagtaaaatttcatatactttggttttatggcaaaaagatgtatactcactataaagtatcattcattattttagataaaatattaactttttgtggtagaactttctttaaatatttatttttcttttggaatgagaattttcacactaagtagctccacaaacactagcaaattccacccagcgttgcctccttttatacttagggaaacaaagcacttttgaccataaagttgttgctcaaggttgtaaaatcagtgacaaatccaagttccttgacttccactccagtggcattttcattatcttcaaaatttctttaacaccaaatgaaaactaccacgcacacatactttggagactcaatttccaattggatgtgaatagtttaagtacgtttacaaaagtaaaattttaagaacaaactgttcaattttcctttatttaaattctctatagagattactaatgataaataacatgcaaagtatgcaatcctaactgagaaaataggtgagccaggcagtggtgtcctggtcagtgtttcacagctggttcctagtggttgaggggcctaattagtggaggctgctgatttccatagtgtaaatagtcccactataaccaatttcaagttatcaacatgatgtcaaaaaagtgggaagtttaaaattatttgaaaattttaaaatcaattttgcaagcttattacaagttggccttagcacactgctgggaccagggttgtttctccagagcaaagactgacttaagcatttacttattagaattcaggacattttatcaggacaatacactgaagtgctttaagaacatatatccacttagtatggataattatcatgaaattggtgtacttttaactacatgtggaaagtagctttttcttgtaatttcccccagccaaatataaaggaaagtgttaagtcttcacgcacatgcagttctctgaatggaatatttaagagaatagaaattaagtgtaaacacccttttgtgagattcacataaaaagaatcaaccatatctgtttaattttggcaccttatattcctctcatatgacacaacagaatagctacatttatacaaagtctaaatttttctcctttctacattataaagataaaagaaaactgagggcagttttaaaatggcttgtgaaatgtggtttaggcaaaggagtataggcacaagattgctaggcctctatacaatcagagagctatataatttggcagacctttctacgatgtaatattgaactttgccctttatagttgacatattactaaaatgatatgtctgtgttacattgtgaaaagtcaactcacgttttagaaccagagttctgtttttttcttgatcctagatatctttggaaatctaatgaaaactaatgagtctaatgaaacacttttaaagaacaatgcacatatttatagatacagaaaactttgcataaaatgttaaaggactcacagacattctgtcacttgaccatgggcttctagactcacaccaagaaccattttaaagtgtattaagaaatcttgacattcaaaggaaacccatgatgattattttagaaaagctatacaattatctgtaaaggaaagcaatcaccttaatttatattttccttaaattaagctttttaaacttattgagtttacttatgttaagtctagatttctagacataaatttctgaaagacatagtcacagatatgaggagtaaagggatctttagagataaaataccataccacaagtcctttattttataaacaaagagaggacctaagcactgaaccaactagaacaaaatctccatgaccgaggaggcctcataccattgtataaaggatacatccctggacaatttcagaaatttcagaaaccctgaattctagtaaagtcctgccatttattattcgcatggtattgggtcatcatttagcttctctaatgtttcctcagctaaaatcttagttatactacaaagttgttacaaggattaaatgaggtatttgtgaaaacagtaaatattctaatgccatgtaacaagttaatgaaattataattatgataaataacagacgaacgacatgcattcttcctgtcgggaccaaacttattagacgcaggtctagccaacacctaagacagtcttttataaagaaaaaaaaaagtggctcaaaggtactgagattagtggtcacaggaaagacttctggtataagtgggataatggaaaaagcactagattcggaattaagagatttcgttgtagttccaattctactactaactagtaaaactgaaaaattatttcagacctctggccctccatttttgtggagagcagattttcttaaacatttgaagaagtgccacagccagacccctttaagaacacactgaaaattatgaaaattctccccacaaaaagtatacatttggcacatcattgaaggatctcaagttagctattaaatttccacaagtggcatactaacaacccagacattacttataaattgtttctagaactaaatcaatttatatatatgaaatattctataaatgtacacattatagaattatagaattttgagaagtaaaattgaaggcaagtttacagatattttatgtgaaaaatgtttatatttagtaacagttattacaatattggtttctatatctacaacaaaaaggtatcattttactaccataattaaaaattatctactaaccctttgctacttttatgataaaatcaaaactcattattttggcatttctaatttgagttcaaccagctttttgcctcatttataactattcttctcttacaaccaccccatctttctcttacctcaagtcacttgccacacttaaattctcatcagttgatggatccagtggaacttttcatgctagattcactggggctccgtgcttttgtacctgataatctctctgccaaaagttcctctgttatcctaattcacccagttatcttcaagtttcaggtctaatgtcaaccttccccacacatactttggagaactagttggcagtactataaagttaaatatatgcctattttaggacccccaaattccactcctagacatttacccaaatgaagttaaagcctacatccacaaaaagatttgtacaaaaatgttcagagcaactttattcataatagccaaaatcagtgaataactcttcaatagatcaagttgtgatatatttatataatgtaatactactcagcaataaaaaggaatgtaaccactaatgcatacaaaaacatggatgaacctcaaaatcattatattgagcaagataagactgacaccaatgcacacatattttatgtttctatttacaagaagttctagaagagacacagctaatccccagggacaaaaatttaaaaaagtctaaggaataatgtgtgaagtgattctaaagatgcatcagagaacttcccagggtgatagaagtttatggtgaagtttacataattatatgcgagaatcaaagttcattgaaccaagcacttaaggtctatgcgtgttattggatataaattataactcagctattgcttggcttgatattctaaatattaattctgaaattcttcctctattataatagatctatattttaccaaccactcaaggtgattcttatgaagatggctagttgacctctctttggaaagtaccattgatgagagtttaaaacttgcccttttactaaaattatactttccacaaaataataaacaatatatagagttctaaccatgactttagacagttgtataaatacacacagtgagccacaaatagattaagccactgttcacatagtctagactctagatcccaaacctggatacacttcagaatcatatagaaaacaaaatatagaactttgggttctacccccacaccaagaacgcagaatatttttgtagtgagacccaggaattactttttttttttttttaagttttccctggagacagtgacatcaacaagatggcagaataagaacaaacatgctcatttcccccacaacaacaacaagaattctgtactcacccacatccaaaagtctctctgcagaagtcttgtgaattcagataggaggttgtaaacccccccatggagcccaacacctaggggggtcatttcgagagtgcacaccagcacccaggtatctgattcaacaattgtgctccagggttcaagcctagaaacagcccacttgccaaagagcttagctatagccctctttgtcttttagcctgctaccaaaaccatctgacacggggttgagatggaatcatcttagcaaagaggcttgtctgcctgtttaaatcagtcttgacagtgaatctaagagttatccagtggctcagctccagccttctcagttgaagtcccagctcagtgctgttcacggaagaatccagaaagagatttgttcatatctcacagcccaggcatctgagcctgcatgagactatcactaacctccatcctacagcggttcccaaggcggcccagtctcagcatcagccccttgcattgcagttggagaactaccccatctatgcagggacttgctgggagatgaatatttctctgagccaataaggctgggttctgcagcctctgtcccacagcagatatggaggtggtccagtctcagcttaggcccctcctgctgcagtcaggaaactatctttgcagagacctcctggagatacacatgctcattagagccaatgagaagggttctccagcttccttcccacagcagatcccaagggacctccctctcagctccagccccagtctgctgcagttgggaaactatcctgtttgtgcatatacttgctaggaatcacagacctgtctgagctaatgaatctgagctttccagcctccatcctgcagcagatcacaaggggccccatcagctccagctccttctgctgcagttgggaaactaacctgctgggagactcatgctcctcatggctaatgagaataagctctccagcctccagcccatagcagatcccagtgtagcccagtctcagctccagcccctcccactgcagttgaggaactatctaatctgtgcagggacttgcagggagacatgctcccctcttagccaacaagaccagcccctccagcctttgtcccatagcagatccaaagagagccagtctcagatcaggccccacccactacagtagggtagctacgctatctgtgcagagatctgctgaaagacccacacacctctgagccaatgaaacagtctcaccaatctcctttctacagcatctctggagagggctgagtctcaacttcagccactcttgctacagttgaagacccatgctgcctgtgctggagcctacatgtagaccaccaagacagtcttctatacctaggtccctggccagctttcccacacagccctggtatctgacttaggtgttccccaggtctgtctggcccagaaagctgtgaatctcaaagcccacgcaagacacatggcttgggtgccctttagtactggggtagctgtagtggtcacagtctcatgggacacaatagtcagtcttcttagagtctctggaaggtcctctaaagaagtacaggcacaaaaaagactgcaaagtaaaataaatacctatttcctcaatttgcagaaattgttacatccacaagcatcaagaacattcagggaaatattacctcaccaaatggacaaagtaaggcactagagaccaaccctaaagtgatggagatgtgtgatctctcagacaaagaattcaaaacaactacttcaaggaagctcaatgaacttcaaagaatacagaggatgaattctgaaatttgtcagagaaatgtaacagataaatcaaaataataaaaaaaattctagagcttaaaaatacaatgaatgaaatgaaaaatgtaatagaatcaacaacagaaataaaacagaagaataaatgagcttaaagacaaactatttaaaacacagaggaaaaatgaaaaaaatgaaataaagaaagcttatggactctatggaacaatgttaaagcaaatatttgtgttattggcattaaagagggaatggagaaaagcaatgtgataaaaagcttattaaaaaaaaaaacccaaaactttgcaaacctggaaaaaaatataaatattcaggtacagaaaggtgaaaggtgaacaagcatattcaacccaaataagaataacttaagacatattctaatcaaattgcaaaggttaaagacaaagaggattctcaaagctgtgagacaataaaatcaaataacatacaaggcagattcaaatatataaaatagccaagtatataaagcactggagcatccaaatatataaagtaaatactaatagatctaagggaaaaataaactgcgatataatagcattagggactttagcaccctattttcagcaatggacagatcatccagatagaaaaatcaacaaggaaacatcaaatttaaaatgccctctagaccacatagacctaacaggcatttatagaacatttcattcaactgctacagaataaatattctttcctccagcacatggaacattctccacaatagatcatatgttaagccacgaaacaagtctcaacaaattttaaaaggtcaaaataatattaagtctcttttctgaccacgatgtaacaaaagtgaaaatcagcaaaaagaagaaatttagaaactttacagatacatggaaattaaacaacatgctcatgaacaaccaatgagtcaatgaaaaaatcaaaatgaaaattttaaaaattctcaaaacaaatgaaactgggagcactttcataccaaaagctatgggatatagtgaaagcagtactctaagggaaatatataacaataaatatctacataaaaaatctaaaaacttcaaataacctatcaatgcacctcacagagctagaaaataagaacaaacccaacttatattattaaataaacttaatattaataataaatttattatttaataataaatatcagttctaaataaatatcccataggttttggtgtggtgttttctactttcattttccattacttttaatggcaaaaaaagcattacttttgcaccaaactaatacaacacaaaaataaacatcagaccatatataaatgaaattgatactaaaaaaatacaaaagatcaatgagatgaaaatctggttttttaaagacaaacaaaattaacaaacctgtagctagattaagacaaaaaaagagaagagccatataaacaaaatgagagaagagccatataaacaaaattagagatgaaaaaggagacattacaactgataccacagaaatacaaaggatcattagagacaactatatgccaacacattaggaaacctagaagaaattagtgaataaatttctggacatatacaacttaccacaagtgaatcaggaagaaatagaaaacatgaacaaataagtataatgagatcaaagaagtaataaaaagtctcctatcaaaaaaatgcctaggacctgatggcttcactgctgacctctaccaaacatttaaagaagaactaacaccacttctactcaaactattcaaaaacattgaaaagaaaatacttccaaactcattgtatgaggccagcattaccctagtaacagaactagacaaggacacagcacctaagaaagctacaggctaatatgcctgataaacatagatgcaaaaattctcaataaaatactagcaaactggataccacacattaaaaacatcatttaccataatcaagtgggatttagtccagggatgcacagatggttcaacctacaaaaatcaatcaacataatacatcacattaacagaatcaaggacaaaaacaatactatcatttcaattgatgctggaaaaacatttggtaaaattcaacatctctttatgataagaacttttaaccaactgggtatagaaggagcatacttttaaaatgataaagtccgtatatgacaaaccgacagctaacaacatactgaatggggaaaaattgaaagcatttccataagataccgaacaagatgaagatgctcactttcaccactttcattcaatatagtagtagacgtcctaaccagagcaattagacaaggaaaagaaataaagagcatccaaaatggaaaggaagaggtcaaattttatccttgtttgcagaagacatgatcttcttgttagaaaaacctaaacactttagcagaaaactgttagaactaataaatttggtaaagttgcaggatatagcatcaacatacaaaaatcagtagcatttctatatgttaactgcaatcaatctgaaaaagaaaccaagaaggcaatcccattaacaatagttaccaaataattaaaatacctagaaataaatttaaccaaagaagtgaaagatctcttcaatgacaattataaaactctgatgaaaataaattgaagagaacacacaaacaaatagaaagatatcccatgctaatgaattggaagaattactattaaaatatccatactccccaaagcaatctacgaattcaatgcaatcctttttaaaacatcaatgacattcttcacataaacagaaaaaaaaaactcctaaaatttgtatggacacaaagatcttgaaaagccaaagcaatcctgggcaaaaagtaaagctggaagcatcacattgcctgacttcaaactgtactacaaagctacagtaaccaaaacatcatggtactggcataaaaacagacacacaggccaatgaaacagaatagagaatccagaaataaatccacacatttacagtcaactcattttcaacaaaggtgtcaagaaaatgcattggagaagggacagactattcaagaaatggtgctgagaaaagtggatatccacacgcagaaaaataaaaatagatccctacctctcactttacaccaaaagtcaactcaaaatggagtaaagtcttaaatgtaaaacataaaactataaaactaacaaactaaatgtccatcagtgaattaatggataaagaaatatatataattcatatatatgtgtgtgtatatatatatatatatagatatatatatatataacaatggaatattattcagccataaaaagaaataaaattctgtcatttgcagcaacatggatagaaatggaggtcagtgtgctaagtgaaataaaccaggtacaaaaagacaaataacatatgttctcaaccatatttgggagctaaaaaaaagtggatctcatggaggtagaaaatataatggggttaccagagactgagaaggctataagggaaaggaggttgaagagaagctggtaaataggtacaaaaacacagttcaatagaagaaaaaagttacagtgttcaatagtatagtggaataactatggttaacactcattcattgtgtatgtatgtcagaatagctgtaaaagaattggaatgttgccaacacaaaaaacagataaatgtttggggtgatggatagccctgttacctggatttgatcattacacattgtatacatgtatcaaaatagcgcatgtatccccaaaatatgtacaactattatgtatcaattttgaaaaatctaaaacataaaagttccctatgggattcaaatgagcagcccaattaggaaagactgacccagacagtaagtattagcaaagaaagagatcagagtgtgatgtggttatctattcaactatatcttctccttgtatcaaaaagatttctaagacttactcaagatccaatctttttgttctacattttttcaaatgtaacacagaatacttgcattcctttacataatcaatagacacaatgttttatatagcattatatggtttggatctatgtcacccccaccctcaaatctcatgtggaattgtaatccccagtgttggaggtggggacgggtgggaggtgatttgatcatggggggcagatttcccctactgtactatcctcaagataatgagttctcatgagatctggttttttaaaagtgtgtggcacctccctgatctctatcttcctcctgctgtggctatgtgaagtgctggctcccccttcgccttctgccatgattggaagctccctgaggctttcccagaaccaggtgccagcatcatgcttcctgtacagcatgtggaaccatgagtccattaaacctattttctttataaattactcagtctcaggtatttctttatagaaatgcaagaacagactaatacatagtagaaagacctaagaatttgaagccagatagacctgggttggaattctagctctgccccttcaaagcatgtgacgttgaggaagtcatttatccacttgaagtctcaaactcctttttggcaaaaaattgagttattgatatttctttgatataatgaatatgaaagcaccaaatacatggtatataagtaataaaggtttgctttattttatcccaataaatgtgaacagatatttctacacttcagtaaaacaaaataaaatgggaaatctcctgaatttgtaatgaagtcgattctactctattccttcttactggttagaaagtgctaatcttctgggcgtggtggtaggcacctgtaatcccatctacttgggaggctgaggaaggggaattgcttgaacccgggaggcagagcttgcagtgagacgagatcatgccactgcactccagcctgggtgacaagagcaaaattccttctaaaaatgaaaaaaagcgcatatctttttttttaatttcaagtccaatgtcatcacatgtattttttgtcacaaaaaaaatcttcaaagattcatttatgtaacttcaatttcctctgggcagttgtttttcatagctacacttaccatagttctaatggtataattcattatctcatcatcgactggacatttcatcaaacacatttcactgttgagacaacttgtcagtgatattcaatttgctgtctcatcagcaatatagtatatagtaattaaatttttatcatggcatctcatccctattgctcatccataattcatatttttctgtcaaacatcaaccctacatatattgtactaatgaggagggaaaacagagtttaccttctcagatgtcttcttagactgtgtaaacaattgcattctttttctaagaggagggctagccaaaggcacaattgtgaagcaaaagccctactcccccagcctaccttccaggtatttgccaacctacacatatcatctacaacaaattctctctaaagtactaatgattatttaaaacaattataaatccaatttatctttcaagctgtaatgcaaaaactactccttctatattttttattcttcatcagtagcatttgagctaccaacttctggactgaccttcccattattttgtgaggttaccagtgggtaagttcaagtccttttttaatgcaattctcagtgcttaacacaatgcttggcacatagacccattacatgtgtcaaattttatttaaatgagtcaattttatattctgagagaatatttacattttgaaagaaatatgaaaagaatgaaagcttatatatccaaaaattcatattttggcacttagatgaaggagatatttatatatggggtgggaatggaactttcttatcactactcaaattatatcacattgtgtgcagactgtttcacccactcatctatctctccagcctcctttttacccctagactctaacataactattccttctgcttgattgccctttcatgccctctacatctggtaaactgctttttatccttcaaaacccatttcaaaagtaacctcctccaagaagcccttccaggcattctccacctcttctgagtttccagaagtggcatactgtgtttatgcctctagtaatagtacatagctaccagcaatggggtacttactgtggacagacattatattagatattttatagaacttacccagttttattcttgttagaaccatatgaaatagatgttcatttcattcttgaaaaacatattcaaagtagttaagtaacctactgaagatcacacaggtggtaatcaacaaagcaggaatggaagctagactctgactccaaagcccagaatattttccatgtatcatacagtttcaaaattaatgacaaaatgactgaatgaatgatgactgtgacaaaggatagcatgtcctcatgagcacacatatggctaagataaatttcaaatttcactctctcttccacattttatatttgatatgctagcgtatactaagatacctttgttaagatagctaaggcatgcagaaaaaaaaaacaatttcaatttcaatatgatactcttagaatcatgacaaagaccttctattgtaactaagcattttagaacacagttttgcaactcaaaacctcagtgtcaagccagtcttattatgtgttctttccatttaagcccattctgatcacattttccctggatcagccccagtggtcccaacagggagctataacatgcacaaaatgtctgctgagccaggttaaatgaatttcagttaagggactaatattattaacattatatgatgatttgcaattatcagtcaaataagatcagctaccagagaaccagggagtccttagtaagaggtgaaccacaaaatcagcacactccctcctcaatgagtttataatctaaatgggcaattgcaaacaagggagggatagaagggctctccggggagaggtgagaaggagtccttcatttgttcttgtcctcaatgaaaaaggcttatgtaagaaaacaagttcaaccgtactcccctatctaccctcccgcaatatgtaagtcctttgcaagtacactgggttcatgcactgataattgagaggtggctgtggttcagcaaaaagcattgatctggactttagaacccaaggattctagtcctaaatctgccactaactagctctatgaccttgctccctaactattcatcttctacagtccctgtttctcatcaataaaaataaagatcacactagttcaatctgagagcctccaactctaaaatgcagtaccttagcactgaatacaaatacttagttaagttcaatttctcccactctgtttccaagctaatatcaatgttgattttttttagatttttagcaacctgccccagtatagattcttcttgtactagggctggtacaagaaggcatcaaagaccatggagcagaattgtttacacaattctgatttaatgcctccagctcttctctgaacttatgggcacaaagaaatcagtcttttttttttttttttttttttgagacagagactttctccctgccctgtccccaggcctgcaacctctgcctcccaggttcaagcaattctcctgccttagcctcctgagtagctggaattacaggagcacactaccacacccagctaacttttttttttttttttgtatgttcagtagaaacagggtttcaccatgttggctaggctgatcttgaactcctgacctcaagtaatccacccgcctcggcctcccaaagttctgggattataggcatgagccaccataaccagcctagaaagcagtctcttcaccgaaattcatttatataatccaaaaatttctttataatctgaccttccaatactcctctgatttcatctcctatttccaatcatggactcctcttcagctgcctccttgctggtcctctgtcacaccaagcagactcctgccctcagaggctttgtaccttttattctccctacctagaatatctccctttttcataactgcctagtttgagctctcactttcttcaggttttcattaataagtcactttttcaataacacctgccctcatcatcctttctgcccactcaccatttcatatcctccatccctactttattctgtcctgaactttgatcataatctaattaattatttatcttgttgatcatctgtcttccccattagaatgtaaacccagtaaagacatatttttttgggtcagtttaattcccttcaatattccaagtacctagagtagtgcttaggatataggaggcaggtaataaatatttgttgaacagatgaataagccctcatgtctcaccactctccccctaattcactgtgctccagacacacttgtcttctccttcccttatcatgcacaccaaacatcctctccctcagagcctttgtattgtacttccttctgcctcggatctcctttcaaagatatccatatggggttttttcccacattttattcagacctatatccaaatgttgtcatgtccaagaagccttctcaggtcaaattatctaaaatggcagtctcatttttcatacacttttcttatactttttttttcctttataaccgtggcagtggtggaactaagccactcagatctctttcaaaagaactttcttggggagcaaattgactgacagtcccaactgtctgtattcacctctgcatgctctgaggccaagccttccccaagatggtcccagccagtatttcagcacagcaggaataatactttaagactattcctaatgactcgggactcctctaataggcaacttgggctcaggaactacccatcaacttagctgaaacttctttaaaactgctacaatctgagattcttcttccctaaaccttcttccttctcccttccatttcacaggcttcagacctgcataatagcctgaaggctctcctgtctaatcttattccctccccttcatctttcacaggtatctccccctttaaatctcattcttataccatctaattctgtcttggtgtttgcttcttggagtacctgaaataatacaataaaacttatagcatattcaatattaatttgtttatttgtagttgctcatctctacctcatgaaggttgagacttggtctgttttattaactactagatctacagcatgtagaatgatgcttgcaaagaccaaatatctttggtagacaaatattactgctacatattatttcatttatttgtgaaagaaaataatgagtgtctagtatgttttaggcactatgttaagtactcagtagatcaagggtctagtggaagagataaatatataaacgagtaattataactcactatctcaaggatttattaaaagtattcacaatgtatggagcacaaataacttcataaacagttaataatttaaatcctatacatgtttaaggtattgttaatatcccatgaactatagaaagggtaattcaaccccaacaactaagttcccttgtctcagccaagacctcctcagaagtaaggtgtcccttgtgaaaattttcttcaggtatataaagtgaagtgaaggctatcccttgctgtataagagtaccctgctcaagattacactgattggctaggtaaaaaaggtaaataagtttgtggttctatgccctaggaaaacaatctgtgaaccagataaattattggaacttttctagctcaagcttcaaaaaatggtcccatgcaaatatcacctattctatgaacatttatgataccctcactactcgtcgaggtcactccttttatatgttgaagcactctgtgcttctccttcctagcagttaccaaaagtgtaatttattagtcatttgggagctatctcattagtagataataagctccatgagaaaactacatctattatattaactgctatatctccattgcctggcaaggaaaaaggtctctatatttcttgaatggctgtataaaataatgactgattaattaaatgaaaagtttctgcttatctacctaattgtaaaaattatctccctcatcaaaattcccattgcattttatctattatcttacactccccctctatccatcatatatccatatatcccaccttatatccatatatcccctatatccattcatgatgtagatataaactttacaaataaagaagagtagtacacctcgaccccactagtcacagaaaaattgtcagtctttggattcagttgctcttgagatcattcatccttcccagatgttgacaccccgaatcgagatttgaaggtgacaagtaatagtcctctgatttccactcactccctctcctctcccctttctttctccgtctttctctctctctctgtcttcctctctctttataagaagctatgaaggcagaagcatagtaaaaaatgaatgggtttgagttagaaattctacttggtctgagttccatttctgtcttttccatcacaactgatttgctgatcattgaggactgactgtgctgacttacaggaaaacaaccattaatattaggaaaagcctagagagatgaggaccaacaaaatctctagttgagtaatgtaatctaacctgaaaatctgtagcaatcaggcctacaagagtaacaaaaactaatgctcagcatttctgcatctgctatcaaaaaatatcaaagcactctcacatctactatctccttattttccctcactataatctttaagtgctaggcaactaaggcattgagaagttaaatgacctgcccaaggtcacacagcaaactgatgactcatatctcaatgttctttctattaagcaacagggaggtaagttgaacatctgatcaaataaaagacctttctcatcctattacctcaactgtctctctatgtctttaaggcatgaaattaagaagtaaccagataaaagtaagatgaaaactgctactgcctttgctacaaaatgtgagtaggtaggctttgctgtaattatggagaatacatatctgatttaactcccttatttctttactgtctggatatttggtaatatttgataggaccacaaaggcataaaatgaagaaagagggaaagaaaaaaaaccatatagataaatgtagaaacattagaatttgccataatgattccaaagggtctctcagagttaaggtagatgctgttgatgaaaagagtaaaattctctaaaatatttgaagagatttattctgagccaaatatgagtgatcaatggccgctgacatagccctcaggagatacagagaacatgtgcccaaagtggtcaggctacaacttggttttatacattttagggagacataaggcatcaattaatacatgtaagatgtacattggtttagtccagaaaggcaggacaactggaagctgagtgggggtgggggtggaacacttccagttcataggtggattcaaagattttctcactggcacttagctaaaagagttattatctaaagacctggaatcagtagagaggaatgtctggggtatgagaagcagttgtgaaaaccaaggttttattatccagatgaagcctacaggtagcaggcttcaaaaagaataaattgtaaatgtttcttatcagacttagtctattttatcagcctaagttctctgttgatgttaatgctggtcagctgtgaggcatgtctgacccatccccctgcagttctgaactaccagttgatttctaggagattctactatgctgtcttaattagaacctttctatgtctcaactttggaatgcccttggtggacaggaagggtatgttcaggtggctgggggacttagaattgtattggtttacaatgcactaagaggactttagggtcctgccttaagaggaaccttagacagaaggtgatagtacaatggaaaaacagggaagaaagtgggagcaggtcacattgccacaggcctcagttcatatttctaacccaaaccccaaagtaaagaagataagctctgcatcttacctgctccttttgaatctcctccttctcattatagtaggttagttccagggctccgctaaacttcagggtagaacaagaaaattacctcagcccatgctgttcactcctaccatgtcccgttgtgagccccataaaagctgaatatggagatttctcatcttcccagtctctacggtctaccctctcctttcagctgctacttttttctctatagctcaactcctttttagctctcgtcttgattattaggacaaccttctggttctttttacttcctccagtgtcagccactcaagtcattgcttgacactatttcaaaactcacattcctgaagtagatagctgatctctacaacacctcgcaaaaatctttgaaaatttctcaactaaataaagaatacagttgaaattcctcaacttcatatgcaattcttacccatctctccctacacgtccctgcccactaccaatatatactccactgtggccaattaaattcacaaacctgacttgcatttactcatctgacactactctcacacttttcccagagcctaggatatcctcccacaagtatctacatctctttttgcagtatatgtttcccctctcatctgaatttcatcttgattttaaaatatcctaagctggtctccaagactacttagcttcaggtgataaggcttagctcaacactttggatatccacataaaactactttaaacttttgttaaatttatcttcttaaattaggaaacttgatttttttatatacatacaagaccaataaatactctgtaataaatattcagtttctaagagaccagtaactaagacttttccatttatttgcctgggtgctctgaatgataaatcttttatcaaaaatagagagatttgtgggtaagacaaattgctccataatactttcacaatgaaaacttatccaagtcagatctggccccaaatatcaattccctgtgcatttgtattctgacgaacctatcacagtgacctattttcataccagtgactaagttaagaacgtgattgcttttgaaagaaactgaaataaaaattccaagaatggtattaggagaaatgaataaatcaaacatgattttctacaaacacaagttcataatttaagcctgctaaaacatgtgtgtattttcagaatgagaggaggtgtttgatgttataagtccattgtgactgaataaaaaattacagaccagttcagttttttaatggcattatgggtgcttactaattttttgctaatggttactgataaaacaaaatttaaaacataaacgtttgctgaatcctgtgaaaatctctttttctcaaatactttcatttaatttatttaacaattatatatgaagaacacattctgtgtgctgaaggaattcagaatatgccacctcaaaatattccactttgacctaaggattattttgagctgaaagcaattgagaaaaagtagacaaagagcaaactctctgccctcaccttttctacaaggaagggcaagatgatttttaattataggagacgattctagactcttaacccaaagatgttccagaagaatctacataacaaaatcttactaaaacaacccttatcttccattagtttcctcatatatttacagtttgctacccctaaaagcctatttttctttgtcttgtcccttctctacaaatttactcttctttgttaaaatgctacataaacccaagttcctaccacccctttgaattacacaatgcatgcattaataaacttgtttgtttttctcttgtaatatgtcttttgtcaatttaatttacagggaatgaacctaaggaagtagagagaaaaaggtttcttatccctcatttacagtttcaagaacttaaaatatacacaatgcttgtcttcaaggatcctaaattctagtgaagaaggacaattaaacagatcattaggatataaaaataatttggaagttaaaaaaaaaaaaaggaagcacagactggcacaatgatgtgcatttgtagtcccagctactccagaggctgaggagagaggatccctgaatgcaggagttcagatccaccctgggcaatacagtagaaacctcatctcaaaaaataatagtaatggtaaggaaagaaagttttttaaaaggcaggcaattaaattagatttaaaacgacaagaaagtcagtgggctaacacaggatcatacaaatagccagtcttgacccctccagactttacgttcctacttatttatagcaaaagcagaaaataggccatttttttcatggaaataagtaaagtacctaaaaaaattcaacaggattaaaatccaataataagactacagaaatatttaatgtcattaatttatcttttgtgtttgttgttcatttattcatatctttgacaaaagcttttgacaagcatttttgcaccaggtttgtatgcagttatgggagattcctaggaaagttatacaggttccatactgcaagttatttaaagtcctgtagaacttcatcagttttcatgacattagcatgtttgaaaaatgggaacaatttgatttaggtaggtacctgaatataaatgtgaatcacagaatcttagggtcggtcacctagttgagaagcacccttatggttaaaataccttttttttttcttggagacagagtctcactctgtcacccaggctggagtgcagtggctgaatcttggctcacggcaacctccacctcccgggttcaagcaattctctgcctcagcctcccgaatagctgggattacaggcacctgccaccacgcccagctaatttttgtgtttttattagagacggggtttcactatcttggccaggctggtcttgaactcctgacctcatgatctacccacctaggcctcccaaagtgctgtgattacaggtgtgagccgccgcgcctggcctacaatatctcttataataattcacatttgtatagtacttcataagagttgaaaactcataagacttttaaatattttatttcattttatccccaaaacaatattgtgatattggtaaaacaaatattaactcacaaagagggagagtaagactccaaaagataaaattataatttttttaaaaaaaggaacagaactatgatatgaactcaaactcaagattttaatccaatatgtgttctattaccactcaatcctttaaaggtcacacttttaaaatggatataccgcagatcccaccatcacctagattctctctctctctcacacacacacacacacacacacacacagagtttcaatcatgcacacagagtcaattatacacaattgctaaaacatgaaattctgaattgcaagtctttgcaatgactcccaccttaaaatacaatacatcattttataaggaagcctccctccttttctatccttgtccaaaaccaatcaattaaacaccagagtcaagataactttggaaattccaggcaattctgaactaccagttgatttctaggagattctactatgctgtcttagttagagcctttctatgtctcacctgaattatcccagcttattcctatgcaacatactccagttgaaaccactcaatcacaagtacagctgaactcaattcaagcattttctaaattacaccacagtctctcctgattccgtccctttgcacatgctttcctctgcctgcaatgctattcccttccctatgtatctggtttatttaaaagttacctcttcggttgcttttgtggactttgtcaaaaattcttaccaaggccaatgtcaggaagagtatttcctagattgtcttctaggatttttaaagtcttacttttttttgaaggcttacatttgaatattttattccctttggattaatgtctgtacattgtgaaaggcgggggtcaagcttcagttttcagcatatggctagccagttatccaagcaccatttattgaatagggattcctttctccattgcttgtttttgtccaccttgtcaaagatcatacaattgtaggcatatggctttatttctgagttttctatcctgttccattgctctacgtgtctgtttttgtaccagtaccaaggaattgcaacaaaaacaaaaatagttaagtaggaccttattaaactaaaaaggttctgcacagcaaaataaactgtcaacagagtaaacagcctacagaatggaagaaaatattcacaaactatgcattaaacaaatccagaatttgtcctatgcaagaacaaatatctagaatctgtagggaacttaaataaatcaacaaacagaaagcaaataactccattagacaatgagcaaaggatatcaacagacacttctgaaaagaagatatacaagaagccaaaaaacatctgaaaaaatgctcattatcaccaatcatcagagagatacaaatcaaaaccacaatgagatatgatctcacaccagtcagaatggctattattaaaaagtcaaaaaacaacagatgatgatgaggctgtggagaaaagggaacacttatacactattgttgagaatgtaaattagtccaaccattgtgggaaattgtctgaagatttctcaaagaacttaaaacagagctaccatttggcctagtaatcccattactaggtatatacctaaaagaaaataagtcattctaccaaaaagacacatgaactcatatgttcctggatgcactatttacaatagcaaaaatacgaaatcaacccaggtgcccatccatgggagattagataaagaaaatgtagtatatatataccatggaatactatgcagccataaaaagaatgaaatcatgtcctttgcagcaacgtggatgcatttggaggccatagtcctaagcaaattaacacaacaaaaccaaatagcagaaaaccaaataccacatgttcttacttatagggggaagctaaacactgagcacacattaacataaatatgagaacaatagatgcttaagactactagagagggaggcaaggagcaggcatgggttgaaaaactacctatcaggtaccatgctcattacctgggtgatggaatctgtaccccaaacctcagcatcacacaatatccacatgtaacaaacctgcacatgtaccccctgtatctaaaataaaagttgaaattttaagaaataaaagttacctcttcataaaagctttttctgacacctctggtctctaggctagattatatactccacttctgtgttctctgagtttaattctcttataacactttcattacaatatttttccatatattagtacttctttagtctctgtcactagggtataaactccttgaagacagagagaactaggtcatttatcacaactccagtgcctaacatactgcatgatggtcaaaatagaatcccaaaatcaggacatcagcatggccgtgttctccctgagggttctagaggaggatattttcttgcatttcctagcttctggtggttgctaacaatcctgatgttcctttccttggagatgcatcactctaatctctgacactgttatcaggtggcattctccctgtgtatctatatctaaattcccatctccttataaatagtagccattaagttagggcccactctaatctagtatgacctcacttaactagattatatctgcaaagaccttacttccaaataaggtcacattcacagatttttgggtggtcatgcacttcagggaaatgcgatttcacctagtacactgtgtttcaactggagagaggagaatctgaaattctgcatttggagaacagtactcaagcaaccaacccagctatatttgatttgacatcccaggtcactgccttatttatgaaaccgaaacttcccacaagaaattacaactgctttttgtcttaatttggagagtttattcattcattcattcctccactcatccatcacatatttatgaagtacctttaacatactagtggtatggatataacaataaacaaagcatacaaaaatctctgcccttgtgaagcttacctgtgagcagtggggggagacagataaagaaatatgtaaaactctgcacatgatatcaaattttggtaacttcagtggaaacatactaagcaggaaatggagataggaaagttgaatggggttggaaatgttgcactgtttaacgtggtgactaaagaaggctccaccaagaaggtgctatttaagcatctaaagaggtaaaggagttagccttgtggatatttgggagaatatagtttttaggtagtagaaacaaatgcaaaggccctagagtaagagtgtgcctggggagttagagataagcaaggaggccagggtgatgactacaaagataagagagcagtaggaaatagggcctggggggtaatggaggatagtacagagatcaggatgttcttcctctctccactaccaactaaatagtcattgcaagatgccatgttcctagtttctacatagggtacattttgagctcctaagagacaagtttattatatcaaatagaaaaaaaaatatatatatatatataactttatttcacaaaaatgaaatgctatgctcattaaacattaaaattcaagtaattttagtgtccttcatctgtctgccttataatcaggaaactagaaacaatgtgggtatctagattataataaataaatatttatttttagataagttatacttctcatgttaaaaaatactttctattttaccatatcactctatatatgacacttgatttatcacaatttgtcttggcaaaataactatcaaactattttatttaaacaaaaagttgattccctagttcccttcagtcttgtctagattttcaggatacagttagtttctcatttggtgctaccttatgagagaatttgatagaaaatggcctactcaataaaaagtcaaactttcttttttttttttttgagacagagtctcactctgtcgcccaggctggagtacagtggtgtgatcccagctcactgcaagctctgccccctgggttcatgccattctcctgactcagcctctcgagtagctgggactacaggtgcccgccaccacacccggctaattttttgtatttttagtagagatggggtttcaccgccaggatggtctcaatctcctgacctcgtgatccatcctcctgacctcgtgatccatccgcctcagcctcccaaagtgctgggattacagacatgagccaccgctcccggcctcaaactttcttttctaaaaactcattcaatcagagaatattagacagatagacatagagtattagacagatagaatattagacagaacttcctcataggaagacactctctgttgaacattgtgacctctacatgtctgcactataactcagcatcttgtgcaaaattatcacatcttttcaattaatgttttgtttaaatccaataatttacatttttatggtgatctcaagtttacaaagttctttgccaaggtaacaaactatttttaagagaacagtgttcaatgtcaaagcacatgcgtgtcttatttaatattcacatcaactttataagaattatgatctttattttgcagttgaggaaactgaagctcaaagaggagtagtggtttatccaaggtcatatctgatggcaaaataagattcaagaccatttgtgcctgacttgaaagcctttgctctgaaactctggactctagcacctatttcacatttttattttgtgtaattttcccaaaaaccctgtgaagtacatattatatccaaaatacccagaatacattttctttctttctttctttctttttttttttcttgagacagagtctcactctgccagccaggctggaatgcagtggcacaatctcaggtcaccacaagctccacctcccgggttcaagctattctcccacctcagcctccccaagtagatgggactacaggtgtgctccaccacaccgagctaacatttcggttttttgtttgtttgtttgtttgtttgtttttagtagagatgagattttaccacgttggccaggctggtctctaactcctgacctcaagtgatccgcctgtcttggcctcccaaagttctggtattacaggcatgagccactgtgcctggccccagaatacattttcaaagaggataaataatatatcctaagtcatagacccatttagtggtagatccattaatttattcattcattcattcaacaaacatttaggaagtacctactccactaagcaatgagcattaatggtgaaaaaacacccactcttctggaacttaaacagtctaaaaagagggaattttaaaataactaacaattattaagtgcttattatgagccagttactattctaagcatttcactggtattccctcattggaaattcagaacagccctcatatgatagtattttagataaggaaagtgagtccccaaagaggttaattggaccaaggtccacagattgtaaagactgattcaggctttgaatccaggcaatctagacccagagactgtgcttttaactactctgctatgtttgttcttgagatagaaaataaataaatacattaaataattaaagttgtaatatggattccttgctgaattgcagctttcattgtaccacattgccttctgagatttttttttcccggctagtcctatggtagcttccctggtgtcccagttgtcagctaacaaatgggtcaagttagcttggcagtgacataagcagacactacctttatcacttcccttcttccactcaacagtttgtaagaacccagaatgcctggcattagtgggcatttcagatttctcagtgctggcacagacaagcaaccattccaaacctggaacctaaagcagcagtccaggaaggcaagaggacaaagaaggcaggattgagtgtgccaagcaaatcaaatgccaagaaagaaactttgtttgttactaattttaataacaaatcggaatttattacctataaggtataatctattaaaagtagctcaagaaccatttagggtttttaaggacataggagtaaacatcaatgccatgagaatttccaaacttggaaatgcaagacgcacctgcaatagattggtcctttcctagaagaagagatgagaagattgcagtgatatccaaaacaaaaacaacaaacaaaaaccataatagaagtctagaaggatgagcatggtggcttacacctgtaaatctcagcactctgggagactgagctgtgcagatggcttgagtccaggagttccagacaagcctgggaaacatggtgaaacccatctctattaaaaaaaatttatatatatatagcgaggcgtgctggtgcgtgcttgtggtccgggctactcagaagtctacctgggaggatcacttaagcctgggagaaagaggttgcagtgaactgaaataatgccactgcactccagtttgggcaatagaaggagacctgctgtttttttgttgttgtttttgtttttttaaaagaaagtctagaatacaggagaaaatgcactacaagccttactaaaacatctggaccacctcactttggccatcaagaaaatttaggaagcagttgtaataccaagtttggatgtttggattagggtaagggtgagaattaagaggacttaaccaaccctcaagtcacaccaaataaacattctaagtaaaatgtgtgcttacaataccaactcaagataaatctctctgctacccttccaactggatattgtgcaggggttataaagaggattctgggacagactgcttgggttcaaaacacatttctactttaaaaaaaaggtgaccttggtaaattatagaatctctttgtaccttagtttttacatcttcaaagtgggaataattttattacctaccacttagttttattctgattattaaataaaattaatctatataaaacatttagaataacatctgacacatgcacagtgctacatcagtgtctgagattattatgctgctaaaaacctctcccatatgaatttctagagctacaactgcttgaaggacataataattgacagaaatcaggtgtagggtaagaagcaacaggggaggagaaagaataatttttgagttcatgataagagtaggtctcatgctgcttataagtgcactttagactttttcagagacatggaaacatattttgtttaatacaagttgacaatactttctccttctctcctcattctgttcttaagtccttatctctgccattgaggtgtaggggactgagctgtttctcctggctgtactgattagtgattctccagataaaacactgttactgtccaggctgtttaaacttagtgaagaagagctaaaatcaaatattagcagaaatgttgctggaaagtattttctgaagtgtgacatgaaagctttcatcaaaactcttagtaataagtcattatctatggttgatagggttatgaatgatttatattttcatcttctttttttgtattttcaaaattgtataataaatcaaaatttcttttatgattaggaaaataaacaattacaaatcttaaagagtttaaaagagcaagacatgaagtcaaatcttaaagagtttaaaagagcagtttatatgtggttaacataatcgtgtaaaataagcaagcagacaaaactgtgtttagagaaagtactgaaaggaaaacagtataaacaacaatttctcattggataatgttaccctaccttttatttttctttattttataagttttcaacaaataacatgtggtactttgattagagaagagtgccaactaatttcaattaaaacataaaacctcaagcaggtttatcttaggtgtttgaaatataagtctttgtttttcttcttgcctaaattaggctttaaatttagtggaaaattatttcctgatcagactataaatgaaaataaatcgagcgggagaggaaacaggggctgtcatggaatgatggagtaagaaaaaaaaagcacaagttatttatggtttccaacctcttctaggctttcagcactgcccagcaatcctttcagttgtctctcctcagctatttctcctagaccctaaagtggctattataaacctccatcatgctcatgaagatcctgtcccagcccactcatctctccgcagatgaccttgctacctacttggtcaagaaaatagaggtcataaaccacaaacttcccgatctttccttctccagcttctatcttcaaggtcacacatacattaaaatcttaacctaagtttatctcctcttctccagggaaagaggtagctatccctctttctttccaaagttaactttcttctcttatgcttctggtcccagtttcttttgtactttccctttgctgttactttatttctttctctccactgacttctgccctccatactatctctgagttctgtctcctccttatggcattgcctcctctttccttttctcttctctctgtttatttttcaacccaaagcattccaatgttgacttggggcagatattctgctgccactccagaggtagtctcaaacatccctatagcttcttcagcatcacctctaaatttctgactaccatttctccatctcaaatcacaaccactcttcttagctcccaaaccatattcctaaacatttacatctgaatgtcatacagatacttgttaatatgtccaatattgagctcatccctactaccatggaacttgttccttctctgtattacctagctccccaatgccatcaccaaccagacacttattgtagaaacctctgaattatctctgattccttccttatctccttcctttaatcaaaattgaatttccaaatttcaatctccaaaaatatttcttgagttcaatcattgctctgcatatccatagtgacataattgttatattaacaatatatgtgttataatttttataataaaaataatataattgcatattctaatataataatataattgttatatttaacaatatatgtagagcacatttattagacatgtgggtggatggatggatggatggatggatggatgcatagatggatgcatggatggatagataaatgtaaaaaatagggagaaagctataagacaaaccaggatgttgtgtgtaatctttcacaacaaatctacttatgaaaaatttcgttattcacctaagtttcacatttgaatatgttaggacaaaacaccagctactcaggaagctgaggcaggaggatcacttgagcccaggagttcaaggctacagtgagctatgatctcgccactacgctctagcctgggcaacagagcaagaccctgtctttaaaaaagaaaagaaaaaacatacagacacgataacagaaagtgaataaatatggaatgaattcaaaatgtggaaaatggggtagaaacattggagaggttattaaaataatcaactagaagacatgatgtgttggagagaagcgtgattcctgtaaaatgaattcaaatttaacacaacagaaaaagacaatgatgttattcaccagtcctgaaaatccctatctcatcacctgaaattctgaaaacttccttgcttgtaccctatccctgctcttttagtgaaggagcttaccccatagattgttcagaactagagctgagttattaaccaaagatattgtctgtggtagtttaaaaatagggaccttttatatcagagttaaagtctttggtgaagcttaaacattcttagttaatgttacaattagacatcttggcttctttctcaagctgctgcaaaagacagaatggtatcaaggtggagggtcagagcaggaatgactgcaagtgaaaaccattcccaaggcctgccttatcacagaaagaaaggcaaaactggaaactgaaataaaacaaaaatagcatctatgaaaggaagattgctgggtcatcctggtgataatcaatcagctgaggctattaccagaactcctgaaggtagaaaaataagctaagctataaataaatgctttaaataaaattatttaagttataaataaagattaccagtttgtaatctaaaatcaagaaaaaatttttaataaagaaaaagaaaaagtcttgtaagtattcctgtcataggcttaatggataatagtttttggtttgttgttcccttaacaatacacaatggttatttctacagtcactcatcagatatacaactattaaaaataaataggaaaagatctggatggtaaagatctctctgaatacctcaagggaacactaacatggcaaagaaaactcactgatataaagctagtatcaaaaatgagcaaataaatctgtaagtattttctatctgccttgcataattctttgttaactatcttaaggaataaggagtttaatcttcacactgcagccacagtgataccacagaatatatcaaacaatgtttctcctctgttcaaaaccccctccaatggcttcccatctcattcagagaaaaatccaagtccatttggaagcatccatgatcttatatgatgtagcttcctaccacctacctggcctcatctgctactactctgtctatctcttattcatcctctagccacactcttctcctatttatttctagccacattattaacccatctatctgtattcagcaggtacactcctgattcggcaacatcacacatgttgtctctacccaggacaatcttcccccaggcatcagaaggtggtaccttactttctccagccagtgtaaattacatcttggatatgctttcctttactactcctcaatgagatttcctaaatatctttatttttttctcttacatgtatcactacctggcacactccataattatttgtttatttattttctgttcctcataccctatctcctaggagttcaattcccagttgtatcttaggcctagaatagtagctagtgcatagtagaagctcaatgaaaatttatggaatgactaactagtaaaggctaaagtatgatgaggcccccaggaagagctagcaagttctgctttatgcctgagttgttgcctacaagagaaataggaaggatgccagatagcaaaggggattcaaaacggaagaacagtatttcacatgatagaaatgtttaagaagaatcatggaagcaagcataagagagaacacttcagaactagttaaagccaatgaagcagggaaatacatattttagaatgcttcccatttaagctcagatttaatctttttaacctttgttggtaattccttcaccaagggttcaagatatctgaagtagtttagtttccctttatcattatgaaagttacctcactacctctgattatacttttgcatttaagcctactgtgtttgatattaatatagctactcagcttttctcttctttttttgatggctgttacatagcttatccttttttatatttttatggctaccctattggcttatttatctttaacttttttcttataaatggcttatatatgggttttgatattttagccaatatgacagtctctgacttttcattgtcatttcttatcctatttttattaatgtaattattattatagttggatttaagaataccattttgccatttgttttcatttgtttcatctatgtatctttttttaacttcttatgttattttggctttaaataatatatatagtattttattttatcttttttattggctattttcctatacctttttttgtatttttagtgtttattttaggaattataatatgcctccttaaattatcactgtccacactgaattaatgttataccacttcacatacatcacatataagaaccttacaactgtacacttccatttaccctctttctgtcttttctgcttttgttttcatatgttgtatacatatcctatagatcaacaacacagtattttttttttactttaaagagtcagctgtcaagaaaatttttgcaatctatccatttgacaaagggctaatatccagaatctacaaaggacttaaacaaatttacaagaaaaaaaaccaccccatcaaaaagtgggcaaaggatatgaacagacacttctcaaaagaagacatttatgtggccaacaaacatatgaaaaaaagcttatcatcactggtcattagagaaatgcaaatcaaaaccacaatgagacaccatctcacaccagttagaatgacgatcattaaaaagtcaggaaacaacagattctggagaggatgtggagaaacaggaatgcttttacactgttggtgggagtgtaaattagttcaaccactgtagaagatagtgtggtgattcctcaaggatctagaatcagaaataccatctgactcagcaatcccactagggggtatacacccaaaggcttataaatcattctattataaagacacatgcacacatatgtttactgcagcactgttcacaataccaaagacttggaaccaacccaaatgcccatcaatgatagactggataaagaatatgtggcacatatacaccatggaatactatgcagccataaaaagaatgagtttatgtcttttgcagggacatggatgaagctggaaaccagcattctcagcaaactacacaggaacagaaaaccaaacaccacatgtttggtgggagttgaacaatgagaacacatggacacaaagaggggagcatcacacatcggggcctgtcaaggggtggggagctagaggagggatagcattaggagaaatacctaatgtagatgatgggttgatgcttgcagcaaaccaccatggcaagtgtacacctatgtaacaaaattgcacattctgcacatgtatcccagaacttaaagtattgtttaaaaaatgcattgacaaagactgttaactaaatgttaacaatggctatctctcaggggtaggattacaagtgatgtttttttcttcttgctaatctgaattttccaaattgtatacattaaatttttacaataaacaaagcattctcacatacccacatgctcacaatttttggtgatttttattttttgtgtagatctaagtttatattttgtattatttccttttattctgaaaaacttccttcaacgtgtcttagtacaagtatgctgatgttgaattatctcgtattcatttatttaaataaacatatttatatagtgtataaatatatatttatattcattttcgaaagacgtgtttatggatataaaattctaggatgacttttttctttcaccattttaaagatgtagtttttttcatacttgcattgttttacataagtcagcagcattcttcataattcccagtttattataagacttaatctgactattcctaagatttctctttatctttggtttgtcagcaattcaagcatggttatgattgatgttcattaagcttcttggatatgtggtgctatggtttggatgtttattcctcccaaaattcatactacaacttaatccccaatgcaatagtattaagaggtgaggcctttaggtcatgaaggtcattccttatgaatggaattagcacccttataaaagggtttcagggagtttgatagtcccattttgcccttttgacctgctcctcttccaccacgtgaggatacagcaagaagacaccatcttgaaagtaaagaacaagcccttaccagataccaaatctgctggaactttgatcttggacttcctagctaccaaaactgtgagaaataaattgctactatttattagttaccaagtctattttgttatagcagcaaaagtggactaatacatgtaggttgatatttttaataaaatttgggaaactattaaactattatttcaccaaaaaaaatttgcccattttttcttacctctcctgttgggactgcaaatatacatctattagactatttgatgttgcaccaaaagttatggaggcttttttgttataagttgtctttctctatgtacttcagtgtggatagtatattttgcactgatttaagttcactgatattttcttctgcagcatctactctgctgttaagcccattcagttaactttttatatcaagtattgtacttttaagatctagaataactacttcattcttttttaaggtttcccatttcatggctgggattttccaccaactattcaatcactaagcccatcttttcctttacattattaaacatatttataatagcattttaacaaccttgtttgctaatcctaatatttctgtcaccaatctctattgactattttttttcatggttttctcctatctagtgatttcttaaagtagctggcaattgtagatgctacattgttgacatcatcagagtgacgagtttcattctggcaggcagctaatttactagcacattagctttatcctatcaagacttctttaaagactctgttaggggatgtctaaggcaatcaatcaaaggctggagtaggcctcctccaaacgcatgaattttgggtggtgtcagcccaatgactaacatgttcagcaaagtccttctgctctagctcacaaaaattccaacgttacccagaactgtgcaaactccagaatctctatgtagctcacaaatatttagttgctgccaaacctcatcaaatttcaccctgcactcacgcatcttattgttcaacaagactaggcagtatttcctatgcagattattggagttccttctccacacagttctctcatatctagtatcttaccctgcaaatttcacccaccttagcagctgtaagagccaatatttctttcctccacccattaagatttttgctttctaccaagcaacatgctaaataccaataaaacttgtcttatatactttacttgtttcagggatcacagtcttatgttgaatgttgtttaatgcccaaaaacagttgctttatgacttttgtccaattttttagttgcctatggcataaaagtaggtctgatatacattattccatcacatttgaataatataatatcttttgataatttttattttcatcaaaattttggagtgaaattagtccacttcaggttatagaaaatattcacaaatagcctaattgacaaagacagttattattgaaccatcagaaaaatcatatttactttctctcagaataaaagtctaatttaatttttaattacaacaaaggtatcaatatacctttccacaaaaacaatgttacctcttcgaagcaaatgatagatagatagaataaggcatttccatgagtatgtcatctggacaagctaagtataaatactttcaatatttcttatagattctttctttgtttttctctcacagtagcaatttacttttcctaatactcaagggataaaaagtcgtggcatcattcaggaaaaattgacatcactctcactgttctactctaaagcatacgtgaattcagaatgtgacaatactagacaaaataatttatctaaattaccttaatttttccataataggaatatgcttaacacatggaaagacaggaagccctgtcacagctttgtggggaatttaattcatggcactttgcagacagcaatatttccaaatgtacttttatttggtgacccagatgacaagtctctagatggaagaaaggtaaaacagaaactccagtttgaagatcttgcttctgtatggccttaatgcctttctttccatgcgttatgtttaattctattttaaatttttttactttttgtacctgtgatttcttttagttgcaatagtttggtagatttcatgtggttttttttccttttccttataaggagaaaaggctttctgcatgggaattccttttgttctgacatatgggtgatttcttggtgctatttcccacctatttctgtccccagctacaggttgaggtctgcgtattgttttttttcttagaggcatacaaagggcaggaggaaaactaaactaagagcatatgtggcatctttagagtaaaattgatcactctctcttcagagtttgtaaaacatcctgtcccaggattgacttctcctaactgtaatgttatattacctgtggtttccctaagatccctcatttttcacagagtcagcctcactgtttacttcatcattttagctgttttactccatcagccatttatagcagccattaataacaagaagaaaagcataaggctacccactcacttgtggggatctctccaggtttggtcatattagtgagaattctaaaagttttgtcaatgtactaattagattttaccagagataaaggggacagtgttggcaagataatgggaaggagggctagataccattagaagccaaactctgctgtgcctctctattctactctggatccttaattttttttttttttttttttaccttggactctagtttttcaagattgctgcatcagattttggacctttccttttctggtggtggtggctgttgtgactatgtgtgtgtgagttttaactagtttttgctcctgcaattaggtattgagaatggggaaatatgtgttgcagcttcagtatgccatcttaaacttgaaatatctttaattttcacaacaatcctgagaaatattagcttggcaattttaaagtgcagagaggttacaattattaatgagaagatgaaataggattgcaaagttttcattctttaacaatattaattgtgttcctactatgtgccatccactgtgctgggtaatgaggatgcagaaatgaaccaaagagatgtggcctctgccctcacagagcttaccctctagtaggggaaacagacatttaaactactgattataatatagtaaaatatgttctatgatacaggaaggtacatcaacaaacagagtctaatataaggacagtgagagcttttcaagttaaaaaatacagagtatatatggataataacagatgctcagaaaatgttaattttcttcccttcctaagcttccaaataaccacaaaacataaaggcactctgtattgcctactcctagcattgttggaaagatgccattatacagcgtgcacagaaagagtgtttgttatctctaggtgtaggctgatgaggactaaattctgagagtgaaatccaggtcatgcaaactaagggcaggaactgctacgtcaaatagtttaaccaaagggtttagtaatgcacctgatcaacagaaagtgcctaatgatcaatttgagtagacaattaaatggggcacccatggatattagagaaagagaaaaataattttctccactctttctgtctatccattagagtggttaagtccataactctatgtactaagtgatgatctcattcaaatgaaaacatattcaccataacaccttgggttaagacatttggcctggaaatcatgcctcagggttaaaagtaattttttaggttctctcccttatgaatcaattttttaaatccagctacagccactgataaaataaccttttttattttaatgaaattatttatttattctgttttctgtatttgtatagtgtcttttcatcaagagggacaaaaatcaccacagacacaaattaacctttccaatgtccctgtcagacaggaaaattatcgtgttactatatatgcatctatctctctatataatcattcagtttcacaaatattagggaagactaacaacaattgaagtaatttaaggaagacaatattttaaataaattctcaatttcaactcaggcaatagagcatgtaataaggcagatggattaatttcaaaatcaatattggccagtatattcaaccagcaaacagatgaagagaacattttaaaatactatgaagtcattagctgcaattaataattcatttcaaaagtttacagtttcaatttttaatagcaaacagtcagaattttaagtgcttctcaaatgtacctatcaagtaaagatattcttgttaaggtggtaggaaatacagatgggcttatattgggatattgtatgcctatgtcctttcatccatcctttcattcatccatctatccatcctttcatttacacattaatccagctattcacgcatttcctcattcaacaactctttagagtcaataattatagtaagaaaagtttagaagtacaagcaaaattcatttttgtttatgttgttaggaaaatcttccaaaaatgaactgaaacctaatgaatgagtagaattttaacaagggagttgggggaagacgggaacagaaagaattacatgtagaatgaaaagtgtggaccaaagaacaaaactaggaaagagtatgttcagaaaacaatgagtcaatataagtaagttgacataagtatttataattacttttaagtacttaaaagttatttaagaagatttgaagtagaaagtagaatagtaggaaatacagatgaaaaagtggtgaggatctagatttttgaaggctttgaatgccagaatagatcatatagaaattattttattgtcagtgagaagccagtaaaagttgttgaggaataaaataatcaaaggggtacttttggaagtctcctgtaggcaatgtgtagaatatagtttatgaagcattaactaaaaggagacttattcagtagataaaaacactgcgcatatatcgattacttgtattttaacacttctatagtcaggatgagggaaggaccaagcagataagagatggcttactaaaaaaagttaagtctatattctaagatctttacatatattaattcatttaatcttcacaacaaactataaggaagattattaatctcactttacaaacaaagaaactgtagcacagagaattcaaatccatgctgactcaaaatccaacactattttttaaaaagctgccactcgtccagtgccaacagtattactaatagtttgccaggacttctataacaaaacatcacagactgggtagcttaaacaacagaaatttattctctcacagttctggaagctgtaggcccaagatcagggtgtgagctgagtagatttcctctgagacccctctctttttgtcttgcagatggctgtcctcttgctgcttcttcacatgctcctctctctatgcaaggcacccctggtgtatcttcttataaggataccagtcatattgaatgagggtctcaccctgacagcctcattttaactaaataacttctttaaaggccttatctccaaatacggtcatattctgaggtaatggggattagggcttcaacatacgaatttcaggggagacataatttagtgtttaacaccaactatgtgtcagatgttttatgcatgttcttaattaaacctcaaataactatgcaagattcttgcatagttacttgcatatactgtgtgcatataacaaatgaggaaactgaggttctaaaatttttattgacttgcccaagttcacatagttattcaaaaagtggactgagacctaagcccaaatgtgtctaatctttctggtccaggtatccaacaatttcatctgtaagaatatatgttcatgatgacacaatgtgttaaagttaagtcaatccaccctttctccccaaagttgccaacaatcagcagaaactcatgttttaacaaaagcttcccacaaactacatgtctatgtgtggagacacagagcccacagaagccaagcttcatgagaccataacaatctgcacacatgaacacttctggtgaaatgacactgcccagccagcacctgaaaatacgccactgattaagcgaatgtcacctaatgagtgccagagttagatccaactctaaaacagatattgcttccaaagcagaaaagaatctagattgagttttcataaatttacagggaaagctcttacaacttcacattatttgctaaatggcaaaaaggagggtggaaattaaaattgttttctggtattaattaatagggaaatgaatgagatgccttcaccaaggggtttgtacaaaaacccttaaagagcctaagctgagaaccaagtacaataattaaaatatttataaaattttcttatattcatatagggtctgtgaaaaaatatacacagttgacccttaaacatgaaggttatgggctctgacctttgtgcagtcaaaaatccatttaaaacttgactcccccaaaacttaactagtgtaaactaaaaataaaatcctaaatccctccactaactgaatggacttacacttgtggccaaggggacccctgaaaaactttaaaactgagttcctgatcatgaccagatgggaggtcagacacacctcattataccccctcctgtctgtagtttagatgcaactgaccagcaataatgttaaaatacagactgtcagactgacaaaacaggctcttaaaaggcagacccttactggcaaggtgctttctgactttggagacatagcaccagaggaaccagtccagaaaaagggttttcattgtccagcccttcttgtacaaccaaaagactggcagttggtgttcatcttttcccttcaaagcagctttataaattaaagcagtcctaattagaaacttgatttatgcatttgtacaaaatattatagtagagtttgcctatccctttttgccttaaatcctggtgctcacttctttcccttactagtaaatattctttgtggattttttttccagaatagggcaggtttgtccgcattaaaaacctgtttaggtaagaatcctgtttcctcaatgattttcttaatggcatgtggaaactcatctgctgcctattggtcagaggctgcttttcctattatcttaacttttttttattttttatttttattttatttatttatttatttatttatttatttatttatttatttatttatttattttgagacagagtcttgctttgttgcccaggctggaatgcagaggcactatcttggctcactgcaacctctccctcctgggttcaagcaattctcctgcctcagcctctcaagtagctgggactacaggcgtgcaccaccacacctggctattttttgtatttttagtagagatagggtttcaccatgttagccaggctgttctcaaactcctgacctcaggcaatccacctgcctctgcctcccaaagtgctgggattacaggcgtgagccactgtgtcccacctatcttaacatttttaaagccaaacctctttctaaaattatcaaaccatcctttgctggcattaaattctccagctttagatgcttcttcttccttcttttttaacttatgtaatgactttactttttctcaaattatattagagtctttaggtatggctttcttatagcagtcctgcacctacataaaagctgcattttcaataagatagaaaaaagtattttgcaaaaagttcaaggtttttcatgcctgctggtatacctgaagtgacagcttcacaaattttcttttcttttttttttttaacaatcatccttacactgaattcatttatcttgcagtggctttgcaacgtcagctgcaaacctcaatatgtagtacctatcaaacaactcaacttttctttataatgtcatgacttttctctgcttcttgggagtacttccagcatcattagtggcactccatatggttcccatggtgttattcaagatttacaatattgtactatatatgaagaaaaatacacaagaaccttgaactttgagtgatcgctttttgctgacatgtgcaatttactggagagataaactgctcacatggagataatgagggttacactacctttattaagcagaaactcacaacacttgggctcaccacaatagcaacaagaagttattacagtagtacagcatgtactacagctaattttgtgcagttatgttttaatgctgcatctttacatttgtttacatttctctcaactgcaaatggcaccatgtatggtctataaatgtttgtgtgggtaagtttttatacattttagttttttataaaagatttctgtatattttatagtagtaaatgttaaaatagactagtatctacatatactttattcattcatgacatacctgacttcctcctaattttatcagtatttctagtttgtgtgagtttattcaagttatcacaaatctcaaataattttctaatacatttattttttaaaatgtgcatataagtggactcatgcagtgccacctgtgttgttgaagggtcaactgaactttaaatatagtggttttgactttataaaagtctatcctatttatataatcttttgggactccctttttccctcagtattacattgttaagattgatgcatatttttgtttgtagctgtagtttcaccaatttgaatactatgtaattttccattgcaagaacataacacaatccatttttctgtaaatggacatttagattatttccaggtttttattacactggacatgctatgactattcttgtctatgtttcaaactctacaaaatctgtaagaagtttctctagggtatatacctaggactagaaattgctggctcataggatatgcaaatgttcaattttacaagaccatgccaaactaacttgttaacttgttaaactcatagttccatcaacaatatataaaatcctgctattctacatctccttctttggtattgccagtgtttttattttattcccatctagaagactataaagtggcattcatcttagtcttaatttgcttttgcctgattataaaagaagttgaacttatctttatatatttattggctacttatgtttcctcatctgtgaaaagcctgattatttttcctttggtttacttgacatttattgatgttgttcattatatatgctcattatatgatcattatatattgatgttgactttatatatgttgttcattatatatttgttaaagaaatcttatgttgattactcttactgtagacatctaattgtttgtaacttggtttttcactttcttaaaataacttgataaacaaaagctcttatgttttaaagtcaaatatatcaccttttccttatggttagctctttttatatttaaaaaaaatcattctctacctccaatgttagagtaatactcaaatatattttatattaagattttaaaggcttgtttctgatatttaagtcttttatccatctggaattgatctttgtgtttgatggaagctgaggatccacctttatttttctgtatgtgtggtcagtttattgaatagctcttcccttctccattcgtctgtcataacaccacttttatatatcaacatttcacacacataagtttgttttttaagttacctttcattcttggtcaatttatcaataccaaccagtagcatggtgtcttattactataatgtgtcttattacgatgtcttaattactataactttataataattcttaatgcctagtggtaagccatacctctttactctttttcctatcttagttattcttaatatctatacttccataaaaatcttaaacaaggttatcaagtttcaaaagaaacctgttaaattttttattaatgtcattttaaataaagatacatttggagagaaatttgacattttcatattaaatatctctatgaacatgattttatttatttagatattattaatgctttttaataaagttttatacctttgtatacattcttgcacagttttggtagatttattactagatacttgattttttgatgctataataaatggtaccttttaaaattatgttttccagttatttgttagtaatgtttagacatgaagttgatttttctttgatgattttatatccagcttcctgttaaactctattatttctattaatttgtttatagggtatgggagggattaatagtagacagtcatatcatctaccaaaaatgttgcttttatttcttattttccaatcctttgacttttaatttcttttttcttgttttacaacattggctagggcttcccatatattgccaaacagaacttgagattgttatcatttctgtctcaattctgaattttaattttaaaataatgcttctaacatttctctgtttacattaatggggtatgtgtgtaagtaaaatggacttcatcagattaaggacatttctttctatgctttaggatgatttggctggatataaaattcaaagttctgttctaacacaaagaatcagattgttaaatcagagtcacatgactaagatattatccagtatcaagctttgctaataatttctaccatggcagcaatcaagtggcacaagtgaattagagagagatctgggacatcccacatatgtctataaattctttctccttgcattagatatgctatgtggccagattaatagaagtctgtaattaaggtttgtgagttcccccacataggtttgggttacaaaacatctctgttttatatcctagatagttttgcaactgatacaacatttccaagaagccatgtctcataaatccataaattataggtttgtttaccataagcaatcctaactcaaacacatcctgaaaagaggattccatatatagtgaatctccttctagcaaatatcatttatatgtctgtcaggtcatttatatggatattcaactaggccacctgcctctgtcccaaagagtatgccagccacccatacctcactatctttaataggagaataaatggattataggccagtgctttaaattcttcatcctcaattcaaagcctttttccttcaaaacttgaaagtgttaaaccatcgtcttcttgcatccagtgttactattgacaaatctgctatcattttggttttttttcctctgaatgtgatctcgtttttcctctttggaactttttataaacgttttattgttttctatatgtttaatgttttctattatgtatcttggtgtgggtctttatcattccagtctagtattttgtacccattactcttagattagctatctttcttaattcttacttctgtggaatttacctttgttactttctcaaaaatcacttctatagttttaattttctcttttctggaactcctgttactcaggtgttggtacctcaatttctattctctatctcttttctgcttcctcctggaggaatttctctttgctttcaacaacctaatccatttttttcagctgcattcattctattattcatcccatctgttatgttctttatttaaaatattatatttattataccaaataattggctttttatacttattttattttcttataattctaatatcttactttattctatctgttgagttttgatgcttgtcagaaaaccttgtctttctaacacctgtgatctacatggtacctgtaatctatatttgttcccttttttccttttaagtgtttatgctcctcagtcacattatcttgatctatgagtttatattcctgctgtgggtatctaagcacttcccaagactactcaagccccacaccaaggatgtgggtaccagaagtctgaagtatagctgccaattaccatggtaacgatccaggcatttggtgtcctaaggcaaaagcagaggagaatcaaaagtagaattcaaactgttttttcttttaattttaccgctcatagcctaatggaccaatccctgacctaggctgcagccatccccctaccaccaacagttgaaacagctttctgtatacccacaggttacttataatttttttattcccacttagatttccacccagagttgactttgagagaggagactagaagcttatgctaattttgcatttcattaggagcaggattcaaaaatgcaattgcttatttacttgtcttatgttttccactgtgactagacattgagcttttcgaattcagagattctatttcattcaattttacatcccagacccatatagcatctggcatgtagctgacatttaataaataattctaagttgaatgaataaattcccgacttaaagttggaaatatttcaccaaaaagtttttgctatgactacaagttaccattagtctttttcatggcaccctatagcttatttaccagctgtgttaccttgggaaagtcacttaagctttctagttttcagtttcctgtctaaagggttcaaagcagcagttggccttaccaatgcatgagaccagttttattgcaaagtcaaagagaaaagagtcatatgccaaaaacaaataaagagcatattaaaggaaataagatgtagaagacagaagcagaccctggagaagccaggagttctaactctagttctgccacaaaccacccgcccaaccttgaataactcactaaatatctctaaatattatccttaattctaaaatgagacaattgagagacagaatgacatggaagacaaactggagtaaaatctcagatctcccactttcttcatttggtacttggtcaatttcctaaccattttagtctaagcgtctttatatgaaaataaagttattatcatctccttagagttgctatgaagtttcaatgaaaaaaatataaataaagtgctttgcacagcatcagttacatattgagtgttcccaaaatgttagtttcctgtctctccacattttctcaagtgtcatccagctttacatagttatgaatctagatgatttattaaaaactggatctacttctctaatccaatatagatgcctaccaaagtttctactgcattatttctcctgagagctaaacttttcttttagatgtcaacttttagttataaattatttagaagtttagtaggtgtgttttaatgcttctgggtgttaaatattcagtcatcattggctagtggtgaaagtttatgcgaggaaaggaaaagctaagtgatgtgcatatatcatttatactttaacaacagcacctgctccagtcaaatagtcatccaccaatgatatacgagggaagtgtttatgcattggggcaacaatatggaaatcaacatctgtggttaaaaaaattgtatgtgtcactgcttatagctgtgaaatgaatgggcaaccataatgggatggtgtaatgaatttgtgacaaggaccagaggaaggaaatgatcatcttaatcagattgctattgatgcctttttttgtgacagcaaaaaataaatatctattaattacactaaaatgaaaagtgtttggatacagcactaaggaaatagatagttccagttaaattgttatatatgtcaatgatcagagataaaatgagtaagtgccaggaagtctctgctgaactatttatgtaacagcactatcaaataagtgagatggttcaatgatttctgtgaaattatacaatacagttgtattgctttagaataattagaactcttgcaggtgattcagatattgatcatgggacaatttctcatttatcacaagaaactttagtaaaaggtacacctcaggattcactccattcatttctgctgtttatcctaaaaactgggcaacatggaatcatagaccagtgtgggagcttagagttaggtggaattatgcttgaaaaatttacttctgctcattagtcaaaaaggtaaattaataaattcattcattcattcattgtgaaatttcagaacactatattaaagacaatattgaagactccaggaatgaaaataggacatcaagaaggaaataaaactagattcaggccttattaatccttattaataatttggccatttatattcaactgtaaatgttacatcttctgttgtatatctaataggaatttcaagttcagtctataaaaactttaatgctatatcttccccacctccaaacttgctctgcttacagcctccttcactttaaccaatgtccactcattctttctgttactcacaatggaaaccttgaagacattcttgatttctctctttcttttacatgccatagccaaggtattaggaaatattttgactttaccttcagaatatattgagaatcctaacacttctcaccacttccatcactaccaccctggtctgacccacaccatttccaaccattatacaatggcttttggcctactctgttgcttttactattggctcctgtgaagtattatccacatagcagccaaagtaattctttgaaatcatgataaaagatgtcaattttctgctcaacttcttgtaatgaatttacccatttcactcaaaataaaggtcagagtcattaaaatgaccaacaaaaacccagatgatctggccctccattccctctctggctttacctgctacactatacttaatacactccttctcatctactctactccagcctcaatgtcctccctgcttttcctaaaatgcataaggcacattttgttggacttttagattagttgttctctctgcttgagattctgtttctgtaaaaatccacataggtaattccttcacctcttttaagattttgctcaattgtcatattctctgtgattcttattctatcattttttaaattgcaactcactcccactccaatcctgatcacccttaactccatagcatttatcttctaacacatttatattatttatttaattattacttttattgtctatagcaccatgatcctaccttatgaggatgtgaattataaaattcaggtatctttattgattttgctcatggttgtatttcaaatgcctataaaagtatcaagaaatattgaagaactcaaaaaataagtatcaagtaagtaacaaagctctaaataagtgcccaaaaaataaacaacaaaatgaatatagaattcaaggtttattcacaaagaaacatgcatcagactagctgactagccccaatgaatgttagaaaacaggtcagtaaggtcattcatttctgaggaaatatgaaccttgaattccatatcaaaactatttgtctatcaacaaaaactgaagtaaaataaagccccatatgcttaatgtgaattcccaaaatgttaacattgtactgtgtttattactgtctctcacatgctccctctccacgtccctccccctcaccccctccctccagccacacacacaagtaaatatataaataatccaactactagataaaataaggaatacatggagctttaagtatgatgaagattaattctcagtaactaaaatctacatgtcttcatgagaatagttgttagtatttattagtagtcatataattgcataacaactgcataattatcctgtagttgtataattgtagtcatataattatacacttatatttgtgtagttgtataataacatgaacataagtctatatccaatctgaagatagaagtaatgcaagataacgatcactaacatagttatccaatcagtattacatagtaactaggcctttagtataatttaagagcattgctgtttttgctggggaacccactagaatagcattccagaacctcttctgaacatatacaagctggaatggcattttcagcttcatctttaacatgtgtcagtcactaaatgagcaaagcacacattatatgttgataaaatttaatgttcaaatcctctgttttcttctatctccatttataataggagtattacgttgatcatacaattttcttaaataattgtgtgcaagtgtattccacttatctgggatacaatataagcgtagcctttttgctatcagtaacatcagaaaactattagaaggggagatagtaaagaaaaataaataaagttatttgtattttttataatactatgtggttaaatggtaactctactgctgctgcatttgcctacctccccctgggcatggggtcagtggacttagcaggtaaactcaaagcgggattcattcatagaccataggaatatactttaggtctttattcaattgtcatcttctcagtgagtccttcctggccattctatccaaaattacaagtcctaaaccctgatacttcctgtggccccttcttccctcattttttccttagtattcatcactatgtgtttcatttattcaattttcttgttattagtaattgaataaaaaaaattattcaattttcttgttgctagtctacaggcaacagaggagctttccaaattttccaggggaatgaaatatttccctacccatacccagaggacttattcaagagacaagggatagctcaggaatcttttctgtctcttgaaaagtctgattttctgacttcaacaaagagactgaaggcttagcttgctatcctgagcatgagcattaatatatagactagctcatcattttcctaaatcacaggagtatatattatattagatacttctgttgatccttctatttcaatgtctcagcaactcagagccacattttacaatcattgctttggtccccttccaaattcaattatcttgacaacattcatcattctctgcaacttgccaccctgaagaaacttaagaccttatttatatcagctctctgatctcagatgaaaaccactatattattgccaatgtactccctgtcattccatcctagaaatgtagactggttgcatactcattatctattatatctgtgtagcacattttgctttcaaagtactttctcactgtctcactgaaccacgtgagatagctaagacaaatgctactacgccatttcacaaacaaacgaactgaggcctggtcttctcaatttgttaccaaggtaaaggcataacctctgttagtgttttcactgcttcatcatttggttctgatgtcagcatatttatacctttttgttgtggtcacccttgtaaaaagcattgagatcattattattttaaagttgcaatatgcttacattcttgacttcttcggtaaatagttctcaaatgacagattttttttttaattaaagattttttttaccttttaaaaatttagaagattcaaagatttgcttcaaagtcaaaacaaaacttctgacctttctacctggccagccatgtctcatgaatatgaattagaatcacagcttcagagtgtagaagttggagtctgaggtggttgtgttagggaggctggaggtgccagtagggatgagaagaaagaaacaaaaattcctagtgaaaatattcagtggagataagtcttccactaaaaacaggcaatctccagcaaggttactaaggtcaaatagggaaagaaataaggaagtgctaacaagtgaaaatatcagaaagtcaaccatagaataattaccaaattcaagaatatgcagctgcagcatcattttgcacaatatttatggcctcatgaagggcttaagtatagggtctggtaaccaaagtcaaggagtgacagattcagacttgggaatcttttgactaggggacaaattctaggactaatttttaggggcacaggtttgccaatgacagtagaggatatttcaaaattctaaatcaactcaatgaaatataatcatttgatggggagagcaatttacatctaaggattttttttaaagagtgtagccactataagtattaaaaaatctttttcttcactacatgttgaaaataaactatgctttatgaatattgtaggtttgacaaatcctgttggggattattattttcattactttatttctagatgttttatcatgctcatttgggatcatgtgtaactttttcagatatatcataggtaatgtaaatttgccattagattggaaactaatgatatttacatattaatcaactactactttaatgctgagaaacagttacctacgatagcagatgcaattcaagaaacagtgtgtatgatcatcattttagcctactataatgttataattttagcctatatatatctgtatgtatttatatgtgtatatatcatgtgtgcatatatatattaaatacatatataaatataaaataactgtcttataagatgaatgccctccttgtaggcttaaaatctaattgttctatgagaattgtatgttgacctatataacaaagtaggctctttctgagttgagagtgctgagaacaagtatcaaactgaaatgaagaaagaggcagggatcagaggcctgaaaaaatgcagtgacactaccaaaagcagaatcaatgatggagacaaaggtcacttatctgtcaaatatccaaagacaccatgtttatatcacaatgagaatgcaagctggagtccaggaacaaatccaaaatcaaatctggagatagtgggccaggaatcagagcaaggaactagattacctttgcagtagtccagatgaatttgcatatttccttgtagtgggacttcattcctgaagcaactaagaacctcttttatttcgggaagaatgctagacagcatggagaatttatgtcgacatttgtttaaaagaaaataaaaagaagaagaaagaaaggaacattgtccttactctaaaagacctcaaactctggtgtaaggcagagatttcatgctaacaaataaattacaatgaaatgttaaatggctaaacagaaatttttacaggggcccagcccaaaggagggagtgattgtgtccacatgggtgaagaggaataagaaaactaccatacagcaaggagtatggttcagcatacgtttgacggttttaaaggcacaaaattctaaagtcaagtatcataaatgcgtttctttttaaagtccctatcactctacatacccagataactaaggtgtaccaaataattaactatatatcagttttatttacccctttgtcaaacatttactgtctatttgctatgtcacccactgctctaggttaatgtacaattaatacaacatatatgcttattcttttagcatattatcatagtagtatgcctgcctcaaaatttgcagttcataaatccactgttttttaataaaagaagttaatccttttaaaagttattcatgtacttgtcttgggataacacagtataaatttactacccaattttttagtgggaaaggctctcatgtttttcttgcaagaagattattattcacctaatattttcctcataattgtatgtagcttctgctacattcacatttctctttgaggttcttgaagatacaaagatgaacagatcatggagcatataatttagtaaaaaagaaacataaactgctaactataattcaatgtgagaagagcaataatcaaaggcacaaatagtgaacctaatgaactttaagtttcagaagctctcccttagacaagctctctccaagccctataaggagccctaaaatgtcttcaaatggtcatattttttgtaagatttgaaaaaaatatatattttaactacaaatgtttaagattattgtgtatttttattctgacttctcctccattatattttccttgtacagggtgtcattggagtggtcaaagacattttggagacctagcaaagggtgagttgggaatacatttagtttaatcttagtaggatttatttacgaaatccatagctacttctatcaacagtaaggttgttagcattctcagtataaaaattgtttccaggtacactcccatcacccactgtgggaaagccagggatggccttatgacatgaacatgtgctatgatgcctggagcaggaagtgtgtggaaagtgcagaaaaaataaggtctcactatggaattaaaagctagtctgtggaatattcttccaatcttcaaacatgtaatattgtaagcagaatattgttttcattaacatctagtcaaaatggaaactctcatctgtgggaattatacttaataatgtagcacatcgttatatatatcccatatatttttctttttatgggaatcaaatgaaaataaactctatcagatttgctgtgttagtatagcacagatctgtcacaattacaataaactgtaagtatgtctctaataatgcatacgtgaaaaacttgatacagatttttttcaaatttgatcatcttaaaacaccctaaaatttcactgatatcaaataataaataacaattggtgaggcttaaagaagctttttaaaactatgaataataaaaaataaattttgatccactatgccagaggaaagatctaattatccttctgttctctctatagaaaatattacaaatttttggactgattaagaggccattaataagtatacagccagaaaatcgaggaaaatactacaaaaatatattaggccataattagttacaatatcatacaatattttatgattttgtgatatttgcagtaactttttactttttaaaatgtgtaacttattaaatttatttttgaactctaaataaatattcactttttaacctaattttgtattggtaattttatattctttacattaaaaagacaattataaaacctggatctgctataatagttatttcttttgtccacctgtgcgcttatataagataacaaaatagcaagagcaaaaagcccattaatgaaggagtttcctcaggccaaggcaaaggaaaacatgccaaagagaggcaatgaataaaaggcataaactgaaatatgagcttataattaagctggggaaaggaacccaactgtgcatctaacccaaggaaacattcacaactggatagagtaactaaagttttgcactctgtgatatcagagtagggaccactgaatcaacggcgtaagatagaaagggatcttttgtgaatgcacagagcagattttatggcccatcattacatcatgtaagagagggacagatttgttttaatagttaggaatggttgggaggccaaggcaggcggatcacgaggtcaggagatcaagaccatcctggctaacacagtgaaactgtctctactaaaaatacaaacaattagccaagcatggtggcacacacctgtagtcccagatacttgggaggctgaagcaggagaatcgcttgaacccaggaggtggaggttgcagtgagccaagatcacgccactgcactccaacctgggcaacagagcgagactctgtctcaaaaaaataaaaaataaaaaaagttaggaatggacaatatcatggtgatatatgttcttataagtgaatttgcacaagtgaagtcagtgtttaatacttacctaataaatataaacattgtaaatatctacatattttatgtatttatatatacagaattgtagggaattgaaagcatgaggaaaggctgtggggaaaggaaaaaaatacactggcaaaaagagcaaaacatatgtattttaaaggtataagcaagtaccaagaagggtttgaataacttggatatctactgaatctatccttctagcaattaaaactaattaaaccagtgtttctaaaagtaagactgctggacctaatctcaggagtctattaagttctcaaattttttaaaaaattctaaacctattgttaaaatccctgaaaaatagtctacaaattctcttatattacatatttattatcatatgctcataattacttcctatctctgaggatgtatttagtttctcttgttctgaatgaatttatatttgctctaatgcatagcatatacatgatttctacacattttctacacaaggatctgagacaagtgataccatctgcatagatgtggaagtaaaaattaaatggacaggttgacccaaaaattctactcccaggtatttatcctaaggaaaaatcacatacatagcaaaacaaaatttttatataaggcaagttatgatggtactactcataaagtgaaatactgaagcaggatatttccctgacccctttgtgggtggaaactggagtgaacaggtgctggaactggctggccactttagtgctgggaggggtgaactccactcactcgctgctccacccctcaccagagggagggtgaatagaagcaggtgcaggagccagggtgagtgcttttgggcaccgacaagagcgaactacataccagcccagcagcagtatctaggggagggtgcctgcgacccctgaagctccagaggaagggttacagtactcttttagctctgccatccatggacagcttaagtgttaacagctcagtggagggtcagtgtgacagcattttgcacccacactcatggcacccgagttcttgtctggtatccaggaggaatgagatcatacaaatgaactgaagatggtaaatgtgggagatttcattgccaatgaaagtggctctcagtgagaagggaaaaaaatgccaaaggggagctgaaaaggggacagagcaggaaggcaatcttcccctgaagtccagccatccaaggctggactcctctctgaatctacgccatcaatctgtccctctgaagtcaagccacttctctccaacatccagctgcttctcctctctgccagctgagccttgggtttttatgggcacaggatcgggggcaggacaggcattggatggttttggaaaaggcaacattcgggcaggaaaacagggatgtaaattctcactttgggccacagtgccaggctttttggcttgagggtggggccctcactggggacctgcccacttctgccaacaatttcactgcctcctgtccctatcaatactacaaataagttaaatttaaaaaaaggaaaattgtccagtaaactaaggtacatattaccataaacatcataattcattaaacatgtaggaaagaatagttctcaaaatggaagacatctacaatctattacaaagtttagaacaggttacaaaacagtatatagagaatataatgttgcaaacaaaaatatacacacttacctagaaaaatattggacagacttgtctgaagagcccagtcttacctttgtgtaatagcattattaacgatttgctttttcattctgtttttaatttaggtacatttatgttttctacaccttctatatttattaagcatgtatttatttctttgttattaagaaaaaattataaaagaaaaataggaaaaaaagtcatgaaatgatagttggatggttagaaaatatttaactctagatcttgactacatgatttcatgggaatcctggtatagtttataactgaggaaattcattcctctaaaaatcaattagcatttgtatttataagaattaggctgggcgtggtggctcacgcctgtaatcccagcactctgggaggctgaggcaggaggatcatgaggtcaggagatcaagaccatcctggctaacatggtgaaaccccgtctctactaaaaatacaaaaaaattaattaggcatggtggcaggcgtgtagtcccagctactcaggaggctgaggcagtagaatggcgtgaacccaggaggcggagcttatagtaagccaagatcacgccactgcactccagcctgggcaacagagcaagactccatctcaaaaaaaaaaaaaaaaattataattgtttatatgccatttggttgaagaatcaaataattttataaaattgaatcaaagtaaactaaaattatattaaataacaaactttttgctctataagtcatccactctaatcatttaacatctcaagcacatttcatacaactgtatttaaagttaaattgccaacatatcctttagagggcttataattaaaaggattcctatttaactccactgatatcacactactaataagcaacttaagtttatgaattttagcagtgttttaattttaccttgatatttaccacagttaaatcttatatacaaaggatattacatacacaaacatacgcatggatattcatatccacacattcataaatacacagataattatgtatataaactgcattttaaaatgccatatactcataataatgcttaaacatctaaattaatttcacctaaagttcaaatatttaattttcaaagaactcagtggaaaagtaaagagttattattcatttagaggcacttcaattctgccacccaattatttggttacatctttcactattctatgcccctgataaggcaatctaaattaacagaatcttaagtacatctgaagagtaatatcaaatacttggaatgcagacatatctcttatgcttctatatttgaaaatgacttctaattattatatgtttggtctttgcattggaagacaaatttaaaattatattagctcactgctggaagaaggaaggaaagcagacagaaataaagaattacaaaaagagtgagaataaaataaagaaaaaatgagcaagactgagtgggaaaagaagaaaagaatatattgcaaataaccatgtaatctggaaatctaaccaagatgtcctgtaatcgctgttaataataattcagagttaggggcaagaaacttcaggaaaattttcatatcttcagctaaaagatattagataatgatatggacaggagacaagaaaacactgggtagaagagggcagttctgtggcaaaggcccaacctccaggcctggaaacctgtggccctaaatgggaacaagcaaacctgtttttgtgtccagatgttgccttttggccagccacgccccctatcctgtacccatataaaccccaaaccccaggttccatgagcagaaaagcagatgaacagaagagcagaagaccagaagagaaggagtgaagagaaggagaatctgaacatcaaaaggagttcggctagggatgatcggagaggagatcagccactggatgaccaaactccaggcgaagatcatcttccgactccatctgctttccagctccccatccatgccactgacagccacctccaccactcagtaaaaccttcgcattcatccttcaagtccatgtattacctgattcttccttgatgatggataaggacccaggtagcaagagggcactgagctggttaacacttaagccacctgcagatggcaaagctaaaaaagcacactgtaacacatacccacttgggctccaggagtcgcaggcacccacccctagacactaccatggggccggagcccaaaatgctcaccctagctcctgcacccgcccatctgcatgctcctcctcctgtaagggggtttgagctcacatggcggccaaacagaggagccacgcccctgtcgatgtcgtgtgagggggggtcagggaactctcccatttcaattagaaagatgctttatatactttggccattaaaaaaaagtctttacaaaaaagtctagtgtatcattgttatcaatactttcgatactattatttgcaacagctcaagagataattaatcagaaaatattgtattcagaaaagccacctaatatagaatgttgtataattatctgaatgcttatagcaagctaactcaaaagtcttcaggtaattaaatagatttttaaaatgcatgacaatgaattactcaggctgaaaaaatggaaagtgtacatgtgagctaaatgtagaaaatgaaagaaagaaaaagacagagaagaacatcatcttagctagataaagattgatgcatgctgtatagacagggaatgaataatttcatgatatctagtgatacaaaaagtgggccacctagacacatttacttagttatggaaaggcaaaaaatcattacagctgtgaaagtaggcttaaggcaaaatcacattccatttattggcatgcaaatatacacatcaaacctctgaggggtaatatttctttgtcaaatgaaatctgttcagaatgctgtggaatgagttgaacttagaagtacctttttctatacaaaagtgtatgagaaagaaaacataatctagctatttataagaagcaaaataccagacatttgagagtcaatgttgaatttttacacgtagtggatttctgaaactagataaacacatgcaggtatgtctgtgaaaaatgttatttacaattcatcagactttgccattgacaacaaagtgattagaatttttaataacaatgcagtaaaactttttgataaaggtaaagatgaggtggatgaagaagcctgctattttgagcttgccagtccaagaaatgatcactgaaatatgtaggcaatattcacctaaatctatttgtacaataagattgtaaatgaactgatgttatcctatgtaatacaatgaatctttcaaagctttggttgaatttaccttcccaggaaacaacttctccataagaatgaaacaacaaaaaagagaatttaagtttataaactgcattcatatataatatcatttcatcctttgaagagttttacaaatgagaaaatataaggtttgagaggttatgaaatttaccaaaggccataagataatatattatgaagtcagtatccaaatgagtttcaagtagctggaacctggctctatagaagaagagctcttatatacacttttactctaaggactcaggaactgatactgtggttgtcttacagaccatttaaggtcacattagctaaggggcttcctcttccttttaagcaatgtgcctcaagtcaactaccaaatttagagtaatatgtaatttgtggccttatattactttcttccataggaaatgcattttttgaaaatacccaaaacttttcctgctgtagaaatatcaaatatgattattttgactggcttattcaatatagtcctctccactatttcttatccctctaaaactggaattgaaaagaataatcttgtggtattttctattatatgtgtaatatttaagtgataaaaatgaataaatcaagaaaggattgaaatactatcttaaatagatttttaggaaaatattcaactcaaagtatttagtattctgcttaaagaacaaaattcaagcaactgaaatatgaatttactacctgggatatgtgactttcctatgagaatacaaacccttaaggatcttggtttagcataatgcatttcaatacacctttactgaattgacttttatgctaagtgagcatttagtatatatttttaatgtttgtaagcatataccaggtaacttctaaaaaaggttctctaagagaaaatagttaaaaggtcaatgtacccgtctcccaaaaactcttctacaatacgcagttatgttccattcaaaggtgtgattattatggaacccataataaagctgagttaacaataggacagaagctctttaggatcagaaagaatcagtgtaggagaggggaggctcaagctctgccctctcaaagctggatattggagatggaactaacacttattgagtacctgttttgttcaggcaaagtgttgtgttttatctacatttaatctcatttaatcttcatgactattttctgaaattattataatccttatttcacagattaaaaaactgagcttcatagagagtaaggaccatatatttcatctgcctcctttgaggttctgtcaccccttactttaagactaattcccttactgtgtaatatggtttggttgtatgtccccacccaaatctcatgttgacttgtaatcaccagtgttggaggtggggcctagtgagaggtcattggattatggggctggtttctcatggttcatcactgtccccctagtgctgtctcctgactgagctctcacaagatctgggtgtttgaaagtgtgtaacaccacccccttcgctctctcctctctcctgcttcatcatttgaagatgcatctgcttcccctttgccttccaccatgattgtaagtttcctgaggcctcccgagaagcagaagcctgtatatcctgcagaactgtgagccaattataccccttttctttataaattacccagtctcaggcagttctttatagcaatgcaataacaaactaatatactgtgttgccttactttaagactaattccaccatgtcagccatggacaatccagctgaccctcccaagtaaccttccttggtttccctagatcttaatgtagatttcatattacacttctgcttgttttggggtgctatgaaggcctcagctacttaggtcccagctcttctgcttgcttgaatctggcccatcccatcacctggactcctataaagcttcccatctgaacctgtctctccataaattctgtcttacttctcattgacaatccaaatcccctggccagaaattgcaaattatttaatacatccacattagcctccacctcactatttttttcaggcatatttaaggcaattcagagctatggtgaagatgagtttattgatgtagaaattgtttggtattcacttatacatttcctgtacctaacacactatcttgtacaggtaggccatccaatatgttttttaaagtaataaatgaatgagtaaatgaagaaatatgttggtgagcattgggctaaggtacccagggcagattctctgttttttctgctgccattatctgagagcagaacacagaataaaaatttttggtttgagtcctggctctaccatcaacaatgtgacttttgttaagttattctgcctcaaattgcattatttgtaaaaagggggataaagataaaatccacctcatggagcattgtgaggattaaatgagagaattaatgtgatgcccttaataagcctggcacagtataagtactcaggcacaatatctctctattaccttacattctataattaggacaactgtcaatagagtgctacttcttgacttttaatagacattttttggatagatatacatgactataacataatgaaattgattgttaaacagttattccttccattgggcctatgtcaatcttcctttaacttcaacacttttgttctaaactttgaggatcttcttccacatgaaagctgaaagtttcaaggctccatggtcacttttggttgtacctccctaataccttaaactgtaaattccttcatatgtattcattcactaactcattcattcattaaataacacctattaaaatcctacaatgtgccaggtaggtactctgccagataaaaataaacagagataaataaaatacaatttttgccttcaaaacccatacttctatgcaggagatgggcttggttgtgtctctcttggccattctggtcactcgcttttgaatgccctcacttttgtctacattcctattaaagtttccaaaaaggagtacaacatgtgaccagtgctgagaagagcagaacaatcacttttttattacactgatctgcatgtgggaaagaaccagagatgggatgtagcaatctcttcatggtagacacagtcccaccccacctcacatgcaccatggtaggggtggggaactaggaggttaaaagctgttggaaacaaatggtagattctttttttttaatctaaagtctctcttgagatgttcccttttggaggatgtcatgggtgcatctggctggggcccagcgtagcaggtggtaaaagaatttactaaaacagtagtgagttaaagaaagcaagtttgtaagagagaaagtatgttgcaaggaaataacagacagcacagcagagaaggggctgtctgcaaaatggcaggggctggagggaagttttatagggtcatgctggaggggctacatgcagataatgttatgctgctggggctacatgctgagtgagatatttgggaacagaatgttgtgctagttgtttatttgtggttagccatctcttggaacaattgttttcccctacctgaggccccttcctcattgttgcttacttatgaggacaccacatcccccacccccaccacacctccccatagaacaacaatgacaagtctttggcattagggtggaggtctcaacttccaactacttcctgctggcctgcatcatagaattgaccctacctatggttgttgagagtctgtcagcagaccccgtgggccattgtcctggattgtgggaattaggatattggatcttgcgggaggaagggactcatcagagagggggaggatatcaaggtaaaactggggtatagcagaatccaggagagattcataaaggtagcaggcatcattgggaagagaccaatatccccttcacagcagcatttgaaggtgaaactgctgaattctggaagacatgaatttgacaagttgaagatgcaagggccaaaatgggatcataagtggcccctgacctagtgtgtgatgaggagaagggtccctgataaggaggcggcccttaaaagtgacatcaaggttgggctatcagggggaaggtgagggagaaggagtagatggagtaggtgtagttgaaagtgaaggtggtttgtcaggggaagaaagtatggcctcaacctgtccagccagttggggtgaatgggagagagaaaaaagttcatctaaaatgtcaggagagtcactgaggctagagaatttggcgaggcacatttgacaggtttggcagagatcgcaatcctgagagagagtcatgaaagcctgaatataaggaacttcagaccatttagaagagctgcaacagaagaggtcaagctacagaacagtgttggggacaagggtcccacctagaggccaggatttctgatccggaagttttttaagtggccatgtggcaggccaggtctgactaatgtaggcctccataacaactgtttcagcactgactgagtggttaaattaaatattaaaagctgatagagccagtgcccttatacaaaggctggaatgtaacaaaagcccaccaagagttttgcctaggcctttcctgggccttgaagcatgaaacataatgaaggaattcttaacaagacccgtttaggattaaacaagtttattggaggtctgaagaaaccacccgtacttccacaaacaagtttaatgggagtctgaaggaactcctcaaacctccatgatttagcaggagacaagataagggtaatcaccctagcacctggatccattcagattaagtaaatttactaaggctctagaagaaggtcttcaggactcagatcttagttatagatgagaaaaagttaaccacgtctatctttagatgaatgcacacttacacatagacatatagcttagaaggtacataagatctggaaaaactttgtaattttaagttggtctggtgatactttccaggccttctccctgtacctggttacagtaataaactcccttctttcccagttcatctgcatctcattatggagccacgagaataagcagcccaaccctcatttggtccgggaacagccatgctatgttacatgagaaaattagacatttctttttgagagtctgagagtcaaatttatcccagtgtttgagaatggagcccagggatgagtctgaggaatggaagggctttgtcccatggtgggaccaaaaagaatgtctgctggggacctgaaccataatttctctcagggcatccccccaggaaaagggggttccacttatgtctgctgagggactccaagatgcactttccaaagggcatcccatctattggaaaggaaatcctggcactagggccttacactggatgaatactgcatgagcaaccccaggtcagtccaggtatgaattatgcagggtgctcaatccaggtacaagaggaaaaggttcagggaagatttatcattccaatgctgtttgagatcacctggcttaaaaggtccagagcaggatggctggctggctctcttcatgggagaatttagagtgagagagggggtctgagttcccccaaaacgcatgtgagtttgcccaaaacgcatgtgggtttgccctggttgagctgccactgccaattgtgccacacatagggattgaggacttttgaccagaaaggataggagagagtcttcctcccttctgggcaagacagcaaaacctgttcaccccttgaccttcagcctacaccagggaatggccctggccagttgccatcagttgccagagggatactaaatattgtctgctggaagactggaaagaaaagtaaactctaaactctcaccctattgagtggcagtgttcagacgtctttcccctgtgaccttctgatcccctggggaatagccatggctgaggaccatcagttgtctccaggcttgaatgctgtccaatgagagattggagctggaaaacaggaaagggggatagtaggggagaggtccccatacgggtcaccaaaatgtcataggtgcatctggctgaagctgacatcataggtggtaacagttattgaaacaatagtgagttaaagaaagcaagtttattagagagaaagtatattccaaggaaacaacaggcatcacagcagagaaggggctgtctgcaaagaggcaggggctgaagggaagttttatagggtcgtgctggagtggcctgtgtagataaggtcgtgctgctagggttatgtgtagagcaaggtatttgggaacaggatgttgtgccaacaggtttgtggttagctgtctctcagacaattgttctcccccacctgctgcctcttccttgttgttgattgtttatcttattaggactccacagaggaatcacgttttggagtttcttttctcatgcatccagtagagtaagaaaagcctatatcctccacctttctgagaatatcctcttcctcccaccttggcccttagaaacaaagcagaaaccagggacaagactcaggggaaaagaggtacaaatggccagcttaagcctgatgttctaggccttttggtgaaatactttccttttctttggcattttcccccttaggtttatctaatcttccttcttctcaccatcaaaacagtaatatttaaagaactaagatggggtgaagtcctaatcaacaggacaggtgtttaggttgccagccatcattagatacatttttgattgaaaatggttaatactcagttttgctgtactgctagtcaacaaacccataataagggctattgatgagggccattgctatgaatggggtaccattttacctaaaaagaccaaaacaaagccaagataacagcaccgtatccacatggaacctcccaaccaccccaggagtgtagtcttctcagactacagggtactaagcatctttctctctcaaaatcagtatttgcccccaggggtttttcgcaagaaacatttctttcaggtctcatggatgtagcttcccaacagtcaacagttactgacattgaacttctgttctaatttgttcttaaaatcttccaaggagttcatactatctaaatccttagagattacgtaaggttcttattaatctgatcctgtctatgatccagtcttaccttctatcatcctccacttacattctagtcatgcagagctacttgtagctcctagtaaaaaccagacatgctctctttcaaatgtcatgtatttgcaaatgttactccttcagctataaactctccctactctatttgctcctattacattcctcaatatttttcttaagatgccttctctgagaagccctttctttcctatcatatggacaaatgcactatctatattatgacatcatattgtagtacagactgaatatctgcatgaccccactgaactaggagcttcttaaaaacagacactgtcatatacataacttccatttatttaacacacactatgtgtcaaacccaaaacaattagatgctttacatatatcagttccatcttcaaaacaatcataaaggcaaatttttttatatttatgtacaggctaagtgggacaagttcaaaaccacattgaagtaaataggggaaacagaattcctactttagccccatttggctccaaggcctatgctccttccatggcagcactctggcccccacgacatactgatagaggcaggaggcagagaaactctaggcagacaggggtgggtccctggtggaaaccccaccttcaagccaaatgtagcctgaaacctgcagcccaaagtgagaacttctattcctgtttgcctgctctcttgattggttctttctgattaatgtctttttaccaatcaaatgttgccttttccaaaactaccaatagcttgctgcacccaccatcctgtgcctataaagatcctagactcagccagtagagagaagtagctggacatcagagagaggcaacttgacttcggaggagagaggcagagagataacttgacttcagggaagagtgacctgccattcccattccctttccagctcccctgtctgctgaaagcttctctcattgctcaataaaattctccccattcaccatcctttgatttgaccacattacctcattctcttggataccagaaaagaattcaggacccaccaaatgtgggtacccaaaaaggctgtcacactggccctttgctctcactgactgagggcagccactccatgcaacgaggcaaagggccactgaggtgataacacactgctgtccatagacagtgtagctaagagatcattgtagcatgccctctgaagccttggagtcatgggccccccaacctggacactgccacaaggcctgcatggaatttgctcctgtaagggccaaagtgtctggcaagttcctgcactctcttgcctatgtgatccctcccatgtgcggtggatcatggtgggcctaagtaagtggagttcctcttgccagtgccaaagcagccagccattcccatacttgtgtgcttgtgtgctccctaccaaacaccgcatgttctcgctcataactgggagttgaacaatgagaacacatagacacagggaggggaacatcacacagtagggcctgttgggggatgggggactaggggagggatagcatcaggagaagtacctaatgtagatatcaggttgatgggtgtagcaaatcagcatggcacatgtatacctatataacaatcctgcatgttctgcacatgtatcccagaacttaaagtataatttaaaaaaaaagaaagaaagaaaagaaaaagaaaacatcctgcatcaatacaatgcagtttcactcatctttgtattctttaagtgtggcataaagtaggcttctgggcaatcaatgaaaatgtgttgaaagaatgaagaaataatttattaaatattttgtacgcccactttgctttcttttactcagaaccctcaattctgatgaagaaacatttgcttcacaaggagtcattttaccacagtcctcaaaaaatgttagaaaccaaaactttttagtgttgcaccacaagttatagagagtataaactttccattctgggtaataacagttttttcaggatatcctttggtagtagttacataattcaaactcagtggacttcctctatgctcccacaaaattttgcatccatctctactttaggattttgctatggactggatgcttgtatcccttcaaaattcatatgttgagattccaattcccaatgtgatgttatttaggcctttgaaaggtaattgggtcatgagggtagagtaatcatgaataggataagtacccttacaaaaagacatgagaggacttactttctcccgctctgttctctgctatgtgaaggtacaacaacacggctatctataaaccagaaacagggcttttaccaggaattcagacatgctggtaccctgatctcagactttcagcccctacaactgtgagaaataaatgtttgttgtttaacccacccagtctatggcattctgttttggcagcccgaactgacttagatacatttgctattaagctacatgggtgtacgcctgtctttcttctagaccatcacctccttgaggacagagatctgatctcacttatttctataccccccacaaaaaacaaaagagatcctgatacaaggtgctagttagtttatgtagaattgatgttgtcaaataatctgacacagtaacaccaaaaccaactcaaactagacaaacacctgtctatctgaaaccatgtggaatcagttatttaaaaaaaaaagaaaacaagttttccaggtagcttagactttaaccctttaaaagaaaatttttattttcattttatagggaagcctttctaaaatatacataattcttttttcttaaggaaatcatatttaaaataatttaagctactttgaacattatttctctactctataacaaaataattgtttcagacagtttaccccacacaacgatctcagacaactgtgatgacttttgtatgtgtgtgtgtgtgtgtgtgtgtacgtatgtgtgtgttcctgctttcctttgctatcaggctgtcagatttcatttctcaggatcatgaatatgtttgccaatggcaactgctccctgtatttaattactttcatttattgaaggttcactaacaaccaatgcactaagcactttatttgtattattttatttaacctgacaaatttcaaagagtgtagaatggactctgactcctcagagcttgttttctgcttttactgacacgttcttcatgcatgtgaaaggaaaatatcttgggccccttcaagctaggaactgctcagcgaaaatctacctaccattctatttaaagccatccctctgctcactgagatagatgcatatctgattgccttctttggaaaggctaatcagaaacttaaaagaatgcaaccattagtctctcacatatctgtgacctggaagtcccctccccactttgagtcttcctgccttttcttcacattgacctgcctttccagactgaaccaatggacttcttacatatattgattgatgtctcatgtctctctaaaatgtataaagctaagctgtgccctgaccaccttgggcacatgtcctcaggacttcttgaggctgtgtcacaggtgcatgtcctcaaccttggcaaaataaaatttctaaattaagcgagactcatctcaaattttcagggttcacatgggtaaagctctaggatgtaactaaacatggctaaattgttatccctttttcagaaaatcccattccaatgactttatgtcaggtagcacattacaaggataaatacttcactgtcgtcctattttcttaatgtttataataacacacaattagaatggctaatgcctctcaaaaagctctctgtgatgcctacaacagataaatacttggtaagaaaggttgggagaagaattagggaatgattggtggttttaaaatgatagaaaagaaagtatatttgccctgtggtttcaaaattacaactaacggatagaattttaaggaagtatatgctgctatttcatgtgtgagagaattttctaagtactagaatgtgtcataatagaaatagtaagctctatatctcaactctatacttttaaagtagcctaacattctaaccatatagctactagcttgctaaaatatcccaggaatgtgtgtgcttcaatctagttctcactcagatgttttccttttcaagcccacaatttctttattggaattattatttgcatcttgttactcagcctcctgattttcaacttctcccttgtagaatgcagattggatctacctcatctacttcctctgcttcagactgcctcagaaagcatgtctggcttggatcttggcccatcagaaaacatttggttggcctgctcaggtctttgcactgtgaagagattccaaattagattggattccagattagatcaaattaaatgctacataagacatcttcattacataagtccttgaactacttgaacaacaagatttctcagacttcttaggattccatgactccccaaggggcagaaaaattaagagtaaagattgtagagtcagagataactgagttggagttcttaatcttctactgcattataaaatatgctaaataatagtaccaatttcttaaggttcttgagagaataatgagactgtatatgtaagaagcttggcatactgttaatatacttagcaaatgttaactgttcacaatagtgttaatgttaggccagtagcaagcataatcgtaccaattccaaagccaagcccacacaaagagagaagaaaaagaattaaatgaaggtctgctcttgttctgttttgttttgtgattattgtccaggaacataatctatcattttgaaaagtatgtttcacttactggttgtgtaatgttgagaaattatttaaattttctgtatcttagattattcatatttaaaataatagtaataataatacccatcttatatgaatgttataagaattaaatgaataaatatatctagaacacttaatatatgtaaagcactgcttagaatataataagggccagataagtgttagctatcattaaaatgtgttagtacctgtattagtcagagttctccagagaaacagaaccagtagaatggatgagtgaatacatatatgaatacatattggtaccatttggctgtgtccccacccaaatctcatcttgaattgtaactcccataattcccacatgttgtggcagggacctaatgggaggtaattgaattatgggggcaagtctttcccatgctattctcatgatagtgaataagtctcatgagatctgatggttttatgaaggggagtttccctgcataagttgtcttctcttgtctgccgccatgtgagacatgccttctactttccaccatgattgtgatgcctccccagccacatggaactgtgagtccattaaacctctttcttttgtcaattgcccagtgtctggtacatctttatcagcagcatgaaaacaagctaatacagtaatttggtactgacagtggggtgctgctgaaaagatacctgaaaatgaggaagtgactttggaactgggtaacaggcagaggttggaacagtttggagggctcagaagaagagaggaaaatgtgggaaagtttggaactccctagagacttgttgaatgcatttgaccaaaatgctcaagatgatatgaacaacgaaatccaggctgaggtggtctcaaatggagataaggaacttgttgggaactggagtgaaggtgactcttgttatggtttagcaaagagactggcagcattttcctctgccctagaaatttgtggaactttgaacttaagacagatgatttagggcatctggcagaataaatttctaagcagcaaagcattcaagaggtgacttgggtcctattaaaggtatacagtattataagggaagcagagtatgaaagtttggaaaatttgcagcctgacaatccgatagaaagcaaaaccccattttctgaggagaaattcaagctggctgcagacatttgcataaataatgaggagctaaatgttaatcaccaagacaatggggaaaatgtctccagggtatgtcagagaccttggctcagaagccaaggaagaaaagatggttttgtgggccaggcccagggtccctctgctgtgtgcagtctagagtgtcctgtgtctcagctgctccagccatgactaacaggggccaaggtaaagcttaggtcatggcttcagagagtggaagccccaagccttggctgctttcatgtggcattgagcctatgggtacacagaagtcaagaattgaggtttggaaacctccgcctagatttcaaaggatgtgtggaaacatctgaatgcccaggcaaaagtttgctgcagcggtggggcactcatgcagaacctctgttagggcagtgcagaagggaaatgtggggtgggtgcccccacacagagtccccactggggtgctgtctagtggagctgtgagaagaatgccactgtcctccagaccccagaatggtagatccacccacagcttgcaccgtgcacccagaaaagccacagacactcaatgccagcacaggaaagcagccaggagggaggctaccttgcatagccagaggggctgagctgcccaaaaccatggggacccagctcttgcatagcatgacctagatgtgagacatgaagtcaaagaatatcaatctggagctttaagatttgactgcactgctggctttcagacttgcatggggccttcagcccctttctttgggccaatttctcccatttggaacaagtatttacccaatgcctgtacccctattgtatctaggaagcaactcacttgctttttattttacaggctcataggccaaagggacttgccttgtctcagatgaaactttggactgtgtacttttgagttaatgctgaaatgaggtaagactttgggagacttttgggaaggcatgattagttttgaaatgtgaagacatgaaatttgagaggggccaggtgtgaatgatatggttcggctatgttcccactcaaatctcatcttgaattgtagttcccataattcccatgtgttgtgggagggacctggtgagaggtaattgaatcatgggggcaggtctttcccatgctattctcatgatagtgaataggtctcacaagacttgatggttttataaaggggagtttccctgcacaagctctcttctcttgcctcccaccatgtatgatgtgccttctttctgccataattgtgaggcctcccaagccatgtggaactgtgagttcattaaacctctttcttttgtaagttgcccagtctcagatatgtctttatcagcagtatgaaaatagactaatacacatagattgattgattttaagaaattgactcttgcaattgtggagactgatatgtcttaaatctgtaggataggctagaagtctggaaactcaggcagaaatggtgtggcagccttgaggcagaattccttctccagaacagttttgctcttaaggccttcaactgattgtataggtccacccacattattaacagtctgctttacttagagctacaaaccactgctcaacgaaataaaagaggacacaaacaaatggaagaacattccatgctcatggataggaagaatcaatatcgtgaaaatggccatactgcccaaggttatttatagattcaatgccatccccatcaagctaccaatgactcttcacagaattggaaaaagctactctaaagttcatatggaaccaaaaaagagcccgcatcaccaagacaatactaagcaaaaagaacaaagttggaggcatcaagctacctgacttcaaactatgttacaaggctacagtaaccaaaacagcatggtactggtaccaaaacagagatatagaccaatgaaacagaacagagccctcagaaataacactacacatctacaaccatctgatctttgacaaacctgacaaaaacaagaaatggggaaaggattccctatttaataaatggtgctgggaaaactggctagccatatgtagaaagctgaaactggatcccttccttacacttaatacaaaaattaattcaagatggattaaagacttaaatattagacctaaaaccataaaaaccctagaagaaaacctaggcaataccactcaggacacaggcatgagcaaagacttcatgactaaaacaccaaaagcaatggcaacaaaagccaaaattgacaaatgggatctaattaaactaaagagcttctgcacagcaaaagaaactaccatcagagtgaacaggcaacctacagaatgggaagaaatttttacaatctacccatctgacaaagggctaatatccagaatctacaaagaacttaaaaaaatttacaagaaaaaatcaaacaaccccatcaaaaagtgggcaaatgatatgaaaagacacttctcaaaagaagacatctatgtagccaacagacacatgaaaaaatgctcatcatcactggccatcagagaaatgcaaaccaaaaccacaatgagataccatctcacaccagttagattgctgatcattaaaaagtcaggaaacaacagatgctggagaggatgtggagaaataggaacacttttacactgttggtgggactgtaaactagttcaaccattgtggaagtcagtgtggtgattcctccaggatctagaactagaaataccatttgacccaaccatcccattactgggtatatacccaaaggattataaatcatgctgctataaatacacatgcacaagtatgcttattgtggcactactcacaatatcaaagacttggaaccaacccaaatgtccatcaatgatagataggattaagaaaatgtggcacatatacaccatggaatactatgaagccataaaaaagaatgagttcatgttctttgtagggacatggatgaagctggaaaccatcattctcagcaaactatcacaagaacagaaaaccaaacaccacatgttctcactcataggtgggaattgaaccacgagaacacttggacacagggtggggaacatcacacactgcggctgtcgtggggtgggtggagaggggagggatagcattaagagatatacctaatgtaaatgatgagttaatgggtgcagcacaccaacatggcacatgtatacatatgtaacaaacctgcacgctgtgcacatgtaccctagaacttaaagtataattaaaaaaagtaagattaggtcgagcagtgcaaggaaactaaggtgggccattgttatcatagtattgcaaggcaatgataattcccaccagcaaataaactagtctcaacaacaataacaaaaaaagagtctcctttacttacagtcaactgaatgtagatgtcttacttatctaaaacatactttcacaacagtatccaacttagtgtttgaataaataactaggtactatagcatagccaagtttacaaataagactaaccattacagtaaagaagtatcataaaatatattttatattacacactgtagggtctcagaaaatgatatctccaaatgaagggttcacaagtgactctctctgaacttgtactctgctgtctctgaccattcattctaccccaagtctaccccaaatctcttccccaaggtgggtcataaaaacacaacccctttcctccaaagccagccataaaaccttaaaatattacttaaaataccactgtttgtaaataaattatctgtttgatcgtaagtcataagactcccattccagaaaggttcttgtaccatacccagaaaaaagaatgctgcacagagaggccaagaataatctaaacagacaggccttgctaggtttcccctctcagtttattagcattggatcataccctttctgtccagacatatttctacatggcagctcatactttgttgaacttaagcataaaaatggatagttttccctgtatcttcgggaagataccctatccttcattctaaaggctcctatatcacatgaaaattttatcaaataaatttgtatgccttttctcctgttaatatgctttttgtcaatgattttcagtgaaacttcagagggcaaaggggaagctttccctcagcccaacagaactatctttaagaaattagtttagccaatgactagaggtgctaattgctttgggttttttgactcacttactcttgtagactctacaagacaactcgggtttttctgctaatatgatatctggtattatattcatgaatttatttttcatcatgtggaagatgaccagaacagatttcaaaataaaacaactttctcttaaatgacaaaggattattcatatgctagaccttaatcttatattacttactttcaatgacagctgcatacttacaaatctgtcatatttactaaaataataatgaaattctaactgagaatactagtatatgtgaacatttcataaaatgtttaactaatagtgcactctctcatctcaaaaataatccagaactattatctgattcagttcttggacagtgctttgagttggataatcatatatctggattttcaggaatactctcaattttaaatattctgccctgtatagaaaaaaaaagtccatacttttatataatttgaaaactatgcttcctttagattagacagtaatataattcatttatttattcaatgaacatttactgggaagttaatatatgtaaggatctagcttagtcctgagaagatataaaccatatattcagggcacacaggtcctgactccacagtattgtaggggagttctatcatgcttacaataactataacacaatgtagaaaatacgaagctccccaagggaaaaaaaaaaatgcttactgattctaggtaaggacagtacactgttttaaggatcataacaagccattttgaagtctccacataaagctctccatggacggagtctaaggcaggtagatgtccttagacccactccagtgctatctaggcaacaatgtgtcaagcttgtatagtatggatattctgaaactttttctttactgttacattctgattatcaagttattggcagttctgcctcctgaacaaatcttactctctcaccataatattttcaaagttggattgacctccatataacacaggctcctttctctgcgggagaaaaaaactttaggaatgtggcacttcctctatcttttttgccaggatagtctgcctgttgaataagaaatgggattacagaatttcactattacaagaatgaatgtttaaaagaggtcaaattattaaaatgggcaagcaatcaacccaaatcaaatctgaaataggaaagatgatagtcattgcaacctaaccattctctccggtctccataatgactcagttttggagaaactctgacatctctaactctgatagtaacacaatctgcagggaagagtatggaactgtatgacatcattttagcccataattgtcccatgttgtgccataaaataagtaatttgaaggatagggtgagctgtaccgccatgactcattcctgtgtttttaaaactatcttcagaatcttacctaggactaagcatcttttcactgggtcaaccaggaaattttaattcatgtttctagcataatatacatatacttaacaaaacaacatatcattctctgacatcaagaaaaatacagtcaatcatctacttcataaacatttattgaatacttactgcctaaaaagctctgaaccatattacagctgtgtaaataaatataatacttgatattaaggtatgatctaacaagtgaaacacttgagcaagtcatttaaatgcaatatgtcaaacactataacagaggccttgggcagtacaggaaacagaagaatttttctagttaaggtcattagaaaattcgtgattgatagacaggtagacctttaaaaagattaagtagaaaatttccagatgaaaacaaagggaaaaatattccaggcagaggaatgaacaagaacaaggcttaagtaaagcttaatgtaagttcagtccagacagtaaagattatgctaaggagatggcacaataatctgtaaaaaatgaagatcaataaatagttttaaaactgttagcctagggaggtagagctacaagaggaaaatcctgactatgaagaccagttaaagcttgtttctaaatctgtagaaagattctatgaaagcctgaattagatcagtgccattgtgaatggagaggaaggtcaaacatagagatatttcaagaagttatgaataatagtgacattttacagttaaatatctttgcatcatccaagtaatatttctttgaggtctagtatttctggtaagtatgaatgtaatctaatttcattatatttgaaaaatattaggtagaaaaccaaagtactctcactattttagatcatattattggaaagttagctagagtactccaaagaaaaatcttactgtaaactattcacagataaatgctgagttaacttcagcctcagcaaagtaactaccagctctgtgagttactcacaggcttcctaggtgattaattttgcaagcaggatttttctttcttttacaagttagtttgagtgtattttctaaatttaatttgattttcttctttataaatcaagttactacccatgagaaatgatgctttgtcaagaaaaaatctatccatgatcttccaggagggtaatacatagtctccaggtacctagttgaacagtttctggtgtgacagctacctaattggtctccctgtcaccggtttctcttgtctatgatctactatgcatgatactgccagtttaatctgccccagcatagctgataatgccatttacttgcataaaaaccttctgtggctcacaacgacctgaagaaaagcatttaaatgctatagtattgcaattaaggctctcaagcagacagctagaataacctaatcagtcttactactctcagctccccacctactaatcctaaatgttcactatttataaaacctttcccactttctcctaagaaaggtgatgggatgtcagacacatgtttattaatccccactatagcacaatttactgtgtatctttgatgaagacatttaacttctctgaggcttactttcctcttctgcaaattataagtaatacctacctaccgcttcaaatcttatttaaaatgaagtgaggaatgaatcaataaaatatctaccatcatgggttgctatagagattaagagataatatattaaaagtgcctgggcagatcacctgaggttgggagtttgagaccagcctaaccaacatggtgaaacccgtctgtactaaaaatacaaaattagctgggcatggtagtgcatgcctgtaatctcagctactcaggaggctgaggcgggagaatcgcttgaacctgggaggtggagattgcggtgagccgagatggtttcattgcactccagcctgggcaacaaaagcaaaactctgcctcaaagaaaaaaaaaagagcctagcctggactttatttataagtatcaggttttattactcttctaagcctttactcacatagttttctccacctgcaagaccttcaacccagatcttatacattacacaaagcccatttctaaacccacccagctatgaaaccatctctagtactctagtaaaaatcatcctttctcggctatagtgtaaaggaaaaattcttgtcttgaaatcaaattcctgattctacccattttctaacagtatgaccctggacaagttgcttatcttcagcttccccatttctaatgtggatagcaacagcaactctacctgcctcactaagccattatgagaatcaagttagagaagttatatttttaactataaaatggcctatatatgtgagagactgttatttcctctaaagtataagatcaaataaaaaactttggttttcctcatctttataactgatatccaaaagatatgttatgaaagaacaccaagtccaataaagaagaaaatagttaatatccaggtcaagaactagaatattggaatcaagaagggatcaagtaaaaaggataggttaaagatagccgggcagagctgaagttatgaagaaaaaacatgttcctgagtttcactttacatagcaaccaatgtgtgcaaaggtaggtggcagcttaaagaagctacacaaagatgaatatacataccagatgctcaataagtgataaggagaggggagggaaggaaataggaagaagagaggaaaggaaaagaggagagagaaaggaaacagaagggaaaacagtttcatcattcctttcaagggctaatttctatgccacttgccaggctgctataataaaaagttaactggtagctaaagcttatgtatgaaaacactcacttctcctttaaggttccctttccttgactgtgccttttctctccactctacccctcttccaactcctatttatcagtgtttactttcctcccaccattacccaggacctccaaataccaacacaaatccatacgaagtaattactcttttccacccactatctcagaaaaacaaaccaaaacaaaaaataaacaagcaaacagcaaaaaaaaaaattgtttttatttaaatgtcaagagcctcataggtgcattcaagaacctattgagagcagtattgtgttaccctacaatagcatgcacagtttaacagggactaccttaactccctttgtcttctggagcctcaccaaaatatccatggaaggaattttaagtaacagtaataggtttaaatgagaagatatttgtgcattgtatagtaatgatggtgagattttcttatattcacataatgctttttgctttgcaaaatgctttcttattggttatttgatctgaattcccagggagaagtgacaaaacaaggggaaaagtcctatttatactatgcattttaatataatgcagttttacaaaattcctttttcaaagcatatatatatatccttttatttgattctccctgacatatagtttttatctccatttactgatgaagatagtgagtgagactcagagacgtaacaggactttccacaagatcattatcaatataagtgctctttatggaccatttcctaggtccaggaattgtactcagcactttacatgcctgatagcttatttattcttcacaataaccttatgaggtagacactattattactttgacattttacagattaaaaatcagataggttaaataatttgacaatggccatgtaactagcaactggcaaaagcaaaattcaaacagaagactttcagattactcttgattgttctgctataccaagcagcctccttcctggcccagtgctgttactgtaacactgttagtaatataaacttactttctttctgtcaccaagttagaattgcagatttcagcccagcagctcaagttctatggagaaaatacacacacatatacttaaagcagaagtgaggaggatgctgtgtccatttttttacaccaaaaaaacccataaatgaagcagaaaactcaccataattgggagctaaaaatcagttattatagtgttggcagacaggagaagggtgatatgcacctcagtatagaatattgtagaatagagagatgaattacttatagttcagcaaaacacctaagaaacaaacaaaaaaatcaaacctcggaatagatgcttcttttaaaatgtttttaaaaaggtcatttattttttattcctaaataaaaatttctatcatatttcaaaacaccaccaatccaacacagaatagccatattatgactctgctcctgtcatcttatgatatcaacaacatattacaggttaaaatgctatgggatgtgaaggatcagggtgctgatttacattttccagaaacttcatataaatcagagtttaaggtgagcagctagaattctatcacacatatgctgaggaagtaagaagacagatctctttccaccaggcactggagatgaaatttcaaaaaacggtaggtgaaacttgtatttaagatcttcccaagctgaatgcaaacaagtcgatgtcactttctttccagacaagaaaagtctaaaacctttacctccaggtcttttaaacttacatgctattaaaatcacatcaaagttttgcttcagaagcccatctgattttctttcaaggagaaaaggaatcattgggtggcacactgtagggactccatgagattcaaaataatgatcccattgttcttcctatcaaccttaatatatactaaatatatagctataataacgaagcctgtggaaactaataatgagttcaacagatccaggcaaaagtaaaatatttctaatttctaacaacaggatattctgtatgccttttgggaagctcagatcaactcattcatatgctcaaaactttccaacggtttctatttcgctcatagtaaaatctttccaatagcctctaaggctatcccttatctgtcctcctctttgagctcactgcagttaaaatggcttttataaaaaagacagggcaataacggatgctggtgaggatgtggagaatggggaacccttgtacactgttggcagaaatgcaaattagtacaaccactatagagaacggtatggaggttcctcaaaaaactaaacttagagctgccatatgattcagcaattccactgctgggtatatatctaaaataaagaaattcagtatattgaagaagtatctgtactccaatgtttattgcagcaccattcacaatagccaagatatggaatcaatcaaagtgtccatcaacagatgaatggataaagaaaatgtggtacatacacacaatgggaatttacttgactaaaaaaaaaataaataaataaactcctgtcatttgcaacaacatggatggaattgaaggacattatgttaagtgagataagccaggcacagaaagacaaatatcactcatatatggaagctaaaaaaaataaaatgtacacatgcagatggaaagttgaatgatgggtacaagggtctgtgaaggtaatgggcaggggagaataaagaagagatggataatgggtacaaaaatacagttagatagaaacagatctagtgctcagtagcacaatagggcagctatgattaataatatattgtatatttcaaaataacttaaaaagtggaattagaatgttcctaacacaaagaaatgataaatgcttgaggtaatggacatcccaattaccctgatttaaccatcacacattatatgtttgtatcaaaatattgcatgtaccccataaatatgtataactattatgtatccataataattaaaaataaaaattaagaaaaaacacacaaaatgcacaaattgctaacatcagttaccttgcatgcagggaggatagagctgatacagtataagcggaaagtgagtgaaaggggagtccacaaaaatagaaaaattgttttaagaacaactgtatttagaataaaaagtatatatttatcatttatgcttctatgcaatatatatgggactatgcatctagaaattgaataaaataatgtttttgaaagtttatgttctttcgtaatgacacatgcacccctgtatgttcattgcagcactattcacaatagcaaagacatggaattaacctaaatgtccatcagtggtagcctggataaagaaaatgtgatacatatataccatggaatactacacagccataaaaaggaacgagatcatgccctttgcaggaacatagatgaagctggaggtcatcatccttagccaactaacacaggaacaaaaaaacaaatactgcatgttctcacttataagtgggagccaatgatgagaatacatggtcacaaacaggggaacaacagacactggcacctactagagggtggagggtgggaagagggaaaggatcagaaaaaataactactggttacttagcacctgggtgatgaaatataatcttacaacaaacccctgtgacatgagtttacctatataacaaacatgcacatgtacccctgaatttaaaataaaagttaaaaattgattaattaattaattacttttttaaaaaaaagaaaattgaaaaatcaaaaatatcaaggcaatgaaagcctagaaaaaaatacaggagaatacttaactagtcctagaatgaagaaagataaagcaaagaagaaagaattttttaaaaagtaataattttatcacataaaaattaaaactattttgaaggttaaaaagtactataagcaaaattaataataataaacaaaccagaaaaaaaaacaattatgacaacaggatggcatgtttcataaataaactgctctttcaaagcaattaagaattctagtaccacttagaaaaatagacaaagagcttgaatggatcatgaaagaaaaatagacaaccaataatcatgtaaaaagttgaatcatgatagtgaacacgtaactgcaatataaagcattaagtaaaacatcttatctattaatttgacaacatattttaaataataaaataatgctactaaagatataggcagattggccttttgaaagatggctgatagcattgttctccaaaacagcttgacaatttgtatccagagacttaaaaatgtccatacccttgtactcaacagtttcatttataaaatcaatcctaatgaaacagttagaaaaaaaaaaaaaagcaatggcttatacacatgcacatccattacagcattattcaaagcaggaaattgaagatagcctagatttgaatgaagatctgcttaaataagttccaaatcatggaatattcatagccactaaaatattttccaaaaatgttcaatgttatgatatggataaatgctattagtgtaacattaaatgtaaaagacataaaatgccctatatgctattgtcccaacttcatgtacatatatttgtacaaaaaaggactaaaaaagtcaaaataattacttctaggtgctaaaattaggatgatgcttatttttatgcttttaagtataatttcacaaggttgatatctattatttatcaaattattgtcatgattaactttttttttttaagtgactagggtgataattaggctctgtccttcccagtttacaaatcagctctgagcaggacagaaaatatatgagaggcctcaatattaacaatacaaactcagcaatcaacatgctattgattggcactaggattccatgtagcttccaaaacatcgagttggctacatgactccaatcttgaaaaatagtgtgtgtgggtatgtactattacctcccttcaaagtattgactgccacttaaaagtatccattgacttgtccctgttagcccttaggtatgaacctgagacatgcctcaacttgccttagtctttggtaaatgttgatttttaacagtagtgtccaaactgtttgattccataattctatttgtaaaaacaagttgatcgtacaactctaattgctttatatttatttttaaaattagttactactaatatataagttacccaaatatagaaaattttaaagaatatgattaaaagaactggaaataggaattctaatattctgctcctacacttcaactgatcattttatattcttgccccaggatatgtgcccttcctatggaaatcagagtcttagaccacacttccctattctaccatccatctccttcccctacagcacaggtaaccatgttctgaaactccagaatgccttagacttgagtcaactcaaactatgacaattttgctaacataacccactcaaaaaatataaagaatcatatcattcccaccctattttatgttttggaaaaattgaattttcatatatgaaaattgcatacagtatggtataactacatttctattattgttgttgccatttgttgataataatcaccactactaccattacttctttagtggcctaagtcctagtattattcagttcttttggaagtttcagtagtatacctctgaagatttttgaagtctgtcatggcacggagcaagaagggatgtcttctcccatttctgtaaaacttgattggcttcttctatcttctgctcacaacttttttgagaatttagcaatgtcacctcataaaattcttggatatctgtaaagaaaatgtaaggaaagcatcaaaatgtaatgcatgacttcataaatagcttctgcatatatgtccatatatagacatacagaaattttgctgattaaaagaactgcataaatatatatcccaaagtaaaacagaagaaatcctgaaaattatctttttacctgcatttagaatgcttatagcagctttattcataattacaaaaactagaacaaatccttcaaaaagtgaataaactgtagtaaatccatataatagaatgttattcagtaataaggaatgagctatcaaacaaagcaaaaacatagatgaatcttaaatgcatattgctaagtgaaagaagtcagtctggaaaggatacatactgtatgattccacctatatagcatctggaaaaagtaaaactaaagagatagttttaaaaaatcaatgtttgccagaggttctgagaaagagaaggaggtttgactagataatgcagaggatgatgaaaatattctctaatgatactgtagtgttggacacataacatgaaccatttgtcaaaacccaaagaactcaatagcacaaaaagtaaaccttaacgtaggcaaattaaaaaaaaaatcatgtaggaagtcagaggatcccaagatgaaatgcagactgttacaaaggaatgtaactgtattacaaatgtataaaataacctccaagaagtcaacaggaaaaaaaaagtactgacttaagtaactttgaaaatgaacagagactataaaaccaaagtcaaggaaactatacaaaagcatcatactctagttggtaaacttgtgtcctgttgggtacagatgaacaattctgaaaacacaatacatgtatactaaaattgaacaattaagtgaatggatggtagatgatgggagccaagtttcttactgttctatagaaagttacaggcaagtaaggttaaaatgattcatatgatattagatgagagttggagacatgtttagcttaatgtagatacagatgaatacatataagaatatttacagacatgtatatacacaaatcagttatacacacatatatttccttgctccatctgctgagaaggcctagaagcaatgatgccatagtaataacaaacaaaactagcactctgattttggcctctgtgcagcattgctaaagagtaatgaacactgtcatattatattagcaatgagggtgtctatatgaactcaaagttttcaagagctacaggatagagagatagataaaaatatgtttagaaacagaaatgaatatgtatctggacatttcccagctttgtcatatataattcctggctctgtcttctgagaggacctagaagcagggacaccccagcagcaacaaacacacccagagcccagatcttggtttgtaatactattttccaataaaagaagctccttggagaaatggttgatcgtaggactggggcaggagacataagatgagcatggaacatcttatagccccagcaaataaagaaatagtcaccagagaaacaaccctgctacagtgggggaatatcaaagaaacacaagaaccacatgaaagagctgccaaagatggccaaagctggagcaatttgagcaaaaacaatattacctagtattggattataacacaaaatataaaataaagggatgagtaggagggattacaaaagggtaagaggaaacttctaagagtgatgtgtatgcttactatctttattgtgcttatagtgcatacatatgtccaaacctattaaattatgcattatatatgtagttcattatgtatcaattatgcataaaatatatatatgtatcaataaagaaagcaaaaagacaaggtacaaattgaaagaagataatttcacagcacacagacaaaggaacagtatccagatatgaaaagaaatacaaatcgcaaagaaaaagacaagcaaactaaaagaaaagaattggtaaaagttatgagcaggcatttcacagtaaaagaaatacatgtcacagataagcctaggaaagatcctcgacctcattggtgataaaaaatacaaactaagatcatagtcaaatgccatttacatcaaaaatattgtcaaaaataattaagtctcacagtacaaggactagaaaaagacatgaatccttggtaacttatttattcctagcaagtgcaaattgctatagccacttcagaaaataatttaacatttgtttatcctataagtcggtatttctactacccagtacatatcctagataaactttggcacatatgcatcaaaaacaaaccaaaatattcctaacagcatagattacagtagcaaacattagaaacattccaatgtccatcaaaagtgaaatagataaattgtgatatgttctcaagatggagtgtatggagcagtaaaaatgaatgaatgataatatcatgaaactatatatcttagaaaaataacgttgggtgaataaagcaagttgcaatatgaaaaaaattttgtaaagttgaaaaatgtacaaaactgaactatatatttttaagcatccatacatatacatgtaacaaaacaaatagacaaaagcaaaggacgacatgaaaagatgtagttacttcagtagacagggtgggcaaggaagtgggataaggaaagtacatatgagtagatacaagttaatggtaaggatctatttctagatgtcagtagcaatttcagaaatgtttgttttgttatgctgtgtatattatagataaattgcatatattattttgtatgaattaaatattatattttcataaataataaagaaaaattttgtgtttcataaatattaagatttacagagaaaagttagcaatccttaaattttatgtacagctacaactttattctccactagcaataaagtaactgtgaggtcatgtttgaaaaatgtgtaagaacagaaagtaaaatctgtacagatatacatctttcccagatttttttaataacatacgggctggtaggttactaattgggtggacaaaaatcagagaaataaggaataaaaaaaagataaaacccagaaaacaaaatatgtttgcatcatcttgcctcacgtattaatggagagaaaagaatttgggcatggtggtgtgtgcctgtggtcccagctactgaggaggttgaggcagaactgcttgaacccagaaggtcaaggctgcagtgagctgtgttcatgccactgcactccagtcctggtaacagaacaagactcactttcaaaaaaataaaaactaaaaataaagggaaaagaaaaaaaagaatttctgtaaacatatctgcagctacagtctcttaaaagaataacgacttgtaatgaataaaacaatttttgtagatagtaaaatttcaagagtctttttctctgtatcgttttataggatataaacagtttcatgagcagtatttgcaagtcaccaaaatttgaaatactacgtgtacaaattattcagaaaagaaagggtatttatcatactcacgctatgcatttatatcaataagctgtacttcgaaacataacaaacagtgatttgatcacatttagaaaaaccctagggacaatatttttaatattaaacttacaaatcttcattaatttatacccccaaatgtgaagaagtgttctaattctatttcactcttttgtctgcttattctccatgccttaagcaactactagagaggaagaaaataaccatgattaagtcaaagatgacttaaatttgatgataattcaatgatcaatgtcaaatttcacttttggttaacaagaattattttttaataattgacatatatccccttgtcactttccaagcatctctcttttgcaccctctttcctcaccaccagcaccatcattcccactgccagagttcaggccctcgccatctgttactcacactcttctctaggcccagatcccccttcccacacttagaaatcctccttctccttcaatgcccagttccagttcagtgtgtgtaaaaacaatatttgaagtcagagatctaaatatgaaatgtcatcatcaagaaattatttttactaaaactgggttcaattgagtaggtagtaagaacacccaagccactatcatcaaaaagaaaatatgtttggaaagttgtaggggattgtcttcttacagcttcaacaaacagatggtaaaatgtgttaaaacatacgcctatgcttcttccaacatgccttgttcccttacgacatacctgctttgaattcatctagacagtatagcacagttgatcttcctatatttaacgatgttgcaaattatattaggcttttctgaacacttggttctgcttagggagctagataaatgctcatatccacttcccttatcctgtatccaaatcccatactttctcttctgcaaagtaaaatgctgctgttttctcctgttccaaaaacatactgcttgaatctactcaaatagttatttctctttcagccttatagtagaaatagttgttcacccacctgttttcaacatttcaattcactaagtagtttttaagcgctatgcaaggcccttaggaatgaagacaatgttctatccagccatatattctctagtatctagcattatccttaaactcagcaagcacacaatgaattcttggtaattttcatttacttgtattccctctctttttaaggatctaacagaagaaaaatcattgaatgaagtcaaatcccttctcactcaggactgctaaaccctgcatattgtttagattacatttttatgtgacttgactccttgatttaatcacagcacctcaaattcttgaagacgtgtccattttgatgtcacaatttttaaagaatcatctataaattattgttaaatttacaggaaagtgtttacaaactctaatgtacacaaaaatttcctggggacatggggcctgaatttctgcacttctaataagctctcaggtgaggtacatggcttctgatccactagcaacattggacttaagaaatagcatctcagggataagaatttcatactctcaattcaaatagcccttttgagtcactgcaatcctcttgcagtgactcaaaagaaaagtggggttaaagaggggaatagggtgaaagatgcccataatagaaggaagatggcaagtgaagaactctgcctattgattcataaacaataagtacttagtatggatattattgactaaactgatttagattgaattcattagaacttagttgaaagaagctgtatgtccatcttctgcctttaggatccattaaaacaaaaaaattgacttctaggtgagagctgagagagcccctattcagtccaatctctctctcttttaacctacactccttgaaaatgagatctggtcttcataataatgattctgacacagttaggtcttcaattgtcaaacagcatgttgaaggaaattcataataaataggactggattttcaagcacatccttaaaaactcaacatatactcaaaatatttcatcttcttccaagaagaaacacctaacatgacatacctatttcaatgatgctactatttcctcaaaagacacttaaaactcctctttgagatataccttcaagcatttgatgagatttttaaggtccttggaaatggtaaatatttttctcttgaaaggaagtttggttttcttgaaatcaccaaaattcactaggcaaacttcaaatataagtaatggaaaaaaggattttttacatgacttaagaaaatacgattcttaaatcatgaggcttttttcttgtgtgactcatgagttgctctgcaattatctacttaaccacaataaaattaaaaagtaactagaatgcccaatgtgtaacatctttacatactttttaatctattatgggctagaataaaagtgactggggaatgtctttttgcacttcttcccatcccagccttcatgttaccaggcatagtattatgggaacaatagcagtcacctctgtactctgccaaccagaaacccctgtggaggttgttagtgttgattcatttggtttttggtgattggcatatatggccatagctcaccaaagctgtttaatcccaaaaatttaccaaaatcacctgaggattctcttctttttttttttttttttaagacagagtcttgctctgtcatccacgttggaatgcagcagtgcaatctcggctcactgcaatctccgcctccagggttcaagcgattatcctgactcagcctcccaagtagctggaattacaggtgcccaacaccatgcccagttaatttgtgtatctttagtagagatagggtttcaccacattgggcaggctggtttctaactcctgacctcaagtgatccacccgcctcagcctcccaaagtgctgggattacaggcataagccaccacgcctggccaggattctcttcttacagctgcaacaaagagacggtaagatgtgctttaagacatatgccttacgcttcctccaacataccttgttctcttaccacatacctgctttgaattcagctggacagtatagcacaggtgatcttactatatgtaatgatgttacaaaatgatattacagtcttgatgttccattaggcttttctgaacacttggttctgcttagggagtcagataaatgttcatatccaatttccttatcctgtatccatatcccatactttctcttctgcaaagtaaaaagttttcattctcccaatccatatgagtccaaaactactagacactgaagcatagaagtggaattttcaataaagcctttatcagtgtggtaaacgtcctatcttaggctttgtaccaagaaaagtttctttaagaatattacctggaactagaggaataaagttgaatgtgaggaagggactgaagttgaatgtagatgaaatgaaaatataaatttcacagcctagacccagtgaaagcaagtaccaagtaagggaataaaagagacaaaacaggaatgagtgcaaaacccggagtccaaggactaacgcaaaatggaactcaatagatgctgaacacataagaccagagaatgagtaaatgctcatacccaaagggtcatgcaaattccacattgttctgatatgattgggcttcttctgtgcctagacaaagcacaaccgaaggaaggaaggaaggaaggaaggaaggaagggagggagggagggagggagggagggagggagggagggagggaaggaaggagggaggaagggaagaaagggaggaggggagggaaggaaaagaaagagaagagaggagaaaggaaggagggagtgggggtggggcagagagattatgaaggaaatcttggtttcaaagtattttcctctattaaaaagaaccaaggctttttggagaaagggctcacaggatgagaacaaggaaattatgagtctagtacatctttttgtactagaaagtaaggaagtgctcaaaaatcacaggatcatatcaaaaggacatgtaagccagcttgaaggggctcttaatgactaaatctgaaataatttgagccttaaaaataaattaatagtcatgggatataacctttttaataaaataataatccattatttcatcctgatatagaaagaattaatgattaaatgggggagaagggaaagttcttccttccagaattccaactaataaatatagaagaaatgatggagttataaaatcattgagggattctgcaactagtggtaaaaaataggacaaagaatgtggcattgtatagccttatagtatctccccaccaattagaacaaaatgggccaggcatggtggcttacgcctgtaatctctttgggaggcgaacgcaggagataggagcaacagttgagcccaagagtttgagaacaacctgggcaatatagtgagacctcatctctgcaaaaaataaaaaggtacttataaaattattttttaaaatagtacaaactggcacggggagcctcctgttatcaaataccaagaagaacatagcataatttctgtaatattcctgcccaaaatgcgtaagttgaatctaatcataaggaaacatcagacaaatgcaaattataagacgttctactacatacttgacttgaaatcttcaaaaatgtcaaggtaagaaaagaaaagcttatgaactattgcagattaaaggaaactaaacaggcatgacaattaaatgcaacgggtaatgtaacttagatcttggactgaggaaatacaactataaaagacattatggagacaactgctgaaatgagtttggactgctcattagataataatattgtagcaatgttaaatttcctgattttgataactgcactatttatataagagaatattcttggttttagaaaatgtgtaagtatttagtgatcaatgtgcctaatgcccccaactattctcaaatgagtgaatggcatcaggcacttcattaataagatgcatgcaaagctgggcatggtggctaatacctgtaattccaacactttgggacgccgaagtgggaagattggttgaagccaggagtttaagaccagcctggtcaacatgatgagaacccgtatctacaaaaataaaaataaactgatatgcatatatatgtatatatgtgtatatgtgtgtatagagatacagagatatatagagacatgcatatatagaaaataataaatagagtgaaatgtaaacaattggtgaatctgggtaaagtgactactattcttataacttttctgtatatttgaaattacattgaaatacaccactttgaaaaatggtaaggtgactaggaggtgttagtgataagtatggaactgagaaatatccagtaacatttgtaaaaaaaaaaaatctacaggaaagagactcgaagaggaatgaagtatacagtgcagaatggcatggaagaggtagaagatcagatcattagggcatatgtgaggtagtataattacttggagataaaagcacaagctctgaagtcaaacaaaatggccctggctctgctacttactaaatgtgtgaccttatgcaagttacttaacttctctaaacctcaccttcttcacctataaaatttacatgtgtaagtactccatgtggttgaacagttatataaaacatagtaaatggtagctatgatattctttgattaacatatcttccaacaatactgtgtaccaggcagtctcattaaatgttgaatacctgaacatagaatatgctcagccaggagtcacttcttccataagagtcaagggtgcagacacttgaatcaataaagcagaattaatacttgacaaggaggcagaaattgttatttacaagtttttaaaaagctgattcaaatggaaattgtaacagagatgcaataagatgtgcatgaaggaacacagtatttttgtggcccaaataaggtctttaaaaatacgacctctaaaatgaattttaattcaaaatatctccttgatgaataaatgtgctacttcaagttgctcaaaaagcaggcactaaataaactcaagatattgttaatgcaaatcagctaccttttatcttacacttatagcacttatactcccaaaccaccaggaggtgtgtcttattctatatctaggagataattaactttcaatttcacatcaatcattcaagatgtaggaacgttgtcaattctttttacctcacaaagatttaccatgtaaattctacaaatcttcagaagataagtaactatatgtaatctgtatgagcccagttttaagttacatattctttcatgcctacctccccactaaaaaattcccaatatcttccaatctgtgattaagtattggtattgctcattgaagacaggagagaagaaagaaattagcatttgccatttaccagccatgcataaactccatgtgtttagttgtactttgtaaatgtcattcattttactaacttcttttgatcatcttatgagacatgtaggttacacccatgttagagatggagaaactgagactggttcaaggtcatcaggctggacaatggcaaggctattactggaattcacatttgacacttaagcctaaaccctttaatgcaacatgctgcaacagtatgcataatagaatgttaggggttaattaaataatatcagtgctaaaacaagtatattttattgtcaaacgcatgactagaatatcatttagaaaattcttcagatcaccagatggaaagaaaatcaaacctaaggaactctcaaaaactttccaggacctgttaccaaggatattttaactaatctcaatagcacagtgcttagctgaagctacttggttggtttccatcagcaaaatctcaaacagaatgagagtttggactccagggatctttccagctgatgaatgccaagggagacaagaatgcttatgcacagaagtagctatagactttcagtatagttaagccaggagacaaacattaaagaggatgctacaaattgactctattggcctctcagatttgctttttacatgctgtgaacacagagtattcaataaatattagttacgcaataatattgtaacaattttttccagaggataagaactaactttaacagaaaataagcagcagaagagaaaaagatggcaaaacagctatgaaataatagactttggaggaatctttgctgtcaggcacataagtatagatttacttaatattctgtttaatggtgattttatgcaattttataatcagtccaattaaacaactcatataaggaaagaatagcattcagtctacagggagacattatccatagagacacatgttaagtaggaaaataaacctctgtctctgacatgtaaaatacaacatccctctcatctcctcaaatcggatatataaggacttttattacaacttgccaaaatggcaagattgttttgtttcgattttcttttttttttttttttttcacttagttctttcttattttttccttcttttggacatacagctctgaatcagaagactgtaaagaattctactcataaataccaaaagcttagtcccctcttatgtataccatgaaatgaagggtattttttggcagattaataaatctaatatcaactatcacttgaaaaaagtatcacattccactgcaccaaaaggatgaatttaaatgaaagtctgtaatttcacctggaattggtccagtaagtgacagctgatggctaatctcaaaaagaacatgcttgtaaacacctgtgttccaattatctgaaaatcaattttagattgtagaaattattgaaaatatattcctataaaatgtgtaataaaattttattataattatgatgtaattttattatatataattatattattgtacaaaatgatacaatcatattataatttattgtagtgtacaaattatattaattatataaagttaattatcatatacatatcattatagtacagatataatcatttccattatattattttaaattttatgatctactgtgctagaaaatcttatgagaatgtactgcttaaataaaattgtagaaaaataaaaccaagagccattaaatatgtcacctttctttttccccaacttccccaataactaaagagttagcttaagagaaaatattatgcccaaataccaaagtacagattagaaaatatgctacccaatatacctaaggtatcattagcatacttttgtactggttaaataaagtatactgccttttgttctaaagtgatagtggaaagccagcttgtagatgaatggtttttatgttgcaagaaccatccgatcaactgcagtccccaagtacgacatgaagctttgtagttctctcttagactgcctaatgttgtatgataatcttgagaccactggaaagccacacaggaccccatagtcaaaccagcaggccattctgcctgtttccagacaaggaaaactatgctgatagttccactaacagtctttggaaaatagtaatgtttcttcttgctttattgaaaaatacatctatgagcttcttctcgtattttcttctttctcttttcattccattcattcttttcctttccctttccctttccctttcattcccttcctgaacaattcagtcccaaagccactgggtgaagtagagcaaggtctactctggtggtgaaggagtttggagaacagagctacagtggtccagagcagagtgtcagagtggcccagggcctaatcaagatgagaagggtattcaagtatggaggcagaccacagcagagttacagagcctgacagaatgaggaaagagtccttgaagacaggtaggctaatatgggctgttggaactaaaacaagttaaggaaggccaaataggctacataatgtctgagcatggagttaaaacctgagtagtatgaggagggcgcccatgtgatgggaagggactgaagtgctttgtcctagctaagtagagtgacgaggtctcccatgcagagcagtgacctagcaagggttgtgagagcctgagtttggtgaggagggtatctgtgctggggtggcagtagcaatgggagactggttacatacagaaggatgggtcaaataagtaaataaaataaggataatttgaatctatcagaaaagagagtgaaaatatggcagtagagaaaactacaatgaattatatagtgttagactggaactggagtaatcagtgtgaactcatggttttcaatagagatagataaatatagatattaatatagatgtaaatttgtctgagtttaaacatacacaaaagtgaaaataacttcacagtggggaagcctggaaaacacaacttcaattgtgtgctcagagtgaacatcataagtaaatgcagcaaatctaattacgtgccacctgataggatgcaatgaaaagatcacagcctcacttctgtaatactcctatttcagaaatgtcagtcacaaaaaaagaaaaaagtaaaagctgagagtctgccccagaattaaggaaattagaaagacatgacaactaaagatgacatgtgattctgaactaaattctttgctataaagcacatctaactgggacatctgttaatttcccattaataccaatattggtaatattggtattattggtattaacaggaaattaaccaatgtcccaatatgttaatttcccattaataccaatattcccaatattaccatctgattttgatggtaatattgcagttatataacagattgctcttgttcccaggagatacactaatgtattaggaagaaatggaacaagttggtcacttaacactcatatgggtcaagagacttttttaagtgctgtactgtactttcacatttgagattatttcaaaaaaaatttaatgccctaaaaataaattttaaaaattatttctaaaaaacaaagaaagaaaattacatctaggtcatagaagatgtaaattctttgtggttgtctagatgcaaacccctcacccacttttcaacttcaagagtctatttttgtgttaataataaaggccattcatcaaacataccatagcaagttgagcattgtatgtacattatctcatttactattcccaatactcctatgagataggtattatttttatccctttacgaaggaagaaactcaggaagagagaggttgagatgtttgcccagtttgcttaatttataactggcagagctgggataggaactaggtatgtctcactccaaagcctgtggccttaactattacaaactgactctttatgtctggagtaattgttagattttctttgttttgctctgggttaacagggattttgtttgttcatcttgcttttcttgtcacctaggatgttttatggaccatgactcagcagttccagctcaaagattctttctccctgaagcctccttcaccaaaagtcatttctcccttcctccccattattgcctttgcactttgcatttatcttgtgattcttatgaccctgtgtcattggaatatatgttttatttccctacatgtaaactttgcaaagttaaaggccaagtcacactccattctttatctcacataagcagtggctgtcaaattttattgtgcaccaaaatcacccaaagagcttgttaaaaaacagattactgggctgtatcaccagagtttctgattcagtagtctagggtagggcctagaatttacttttctaataaattcccatgcgatgctggtgttgctggtccagggactgcactttgaaaaacatttcagtactgtatagagcttaccagtctcttaccaaagtagctaaatagtgttttttgatttataaaactataacacatacattatcttctttgctataatatgtccaaatacagatataatatatgtatgccatagaatgcctcatattatatggtaataataaattggttggttcatctttcccaccttttattcattcactcatttcttcaacaaatatttcttaagtattgactgtgtgccttgtactgatagagcagtgaataagacagattagcctctgctatgataaaaactaacagtctagtagaaaaaaagaagactaagcaaaatatgacaaatttccatacttcacttccaattatcttcatgggaagagatatttgataaatgggagcaacaaaacaaaatgtgtattagcacaataacacattaaagttataatgggttaggcagagaaaggtttgttggtgttaagagacttttcactctagagtacctgaagcactaaaacaatcttcaaagatgtagagacctgagaacataatactgcccctccaactcctcagggatacagtaaatggaatcactacaggaaaagctagagtctggggcaggcaaaacaaacaaggagtaaaattagaaagaagcaggaaaaccataaaggagataccccttatgcccatcagagatggactctcagatgttcatatgctgtatgaatagatagatgggaaagaaaattagaattctgcagaatccttggggatccatgtacattcatgttgtccagaagcaaaattttctttctggatatatgcaatagtttaatcaagttactactatagtgtcagtgaatatcaggcctaaagaatatagggtataatgagaatacatgacagaaagcctgttctagggagtttatttcccaaaggaggaagaacattcaactgagacagaaggattagtaggcattttcaggcatgggagtttgaggacagggaagtggaagagatggagaacgtgcaagaacctgagagaggagaaagcatgacaaggaccctaaaaaaattattagagactggccgcggtgactcacgcctgtaatcccagcactttggtaggcagaggcgggaggatcacttaaggtcaagagctcaagaccatcctggccaacaagacgaaacctcatctctactaaaaatacaaaaattagctgggtgtggtggtgcatgcctgtgatcccagctgctcagcaggctaaggtaggagacttgcttgaacctgggaggcagagattgtagtgagccaagatcacaccactgcactccaacctggcttacagaacaagactccatctcaaaacaaaacaaaacgaaaaaaacaactcattagagaaggacaaagagaatggtataagataaggctggagaggcaggcaggtaggtagactgatgtattctgaactcggtttttaggaccttgaaagtattgatcatgtcagtaaattttatatcattgttgccaggaagactatatacgttctataaaggtggaatgagagaatcaatgaatggatggatgtgtaaagcaaatatatggtacaaaagacagaggcataaaattcagatggcatgatctggaagcaaagcgttgaatggaccaatgtaaaaaagaaaaggagtctgtgagtctcgattatgcagggctagaactgtgagggggctgaaaatcatcttatcaatctgcttactgtagaaatgaaaaaactaaggctggtgaactaaggtggcttctccaagaacacaaagccagtagtggctgaaccaggacttgaatctcctggttcccaaaccaagaagctttccactacagtcatagctcgttctggacctagaagtataagaataagtctctaacggtcactatgcaggcagatgccaagcacatcagaaccttatccctaacagatgcataactagcagctgccacaatttctctagttgaaaaagtttctagttagaacttagctatggatgatataagaaaaatacttatccctccctgtcataaaattgattcatttagaaaatggctattctctctgtgttattatttccttttctacctttagcctgagagaattaatacaaatagtatagtagcaacactcagcacaaaattatcttaagagcacatgaggtcagactgtcatgggaagaaatctctctaagcagctgcataactacctataattcacaggaaggtagactcaataggattctggaaggctgaccgcacattctgttcctctttaggtaactacagtttgtcagaaacttggacagacactactaacatatcacaaataatgattttgccctgagtgacttttggtctgttatttccaactttctttctctctgctgattaagttcactaataatactactacataaagaaataacatattttactcatttaaacatcacatttgttattaatcaaagtattacaatttggctttcttttttctatgcttctcatactagtcaggcaaggtggtaggtaagaactacaccatcatcttttaggaagtgtcagaatgcctgctgggcctacattccccttctgaaggatttcctacagataagctatcccagactgactggtgattgctgagcacctgacctgagactagtcaattgctagatgggccagtaggtatgaaatggcctggtataagaactctgccttacacaggtggtgataggctaatccaattggatactctcacttgaaaagttaaaaaaaaaaaaaaaaaaacagtcagttagttgataatttcagaggaatagaagccaaaacagagagctgcacattcagcgtaatagtagagatgagatttgggagaatggctgttgaggatataggagaataacctggtggctaataacaacagcagctacaacaataacaagaacaatcataataaaggcttacttttattgagctcttactatattccagacatgataaaaaattcaaatgcattattctacctaaaccttgcaactacctatgaagtgggttctgttattatctccatttcacaaataggaaaattgagacggagcaaagttaaggaagagcacagtcactcctttagtaagtgatggaaccaggattctaacccagatttgtttgattccagaaccctgctcttaaccactatcctaagttagagcttattttatgtttagaaggacattttaggcttcatacaatgtttagatctctaccttttgtattcccacctgaatttgtacagcaaacccccattacttaaggaaaattgaacacaaggaaggtggtgctctggaactaaaatgtatgctcaggcttggttttgaagtacacagctgaaagttatgttttccaaccttggaattgttaccctaccatatgtatcttaatcatatctctggcatcttactgtacataggtttcattatcactctttgttcattttgaccatgagaaatgatgataataatagcagagggagaaaagaatattagaatatgggaacatacatgtaaatatcttggtccatgtaattcaataaatatttattaagtgctatttatatgcaatgtacacatacccatgtatgttccccttattacccaggttgatataaaagtcacaatgcagcatagctatgtgttgtgttcatgtctcccaatctctataatttctgttaccatactatcatgtatcagagttgatactaagatcagaaattgtgtttgtgtgtgtatgtctgtgtgcgtatgcagtatggggtgctagaaagattcagagatctgagttctagtcccaattgccattaactagctatctggccttataaacttcacatcaactctctgaccccagttccctcatttgaaagaaatggataattgaacaagaggaaatccaagaccctgttaactttgaagttctgctatttagttctcatttacttttatttaaaaagtgaaattaaatgtctctccttgaccagatagaagaaggcataccctctaaatgtgtactggtcaatttccaggacgtaatgaaatgttatacatggttttcaaaaatattttttgtggagggtttgaatcagacctttttgtcaaacaaaatcttagacaatcccaaatacataaggctaaaagtaaataaacaaagctgctctattgaagaaaggaagaggaagccttgttgttacacctagcagattctgcttgggttagatctgtggaaccctacattttccaggaacatagcttaaaaactatggcaaaccagacagcagaggtacattaatcaagttaaatgttattgttcatccactatgcatagagcaatataaaaggaaagtagagaagtagaaaacataccctctgcttgcaaggagcctgcagtttccatgaagagattgggtagaaacttcagaattaatttaagaaaaccacaaagcaaagaaaagcgggggcaagaaaggtaaatcctaggttctgagaaaatgcacagtagagactaactgaaggtccaagaattttaattaacaaaattcaatatttttgaaaaagagattatacaggttgagcatcccaaatcccaaaatctgaaatctgaaatgcccccaaatctgaaactttttgagtgccaatatgatgctcaaactaagtactcattagagcatttcagatttcaggtattcagatttgggatgatcaactaataaatatttcaaaaattaaaaaaattgaaatccaaaacacttctggttgaaagcatttccgataaacgatactcaacctgtagtacagaatacttcttgattaaacagaaaagggcagtaaagctgtcaggggatctgacaacatggaagtcattgctgactttaagaacagcagcatcagtagaaagttggaaatggaaatgatttgtctgcttatttccccatagtatttattcaattatgtaagcattttatttccatatttttaaatgtatttattgtctgtcttctccctattagaacatacgctccatgaggacaagtatctttccaggtacattcaactctatattaccagagcctaaaaatagtgcctggaattgtaggttctcagtaaatatttgttgaatgattgaatgaccatgtattgtgctaggtattagggaatagagtaagggattacaaaatgaatatggcatggtttctggttttgagaagcttacaatctaatgaaagacatatactaattcacaagcaactacatcactgcttctcaaacttgaataaagagcggtactctttaaatgtcacaggctattgataaagtttggctgaaactaagctgctactttccacataaacgatactgactgtggtaacttggctttagattggtataaagcagcgattatagattaagtccacctctgttctctttaccatagcctgtgacatttgaagagtaccacttgtcaccaacgaaacagtaaacacaagcgcaactacaggccttccgggaaatctgcagcagtgcttagttgtaaagtggttatccagagaatctgaaataggctttggatttctttctttcctatttatttatttatttttttgagacagagtctcactctgtcgcacaggctggagtgcagtggcgcgatctcggctcactgcaagctccgcctcccgggtttactccattctcctgcctcagcctcccgagtagctgggactacaggtgcccaccaccatgcctggctaattttttgtatttttagtagagaatggggtttcaccatgttagccaggatggtctggatctcctgacctcatggtccgcccgcctcggcttcccaaagtgctgggattacaggcgtgagccacggcgcctggctggatttctttcttttatactgtgaaaggaaaacacaaaaatgtttgtaatgtcacagaaaatgtgcagcacttagtatatatctaactcctctcatagaccagctcctttattttcatatgttcccggatcacaagtaggcaatgtagagaggaaagaagatacattccagaatccaacttgggtttgagtcccagctctgccaccaactagctgtgtaactgtggacaagttacttaatttctatgagattcaatcttctcacataaaatacagaaaatacccatcttgtaaaattattgtaagattaaactaaattatatagagaatgatgcctgacacataatagaagttcattaaatgtcagtttacctccccttctcctggtttcagcctcatctgcaagtctcttctatgccaccaccatttatgatacatttatttcacaaatatttattgagtactttctatgtacctgccactgctttgtgtactttggatacagcaaagagaaagggcctttctctcacagagcttacattctataaaatgcctgacccaagtaggaggaatggagataaatgtttgagatgggtattaaaaatacatagctggcaaataaacctagtctcaggctcttggcttagagattaactacaacctgtccagatttacttgctgctgccaggtgaatggggccgaagagcccttccaaccctttaggaactattagtggagatctgaccacatgtatgtcagtagttgaaccttttttttgagacggagtcttgctctgtggcccaggctggaatgcagtggtacgatcttggctcactgcaagctccacctcctgggttcaggccattctcctgcctcagcctcccctaagtagctgggactaccagcgcccaccaccacgcccggctaattttttgtatttttagtagagacggggtttgactgtgtgagccaggatggtctcaatctcctgacctcgtgatccgcccaccttggcctcccaaagtgttgggattataggcgtgagccaccacgcctggccagtttaaccttttttaatgtaacctggaagactgaagactccctagctctaaattctattagtaaagcaatgttatgctaatgaaagttgtgaatttgggaactcatgacaaagtcaatgtcatctcaagaagaaatgcaaaggctgcaaggaggggggatgaaaaatactgcaagaaataagcaacaattgaactgaataaactattgtaggcaaagacaggttggccatccacacagtataacgaaagaagacgctgaccttgtctttagggcacaaggcatgtgctccacaaacatttgttaaatgtatgaatgaatgcctgtgactgcaatctgtcaaaacaacaccaccaaaaatggaacggaagaaaactggaggaaaaattaaaagtacataaaacagaaatcgaagaaatagaagactcaagacaagtaataaaagaaagattgttagagatatataatacataacatagtttgacagactgtaagcggtgggaaaaaaagagaaaaagaactaaaattgctgcctagattctaagcatgtgaaaaaaaaatcctcttttagttagtgtagaatttaattatgaagataactactttatatggaaatctttcttcaagcatttttttagcagacgttggctaggtgacagaggagaagagccaaactcataatgaggtcatttttctctaaaccacgatgatccctttcctcaatttcacaggaatgttgaatcaccccatagtataaaataattcccaacaccaatgggaaagagatgtttcctggtcctgccacagtactgatccactttcaaaactgaaaatagattctttactgacactgatttagttccttatccatgtgctatctagtctggtctctctatttaggcacagtttcatttgtgtttaattggatgataaaaccactgatatattagacttacaatgttttttgacagttacaggtgcttatgtcaaaataaaacaagaggctgggcgcggtggctcatgcctgtaatcccagcattttgggaggccaagaccggcagatcacttgcagtcaggagttcaagaccagcctggccaacatggtgaaactccttctctactaaaaatacaaaaattagctgggtgtggtggcacatgcctctaatcccagctactcagaggctgaggcaggagaatcgcttgatcccaggaggcagaggttgtagtgagctgagatcatgccactgcactccagcctgggtgacagagcgagactctgtctcaaaaaataaaataaaataaaataaaataaaataaaataaaataaaacaagaaagaaaaggtaacaactcttttcagaaagccagtttctaatttaaagaaaaaattaaggggaaaaaaggaattaaaaaaaaaaactgacccacaaaatatgctagttatcctatttaccccttaccatccattcacttttctttttcctgcaatgtgcccaggatgccgatttctacagactaagtcactaagattctttgccttttggcttctggttgggatcagctaatgtgaggctctggcagaaaaccagagaataggagaagagaaggtcagggtatttttttgccagtggttgtgttcttctccctaagagcaaagctcctatccagcaacccctctcttgcagctgaagctcttaccgaatcctggtcaaacttccttttgtcctttggacctaagtgtaatgatgatggccagatttttgtagttccccttaactatgaacacatctgtctaaataacccctctaataaattatcttcaattaaacttttgagagtgtgattcctttccttccacgactctaactaatatgcaaaattatttaactttactatataagctttactagctaataataatgttagctagcatttatttaatattccttatatggcagactatagagagtactttacatgacttatttcatcatttaatcttcacacacaaaatactactattgttattattttccctatggtgggtaatattattattcattattcagacattgacacccattcgcctcacttccatgagatgcatatacttactccattgatgttggccttggtcctgtgtcttgctttggcctatagaatagggagaaaataatgatatgccaatctgagcccaggtcttaggaggttgtccagtctcctatatttaccaccaacataaaaaggacatgcccaaattagcttctcagtcccaggagaagatttagagacatgtaccagagccacctcagtcaaatacaatacatatcaatccacctgcaaaaaaaatgtaacatgagcacagccaagacctcccaaccaatctaagtccagctcagataatcctgagccaacacacagatccatgagtataaaagattgctatcttaagccactgagttttgggatggcttattatgtagcaattttacagtaatagcaaactgatgaattccaattttatatatggaccacagactccatataggggttttctaccaaaaaaaaaaaaaaattagcatgaagtcaataaaaagtcattctccagtaaaaccaagttataaaccattaaactattaatctgcaaaaattgtttctaattgttactaagaaaagattcccaataggcatttaaatgaaacatatagtcattaccacaaaagacaaggcccttcatagcctgcttatgtctttattcccacaacctgacatcctccctgtccctgcccatcactagagacacacaaatttacctgaatttgtttgggtatgctgtgcagtctctcagctctgtttctttacatgtactgttctctccacctgaaaatttcttctactttttatcccttaactcacctctagtatcatcttaccctgattcctgcaggctgagtctggtgcccttgttctgtgttttgtgtttgcctctgcttatctctcccatagccattatggcactgtattttaactatgagttccttgagggtcaggattttgctttctgtttatcaccatattcctactaataacatgctacctggtacatagcagtctctcagatgctgatacaatcattttagaaagctataaaccatccaattggtttgaagggaacactgcattggtaactgataggaaaagtaattgaggaattaagagtttgtcagtcttaattcagcactatctaaaatgaaaggtactgattcctggttcttgatacaaatcaccctagaatagacaaaaataatccatcaaactgccttagcttgaggtatatattccttgagaatatctaacaccctttgtctaattctttgctcagcattcttatgctggcaaagttggtgtcctgggtggacaaaatattggtcaggaagatagaagaagaaaatagtaaagataaccaatccctcattctggagctagccacacttcatagaaataggttagcatgagtctgtttttgaagttaatctccattgaataaactaaaaataactgcaggatttccaaagctacgccccaatcctgacttataagaagtcccaacaagggactgtcccttcacccaagaggcctggcctaaaacaaccagcagatgtcttgggcatccctttccctacagtactctgcagtggtagcaactgctaaggggaagaaaaactagaaaaatcagactggtgggatagcaaacccagatgctgtcctccctgttgctaatggtaacaggattagactagatggggaactgtaattaggcacttggcttttatatctgacatgtttacagccatcgtgctattctgggctcttatataacatttatatctgatgctataataggcatttttgtgatcgtactttcttcctcttccatctaagtgactacaacaagcaagcacttctttcctcttccaagtttggacctgaaatgccccactcatatatgtatgctctgtaaatatctgctttttagccttaactttttaataaacacagatgcttaatcttgattctatgctgttatttatttgattaatttctctattcatgtagatcagagattagcaaactatagtccatagacaaacctgcccccacagtctgttttcatatggcttatgagctaagaatgatttttacatttctcaaatgttatataatacaaacaaacgtaagcaaagaaaaatgcagcaaagccaatatatgacccacagcctaaaatatttgctatttggcccgttacagaaatgtttaccaactcttcatctatatcgatgttgtccattacagatgaagctaatttatctagcatttgatgatgatggtgaggatgagaattaatatttgtaggatgtttaccatatgccagaaactaagcacttgccatttattatctcagttaatcttcacaaacattctttgaggccaatgctgttatcagccttatttacagatacagaaagtttaaataacttgccatggtcacacctatagtaagtggtgaagcccagatttacatccacacaatccagttgaagactccatcctataatacttccaaaaatcaatagaatcatgacatcttccagtaagtatataatcccctttacatgataatctgataaaggattactcagtctctggttacccatgctgaggtaaattgtcccatcattgaatagctcgaaattcagaagttgtctacagtttgaaatgaaaccttatagataacttttatctcttagacttatttatttcctctgaaccacacagactaaatttataccctttacaacatgcccttcaaatattgaagatagctcagatctttccaaagtcctatttcactctacacattcattcacctagaacttttcaagcattcttccttattttttattcaatagaatttcaaagccttctcgccaccctagtcacactccttggttggctctatagtataaagtatgctgccaagaaccacaaaataccaaatatctttattggtctctagttacatgtacctaatcaacactcactaaacataccattgtttttcatgactctgtcctgtgctctttatctctacaaggaatgttcttctcccttttctttatgggccaaacttctaataatttttcaaaagtcaattatctctgtgttttaaccatactctgtacattcctctatagtaaaatgtgtcacactgtattgtctctattaattatctcacatgtaagattagggcttcttaagaaaaaacattgtgtcttattcagttttgtatgaatgcatatatttatgaaccaataatggataataccttattttgttataataccatccatattacttaggcagccaatattaaacctatataaggaattctaaaaatgacatctctcagctttgtaaaattttaacttattataatttattataatttataaccttataagtatataattataattttgtaattatgagttacatgtaatatacaattatatttaaattataatttataaacttaccatatttaacattctttgagatgttataaattaaatttgataatgatcattgtttttattgagatatcatacattcatgctgaaagcatgaaaagattttcaaattcctaagtccccagatcctaaagtttcagtttgactctgataaacaaaattctgaccagagaaaattcaaggcagatttgtctccatttaccttttaaaaatactttcactcacctaggagcttgaaaaagtaaatactttagagtctaaaaaaattcaaaatcactcaagatcttgtgaaagactgttttctgtctatgaagtgtgatgtccacttcaacttgttttccatagagcaagcacttttatcattaaattgatggatgtggctttggcaagaaaaacatttagaaaaatattgagaaatgatgaatttttaaaactaccctcaacttatttagaattaaaacactctttaggaactatggcagagatttctagtaatcaccaaaacccttttggatatacatctaggtcaaacttcctggtctcccttgcatttggctgtggctatataactgaattatggcttttgagacgagaccatacatgatgtgtgtcacatctagacctgaccaataaaaacttctcacaggttcagggaagtcatatttagaaagaaaaaaataaatttttaaaaaaggggaaaaaacctttttacaggtgatcccccttcctcttttaactcttttggctagctagaatggaaatgatccaaagagtgaccttcagagccccttgacctacttgttgaagatggcaaagtcataagatgaaaaacattaaagttcttgaattaatgctaaagggaaaactacctaaccatgtacagtcacattagattttgacataaacaagaaataaatccttattgtgtatagccactgagattttgggatttatctgttatagtagctaatgttaacaaatacaaggatagatcaacttacacagattcccagcaaatgaaaacatctccacatctcttcatggacatttaagtacattaataaactacaataatgtaacatagtctatatccaatagtcaaagtgtttacaattgtttttcatgtaaaagcatctccacagaggtgctgcatggagaaaactatttaaaaacttacaaatgccattacataactaatatttaaatgtgaatgaacctatttattcataattgaaaaccacagcatcattgaaggtaaaataatttacttcttggtttttgtttcctaatatgtaaaagtttatgtatctctctttttttttattcagcagttaaaaactcttgagcaataactgcactcctactgagataataccttcctgcaaatatatatgacctcaattgcaaaactcattgggtctctccaaagtaatttaaaaatcaatctgatctgtaacaagaagtcaatagaattcctgaaaaatttacataacacaactccctctgtgtttaaaatttcacagcaaaagttgtatataaggaagagctttacagaaagcttaagcaatggccccaaaatgaaacaaaaagtaaagaacaattagactgcttctaaattttagtggactgatgttattatatttattcaaggaacatttattgagaacatacaatatgccaagctctgtgctaagcaacatgacagctacaaaactggctcctgattttctggatagtataggagataaaaacacaaagtaattaactgtttccttttggtattctgaactctaaaatatttctgtctaacacgatagaaaaataaagcaaatcccaagctcactcctaataaaatatcttttaaaaatatcaataactgtggatagggttagatgttatctgaaaggaaaaacaggtcagctaggaaaagattcaaaaatagagaggatcatataaatatatctatatgtatatatattgacatatatactcatatacaaacatacatatatattatacatgcacacacatatacatataatatatatacatcctaattttgtcaaatttcagatgatagtggtgtgtcttagctccagtgtcctataagtagagcctgaggcaaattaaatttctggtactttattttggggggtgaaagtcctttatttaggaggagcaataagagaaatactacagaagaaaatgagcaaagaaacgtgcaaagcaatgtagtataatgcataattgcattggctttatgaaaagccatgaattgccctaccagctctctcagcacaggatacttctttggaaggctttcaaggagaaactatactgtgggacagttcacagaggggagaaaggagagatacattgtcagcctggtagtgtacctcaatcttccatttcaccttcatacagaaccagttcccccatacttcagtgttgtgtcgtccagcccaccaatggttatttcacaagccagatttcacaggctctgtgtcatttcatctaagcctggaaagtgagaggcaactcagggtacatgaggttggcatgagagaattatgagctatctaggcctgtgcctctgatctttgagggttgttgggagggattagagcacatataaaaaacgcctgtcataaaataagattccagcctggaaaagatagttaaggaattaagtaacagcaccagcaccaaaacaagtccctggcaggttcatcactgagctcacagcttccccatgtgctttttacctcaagaagtgtcccaggctagcattattgcttctggctattccactatcttgtcctgtcttagcatgagccaactttaactccatccaatcctgtcttgccatcctgtttttcctagcagaatcttcaataaggttgataaacaaccactccagctgcaaggactccctgcataccattagttctgatatggtatcataaaaggctcagttctgctaacaagtcctcttccaccagaggactcagcagtgggataaccctggagtcatcacctggtgtaagactgctctacaacatgctactatgtatttctggattgctgtgcatgcatcacactgatatcgaacatcttccaatgcagggagcaacagtgaacatcatatatcaggacacaccaaagatgttggtacctcaacccaagatagagacaggacacctgttaaggcagctctcatgcttctttaaaaccaaaattgttttctcaaactgcctattctatagctgtcctattggggtgctaattctctaacgctcagtccacacaggagtgaggccaccttgtttcttatttcctcccaggaggctgtgtaggatatttaaaaactgcctcttcacctctctcaatcagaggagcagtttcagatctggaaaaatacaaggatttccctgtctcctctgctctggaaaaaataaaatgtcccccaatcacagggtgaaaggttctccctcacctgaattatctgccaatgcccagctgtgtccctcccctctctgaggacgatttgaccccaattcataacaggaaaaacttttaaataaactaaagggttgaattactgttcaccacttattacattagctgggcttgagcacagctcgaacaggtcaaacagaagatttttttttttaaagaatgtgaatccagtcagattcatctgcaaatagatcaaataaactactactatttaacagatcactgtttcttattagctgaaactttgttctaaaatgactattctcaatgtcgctagtgtaattaatttaaaatgctacttcgatttataaataactctcataaactagaaagacatatttctataatctaaacaccgatttaagctatcctgatgtttagttatttgagcatgagatggacagaaagacaagacttatatttttaaatatctggtactatctcctaccaagtgggagccatattgggattaatatattacctcaaaatctcaaagggacatcattatggagcaaggtgggttacaggtagcaggaaagaaggggaataaatgaatactatagatgatgcagcagaataaagaaggaagaatgtgtcttctttcttgtgcctatttgctgctcttagccaatgcctctcatgtacaaaagctaaagataggatacaactgggtatttgaagagagtgaccaggacaaactcaaccctatctgtatacagggcttccctattttattcacataaaaatagaaaatcttctttggcagaagaaaaaaaacaggtaaaatacaactgggttttattatttcaaaaaaattgggatattttctttgtcccagggactaggcaaggcactaaggataaaatggtaaataaaagtacggtccccaccatcctagaatctacagtcttatgggagacacaaaacttatcaaatacatacttaaataaatcaaaactgtagtaaaagcaatgtaaaaaagatacaacatagcacaactggggaacatgacctgttctgaagtgtcagaaatggcttccttgttcccagttttgatccaaagtatgaatatcaactttgaaggtaaaagggggcagaagtggaaaagtaaatacagaagcattgtattccaggcaagtaaacatcttgtgtaaaagctctgacgcaggaagcaacataatttgtttgaggatctgagagaaagccagtgtggcgtgacaacaactaaaagaggatgtggtaaagctgcagacatagacggggctccattttagtctttatttaaaaataatgtaaggccactgaaagggttcaatattaatcctttattctaactaaagctaccgagaaactaacatgccaacttctccagctacaaacggaaggaatcatcactctgaaggcagcctcatgatataattttatgctccaaaaacattaatttgcccagtatgtagcaggccctaacctagaaagaaatgagtaaaagaaaattaaagaatatgctgtctaatgttttatggtctgatggtagagacagggtcttactggaagaaaatacaggaagcactaaaatagtggtatgtgctggatgctatgagaatagtcttttgttccttcctccaaggaaagaattgagcatttaggaggaccccattaagttccccccagttttagggactgaacaaaataataagtaaataaactacagtataggtgctcaatgatgagaacacatgaacacatagaagggagcaagatacactggggcctattggaggatgaagggtaggaggagggaaaggatggagaaaaataactaatgagtactaggcttaatacctgagtaatgaaatatctatataacaatccccatgacacaattttacctatgtaacatatctgcatatgtaccctgaacctaaaaaaaaaatagcacccaatttaggatatatttcatgtaagtgtgcacatctgtgtgtctgttccacaatactcataatcaggaggtagcacacatctgaggataattttatgaaccaatttaattacatttccatgccaatccatcacaatttttttcttgttcttatttacccttctcctctagtatccaaagtcaaaaaaaagtagaagcagtatttaatctgagtggattatcaataacttgtcaaatttataaaatgtagttttaagaccagctgcatgtgaaataagccagcatattggcatccctaaatgatcactgaatcagagaattaattcttcccacactaaatggacttctggcaaagtaaaagtctactacaattttccaatgtggccaaatccttctccagaaattgcactttgagaactagaggctcctgatcaatgtttatcaagttctaacaaaacagaataaagcagcagaaacccagtagactcatgatataaatagttgacaacattaatgagtagaaaaaaaaggaaagtacactctacgttttgaggaataaaagtgcaaaaaagaaaccaggcagccttatcttggccaaagctctcatttttcatcatctttgagctgataaaatgcttcccaaaaggctttgtaaattccacttggttgaaatgtaagggaagggaaagggaagtaaatatgaagccaaccggactagaaaatattagagaaggaggaattagggaggaaacaaatgaaagaaagatttctaagaaaaaataatttcattactcagaaggtaaggaaagaccataaggaaacatgaaagttgagcaatactgttgcagcatctttactttccacctcttatcacttccttccagcaaccctctaaaacacttctgccactaaggtccactgttgaggttaagaatccatgacaactatggattcaaggtatcaaagtttgtcacattatacaatgactacataacaatttgccactgctaatttcatccacaaataaagccatcactaacaaaagcaacacaagctaagctttactattatgtagatgacagtaagtcatttaaaacaagaacatctcacaaatgcctagttgcatttaaatttttaaataaaaatgttatttttcaaatgactctatctgtaacttctctggttctttttatacatccctacttcaggataatgtgaagctaagcaatttctttaagcccaaaatgaaaccatataatatgctatttcttaacagtctcaaaccacaaagacttataaccttagaaacaataaaaaaaattcaagaatgcttttaaatctttcttttttcccaaaattaagttgaaaatagtaatttatctttcaaactcatctaaaagtgtaaatattaaggtttaacaatagtaatcttggagagtagttccagtacatcattaactttatgaaacattttaatagatgccactttccttctggttttctctactgctttgtaatagcataaatatttattcactaaattctagaactcttgctatataaatgttttatggctatatcatataatttgtataaacactatcctctatatcttgaagaaaagcctcttaatgtacagtttcagcaatctgtgttaaattataaaactcatggtataaaaagatatcatccacaaggtaaggtagagaagagaaatggaacgcagtgtctgaatagtttgaaaatttaaagaagaagcaaccagcctgccaagacaggtcactgaggcaccattcctggagaatgttcaatgtgcattaacatattcaacacagtataactttatttatgctctctaattcttaaggagatataagtcttaaaatcctgtgtctctgatgaccttctcaattgcaacttaaaatctggagagcctacaccataaattttatttctaagtagttgagatcttaaattactcctaagtcaaagtttacagcttggctattttagtttttgtgaaaaaaattgcaacatttttgggtactcaatcatgtttcattccttcatatcaggtaaagcccataactgagatgaaggtagaaaaatttcttaaaccatgctctttgagcctctcatatattttctagatgcctgaactaagccatgtgctagcagcacatgccatcttatagactacatccctcagcatcatcctgtagataagttaccatatgctgtgataaaaatattggtgaaaggagtgaaagctcaaagaatgaaaatttagagtcatgagcattatttagggatagaaaggtccttagaattcatctagtccagcagccttattttacaaataacaaagctaaagctcagagaaattaagcagcttgtctaaattttcagagcatgtaagtagggagctagcttaggaaatcaggtccatctaattcttggttcagcacttttatttgtatattatgcagtctcttaatcaaaaagaggcatttaatcattcaaaaaaatgtactgacaggcacaggaattacagaagagaatgaaaaaagagatggtattcctagtctaataaagctcacattcaagtgtgaggaaaaaatataaaattatatacacaaaataaatatatgatatatgtcaggtagtgacaagtgctctggagaaaaattcaagaggtgaaagggatgaacagtgagaaagattactttatatcaaatagtcagtaaagaggtgaaaagtagacagacacttgaagaaaggatgaagcaagccatgtaattatctagggataaagtactgtaggaaaagggaacagagggtgaaaatatcttaagtcaggaatgtactattcatgctcaagaatcaacaaaaagccacagagactggagcagagtgaatgaaggtgaatcatgacagaagaggatgttggaaacatggtgtggtggcttattgtttagacctttggattttttttttcagtaaggaaaatcaatggaagttttcgaatagagaaattttatgatctaacttccattttaaagtgtccctccttagtctcatgtatggtccaaaaaataaaataaaataaaataaaataatctctccagctactgtttagggaataggaaactattgagcactctaggtaagagatgatagtgatttgaatgagggtaataatggacaaagtgatgaaaaaatattggatatattttgaagatagggagaaagagatttttgcctatagactacatgaaggctatgagagagaaaaagtagttttttagcctgggcaagtggaaaaattgagtcactatttattaagatggaaaagacaatgggagaagttgagtatcaagggcttagtattggctattataaacctgagatgcttgtaaggtattccaaggtgaatattgagtagtgtttggttttatgagtttagagcttaaaagaaaacttataactagagatataaatttagaagttggaattatatagattgcatttaagtcacaaaactgaataaaataatctagcgagtatgtacagctagaaaatacagactaaggatgatagggtacataagagaagcaatgagcaagcaaggctacaggtgtgagtcctggaacatttcaatatttagagatttgggaaaataaacaggaagatctaggtaagatgactaagaaggagcagccagtgaagtaggaggacaagcaaaggattgtagtatccaggaagccaaatagagttaaatgtatcaaggaggaggaaaggatcaactgtgacaaaagattctgataagtcaaggaggatgaggtctaatcaatgtttagtcattgataacactgacaggatcttcgcaggacaggtttagtgacgtggtcagcaagaagagtaagttcaagagagaattagaggaaaagagatgcagacagtaagtgtgtataaatttgttgagtctggagtaaatgggagcagagaaatggggcagttccgagagaaaaaagggatcgatgttatattaaggctataagaatcaaccaggaaatgtgtggcagcagttccctatttcctattacattttacttcattatattcagtaatattctcctctactccacttttatacctactctccaaaccttatcatcactccaaagtgccctactatatcataaatagatacactccaccttctggtcaccatatccttttctcacctcatctgtactttgactccagtggtacctccagtgtactgattcctctacatcaccgccacccataagcccctttccgtgtaaattttcctatccattcagcttatattccttggtccatcacttcagtcactctctcattaagattctaaactcctttcctctatggtcattccactgagtacaggaaatcctcaatcttggaaattttggatgaaaatcatttgcctaacctatactagcatcttggctgctgagcacagtttaagtaaaatcacacaatgggaaaggtttgcattattataaattagtgattatcaacctcagattagtgactaatatcagctgatattgcttccctatgtagactgttctctcattttccacaatgaaaattttcaaaaacaccttaaccacatatccttaaacctctcttattactttgaaacagtaaatggttccataaccaaaaacaaaaacaataacaaaaatcttattctcctccactagtatttcttacatccagaaatatttccactgatcacccagttgctctgtcagagacttcaaagtcatccttgatacctccctctctgccacttccccctctccaatcaattatgaagtctatagatcctatataataaatatctcttgatttgtcaatttttcccattcctgctgctgctagctaaatccaggtaaccaacatctcacacctgcactaccacaagagcctatgattcctgtttctaccctttaaataggataatcttttaaaattataagtctgatcatgatgcacacacaacccccattgatttaactttttaatgactgttcattgcatttattaataaaataaagtaaaacaattcttaatatggcctgcaaggcccccaataatctatgttctttctaactcacctgtcactttttccttcactctgtaccatattgggtcactgtgaggagctggaggaaacctttctctctctcttgcctgtaggcctttgacctaatattagtattctaccctcttccaaccattactatcactaacagtctcctaaaatattgtcagctgaaatatcaactccaaaggatctctttcctaactaggcagaaaaagttaacaccataaacttcccttgcaaagcatttgttgcacagataattacttattaaatgcccttctttctttttattttttgacatataattttacatgtttatggggcacatatgttttgatacatgcatagagtgtgcaatgatcaaataaatgaaattagaatatctaccaacacaaatatttgtcatttctttgtgttgggaacattccaaatcttctcttcaagctattttgaaatatacaataaattattgttagctattctcactctactgtgctatcaaacactagaacttattccttctacctaactgtatttttctacatattaaccaacctctttttatcctctcctccctactacctttctcagcttctaataagcatcatactactctctaccttcaggaggtgaacttttttagctcccacatattagtgagaatatacaatacttgtatttctgtgtctgacttctttcacttaacataatgtcctccagttagatccatgaactgcaaatgacagaattccattctttttatcgctgaataatattccactgtgaatatataccactttttttaaatccattaatctgttgatggacactttgccaattcaccacaggtggctcagccctcctgtcacttccaattgttcccatgtaagtggatggtagtgggcttccagcaaagattctcagactggtggggagtgaacatctaactccaattctctcctctcacctcagaaaccatgggtctaaagaagttctctgtaagtgacatcgtccttgcttggggtagggggtcacacagtctgaaatgaccatttatttaagtcaccagacatggcttctctgaattatgtaggcccagagagcttctccacttctcccctgagttcaccagaattcctgtctttgaatagcttctacttgtatttttttggtggagtgatgccaggatattttttattccaccgccttgttgacatcacaccttctatctagctttcctgctagatagactataagtttcatagaggtagccttatatttctatcaccattatatccttagctcttactacagagttagaactcaaaatgtatatgttgagttgaatttaacaccttattttgcctttaagattttcatcaaaaattcgggaaagactaaaatcatctgaacatctgattactgatacactggtattattaaactttcggagcatcatccccatttcctaaagaaaagtaaaagctgaaatctagatttttataaacattgctctatctttagtagtttctaacatacctgaaaacggctgcctacagaaaaaagctacacaagaggttttgaggtttgctgtatttgtgaagaattcaggaccaaaagaaataatttttaggtgactgaaaaacggtgtgcttaaagaagaaaaagaagttggggagggaggagccaagatggccgaataggaacagctccggtctacagctcccagcgtgagcgacgcagaagacgggtgatttctgcatttccatctgaggtaccgggttcatctcactagggagtgccagacagtgggcgcaggccagtgtgtgtgcgcaccgtgcgcgagccgaagcagggcgaggcattgcctcacctgggaagcgcaaggggtcagggagttccctttccgagtcaaagaaaggggtgacggacgcacctggaaaattgggtcactcccacccgaatattgcgcttttcagaccggcttaagaaacggcgcaccacgagactatatcccacacctggctcagagggtcctacgcccacggaatctcgctgattgctagcacagcagtctgagatcaaactgcaaggcggcaacgaggctgggggaggggcgcccgccattgcccaggcttgcttaggtaaacaaagcagctgggaagctcgaactgggcggagcccaccacagctcaaggaggcctgtctgcctctgtaggctccacgtctgggggcagggcacagacaaacaaaaagacagcagtaacctctgcagacttaagtgtccctgtctgacagctttgaagagagcagtggttctcccagcacacagctggagatctgagaacgggcagactgcctcctcaagtgggtccctgacccctgacccccgagcagcctaactgggaggcaccccccagcaggggcacactgacacctcacacggcagggtattccaacagacctgcagctgagggtcctgtctgttagaaggaaaactaacaaccagaaaggacatccacaccgaaaacccatctgtacatcaccatcatcaaagaccaaaagtagataaaaccacaaagatggggaaaaaacagaacagaaaaactggaaactctaaaacgcagagcgcctctcctcctccaaaggaacgcagttcctcaccagcaacggaacaaagctggatggagaattattttgacgagctgagagaagaaggcttcagatgatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaatgcagaagcctcaggagccgatgcgatcaactggaagaaagggtatcagcaatggaagatgaaatgaatgaaatgaagcgagaagggaagtttagagaaaaaagaataaaaagaaatgagcaaagcctccaagaaatatgggactatgtgaaaagaccaaatctacgtctgattggtgtacctgaaagtgatgtggagaatggaaccaagttggaaaacactctgcaggatattatccaggagaacttccccaatctagcaaggcaggccaacgttcagattcgggaaatacagagaacgccacaaagatactcctcgagaagagcaactccaagacacataattgtcagattcaccaaagttgaaatgaaggaagaaatgttaagggcagccagagagaaaggtcgggttaccctcaaaggaaagcccatcagactaacagcggatctctcggcagaaaccctacaagccagaagagagtgggggccaatattcaacattcttaaagaaaagaattttccacccagaatttcatatccagccaaactaagcttcataagtgaaggagaaataaaatactttatagacaagcaaatgctgagagattttgtcaccaccaggcctgccctaaaagagctcctgaaggaagcgctaaacatggaaaggaacaaccggtaccagccgctgcaaaatcatgccaaaatgtaaagaccatcgagactaggaagaaactgcatcaactaatgagcaaaatcaccagctaacatcataatgacaggatcaaattcacacataacaatattaactttaaatataaatggactaaattctgcaattaaaagacacagacgggcaagttggataaagagccaagacccatcagtgtgctgtattcaggaaacccatctcacgtgcagagacacacacaggctcaaaataaaaggatggaggaagatctaccaagccaatggaaaacaaaaaaaggcaggggttgcaatcctagtctctgataaaacagactttaaaccaacaaagatcaaaagagacaaagaaggccattacataatggtaaagggatcaattcaacaagaggagctaactatcctaaatatttatgcacccaatacaggagcacccagattcataaagcaagtcctgagtgacctacaaagagacttagactcccacacattaataatgggagactttaacaccccactgtcaacattagacagatcaacgagacagaaagtcaacaaggatacccaggaattgaactcagctctgcaccaagcagacctaatagacatctacagaactctccaccccaaatcaacagaatatacatttttttcagcaccacaccacacctattccaaaattgaccacatagttggaagtaaagctctcctcagcaaatgtaaaagaacagaaattataacaaactatctctcagaccacagtgcaatcaaactagaactcaggattaagaatctcactcaaagccgctcaactacatggaaactgaacaacctgctcctgaatgactactgggtacataacgaaatgaaggcagaaataaagatgttctttgaaaccaacgagaacaaagacaccacataccagaatctctgggacgcattcaaagcagtgtgtagagggaaatttatagcactaaatgcctacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaatcaatgaatccaggagctggttttttgaaaggatcaacaaaattgatagaccgctagcaagactaataaagaaaaaaagagagaagaatcaaatagacacaataaaaaatgataaaggggatatcaccaccgatcccacagaaatacaaactaccatcagagaatactacaaacacctctacgcaaataaactagaaaatctagaagaaatggatacattcctcgacacatacactctcccaagactaaaccaggaagaagttgaatctctgaatagaccaataacaggctctgaaattgtggcaataatcaatagtttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcattctgataccaaagcagggcagagacacaaccaaaaaagagaattttagaccaatatccttgatgaacattgatgcaaaaatcctcaataaaatactggcaaaccaaatccagcagcacatcaaaaagcttatccaccatgatcaagtgggcttcatccctgggatgcaaggctggttcaatatacgcaaatcaataaatgtaatccagcatataaacagagccaaagacaaaaaccacatgattatctcaatagatgcagaaaaagcctttgacaaaattcaacaacccttcatgctaaaaactctcaataaattaggtattgatgggacgtatttcaaaataataagagctatctatgacaaacccacagccaatatcatactgaatgggcaaaaactggaagcattccctttgaaaaccggcacaagacaagaatgccctctctcaccgctcctattcaacatagtgttggaagttctggccagggcaatcaggcaggagaaggaaataaagggtattcaattaggaaaagaggaagtcaaattgtccctgtttgcagacaacatgattgtttatctagaaaaccccatcgtctcagcccaaaatctccttaagctgataagcaacttcagcaaagtctcaggctacaaaatcaatgtacaaaaatcacaagcattcttatacaccaacaacagacaaacagagagccaaatcatgagtgaactcccattcacaattgcttcaaagagaataaaatacctaggaatcccacttacaagggatgtgaaggacctcttcaaggagaactacaaaccactgctcaaggaaataaaagaggacacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataatgccacatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagatttaaacgttagacctaaaaccataaaaaccctagaagaaaacctaggcattaccattcaggacataggcgtgggcaaggacttcatgtccaaaacaccaaaagcaatggcaacaaaagccaaaattgacaaatgggatctaattaaactaaagagcttctgcacagcaaaagaaactaccatcagagtgaacaggcaacctacaacatgggagaaaattttcgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaagaaatgctcatcatcactggccatcagagaaatgcaaatcaaaaccactatgagatatcatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcactattcacaacagcaaagacttggaaccaacccaaatgtccaacaatgatagactggattaagaaaatgtggcacatatacaccatggaatactatgcagccataaaaaatgatgagttcatgtcctttgtagggacatggatgaaattggaaaccatcattctcagtaaactatcgcaagaacaaaaaaccaaacaccgcatattctcactcataggtgggaactgaacaatgagatcacttggacacaggaaggggaatatcacactctggggactgtggtggggtcgggggaggggggagggatagcattgggagatatacctaatgctagatgacacgttagtgggtgcagcgcaccagcatggcacatgtatacatatgtaactaacctgcacaatgtgcacatgtaccctaaaacttagagtataataaaaaaaaaaaaattaaaaaaaaaaaaaaaaaaaagaaaaagaagttgggatgtaaatttttttatttcttttccagagtctgctcaaattctcatacataaacccttacttccacctggtggtttcccacaatgtggaaagtgattattgggatttcccatgtatactgagtattactacacttgaaatgaatcacggtaacatgcagggatgataaaatacaaactatttatatgaggcacgaagctcatctgtattaagtttaaaatatatgaaatgataaaattctaaaatatgcccaagtacaaaaataaacccataatgttgacattcactttattttttccaagaatataacttctgttttctaaagatctgaacctgattttgtagtatgttgtcatggcctatggacatgtggcatgggtttcaactagcaggccaaaactgttaatgagaacattaatatgacaaaatatgtaaatagacgccctataaaaagggttcctggccaaaaaaagttcaatatatatacctcttagaggtaaatgtatacaaatgcatattcacttttaaagatgctagcggtaataaaatcatttaacttctttttgtgtgccttgcccttctttttctttattacattttgttgttaattccaaaagcctggttttcttttttatttctttttcaacttttactttagaattgggcgtgcatatgcaggtctgttacatgggtaaattgcatgccactgggatttagtgtacaaataattttattatctaggtagtaagcatagtgcctgataggtagttcatcaaacctcattcttctgccacctgccacctgaagtagtaggccccggtggctatgattcccctctttgtatccatgtgtacttaaagtttagctctgcatatacgtgaaaacatgaagtatttagttttctatttctgtgttaatttggttaggataatgacatccagctgcataccagttgctgcatttgacacaattttgttcttttatggctgcatagtatttcatggtgtaaatgtaccacatttgctttatccatccaccactgatgggcatctaggttaattccatgtctttgctattataaatagtgctacaataaacatacaagtacatatgtcttttgggtagaatggtttgtattcctttggggtatatacccagtaatggcattgctggattgaatggtaattgttttaagttctttgagaaatctccaaacagctttccatggtggctgaactaatttatactcacaccaacaatctataagaattccctttcctcttcaaccttaccaaaatctgttattttctaactttttaataatagctactctgactggtttgagatggtatctcattgtagttttgaaatgagtttctatcatgattagtgataataaacatttgttcatgtgtttgttgtccataagtatgtcttcctttaagaagtatctgttgatgttctttgcccattttttattaggttgtctgtttcttgcttgttgatttgttcaagttgtttatagatcctggctattagacctctgttgaatgcacagattgcaaatattttctcccattctgcaggttgtctactctctatgggtccttttattttgcagaagctttttaatttaactaagtccctcttgtctattttttctttttgttggaattgtttttggagacttcatcatgaaatgccagagctgatgccagaatgatacgttttagattttctcacagaggttttatagttttagatcttaaatataagtcttcaacccatcttgagttcattcttgtatatggtgaaaggaaggggtccagtttcaatcttctgtgtatgactggccagttataccagaaccatttattgaatagggagtactttccccattgttattattgtcgaccctctcaaagatcagatgactgtaggtgtgtggatttatttccaggttctctaacttgctccattggtctgtctgttttcctgcaagtcccatgttattttggttactgtagacttgtagtatagtttgaagtcagagagtatgatgcctccagctttgttcttttggcttaggattactttggctattcaaactcttttatatttaatatgaatttttgaatacctttttctaattctttgaaaaatgtcattgctagtttgatacgaatagcattgaatctttacattcctttgatcgtatggccattttaacaatattgattcttcctatccatgagcatggaataattttccatttgtttgtgtcttctctgaattctttcagcaagtgttctcattgcagagattttttacctccctgattagctatattcctatgtatttcattattttgtggctattgtaaatgggcttgtgttcttgattggctctcagcttagatgatagtggtatatagaaatgctactaattcctgtacatagattttgaatcctgaaattttattgaagttgtttatcagttctaggatcttcttggcagagactatagggttgtctgggtataaaatcatatcatctgtgaaaagagatagttcaacttcctatctgaatgtcttttatttatttttcttgcctggttgctctggctaggactttcagtattacattaaataggagtggtgagagtggtgatccttgtcttgttccagttctcagagggattgcttccaccttttgcccatttagtatgatgttggctgtgggtttgccatagaggctcttattctgaggtatgttcctttgatgcctatttgttaaggggttttgacatggggagattttcaattttatcgaaagctttttctgaatctggtgagatgctcatgtggtttttggttttagttctgtttatgtgatgaatcaaatttattgatttccatatgttgaaccaagtttgcatcccagggataaagcctacctgattgtggtggatttgaattttgatgtgctgctggattcagtttgctagtatttggttgaggatttttgcacctatgtttacctgggatattggcctgaagttggtttttttttttcactgtgtctctgacaggttttggtatcagaatgatcctgccctcacagaatgagttagagaggagtcctccttcttgcttctctggagtagtttcagtaggatttgtaccagctctgctttatacatctggtagaattcagctgtgaatccatttcatcctgggctttttctggttagtaggtattttactactgattcaatgtcagaattcattattggtctgttcagggtttcaatttcttcctggttcaatcttgggacattttatggttctaggagtttatccattacttctaggttctctagtttctgtgcatagaagtattcataatagtttctgaggattttttgtattcctttggggtcagtagtaatgtctcctttgtcatttctggttgtgtttacttggatcttctctctttttttatttattattctagctagcagtttatcaatcttatgtattcttttaaagaacaaattttttgtttcatctatattttgtataaattttcatgtctcaattttgttgtattaagttctgatttttatttctcttctccttctagctttagcattagtttgctcttgttttctctagtttctctaggtatagtgttagattctcaatttgagacctttgtaacttgttaacatgggcttttagctctataaactttcctcttaacactgctttagctgtgtcccagagattttggtatatctttttttcattggttctaaagaattgtttgatttctgccttaatttcattctttacccaataacaattctggagcagattacttaatttccatataattgtattgttttgagatatcttcttggtattaatttccattgttatttcactgtggtctgagagtgtggttggtatgatttcatttttattaaattgtagagaactgctttatggctgagcatgtggtcaatttgtgagtatgtttcatgtgacaatgaaaataatgtatattctgttgttgttgggtagagtattctgtagatgtccgttaggtcctctggtcaagtcttgagtttaggtcctgaatgtctttgttggttttctcaatgatctctctaatactgtcaatggggtattgaagtctcccactacttttctgtagttatctaagtctctttgaagacccataagaacttgttttgtgaatcagagtgctccagtgttgggtgcatatatatttaggatagttaagtcttctcgttgaattgaatgctttatcattgtgccctttgtcctctttgatcaatattaaagtcactttgtgtgaaataataatgtgaaataacagcatctctgctttttttttttgttttctgtttgtttaataaatctttttccatccttttactttgagctatgggtgtcactgcatgtgagacgggtctcttaaagacagcatacagttgggtctttcttctttatccaatttgccactctttgccttttattggggcatttagcccatttaccttcaaggttatattgatatgtgaggacttgatcttgtcatcatgttagctagttgttatgtagacttgattgtgtaattgctttatagtctcaatggactatgttattatgtgtctctttgtaatggcaagtactgatcttctatttccatgtttagctctcctttaaggacctcttgtaagaggccttatagtaatgaatacacttagcatttgcttgtctaaaaaggattttatttctcctttgcttatgaagcttagtttggctggatataaaatgcttggatgacaaacaccgcatgttctcactcataattgtgagttgaacaatgagaacacatggagatgggggcggagggcatcacacaccaggacctatcagggggtgggggactaggggagggatagcattaggagaaatacctaatgtagatgacgagttaatgggtgcagcaaaccaccatggtatgtgtacacctatgtaacaaacctgcatgttctgcacatgtaccccagaacttaaagtataataaaaaaaaattcttggttgaaatatcttctatttgcacatgctgaatataggcctccaatcttttctcccttgtaaggtttcactgaagggcacactattaacctgatgcggttccctttgtattgccaaaagagcatcccaagagcctgttccatggtgtacccatattttttctggcaatggcaatgtactcaaccagctttgcttctgactcattctgatttggtgaccacaccaacatgccaagactgtcccagtcttggctgcatcttgccagtttggtggggttgaagtcagtcaccaccacctggtactggggtctgccccttatgccaccaccactgtgctccccatggctggacaagcccaaatgatctgccttcatcccaggaggttctgctgccattgccattgagatccccccctgccaaatttttattctggctattactgggagcagtggcagttgaggcagcagcagctgaggtgtaggtggtggcagtggacaaagatgtgggcaaggcatgggtggccaaggtggtagcagcagctgaggaggtggccaacatagctgtgttgttcctccctctccacttctctgagacctcagggcccttctccaccatgactggcatcagcaggggcaaaagtgctggggacccacagctcctgaggatggggtcctgagccaggaggagggaatgtgggtggacatggggtgggtgtggggccttttaggcaaagtaggagcccacaggtgcaagttagagctggggcaggcccagatgagcagagcagagcacagttgcttcaatctcccagtgccaaactgagcaattttggtcttatgaccactttcacttcattagtattcttttaactttaacccactatttaatggaaaaaattaaccatcaatccattttctcacaaatcaccttttagcatctcatatgactctagcattcatccataggctttaagaaatactggctttaggaagtactggcttccactgtagtcatgattttcctagtttgacacaaaaactattattcacatgctttcttaaaatacataaataaataaaaggcaaaaatgagctcttcattgaatcaactgaaccaaaatttgcgtagttcaataaagtttaaatcattccgaaaggctaggacacttaagtaataatatgtgagcctaaactattaattcgcagcataaattcatcgtggatcttatttccaaatataattaaaatatatctatgtcactgaattattctgttaaaaatattttaattctttttctttttcttttttgtagagacaatgtctctctgtattgcctaggctggtctcaaactcctagcttcaagtgatcctcctgtctcggcttcccaaagtgttatgattacacgcctgaaccatcaggcctggctagatattctaattttaatctgatgtacacacttctaggtaatgattcctaaacttagtgtttattagaattacctcgggtatttatgttaaaatgaaatttcctgggatccatatcaaagtttctgaatcagaattattgggtgtaagatgcaagactgtacatttttagcaaacatcttaggtaacacaaaaaattccatctctaaaactttattattacaggtgattgccagcatgagaggatttctctatcacagttccagaatgcctaagttcatctgcttatgctgattaggctcagtaaagtctagataagtccttcctggtgctctacactggaagaaaatatctttcgtctaccatttctgcttctttcacaatgacaaaactgcctaatgacccttttctcaaataccccattgttaagtgaagcattggtgtattgaagaaacaaaaacactgccaaatgtacccaggcagattttcgaaagaacaaattagaacatctagaaatattaaatgtaatcattaaagttaaaaattcacttgactagttaaactgaagattgtacatagctgcagaaataattaataaggtggaagatagtgctaatataaaaacttacccagaatgcagctcagagtcacaaagtaataagaaatataagagagacacaagaaacatatagcatattcaactacctaaaggaaagaagagcaagaataaaagagaggcaatatttaaagagttaatagtagagaatgttttcaataaatgcatcttaaatgaaaattatattctattgttaactctagggaaaaaagggaaatccaaaaaggagtattctgtaagacaataaatagtagcaaccaagtaacacaagaaaaacgtaaatcaaaagaatctcacaataaattaaaagggaattcatttggcatcaatacttggaacagcatttatgtacaaatcactttgtccccagcttgcagtattcaattatgataatgttttcacagttacttaaatcagttcttttctttcccatccactgcagtgtggttaggtcatccatctataatacaattaggttcatttcttagtattgatattcctttgtgggttcaatctatatcctggttagtgttgtttagtttggtggtgtgtgaagggtatctgaaatattactatagtaatatttccatattaccagattatttgaaaagatatactcagataagtatatcacatcctgctacctaaagcccactgcatcacttccttccatcctttcccacacaccctctgtgtataaataattttttttttttttttttttttgagacggagtcttgctctgtcgcccagctggagtgcagtgacgcgatctcggctcactgcaggctccgcctcccgggttcactccattctcctgcctcagcctcctgagtagctgggactacaggagcccaccaccgtgcccggctaatcttttgtacttttagtagagacggggtttcaccgtggtctcaatctcctgacctcgtgatccgcccgcctcggcctcccaaagtgctgggattacaggggtgagccaccacgcccggccatgtgtaattaatttatctggtttctgatatatcctacctgtatttccttcacacaaataagcagacatctgtgtattttttagatccccttatttcttacataaagagtagaatattatatttttcttttgagctttgctttttttatttgacagtgtgttctgaaaatgataccatatcagtctgtacagatcttccttattctttcttaacagatgtacagtactccatgtggatttgccatagcttatgtagttgctctcctacatatgaacatgtaagttgtttgcaattttttataattagaaaccatgctataatgaataattttctgcatatatatttttgttttattggagttatctctttaggatacattgctacaagaaggattactgggctgaaaggtaaatgcacctgtaattttttactaggtattgtccattttccctccagaagggttatatcaatttgcattgacatcaccaatatatgaaaatttctgtttctgcacagccttgcaaatagaatgtgttatattttttataagggaaaaaatgatgtctcagtgctatttacatttgtatttctctaaatgaaagtgaatttgagcatttgttcatatatttctgtgccacttttatttcttgtgaattttctgttcttatatttttcaaaaatttttattggcttttcagtcatttgtccctcagtctttaagacttctttgtatattaagaatattagccctttgtgggctaatatccagaatctacaaagaactcaaacaaatttacaaggaaaaagcaaacaaccgcatcaaaaagtgggcaaaggatatgaacagacacttctcaaaagaagacatctatggagccaacagacacatgaaaaaatgctcatcatcactggtcatcagagaaatgcaaatcaaaaccacaatgagataccatctcacgccagttagaatggaggtcattaaaaaatcaggaaacaacagatgctggacaggatgttgagaaataggaatgcttttacactgttggtgctagtgtaaattggttcaaccattgtggaagacagtgtggcgattcctcaaggatctagaactagaattaccatttgacccagcaatcccattacttggtatatacccaaaggattataaatcatgctactataaagacacatgcacacatatgtttattgtggcactattcacaatagcaaagacttggaaccaacccaaatgcccatcaatgatagactaaattaagaaaatgtggcacatatacaccatggagtactatgcagctataaaaaaggatgagttcatgtcctttgcagggacatggatgaagctggaaaccatcattctcagcaaactatcacaaggacagaaaaccaaacactgcatgttctcattcatatgtgggaattgaacaatgagatcacttggacacagggcagggaacatcacacaccagggcctgttgggcgggtgggggctgggggagggatagcattgggagaaatacctaatgtaaatgatgagttgatgggtgcagtaaaccaacatggcacatgtatacctacgtatcaaacctgcacattgtgcacatgtaccctacaacttaaagtatataatttttaaaaaggtaaaatttttttaaaaagaatattagccctttgcctgtggtacaggttaagagtattttatttatacatcagatgtccttaattttgtttatggtgttagttgtcatgcaattggtagtcaaatttatcaatcttttctttcgttttctctagaatttgagtcatagtagaaagcatttccctgtatcaagatgaaagaggaattcatgcatgtttcattgttgtacttataggatttcatttcttatatttagatccctaattaatttggagtgaacttttgtgtatgatgtgagatatggatctaattttatctttttcaaattgctacacagttatctcagaaccatttattaatggttgactgaattctacttgactgaattcttttcttgttgagttaatcattgattctctgaggtagaaggtatgaaaattttgtggctttttcttgtttgtttttgttttgttttgttttgttttttgagacagagcctcactctgtcgcccaggctggagtgtagtggcacgatctcagctcactgcaagctccacctcccaagttcatgccattctcctgcctcagcctcccgagtagctgggactacaggcacctgccaacatgcctggctaattttttttgtatttttagtagacacagggtttcaccgtgttagccaagatggtctccatctcctgacctcgtgatctgcccgcctgggcctcccaaagtgctgggattacaggcatgagccaccgtgcctagctgaagtatgaaaattttatgtaacagtgtatcatctgcgagtaaagacagttttattgtttcacccgttcttgtgcctccaattgatttatcttgcctaattgcattggctgattaatctagtacaatgcttaatagtagtgaagatagttggcatctgtaccttagtcccgatcttagtaaaactgccactagtgtttcttgattttaaaacatacttgttttaggacaaaacaatcctaaaattgtacttttaggacaaaagtacaatcatgcatcatttaacaatgaggatacattctgagaaatgtgtcattaggtgatttcatcattctataaaaatcatagagtgtacttacacaagcctaggtgataaggcctgctacacacttacactatatggtgtagcttattgctcgtaggctacaaacctgtacagcatgttattgcactgaatactgtaggcaattatagaacaattataagtatttgtgtatctacacatacaaaagatacaataaacatatggtaaaaaatataacaaatgagatatctgtataaggcccttaccaggaatggagcttgtgggactctgatgagtcaatgagtgagtggtgagtgcatgtgaaggcctaggacattactacacaccactgaagacattataaacactctaaactttggttacactaaatttatatttaaaatacttttatttcttcaataattacattagcttaatataacttttttgctttctaatttttctaattttttaaacatttttactctgttgtaataacacttagcttaaaatgcaaacacattgtacagtggaacaccatgttttctttctttatatccttgtttgttaagattttttctaccaattttttttttactttttaaactttttttgttaaaaactaagacacaaacacacatattagcctaggcctatatgaggtcaggatcatcaatgtcactgtcttccacctgcatattttgccccactggaaggtgttcaggggcatggagctgtcatctgctttgataataatgccttcttctagaatacctttctgaaggaactgcctgagacggttttccaggtaactatttttttatataagtcaaaggagtacactctaaaaaatgatttaaaagtttagtacagtaaacacataaaccagtaacacagtcatttattatcattatcaagtattacgtgctgtgcataattgtatgtgctagacttttatacaactggcagcacggtaggtttgtttataccagcatcgccacaaacgcatgagtaatgcattgtactatgacattacaacagctacaatgtcactaaataacagaaatttttcagctccgttataatattatgggaccaccatcatataagtgctctggcatttaccaaagcttaatatgtgtatgtaaggtgtgtaataaagtaataacatacatgtataatatatgtaatatgtagaaatatactaacacatatgtatctaatgcactttttttatctactatgactgtgtcctcagttggctctctaaaaagtagttctccctaactttaatgctgtttcgtaatgtgagttttttcattactattctctacctttatatgtcaataaattttcaattcctctaatatacagtctatattcaaattgccctaactgtctcaaaaatgtcatttgaatggctttgtccaaaccagtacagaacccaggtttatgtattgcatttggttataatatccattgtgttcttttaacccaacacaattccattatttcccattttttcccaggagacagccttgctgaagggacaaaactagtagcccttcagtgtgtcttaccttctgaatttgtctaactgctaccagagtgacactgagcttgtgcactctctcccctatatttcctctttgtttatccctccctaaactagatggtgaacttttaatggtccaggattgtgacctgttcatttttgtatttccagatttaataccatgcctgactcatggtcaagttttagtgtctttttttaattaaataaaatatgtattgaataaacctgtgaaagagcagtcattgctaaagttaccagcaagccttggcatttttttcagcttattatgacctaaaaagttcacttatgtgtgcacacgttctctctctctctctcacacacacacacgcgcgtacacgcacatacatacacacacacacacatatacacactagaacatatcatttgaaagtacaaaaagagagtgatgatgtatggtttttgaggaaggcggaacctgatagagcagcgaggaaaaccttctgaagtgcaatgataatgacagtgattatacagtgtaaatgttgctattaggtgagcaacagggagtgttttcttggcaaatgggctttgagcgtaaatgtttccagaaatcatacatcatttcagcaaagaaaattaggatacagatgcagaatggaagtaataagccactcaatcacagatttgaaaaagtggatgtgaaggaagttaatttttaaaaacaataatagcagtatcttatgtttataaatataccaggcagattagtaagcacccaaaataatcatcttgagacctgattctagttctccccccattgtgtgttactttcaataaagcattttacttctttgtacctctgtccacctataaaatgcaaataatacttgctattgtcttaagtagacctgttggcttcctgaatctgatcaatctcatcatccaaggcaatgaaaggaaggtcttcttatggggcatcttggtcttaggccccagttcttagctcctgagcttcaccttttctatgagactttctcaggtgactcatagagattgtccctaattgccatctcaaaaactcgaggcttagttttgttacgggaattagagggcttctttagagcctaatgacggacagaggcagaaataaagcccaacataaagatacgtgaaattcatttcaatagaatttatatgataactacttcatataaagaatttatgatataaattctattctcttgcccatgactaggctctctgaacttttattcagtaaaaactgtttccactgtagtttcttttatttcctatttagattatattatgcaatattgcttattctaataagacactatacaaagtatagtgatctatcattttgattgtattttcataatttctcaaactgccttccaggtgttccattatggatcctacaggctatattttataacttgattgatttgcttctcatttttatttagtattgctgagttggatttcccttaaacatgtcattaaatgtttttcaattcctgcttactcttgttttttttcaaacttcattacttcattacagaatttattttaaatcttagagaaaataaaaagttgatagtaacaccatatgctacacactgctcaagacagagcaataaagttcaaatcaaatacataattttaaacaaaaaaaaaacagcaaaatactgtacttaagtagaataggtagtaactcaatacggttggtttctatactccagaaagtcaagtaaataaaatatctcccattatgtcaagagtaaagaagcacattgagggttgaagtacaaaagccaacactgtgaaaatagaccatttcaaatcattatgcacacggtctcttcattcttgttataaatcatactaaatattgccaaaattcatcttggaagttgcataaggatcattccttagaaagatatttacagtaatcaatagcttttgtggaagtatggcatgtcttggtgctccttggggcacaatattgcttaattctccaaagggagaacccccgactccccaattcaaaagaacaggcaagtacatagggtgtggcttgatagtgacgttaagaagaaaaggaaatttacacattgttgaaccactaccagatgtcaggtagtacatagttttacacatattttttattttgaatttcacaacaaccctctgagaaatctgagacatacagaagttgaggaatttgcatgatatcacacacctggcagaaatggaaccaggattcaaattaggtctgtctggaaagtccattatcctttcactgggccatgctgcatggctgcaagacctttcatattcccataaaatacatccttaactggtctgcctaaaaagcagcaatcatccctctttcatccctctttctacttgcctgaaattattacccccattagcctgataataggatcaagatgacaggttttagaaaaattaccattgagaattgttaccccaaagagcacagctgcatgcctttgtgttgccttctccagagcaaaagttagttgatcacatatgataactattgctttaaaaaaaacaaacgccaaatctggtttgtgtgcttcgacaaatgagattcatggtgttacagggaagaggtccctatccagaccccaaaagagggttcttggatctcgtacaagaaagaattcagggcgagtccacagtgcaaagtaaaagcaagtatattaagaaagtaaagtggtgaaagaacagctactccatagacagagtaggacgttcctgaaagtcagaggaggaacgcgtccaccttaggtacgatgcttgtatatatgagatgtgctctgctacaagggtttgtgataaaggattaattttctttctttttttttttttctttgagacagagtctcgttctgttgcccaggctggagtgcagtggcgctatctcggctcactgcaagctctgcctcctgggttcacgccattctcctgcctcagcctcccgagtagctgggactacaggtgtctgccaccacgcccagctaaattttttgtatttttagtagagacggagtttcaccatgttagccaggatggtcttgatctcctgacctcgtgatctgcccgcctcggcctcccacagtgctgggattacaggcttaagccaccgcgcctggccaattttcttaattactatattttgcaataaccgatattattgtctttaaagcaaaattaagaatgcctttgttctccagaaatcagaatacgtagacactcccaagtctgggtctgtttagtaagcactattaatttgttcccttaaccgtaaacatctagaggcaagaaatgtctaactttctgagaatgcagcccagcaagtcctagcctcattttcctagccctcactcaaaatggagtcgctttggttcaaacgcctgtgacaatgggactgcaataagatgttaaaaacagtaaaggacatcacaaagaaagggcaaataatggtgaggcatccattcccttaacaggtgggaggcgggaagtagtcaatgaatggagaaggcagactgagggtcaggatttgtagaatggggttgtaggcaaaaggacacagccaggaaatatggaagctctggccaagggtcaggataaagacttcacagaagtagagaaaggaatcataggtgggacataaaaggaaaatgcaaccacacataaaaaggaatttcaaatcaccattgctcacctcaaaatagtcattccaaaagtcaaagaaacaatatagatgtatgtatgtataatgtatatattcttgttccactttgccacttttgggggtgcagaaaataatcacccaaattatgacatttgggcatgctgagtgcttttgaaaaccgaaaggcctcagaaattagtctcagaatcatgctccccctaagcttgtcttgtttctccccctgaagcacagggaggggctctctctggaattttctaatctggccaagaaagcttcttactaaaagaaacacaagcgccttctatccactccctgttatctgattgcagaaaataaaacaagaaagcaaccagacctggatggactttttagcaagacaatgcctgcctgttgggctcattcaaattccaaagaaaattatttacaaattaatttctgtctccttggtccattcattctttctagtaatcatttactgtatgtcaaaaaactgtcacatttcccctctcctctgtcccctatataaaagggtatataagcttctgtactctactgggagattgaggtaatcaccatgaactcccccatgatgttaattaatctgtatgcctttttttcctattgatctgccttttgtcagttgattttttagcaaaacttcagagggcaaaggggaagttttcccgtgtctcctacataactattgactttttccccctatcaagggcatggtacactaagaggcactcttttttttttttttttttttttttgagagcaagtctcactctgtcacccaggctggagtgcagaggtgcaatctcggcacattgcagcctcgacctcctgggtttaagcaatccgctcacctcagcctcccaagtagttgggactacagactcatgccaccacacttaacttttttttttttttttttttttttttttttttgagacagagtctcgctctgttgccaggctggagtggagtgcagtggcacaatcttggctcactgcaatttccgcctccctggttcaagcgattcttctgcctcagcctctcaaatagctgggactacacgcgcatgccaccatgcccagctaatttttgtactttttagtagagacagggtttcaccatgttggccaggatggtctcaacctctttattttttgtttttatttcttttttttgagacagagtctcactctgtcacgaggctggagtgaagtggcacgatctcagctcactgcaacttcagcctcccaggttcaagtgattcttcagcttcagcctcctgagtggctgggactacaggcccgcaccaccaagcccagctaatttttgtactttcttagtagagacagggtttcatcatgttggtcaggatggtctcaatctcctgacctcgtgatccgcccgcctcgacctctcaaagtgctgggattacaggcatgagccaccatgcctaacataagaagcattctgaatttatgatcagaagttataccaaggcatttagcagccaaccggcattttaaattcaatgccccaaactgaagttattatctctttcccccctccatgattaccccaaaatagcaacctaactttcctgtactttcctttccttggagataaaattctcattgaatagtgcaagccagaaatttaggagtcattccagattcttttgtctacctcacatttacatccagtcaatcactaagttctgtcaattatatctctaagcatctctccagtcatcccttcatctccatccccattagtatatcttgattcacactcattatttttcatttaaattattataacactgctgacagtattctttctaacatgcaaatttgattaatttacttcccctgtttaaaaatcattgagttgctcatgtaaaccaaaaataaaattctaagcccccaaccaactgaatggactcctcctctcagccaagggcattccaagttaaccagaaacaccagttcaggccatgattggaatgggtggttggacatgcctctttatagctttctttctttggaattcaggctcaactgaccagcattaacattaaaacagagaccttaactctaactgagcagactgtttgtagataaacaaatacaagcatgacagacagcattaacattaaaacagagaccttaactctaactgagcagactgtttgtagataaacaatacaataaaatacaagcatgacagacagcagactctgaaagaaacaccaaaagaaacactaagtgccttctatccactacctgttacctcattatttatagctgaaaagaaaactaaagaatgcaaccacacctggatggacttttttttattattattatactcaaagttctagggtacatgtgcacaatgtgtaggtttgatacataggtatacatgtgccatgttggtttgctgcacccaacaactcatcatttacattaggtatttctcctaatgctatccctcccccagccctctaccctccaacaggccccagtgtgtgatgttccccaccctgtgtccaagtgatctcattgttcaattcccacctataagtgataacatgcagtgtttggttttctgtcattgtgatagtttgctgggaatgatggtttccagcttcatccatttccttgtaaaggacatgagctcatccttttttatggctgcatagtattccatggtgtatatgtgccacattttctcaatccagtctgtcactgatggacattttggttggttccaagtctttgctagtgtgaatagtgctgcagtaaacatacgtgtgcacgtgtctttatagtagaatgatttataatcctttgggtatatacccagtaatgggattgctaggtcaaatggtatttctagttctagatctttgaggaatcgccacactgtcatccacaatagttgaactaatttacactagcaccaacagtgtaaaagcattcctatttctcaacatcctgtccagcatctgttgtttcctgactttttaatgattgccattctaactggcatgagatggcatctcattgtggttttgatttgcatttctctgatgaccagtgatgatgagcattttttcacatatctgttggctacatagacgtcttcttttgagaagtgtctgttcatatcctttgcccactttttgatgcagttgtttttttcttgtaaatttgtttaagttctttgtagattctggatattagccctttgtcagatgagtagattgcaaaaattttcccccattctgtaggttgcctgttcactatgctggtagcttcttttgctgtgcaggagctttttagtttaattagatcccatttgtcaattttagcttttgttgccattgcttttggtgttttagtcatgaagtccttgcccatgcctatgtcctgaatggtattgcctaggttttcttctagggtttttatggttttaggtctaacatttaagtctctaatctatcttgaattaatttttgtacaaggtataaggaagggatccagtttcagctttctacgtatggctagccagttttcccagcaccatttattaaataggcaatcctttccccacttcttgtttttgtcaggcttgtcaaagatcagatggttgtagatgtgtggtattatttctgaggcctctgttctgttccattggtctatgtctctgttttggtaccagtaccatgctattttcgttactatagccttgtagtatagtttgaagtcaggtagcgtgatgcctccagctttgttcttttggcttaggattgtcttggcaatgcaggctcttttttggttccatatgaactttaaagaagttttttccaattctgtgaagaaagtgattggtagcttgatggggatggcattgaatctgtaaattaccttgggcagtatggccatttgcatgatattgattcttcctatccatgaggatggaattttcttccatttgtttgtgtcctcttttatttcgttgagcagtggtttgtagttctccttgaagaggtccttcacatcccatgtaagttgtattcctaagtattttattctatttgtagcaattgtgaatgggagttcactcatgatttggctctctgttggtttgttaatggtgtataggaatgcttgtgatttttgcacattgattttttatcagtcaaactttgccaaagctgcttatcagcttaaggagattttgggctgagatgatggggttttctaaatatacaatcatgtcaactgcaaacagggacaatttcacttcctcatttcctaattgaataccctttatttcctgctcttgcctgattgccctggcaagaacttccaacactatgttgaataggagtggtgagagagggcattcttgtcttgtgccagttttcaaagggaatgcttccagtttttgcccattcagtatgatattggctgtgggtttgtcataaatagctcttattattttgagatacgttccatcagtacctagtttattgagtttttagcatgaagagctattgaattttgtcgaaggccttttctgcatctattgagataattatgtggttttcgttgttggttctgtttacgtgatggattatatttactgatttgtgcatgttgaaccagcctcgcatcccagggatgaagcaaacttgatcgtggtggataagctttttgaagtgctgctggattcagtttgccagtattttacagaggatgttcatatcgatattcatcagggatattgggctaaaattctctttttttgttgcgtccctgtcaggctttggcatcaggatgaggctggcctcataaaatgagttagggaggattctctcttttgctattgattggaatagtttcagaaagaatggtaccagctcctctttgtacctctgatagaatctggctgtaaatccatctggtcctggactttttttggttggtaggctattaattattgcctcaatttcagagcctgttattggtctattcagggattcaacttcttcctggtttagtcttgggagggtgtatgtgtccatgaatttatccatttcttctagattttctagtttatttgcatagacgtgtttatagtattctctgatggtagtttatatttctgtgggattggtggtgatatcccctttatcattttttattgcgtctatttgattcttctctcttttcttctttattagtctagctagtggtctacctattttgttgatcttttcagaaaaccagctcctggattcactgattttttgaagggtttttgtgtctctatctccttcagttctgctctgatattagttatttcttgccttctgctagcttttgaatgtgtttgctcttgcttctcagttcttttaactgtgatgttaggattgattttagatctttcctgctttctctggtgggcatttagtgctataaatttccctctacactctgctttaaatgtgtaccagagattctggctacagtaaccaaaacagcatggtactggtaccaaaacagagatatagaccagtggaacagaacagagccctcagaaataataccacacatctacaaccatctgatctttgacaaacctgacaaaaacaagaaatcgggaaaggattccctatttaataaatggtgctgggaaaactggctagccatatgtagaaagctgaaactggatcccttccttacaccttgtacaaaaattaatttatgatagattaaagacttaaatgttagaccaaaaaccataaaaaccctagaagaaaacctaggcaataccattcaggacataggcatgtgcaaggacttcatgtctaaaacaccaaaagcaatagcaacaaaagccaaaattgacaaatgggatctaattaaactaaagagcttctgcacagcaaaagaagctaccatcagagtgaacaggcaacctatagaatgggagaaaatttttgcaatctacccatctgacaaagggctaatatccagaatctacaaggaacttaaacaaatttacaagaaaaaaacaaacaaccccatcaaaaagtcggcaaaggatatgaacagccacttcttaaaatgagacatttatgcagccaacagacatgtgaaaaaatgctcatcattactggccatcagagaaatgcaaatcaaaaccacaatgagataccatctcacaccagttagaatggtgatcattaaaaagtcaggaaacaacagatgctggagaggatgtggagaaataggaatgcttttacactgttggtgggagtgtaaactagttcaaccattgtggaggacagtgtggcaattcctcaaggatctagaactagaaataccattggaccgagcaatcctattactgggtatataaccaaaggattataaatcatgctgctataaagacacgtgcacacataggtttattgcagcactattcacaatagcaaagacttggaaccaacccaaatgtccagcaatgatagactggattaagaaaatgtggcacatatacaccatggaatactatgcagctataaagaaggatgagttcatgtcctttgtagggacatggatgaagctggaaaccatcattctgagcaaactatctcatggacagaaaaccaaacactgcatgttctcactcataggtgggaattcaacagtgagagcacttggacacagagtgggaaacatcacacactggagcctgtcatggggtgggaggaagggggagggatagcattatgaaaaatacctaacgtaaatgatgagttaatgggtgcagcacaccaacatggcgcatgtatacatgtgtaacaaatctgcacgtcgtgcacatgtaccctagaacttaaagtataattaaaaaaaaaagaaattccttaataaaaaaaaaaaactaaatcataatagagtcactgcagtatttcacttggaggaatcagatgtatgcctaggtcctctcgcactattcatttttttctatgcctcatctttcgtgccccactaccctatatctccacaaaataaaggagataaaaaagtgatttccaactttcaatcttttagtatcatagcagttttaagccaaaaattatctcatgtctttgaataatttcaagacataacgtaaaaattgatataaattaaaactaacttaaaaaaatgatttaagtatttattgtctcctatacaccaaccacactcatcagatattacctacatttatttatatatataatcactcaaaactcagatatacgacagtcactctcctgcatgagaagaacaaaggggaaggcctataaattttcacaatgtcaccttcttataaagtcattatttccttccccttgttcttcaggggtattccaagtctccagctttcacaattcctgggtcttatctcatgaaggagccaatacattttttttttcatgatagcaaatgtgccacatctatcatctgatttggatctaatttatctgagggttgaatatcatcttgatctttggtttagtacttggtatgctgacattttgttgagaaactgccaaatcattaccaggagcaccacatttgactgatttccaacgtcactgtttctctctctctctctctcacacacacacacacacatacacgcatgtgcacacttacccattcttatgaatattaatttttcaaatgcttttttggctggtcttccccacatttcacatatatcttagaacagaggaacagaagacactacaaaagtgaaagataattaactcttgtctcttcgtttcataaattaaaaaaaaaacagataacatttcttgccaaaggattatagcccagtactttggatttttagttttaaaaatttgtgacatcatgctattttgttttttgcacatttttggcaaattttgacaatatattttctatttataatatgccatttaataaatcaggctttaatgttataatacatgaaatttttgtggtatatacacaatttatactaaatagttcagtgctcagcacaagaagatgatcaattgatcagttgattgaataaaagattgaatattcactgagttttcattatgtgcaaggtatttttctaggcataaaagatttgattagcacttttattgaaattaaatcaaatatatggaaaatgatctgttaattactttaaaacatttttaaaatgagtgtggggttttctggattattatccattattttctttatattttactttcttttttccaaaaatacctatctttttaaatgacaatcaaacatactccctgtgaatttaatatattaaagaatacttatcaagattcttcctaaattttgattagtcagttgctcatgtttaaaagaaataaatggtctaatcaactttaaattatactaggtttctcataacagctttgttgctgataagaagcctagttgagatttatgtgtttaacaataaaggaaaagctgtacttttgtttgaggcatgtgctttaaagacaaaaggactaattttttatttttaataaaatgttaatgaaaatttctagatagtccaatatcaggcatcccaagctccagcaaaggctggataacaatatatataaccatatatataggataacaatttcccatgattccttgttaatgtggccctgtttgctatccaagactaagagtttaatctccaagtcgaatcacccttgggtttcctctaaaaacaaaattgctcaactagctaatgagattgtccttttccaacatttgtcagctatttactgatctacctatctgcctttgagaagctgggctgtgatccatcttgcacagatcaccaaacacccaccaaagggtaatagctttagctctttagacccagagcttagagatgaaagaatctgaatctcattttaaactgcctgaactatccatttaatcagattaaagccaatttcatattgcacataaaaagttataagaaaaagaggcagaagagccacagactctccatttgttgcctttttctgggaaatcattctctaaatacacagtcttcatcttcagctgctatagctcatagtaattccatattctttttttactcctgcttatacaatgcccttgctgaataatttttcctcttcagaggcatttttgcctttaacacagtatgatactttatagtctgtttacttcaaactgaggagtaacagaatttgtccttttttttttacataatgatgaggaaagggagtcacacttgatactgagagttgaaaatgtaaagtgaaaatgcaagctcctagagtacaaagaaatatttatggaattattatgagacagagatccaattttgataagtctggtatagacctattatagtgagacattcaaaacaagagaaccacaaactgtgttcacttacaacaaagaatgatatgaatttctacagcagcattttattccttgagcatgtactagtccattgatcagtcaatgatctcaagcttttattttttcatatttacaaaagaggtagaattcttgcttttcagtgtatgagctccaagagggcaggaatcatgtctactttgtttactacagcatgcccagaaagaaacagtaggtaagtagatagatagatagatagatagatagatagatagatagatagatagatagagatgatagacagacacacactctttcattttgctcagtgaaaattgtttcacttattccacccccactcctcaacagtgtgtttccagaatgtggttaaaaggcttaggaagcagaatattttactgggaagcttctgggttcttatgtcagtcaaacctaagtttcaaattcatgtatataatatttggcaatttacagaacttaattaggcctgtgtctcttatagaaatggcaccaagtaggtgctcaataaattgtaactattagtactttttaaaatgatttttagaaggtgaggacaggaggagaagcaagtcacagagcagcctgcatttccttttcactatgcatacctccaaaaagataaggtttgagagcaacctatcagattcctttcaatatcctctttgtgtgtgtgtgtgtgtgtgtgtgtgtgtgtgtgtgtgtgtgtgtgtgtgttcatgccattctcctgcctcagcctcccgggtagctgggactacaggtgcccgccaccatgcccagctaattttttgtatttttagtagagaagggttttcaccgtgttagccaggatggtctcaatctcctgacctcgtgatccacccacctcagcctcccaaagtgctgggattacaggcgtgagaatatcctctctcctttaagtagttggaggtggcactgttgtaattgtttttattcttatctatgactacaagtcttctgatctagtttgctggcttcctcttttcctgacacttaaaagtcaatagtggctaaatttattattcagccaaaggttatctttcttgtaagaatttggaggctaatatggctactatatatgtacaatacgccaggcactgttctgaattatatatatatatatatatatatatatatatatatatatatatatatatatatatattttatactttaagttctagggtacatgtgcacattttatcctcatgacaactgttagaggtgaatgttatattgctcttcttcctctcaatttgcagatgaagaaattgaagaacaggaaggataatctatcatcacaaaactagtaaacagaagtattaggattcaaatcaggcagtctgcctccaaattctacctatgttctgagctactatgctagaggttatctccaagaacttagaaataaaggaaaaggatcagcctctgagaattaaaccctaagatggtgattaagagattagaaaagaaatatggaaaatcgcctgaaaaacaaaaaaaagaacagaagggaagaagagaagaaggaaaaaaatgacttttcaaccatggcacctgactgtaaacttttttaaaaaaatagttggaatgaaagttattagctaacaagacatttaaaaagaaatcacagaagtagatactgggatttttcacttcaattacatggtgttcatattttgacagacaaccacagctccctcactctctgtgtttactctctttctaccaggtttcccatgtggctttcaacttaaataacaccctctacaagcagtctgcactgactaatccagatcccagtcttttcctctaattttccatagtatttaaatctgggctgctcatgtatttacccattcagacaacaaatatttgagcactgaaccatgctctaaaaattattgcaatattcaaaaccagagataatgaggtgctgaaccagggcagtgaaagggatgctgtgttcaagtgttcaaggcaaagactataaaatcagagccagtataatttagcacatgctatatattgtcttgcagtgttccaaattgcttcaagtgttatcaataatgtcttctgaaccagatgtaaacttctagctggaaccaaacactgaatcttaaattctttcaaatactcagaatagtgtggcaattagtagatatctgataaataattgcttattgaatgtacacagatacaacttaaggagccattacccttctctttataagacaatggtagattttaacaacttcttgttggcttcctcagtttaaaacaaaatggcatctatttcctcacagctaattactttttttctttatcttacctaagtttttttctcttcagaactcactactctgcgctttatctaaatttatactagatttgccatttgttaatataagaaccaaaaatttaaaaacctccaggaatgcaatttcagcaaattatttagtgaaaagcagataaagccttgatcttccctagactatgcaaagacattgttatcacacgaataatttacacagtctcattaagttggcttttaacctcatgtcccaatgggtggagttcacttcagattctctaatgaacacatcttcaagctcaagatagctcaatgctcagtggtaattaggattagatgaatggaagcaatccgcttcattcaacatatgtcttcactctataaaattccaccaagtataagaagattaatttaagcctacctttcaaccagcaattaacaaaaacaaaccataagttctcaaccttaaagggaaaaataattgtattttcagagatcagagcaagataagaataggaaaaactactttactaaaatctataccctttcaatatcaagctggtcattataatttgttcaagaaacatttaatcacaaatctgatgtgtacatagtgctatgctgagcactgtgggagaaataaagatcaataagacatggctcttgcccttaagcacctcttaatcaactagaggtgatatgcacaacaaataattgtttaacatggttgtaattatgctgtagtataattagagagctgacagttcaggcaatgctctttaataagaaacatgatatgacagcaaacaccataggggagggcgcaacaacgtgaacaaaacaataagaaactcaatgactgttaaagtagggtggtgaaggagtactacagaggagtagaatacattatagcacaaaaaaaggaagaggttctccccgtcacacacaaaagaaaagaagatttgggtgatgagacatgatcatgtctaaagaactatcgtgtgaaaaaaatggtttatataaccaagtgttctccagaggatggagcttacaacatgagaaaaattatcagagagactcattctctctatactcagctcacacaccctgcatactcagggcgtgtgctgaagcagagcgaaagattacccacaggcattatacagatgatccctgtgctgtgtgaaggattcagttggacggaaaagtcctctacaattcaaaactcctgtggtatgatttttaacacacttgtcagcggtttctagttgtcagtttagaaaacaagggttttaaaataaaagtacgcaatacactgtaacaactgagaatataggctgtaatgtctgaaaggcttccattcttctaatcactaggtgtgtaactttgagtgtggcttagcctttttgtgcttccgtttcctcacctgtaggaggagaataatattagggcttaagtcacataattgttcttaggattaaatgacataagacatgtaaaaagcctagcacaatgttctgtaagcatttagtacatggtaagttttgttattagccgggtcttaccttcactactattcttctacaacccagttcatcctcctcatagctgtaagtcttatttttgcttagaatcagtcagggccacctcttcactggagaatgctgtcctaactgattagtttggtctgatcttctccgtggagtcttatctttgacttttatcccaccacacaggaggctccttccaaattgcttccagttttaaattaccaggatgcttcaaactttgctcacactttcaactttactggaagtgtcctccccttctcccaagctaagagtgattcaacttcaaaattctcttccaggacgcccttctcaataaaatctctcctggtatcaacataaaattgaacacagaagaagtcttcatacaagtgaggaaatgaaagctcagaaaagttaacttagccaaggtcaccaacttataaatgactacagtggtaataatagtagtaatagcaaaaataccttacatgtatagagagtctcattgtatgtaaagctcttccctatagtatttcattgtatttttacagctctatgaaaaaaaaataaaatcttcttcttttttatggatcaggaaaacagagagtctgagtgacttgtacaaggtcacacaatttgtcttgttaaaggcacagtcatgccagatcccagaccccagattctgttattcttggtccacaaacttttttctttagacaaagtctcactctgtcacccaggctggagtgcagtggcacgatcttggctcactgcaaactccgcctccctggttcaagcaattctcctgcctcagcctcccgagtagctgcttattccacagacttttctatttttttttttaatttttatatacttagggggtacaagtgcagatttcttacatgcatacattctgtagtggtgaagtctgggctttcagtgtacccatcacccaatactgaacattgtacccaataaataatttttcaaccctcaccccctcccaccttttggagtctccaatggctattattccactctgcatgtccatgtgtacgcattgtttagttccctcttgtaagtgaatacatgtgatatttgactatctgtttctgagttatttcagtcaggatcatggcctccagttccatccttgttgctgcaaaagacatgatttcaggactttttatatagctgagtagtatccacagcatgtgcgtatatacgctgttttggtcactatagccttgtagtttaatttgaagtcagtaatgtgatgcctccaactttgatcttttagctcaggatttctttgtgtatttgggctcctttttcgttccttttgaatttggggattgttttttctaattctggggaaaatgacattggtaatttgatagggattgtgttgaatctgtagattgctttggacagtgtggtcattttaagataccgattcttccaatccatgagcatgggatttttttccatttgttcttgtcatctatgatttagttctctttttttgagacaaagtcttgctgtgtcactgaggctggagtgcagtggtgcaatcatggctcactgcagcctcgacctcccaggctcaagtgatccttccaagtagctgggactactggcatggaccagcacacctgtctaatttttgcatttttgtagagagggagtctcactatgttgcccaggctggtcttgaactcctgggctcaagccgtttcccaccttgggcaccccaagtgctggaattatacgcataagctatcatgcccagcctcctgtgatttgtttattttttgtagttctacttatagagatcttttgcctccctgatttaatatgtccctaggttttgtttgtttgtttgttgtttgtttttgggttttttgggtagctattgttaatgagattgccttcttgatttggtcctcagatagatcactactggtgtatagaatgctactgatttttttatgttgattttgtatcctgcagctttactgtattcatttatcgaatctcagagtttttttggtggagtctttagagtttcctagatataagatcatatcatcagtgagcagaaataatttgacttcctcttttccaatttggatgcctttttttttatttttttttaatgcctgattgctctggcaaggacttccacagacttttctttacaaaacatgccattttgtaaataagtgaaattattccttttagtaaataaatgaaattattccttttttatctttgacctctcagggatgatatttttcttttttgaaattattgaataaatgaaaaaacaaaaatgactcaatttattttgttgatactgagtatcttattctaaaactttgagcatgtcaaggacacaggaataaagttgaggagcagcctttaataaaagcaaaattttctctctaaaaattactgagctaactgcaaaagcatcactaatttgccaggactaaaggtagagctggtttaatgacaggcatagtaacaaagcttgcacacactgtcacagaagatgcaaaatttcacagttaactaactagattgaaccttaaaacaattagtgaacaaaagagtgttgtgatttctggagcagtggggttaggagtcttcggcaagtaccaaattatccacacagtttacatattttagaacatctgaagagtaagtgaaaccatcatggtatttactaggcacaaactgacttatcaattaaatgcaatgtcctactaagaagaaatacaggaaatgcagagactgcctctgtgcgtaatcttctataaatttcccaggagtttttagtaagctattctcctattaaggaagctgtcaaacagctagaataatgaaggggaatggaaaggaaaggaggcttgaacagatagaggaagagtttttgaaaaacaaacaagtctctaaaatttacattaaggatgacgatttcttctaattgtaggaagacatctatggttaactatgttgtctaatattagtaagaaacttgagttatttatctctgccagataatacacagacattcatctagctaaagttctaaattagcagtgcctaacatgttgtaggagctcaatctttgaaaataaataagagaaaggaccaatttaatcctgaaggttcactgtgaatggtaaatacatttcaaaaactatattttaccttttaagtacctactatgtaacagacatcatgctaggatctagtcatttggaaaaaattttaagtgctttggcattttaatgttcataagacatggaaatgttcattcatcttttcatatagttgtcaaagtataacaatggttactgaggataaattcagagtccctcttcccatgcaatgcagggaaattatagtttgtatattacaagttgacagcatcatttctcatatggtttgcaggatgattggttcataggattaaagtgggtctagtcttttccagtcttaaaacaaaagtcatgtttcctattattaatagaagatttgtcagaaagtatatataattgtattagcagttggtgctgaagaccaatgttctacagatgagctgggttataacaaggttctttcatttctgcagtaataagcaccttggctgaggtccagctatgtttctacttatagaaaaaaaatcactaatgcctaaaaatataggtatttgtatcagtatctagaatgatcttgttaagatggtgtagcaaacactgtctatgcccccaaccatattccttaggccttactattatggtgcaagccagacttccaaactgccttagggctttttctggagctaaagtccactctgccagtatgcagagcagactggagtaccagggaatcaagagatactccttcccactaagaagcagcccttaactaataattgacagggattagtatataataaataccctagctgcttcgtcactgtgggtgacagagatataattaattgaggctgactgattctacactgacacatggagttgccagtgagattaaggtactagcttgttaatgcatcctttattagctaccttaccttccctgccttttttccttactgcccttctgatgctttctgggatcatctctgaaaaaaaccatttaaacataaatgtgaatacttgtttgggggcctcttcttggggaacataaactagacagaattgttaagcccttataatattcattgttactgactttaatagtaatacatttagtgttaacaattccatgaagcatgacatagaatgtgatttcagatagattttcaaaatagctttaaggaaacattcttttaatttagttttatcacatagtttttttgtttttccctatccttctgagcttttttttttggttcagagttggtacattgtttaaccaccatgtatcaccaaaaaattataaaggtgcttccatctcctagagaggattagaattatagacgggggcaagaaagaatgccagtcatactttaatctgggaccctcaccctacagacaaaaatgtaagaatataaggccaaaaaacatgaaataagtttcctaacaccatacagctggtcaattatttagtcacaagaattgttgtttataaaaatctaacttaaaaaaaatcattagcaaacctaggacggcatcccaccttgctgactctcaggagcggctctttttgtaatactatcctaaatagcatccttctttgtgcaggtaagattaatggcaaagggtatcccagaaaacaataatgggagagaatgagaagatcacatgcctatatataatttatgagtctgatatttaaataggtcaaattctctattctttgattcattaacttgcacacgtgtaagtctggtaggaaagggctgggaactgcacagttgaatgacaagaggaagagttatctggaatctgtgttaacctttaaaattgaacttctgtatcttcaattgaaccagtagacttatttcacacattgtggaagacattgtggtgattcctcaggtatctagaaccagaaataccatttgacccagcaatcccattactaggtatatacccaaaggattataaatcattctactataaagacacatgcacatgtatgtttattgcagcactattcacaatagcaaagacttggaaccaacccaaatgtccatcagtgatagtctggataaagaaaatgtggcacatagacaccatggaatactatgcagccataaagaaggatgagttcatgtcctttgtaggaatgtggatgaagctggaaacaatcattctcagcaaactaacacaggaacagaaaacaaaacaccccatgttctcactcataagtgggagttgaacaatgagaacacgtggacacagggaggaaaatatcacacaacaggtcctgccaggaggtggggggctaggggagggacagcattaggagaaacacctaatgtcaggttgatgggtgcagcaaaccaccatggcacatgtatacctatgtaacaaacctgcatgttctgcacatgtatcccagaacttaaagtataataaaataaaataaggatgttggagttgaggatgggggcagtcccagacattaccaaaatgtaattgctagctctggattgctataattctaagaaaggcacatttggaggtatggagaatatgagaaacctgttgatttatatgtcttcatgtgaaataacatagcttttcaccttatctttacaaacaccagtttcatcactgcctattttttattttttctatttcatcccactcctcttcccacaactaaatagaatgtagctttttttcttctttgcacaatatatataaataaatatctaaaaagaaaattattactctagaggattatcaagccagactcaaaaacaaaaagtcattaatttgtatgggcattagaaacaggagaaacttagaagtccaatttcagttaactaattcctccatggttttctaacaaatggatatatcctattaaatggacattgcatatttaaaaaccaatattttttgttagacattcaggttatatttaatatttagctattctaaataatactgaaattaacattcttataaagaaattgttagccatatctcagaatttttggggggtagaggataagttcctagggaatttgctggataagagagttaaagtatacattttgatgtatatatagccataatcgttggatttattttcttcccaccaacagggaacaaatgtttctctgttaacatattctcatcagtcttgaatactattaatcttataagctttgcaaactttcttgaacttttcactttttaagtcaaccattattaactatatttttgtgaattccttgtttatgatgtcatgatgtcatttcaattatgtatcactgtgattttgtttttctcattgaataattttcacattttttatagtatacttccagaaaagttttactaaagatactgttgcctgaatacttcaacaccttgttactgaatttaatggcaatgtatttagcgttaacaattccatgaagtatgacatagaatacagaatgcgattttagatcaacgttttaaaaaataatttcaaggaatcatccctttaatttagtttaataacatagttttttgtttgtttcatattgttttccttcatttattatgagggatgattgttcaaatgttctagaggcagtatagcaactgctctgaaagcagattgcctggatccaaatcataattcactgcttaatagccgactgatgctgaagagtttacttaaactttctctacctaacttttcctgtcagtaaaatgggaataatgatattagcatctgtgtcatatggttttagtgaggatgagttaattcatttaaagtgtttaatgtagtatccaccacacagtaagcacttgaaaatgttagccaaatataaatattatggcactattattattgttgcatattgggaggtgctctgacagagtggcttaatcaatattacatgttcttgttttcatatcttagctttctcatatgctaattatgtgcatttgagcaagttactaaacattgtgtgtgtcagtttttctcatctaaaatatgaagataaaatacttcatgggaattttgtatgaattaactgaacatatatatacttaaagcacttacaataatgcctagaacatagctcattatagcattcaacaaatgtgagctattactattacctatttcggttgcatcttttatttattaatgatatgccatattaatagattttctcatagtaatttccattgcatttatagaacaaatctttcttggaactttttaatgtactcttgaattagattagttctcttattagtatttttaaactatattcataaatgagattaatctgtattttcttttagtgttcagtttttatatacactattttcctaaaattagaaagtttctttgctatttcactagtttggaaataagcaccaatcatgagacttacctatctttgaaagtttacatgtatttgattttaaccctacctgagtttgtttcattaaagttaattctttgacaaaattttaatttattccaaggttatgagtctattcatgttttcaatttctaattggatcaatttaggtagtttatgtggtgaaaagagaaaattataagcccatattctttaattcagctagaaattgcaaacgtgaggttgcattcttcagttaatacagctgctttaagaagacaaagccctgtgctagccatcacttctcaataaattgatgaggcaactttattcttccagttgttcaggtctaaatctttgaagatacccttgatacttctcttctttgacatctaatccaccaacaaatcatttgacatatatccaaaattcaattgcctcaccacctccactgttctcctaaattccaacctatcattatctctcacccggagtatttcattaatcttctgatgcatcttcctactttttctcttgtcttctagagtatagaacgaggtgtactacccagatctcccaatcagaaccaacgctttcaattcccaacttccaggattgttggtggccaacagtgcatatctgagtctctctcaataaattgctctcagctcaaagggaattccttcatctagggtcacacctgtttcccaaaggtagacagcttctaactgagacaaccaggtgggaggggtccctggagaaactctaaccagcctgcccactgcggtggaaccgcaggaagttcacaacatttgcagcagagaggagactgaccccttttcttcctgtgtggagcctgggattcaggcagtgggcaggaagcactctagtggaggtactctggatttgcaagagtccctgattccccagaaccccatctttagctaaacgaaggaaaagtcctgcaacatttttggcaccaaacatggggctccaaaagcagtgaatgaaatggggactcaaaatctctcactattgctcctaagcattttcatcctcagactactgagggtgggggaaacaagccgccaagccctgtcactcttgggggtcggaggaaaggcccttttcttcctttttcaggatggacaggcaagcggggtctccttgctccccctcccctctgtgtggaggctggggtgtatggcccaagggtcccacacagctagctggctggctcccagacaaaagccacagcagccttccctttccccccgccaagaggttcagctttttctgacagtaattaagcttttctcctggtggaggaaccactttcataacaataagaggttcttccccaggcatttttaaactgttttttttttcttccccttctctaccccgtcagcagttaacctttaactttttttttccttttagaagacgtttttactagaccaggcaacccaactatcactgtttgtactctctgtaaagttttggtcatgaaaaaggatttgtggggctagtctttggctatggcccatctggtgtgctttgcctgtctgcatggtttgtgctccaagcctccatcttgctttacatcctgggggcatagctggtaagtgcttggcaaggctttgtttagcaaccctgccttaggggatgagctctctctggttcaatatctgcaggttttcctagccctgtctcttaaaggacaccacaaccactgggttttcttctgcctgtctgtgtgtgtactgtgatgtctgtacaaggagctctgattcatgtggcctaaagaaagggtcttggatcaagtattttttaaaaagggaagataaaagctgtggtacctttcaggtcacatgactttaatctttgagaaataaaatcagccttaaagattattggtaaaatgtagatgtcattaaaatgtaaataggtgaactgaagaatgcaggtcagatgcaaggtttgccaagtgttttgaggttacaaactggtttttgggttttgaaaagtatttgacttgctggcttcacaattgataaggcctatggaactgacatacggaactaaccatgcccttaattaagaaggcaaaatttggctgcagttagcacacaattaaagcaacttaccaagttttaccttaaagttaaaaatgcctaggagttaactgaaactactagaaatagatttacatgaaaggtgtataagaacagtaaaatgtgttttttagtaaaaggttataagaaggcatggaaatgtaaacttttgcctagagttaaaggattgttttgagttaaattaggaaaaagctgaaggttaaaagaagtagtgcaacaactgtggaaattaatcttgcagaagaggttcttcatgtgaacgtattgactaaattcaaaaaagggtattatatggtttttctgtaaattgagcactcaaataaatgcataacaaggttttcctatggcaccaatctgctctttggcaacatttgtaagtggttataaaaggtttttgcttctttaaaatttctgagtcatcattttggcaaaataattaccttacggtactctggaattctattttataatatcaagtattttacacctcaaacatttaacagccttccgaaaatcaaacttcagtttcaaaattgtcttccctggcacctggctttttgagtacttcagagggcccctgacgtgtccagaaaagagaggtaaacaggattatttgacatgtttaggtagatgggatttccaaaatgatgctcaatcttctttaggttatatattggtactatatatggttatatatataatgctaatatatgttccagaattgtatgggatttctaaaattctaatgtctaagtatatgctaccaatcacaactaacattgttatgttaagttattgtaagccatggagttaaccaaacttctctgacatgagtgtttctgcttgtagctaccctggacattttgttattcacagacaattgtcttgttttaatccttttcaaagatggtttataatgagctatagaactttaacaggtgctctcaaatacagacttctgataactttggatattgtgacattggaatacaggaacatgcccaggactcatgaagagctgaaatgttcatgaatatcaagcaaaacaggagttaactaaatggactgaactcaggaagctgaagcaacctttttgactttcgcttggaatattgctaatccatgttttgtttttcagagtcaaggaaacttattttggactatttacggcctttaataattgagtaaggtatactcctatgaatgaaatttgaaacatgttggttactctctgcctggttcctctagaatttagaaactatctgtgagtattcttatgacaatatagttatgtgcatcagtgcaataagaatccatttttcttttgcaacaggacacaattggagaaagtagttattttaccaaggctttgactggaagggtatgcttccgtttgaggagtgaagcttgacttgcagagccaataaaagccccatggggaaactggcctcatacccttgtctatgctgtccctgtgcagagttcttgacctgtggtcagtaaagaatgtcactttataacagggataggagctccaagtttatcttgggacctttggagaggatcacccaactcacaagtatttgaagatgaaaacccatggctgggcttggttttaaaaggtcttatccgtgattccttgtggtacacacttccatcaaagccagtccaaaaggcctatgtagaaatagttattcttgctctactttatgcaaataatcaggccaagtataagactaaagtcccttttgcaaaccactcagtcctgacataatttgttttttaacaaaaatgagaactggagagagagaaattatatttcaaaacttatacatttgtcattaaattctaaactcactagctgtttttaagtttttgtctacattttagactaaccctgcttgttcctttgaaccaaggagcaatctccagctgtagctccgaaagaactaaagggatgggtaatataaaaatctggatcaatattctagttctgagcagttatcctgcaaatcctgccaggtgatgggaataagtagaatatccatcacttggaagtttcctttttgggaaagtaagactgagggagctgaccaaggctgggcaccaggcagccaaatcctagcaagcataactatagctaccaattatctgggtgtgtaacaagacatcctttcctctcccttggaggagaactcagttccacagctttacttagcctttggtttatgataaggagtccatgcaacccccctgagatacattttgtctcagactcaattccaagcttcgggtcaaagccctaggaaagaaaattgtatctaagggatccagaagcaaatgataatgaaggttaaaacacacagtgcaggtgagcgtggctgattactgccaattaaggcaaccccaagctttttgtttcatggataaaagccacattaatatccatggcataaatgaggtctagggaactctaaggctactaagactaggtaggaaagagacataggtgacagcgaataattcctattctctaggccctctctgcttcatgggtacagccactttggcactcatggcagcacctgccaaggttgccagaactcaggaatacaaggatggaagagggaaagtggacgctcttccctctctccctgaagtacccctggtatctgttaggaagagaagagaaccagggacacctgctcccttttttctagatgggtagccactcaccttcagtctgtacccatttcaaatgcatcctgaacccttgggactcctttaaaaaatgctttatttttcctttctcttcctcggttctctcttcagataggtaattgtgtctccataccatgggacactcccctcagatgcatcctccaaactgaaaagagttaatttcccaaaccttaaactggtcgacctaggtttgggcttagggaagggaacccggaagtccaacatgctggccaaagggtaaagctttttttaaccagtcggacttttggcttccctctctctgtgcaaactggtaaaaggccttggaatttttgagctgtccttaaccctccccttgtttcattttgatacatgtttcctaataatctggtttgtctgttcttgcattcaggccatcaaactccagtcacacaactggagcctcagatgatggcccctcctaccaggaacacttaggcttctagggaagctctgactgccatttccccaaaacagcggcccatgtcagcaggaagcatttaagatcagtcttcatccttatccttaatctaacatcagttagatgtacttctttggaggcaggaatgagatagtcagatgggaaagagtccctggagaaactccaaccagcctgcccattggggtggagcctcaggaagttcacgacatttgcttcagggaggagcctggcccctcttcttcctgtgtggaacctgcaattcaagaggcaggcaggaagcactctatctagcaaagggactttggccttgtaagagtccctgttttccccttttttcccttttcatgcaataaaaccctgctttactcaccctttaaaccatctgtgagcctaaattttcatggccatggggcagacaagaaccacgtctttagctgaactaaggaaaagtcctgcaacataatgactggtcaatgtagatctggcccctttgcctcaatttaggacaactctgaaaggatatctgagtttcagagctcctgtggatcagtggaggatattatgatagccacttttcatgtaacacgtcactctgcccaatcctacattctcactaactcataagtattgttcctgagcacacttcctaataaactttctatgtgcaaattcttcatctcagaatctgcttttcagggccactgacctaagatgctttgtgcaaggaattatatgaaaaaaaaagcagacagtttttgagctgcaacacccagtggctctctggccagtgagaactttattggtggtgtaagtaaaaactgataattcttagcatgttataatgatgaagttactaaaactttcacctgtggtgaactgggagaaaaaaaacagagggaaggaatgcactggtagttatgacatcccagtcacacaagaggttttggggaaataataattataaaaaccatggatttgaatggatgttgttgaatgtgatcaaagctttaaagaaagacaatgcaagactaaaggtgattaatcaccaatatgaggtaaaatgtaaaagtcagagaactcctgagctataaagatacttatgtcctacagccacacctggctaattttgtatttttagtagagatggggtttcaccatgttggccatggttggccaggctggtctcaaactcctgacctcaggtgatctacccgcctcagcctccctaagtgctgcaattacaggcatgagccactgcagcgggtcaaatatttttaaaataaactttactacagcaataaaagagggtactggcactcaaaacctagaaaccactcaagtacctcaccctaactacaaagaatcttctatcattgctggctcaagaaaatttaaaacatttccaaatgaaaagaaaaccaaaaacaataatcatatatatctataacaagaaaaaaacagaaaatgtgatagtggtattgaggttctgtcagagactatctttgttcttaggagatatatactaaaacctttagggctgaaatgttacgatacttgcaatttaatttcaaattattcagcaaacacacacacacacacacgaagacataaagtttagtaccagttagcaaatataaacaactatgtcttctttttacttctttattccttttcatttctttttttttccctttgttccttcttttttcttttcttttttttttatcctggaacattttctacattcacaagtaaggtattatttctctagttgtaatgatactggatataaacatcctcatttctgaccaaactgatcaaatatcacagaagaataattgtatgaccttgtagaatattggagaataagcaaaatgcattaaataactactggggactatgttgaaaacttttgaaagttcaatacacatagatcttcacagttaagaagtgatgtgatgatttcttgcctaatcaaccagatcaaacacccgaatctaaaactgctcttttttcgactgggcatggtggctcacgcctaaccccagcactctgggaggctgaggcaggaggatcacttgaggccaggagtttgagaccagcctgggcaacatagccagacctgtttctatgggaaaaaaaccaaaaacaacaacaaaaaaactgtccttttcagttgtcattcacaacaaaagttgttatataatcaatcaatgtagttttattttttcagtatttttcagtactcctttgtaagtatacatacccacacaggtatttcctgcttatgctactagtctaaaagtcactgatctaattgtttaattcaatttgaacagtaataaggacaacataactcacatggaagcatttgataatgatttttgactgtgctcttgtaaagcaagagaccatgatgatttgatttagacagcagttatgacaatacaatttgcattcagaaacttaataaacactttaattgtgctcttggttgactctccccaagataagatatttagagatacagagagaagtctaagtaaacacaggatgccacatgttagaaaataagtccaatgagaaagaaaaatgccaagtatacatagatattaatattttacatttgtatatactcccagttaacaaagcaccattgcactatttcaacctaataagtagttatagagcacatactcaaggcactataccagacagtctacgaaaaacaaaaaatgaatacatccccacagagggcttacaatccagtagaagatatggtctgcttaactcaaagaaatagaaattgtagagatgcaaattgttataggaatatagagggaggagagatgaaatctaactggaggtgtcagggaagacttcattcagcaagcagtatttgaatttgggccttgaaaaaataaaacatcatttgattaaaatcaaacattataagacaatcatagaattcactattatgtcaatctcataggtcaagaaactgaggctgaaagaggctaagaggactctcctactcatggtcttacaactggtaaatgtcaagaggcctgaaccaagtttttttattcctttatttagtgctcatttactatatcactctataagagttgtcttaatctgggcaagagagcagatgttctttcagtatagtaaaaaactttttaaaaagactactcatttctgctataataaacttggttgtcctttgtaaaccatatgaaaataaatgttcttatcctctaaatgttaatgttattccctactgtaagtacagaaaattccttacggtatttcaagtataagtactggaaaaatcagatctttgtttaaagattaagaaaccaaccattagaaaagggtgaaaaccaacttcatcatgataagtaaacagactgtggtatgatagtgagagtgataccccactactagtctttgcatccccgggaggatagaaaaggagaggacaacaggattaagctgtactggatataaggtaaattttttccaatgggaaagaatacccaagaaaataataacacatgtgcgccttactatatgtcaggcactcttctaagcaccttgtacttaattctcaaacaactccatgaaataggtattattattaccaccctttatggataatgaatctaagccacaaagaaacatagccaaggtcatgtaagtgatagaggtagcatataaactgtgtctggctatagaatcctgattcttaacaattcaactctaccatctgtcaaaaagtgagattgcatactctttttgaagatggctttaaaatattaatgcaagtacaaattaaatctgtaacacataatggaagttctagtcctaggaagcaacagcttagcaaggcatctaagaacataaactttggcatcaagcataccaggttttaaggcctcagtcaacctacctgtgtgaacttgggcaagttatgaaagcttgagtttcctcctttcgaaaggaggcagcaattattgtgctttgagatgagaatgggagcaagcagcacagtatggtaagaaaagtactgggcttgaatgtctaaaaattcagattataccctcagctactaaccagccctgttaaataaaataacccatgaatcaacaaatatttataaagctttatatatgactctgttgtatatactctagggatatagcggttaaaaaagacattgttccttagtttctgagagctaattcattcaagtttgctcattggtttccttaataattggactcaagccccaaattaaggctgtttggcatttatattctatgattctgagacagaacttgaataacaataccatggtggctctgtttcttgctaagtgcaatttgtgtgtgtatacatatatatatatatatatatgtgtgtgtgtgtgtgtgtgtatacatatatatgtgtgtatacatatatgtgtgtgtatacatatatatacacacacacacaaacacacacacacatacatatatatatacacatatttcaattcctccttttattagttataaggagatttgtacagaaagaaatagagactgaatttccagtcactacctacagctgctataaccagctgttcccacatattttcttcatgggacaacatttttctggaatgtagattaatacatgacacttcattgagccacagtaaaagaaagcagaatcaatgtgatttacagaaacttcatggaaaatattgtcttttttctcttcctccaaaaggagctcagtgacaattccaaacaattcatacagaaattggagaaataattttcacatcttgaacatatttccattcctctagttgacagggactggcaatactactgtgaattttttgtgattattcatgaaatgaagtctcataatggtaagagcatcagctttgaggtcagattgtcaagcacagagataaatacaaatatacatagatataaatcccaatttcatcacttacaagctgggagactttaactgttttgaccttcagtttcctcatatgtaaaatgaaaatgattatacctattttctagttaccaaattagataagacttggtatatagcacttcatttaattacagccattaaacttataatcatccttagctgttaaatatatatatagatagatgtgtgtgtgcaagaagaaaaaaatgaactatcttttcaaaatctaactgatttttatacaagaaaaactactacttcagctattttacattaaatcaccacttaggaaataaaatagacaacacctcctaaattcctttgtaggcagatcaatatttaatacatgccattaaaatattttgcagtttagtactaaaaccacaccaaaatggcaaaccaaattacaagtttattctcaatacttacaagatttcatacataacaaaagtttgaatacatctttccatgtacctactattaaaattatactttaggtattctgacaggaaaaatacacataaatttctaagtaccacttcaagttacgagctctaattttgcatcccctttaccagcacttaaattgctggttttataatcataaatgtaggaataacaagcaaaacaaagcaaataatacataacttcagaattcaatatttgtgagcaaatcattgaaatatttcaagtcaccagtcatgcttcattcaccataagtaggtcaacagaaaagtaaattaacttacaatgaacaagaacttccttggactccatgaaaatgcggagaagagtgggatgaacttagacttttacacataaatgtctgctagtcattgttagactccctagctctgtcccttgctcataccacctcatcaaacatacaaccacagacgctcctccctaacagctgacttttaatcctgtctttaggtttaaacaagatcctttcaaagatatgtagcatgtgatatgaaagtcaccaagaagaaaattattttaaaaaatcatctcctagtacaggaatgctctatctccctacatgttcctcagaaaaagcagattgacttaagagtggaacgataatttgttttcacaccagttgctacattgaatatattaagactacccaaaacaagtctcttcttagagctggaggatgtgcactctgggatataacaaaaatgtcaaagccatttgggtaccaataaaaatgaaacattaatgttataaagtcaactattataatcaggctatattacttccaggaaattagtaaacactatctaatccaggctctcccacaacacaaaagcctagagccagtggattggcaatgatattatagagattgcaacgatacttctggctgctgtttttccctactataccatgtaagatatgaaggagttctcttcacctaactccctcaaatgctaaatggtggtggtactttttactcacagaaaataatttcaattccaaaaattcactagctgtttctctttttttatatgtcacaaaatgtcacgttttcttatttacaagccttatcacttacaaatatttgagaataattacataaaagatgaacatcatttcctattactatctgtatcaacaaaatataaaagtactacgtttgattttccacaaaatattgcccccaagatttttacacacataagaactcctcacctaaatatcacccacagctaacattcatttgatgcataactactgaacctagctgtgctagaccctagagatacaaaaaatgtaagacatgatcctttgtgaaaaagtttacaatatatatagtgtttattccagtggtatacaacaatgttgccacattgaaattctccctcaatattcccttttcaaaaatctctgcatcgaaatacgttccatatcattttatttcattaaggtaaattctggtcaactatactgaataaaagaatatttaaaagtgaacatgggttgggcacagtggctcatgcctgtaattccagcactttgggaggccaaggcaggaggatcacctggaggttgggagtttgagaccagcctgaccgacatggagaaaccctgtctctactaaaaatacaaaaatttactgggcgtggtggcacatgcctgtaatcccaactactcgggaggctgaggcaggaaaatcccttgaacctaggaggcggaggttgcggtgagtcaagattgcaccattgctctgcagcctgggcaacaagagtgaaactccatctcaacaacaacaataaaaaaaagtgaacatggaggagtgacagagaaacagagaagcatcataactagttaactatgcatcaaattggatttgcacattgaaggccagtttatttctatagaggctattgaggataatccaaggaatgacaacacttataggagtccagaattcttactagactgatctaaacatttaagtcatccagttgtccaatcagagaagatcccctgaagcagcaaccacaaactcaaaactctaacaagaccaagggaaaaatgtaaatgagtagcatcggctaagagttacagaaaaatcacatgaactttttggtttatcttctatttcccagaaaaacttaggtaaaaatgaatatttctctactataagaaaaggaatgttgaatgcaaatgcagacaacttatactctgcttcagtataagagataccatcaggagtgctagcgactgtagtctaatgaagagagcacagccatgcacttaaagtatgcagcaaccattgccatgtacaaatttgagccaagtattattattagactttctggtttttcaagtgaagccagaaattcagatttttgtgtgaagtttcctaatatttgtatgttagttcaatgtttaaaaaaattggtaggttcaaatgcatcagtctgtataacagatccagcctcttcaacatgaataaagggtatctatgaaaaactcacagctaacatcatacttaatggtgaaagactgaaaggttttcccctaagatcaggaacgatacaagaatggctgctctctttatttctttccaaaattatactggaggttttagccagggtaattaggcaagaaaaagaaatcaaagtcatctagactgaaaaggaagaaatcaaattatctctagttacaggtgatatgatctcgtatatagaaaatactaaggaattcacacacaaaaaagaaactattggaactaataaatgagttcagcaaggttgtaggatacaagactaatacacaaacattaattgtattttatatactagcaatgaacagtccaaaaataaaatttagaagacaattccatttgtaaatttttttttaaattattaataagtttaacaaaggaagagtaaagcttgcacactaaaaactacaaaacattgttgaaataaagtaaagatatagataaacagacattccatattcatgaattagaacgcaatattgttaagatggcaatactccctaactgatttacagattccacatgacctttatcaaaatcccagctgagtctatggtcataacaccctgaaaacaaaaaatctcagatgacttttttctagacattgacaagctgatcctaaaattcatacggaaatgcatgggacccagaataaccaaaacaatcttgaaaaagatgaacaaagttggagaactcacacttccctatttcaaaacttacttctgtaatcaagacagcatggtactgacataataaaagtcacacagattaatggagcagaattgagagtccagaagtaaactcacatttatggtcagctgattttcaacaatgatgccaagacaattcagtgtgaaagaataatcttttcaacaaatgttttggggacaattgaaaattcatatgcaaaggaatcaatttgaacctttatttcataccatatgcaaaaattaacacaaaatggatgaaatacccaaatttaagagctaaaactataaaacccttagaaaataatattaagcgtaaacctcatgaccttaggtgagtgaactatttcttagacacatcaaaagcataagcaacccaaaaaatatagacttcataaaaatttgtactccaagtgaaactatgaataaaatcaaaaggcaacccaccgatgaaaaataacatttgcaagtcatttttgataagggtttattattgagatatctaaagaactattacaactcaacaacagaaagacaactcaatttattaaatgggcaaatatttgaacggacaatttgccagagcaaatatacaaatggccaataagcacatgaaaagatgttcaacatcattagtcattagggaaatgcaaatcaaaaccacaatgagatagcacttcacgtgagaatattgtggctacaataaaaatgacaaataataagttttgcttaagatatggagaagttgtaatacattgctagtagaaatgtaaaatagtgcagtggctttggaaaaagttgtcagttcctcaaaaagttaaacataaagttaccatatgaaccagcaattctgctcctcagtatagacccaagagaactgaaaacacatccacacaagaatctgtatgcaaatgttcatggcagtattattcataatagtcaaacagtagaaacaaaccaaactttcatcagctgatgaacagataaataatatatagtctatccatacaacagaatattattcagcaataaaacagaattaagtactaatgtctactaaaacatggatgaccttgaaaactttaagtgagagaagccagtcataaaaggctacatgttgtatgatttcatttatccaaaatccagaaaaggcacatgtacagaaagtagattagtagcctaggtgctgaggataggggatgtgaggagtaactactaaggggtctgaggatcctcgggggtgataaaaatgttctggaattatatagctataactgcataactttgtaaacttactaacaaaacgctgaattgtgtactttaaaggataaatgttatggtatatgaatcatatgtcaataaagctactagtaagaacaaaaataagcccagcccaaccactttgcaacatttgcctaaaaggagttctacatcaaaacggctccttactaatatttaaacggagttttgcaaatattagcacacggtaagtagagtgctcagttttctaacgtcaactatccggcataacctatttcaatatttcaaataaaatacagcctttaaaattttagtaataacaatgattttcagaaaaagaatacttcaatgctagaaattgcttccttctgcctaataaagttatatcttttcatccacaatccagttagccaatctttccaattttacagcttatattaataacttccctataggcttcccacacttctgccaagttagatcctttctgtgccttgaaaacacctcaggctttcttaaatgtgctccacctatttggagtgcccttctcccctacagaaatatctgaactatacctactcgtcaatgtttgaaatgccattgctttttctgattctccttcaaaatcaggttctgactctaagtaaactgtctcctagttaatactcctttatatctttcctaggatactttttattgaattttatgtgcacttgtctcctttccccctactgaacagcaggtcttataatacatatgaaagtccaacatgtgccaggtacatcagttctaatcctcacaacagccctgcaagaaaggtattattcttattctcttatagatgaagaaattgaggatttgagaggacaaaattacttattcaaggtccaataataagtggaaagtctgagatttgacattggttcatctttggtggcaactttgtttcccagaaattgacaagctgatcctaaaattcatatagaaatgcaagggatatttgaaaaaaaaactttgcatttaataggtcttcaaagatggttcattgaactattaattggaactcatatcaaaaagctagttacttaacttgagcataggctttagagtcatactcaccttggttcaagttttatcttccctatttataaactgagctgaggtaagttactaaatattttttgtttgtttttttgtttgtttgttttgagaaacagtctcactctgtttcccacgctggagtgcagttgcatgagcttggctcactgcaacctccacctcctgggttcaagtgattctcctgccttaacccccaagtaggtgggactacaggtgcatgccaccatgctgggctaagttttgtatttttagtagaaacagggcttcaccatgttggccaggctggtctcaacccaacccctgtccttgagtgatccacccacctcggcctccaaaagtgctgggattacaggcgtgagccaccccacctgaccaagttattaaatcttagtctcaatttcctcgtttgtaaattgaagattataatatttaggtaactgcattctcatcaggattaaatgagaaaaaataaaattacattcttagctcatagtgggagctcaatagatgtggattttcttcctgtttatacttttttcccctgtgccctgcctcctacttacagtggcttaatgagaactaattctttgagaccagcaaatatgttacacttctacaactctttagccttctggctcaatcattagtacaaaattatctactttatagaaggactgtaaaaaataaatgaatgtatctgagtcagtggctctcaaataatattttagcagcagagcctgatagggttattttatggaagaaatgtgcttgaataggaaatgaggagataagggctgcagtccaggttgaagcatataccactgtgctccacagtcagctcttcgtggaagggtagaaggagcagctataggttttttgtttgttttgtttttttaccaaggagtagggaagttatttcttcccaagttttataaaactctttataaggatgaataaatagaaactagaatcagaaggaaaaacacaaatgaattatttgtagagcaaacctataagtggggaaattccaatctaatgataaacatcagaaatccaaagaggatcagatgtctcatgcaagatccagccaagatttaagaaataaataagtattttagcctgttcacatcagtaaactccatgtttttattcctaaaaatctcacttaggcaagctatgctaaggctgtgaaactgattaatttaaaagctatttttcctcccctgaggccagaagggatttttgaatgatgcaagaaagaaagagagaataatagaaacaacaggtgctctgaacagctgtggggagagaactgaacttttcaagatgatcttaagaactaataaattgttaaatccctgtttcagaagagacacaataaacaatgcacctctaaaataaaagtttccctttactccaccccacattccctgaaaactgactttacccacgattagttgacgattccctgagatgtcagagttcatcctcgaggagaattagtcttttaattgaaaatccttttacatgtgttttctttaagagaaaaacagaaatttaattggttactgaaatttcatttttaaaattctgtgatccacaaacttgaatatgtcttggaggaaatatgaaattgtggaagaatcacagactttgaaatctaaaaaatcaggttctaacacattctagctgtgtgatttcaggtttgtaataataatgcctacataccacctattattctaaccactttcatatgttaacttacttagccctcagaataagtctctatgtaggtattattattgattcactttaaagacgagaaaactgatgtttggtaagataaaatagtttgatcaaagcttcacaattaataagtgacagaactaggatttgaatgtcgacaccctacctccagagacaacattcctatctcatcacattgacttctgacgtgcttttctgattttttttctgtgttgttcttttttcaactgtaaaatgggatgaattcgtaggactattttaaatactaaataagataatatatgtaaagtacagttccttgcacataggtacatgacaaatagatttttatatgataattattaacatagattatgttatagggtctcaaattagcccctgtatgatttacagaattgtattttctcttcattaaataactatggtatatcctttaaaagaaaggagcttatctttttatttctgtttgtagctgtgcctaccacagagaagatgtttaataaatgatagtgaaaaaagaaaaaaaggaagggagaaaggaagtaaaacaggaaagaaagagagaaagagagggtaagacaataggaaggcaaccaaaaaaaaaaaaaagttaaagaatatcctttcttttttttttcttttttttttagatggagttttgctcttgtcacctaggctggagtgcaatggtgtgctcttggctcactgcaactcctgggttcaagtgattcttctgcctcagcctccctagtagcttggattacaggcacacaccaccacactcagataatttttgtatttttagtagagacagggtttcacctgtctggtcaggctggtctcaaactccttacctcaggtgatccacctgcctcagactcccaaagtgctgggattacaggtgttagccaccagaatatcctttcttaatgaaatatattttatctttgtgaagaacattccagtgcacaccaattattgcaaattgtactctacaacatttttataacatttccttgtcttaatttcaagcagttgttccagtaaactataagatgatatttagtccattctacctcaagactattaacttgtatgaaaagcaggtaataattttagactaaagggagttctcaatttttccaaaaaatcagtgtttgttttaccatttaaatacaagccttactagtgagttctcaatttaattacactcaatgtgtaacattttcaaaagtaagtttgaggaagggccacaatatggatcctagccatgtcagctgacaaatgaccagtgtatgtctagcagctgtggatgctgaataatgcaactaatacagctgtcagtaagtcaaatattttgtttaggacctcaataatggatcaatgagtatcagctaatttctgaccaccatgtgcaaaagggcatcctcttactttctgtcaagccagtaatatttgaagagggacatatcactctgagtcaatatatctaaaatgataggtataaaatctttatctttaaaagtggaaaatctagaggggaaaaaatggcagacaggaaggaggcaggactaactggcagctcctactcagaggaacagagcagcatttggaaacccacgtcatgaacttttctccaagaactaccacaggtacaaccaggaaaactgagagaatccacagaccatttgaaggaggtggaatgccactgcagaatccatgggacagctgaggaactgtgagtctgcttgctttcttagctgggaggcttgtagcctgtgacaagtactcagccctgctcactggctgcctggaaataaatttggtgctgttgggggtgtgggggccacagtgggagtgagactggtcttttgggctgcaggtggcatgggagctggttgaggccagtggctgctagcttttccccacttccctggtgacccgtgtgacccagcagagacagccataagtcccctgagaacataattccattgacctgggaaccacacccccagcccccaaaacaaagcaagccctgcttaaggagagtctgagttcagacatgcttaaccctgtccccacctgatatctttctctacctgccctggcagccaaagacaaaggacatatctcttgggagctctatagccctgcccaccacctgagaaacctgaatacttatccaaaggctaccctaggaaaagcttgtgtcctccctatataatcacagctgatatgctcttgaaagcaccaccttctggctggaggtcaagcaccacaaaaccagagcacttaaaaaagacacaagcaagcgctcatacagagaacacttcactcccctgctaactccaccagagtaggtgctggtatccacagctgagagacctgaagacagatcatatcacaggactctttgcagacactacccagtaccagccagaagcctggtagctcctttgggtggctagatccagaggagaaataacaatcactgcagttcagctctcaggaagccccatccctaggagaaacgggagagcaccacatcaaggcagcaccgccatgggacaaaaaaatcggaacagaagcccttgagtcccagatcttccttctgacaaagtctactcataagaagaaaccacaaaaaaacaattctggtaatatgacaaaacaaggttctctaatgcccccaaaagatcacaatagctcatcagcaatggatccaaaccaagatgaagtttctgaattgccaaaatataaaaaattaagaagggtaattaccaagccaatcaaggaggtaccagagaaaggtgaagtccaaataaaagaaatttttaaaaaagatacaggataggaatggaaaaatctccagtgaaatacatagaataaataaaaaacaatcgcaacttctgaaaatcaaggacacacttaaagaaatacaaaatgcactaaaaagtctcagcaatagaattgaacaagtagaagaaagaacttcagagctcaaagacaaggctttcaaattaacccaatccaacaacaacaaagaaaaaataattttttaaaaatgaacaaagcctccaagaagtttgggattatgtgaaacgaccaaacctaagaataactgatgctcccaaggaagaagagaaatctaaaagtttggaaaacatatttgagggaatacctgaggaaaacttccctggtcatgctagagatctagacattcaaatacaagaagctcaaagaacacctaggaaattaattgcaaaaagagcatcacacaggcacacagtcatcaggttatctaaagtcaagacaaaggaaagagtcttaagagctacaagacaaaatcatcaggtaatgtataaaggaaaccctatcagattaacagcagttttcttggcagaaactccataatctagaagaaattagggtcatatctttagcctccacaaacaaaacaattatcagccaagaattttgtatatccagagaaactaagcttcataaatgaaggaaagatacagtctttttcagacgaacaaatgctgagagaattctccactaccaagccagcactataagaattactaaaaggagctctaaatcttgaaacaaatccttgaaatacaccaaaataggatctccttaaggcatgaatctcacaggacctataaagcaacaacacaatgaaaaaagtactcaggcaacaaacagtatgatgaatagaatagtacctcacatctccatactaacactgaatgtaaatggcctaaatgctccacttaaaagatacaaaatggcagaataataactcaccaaccaagtatctgctgtcttcaagaaactcacctgacacataaccactcacataaacttaaggtaaagggatggaaaaagatattccatgcaaatgaacaccaaaagggagcagaagtagctattcttacatcagacaaaacacacttaaagcaacagcagttgaaaaaaaaaggagagacattatattatgataaaaggactagtccaacaggaaaatagtacaattctaaatatatatgcacctgacattggcactcccaaatttataaaacatttactactagacctaagacctaagatagacagaaacacaataatagtggggacttcattattccactggcagcacaagacaggctatcaagggagaaagtcaacaaagaaagagtggacttaaagtataccctggaacaaacagacttaacagatatttacagaactttctacccaacaactgcagaacaagtctcaacaaatttaagaaaatctaaattatagcaagtattctctcagaccacagtggaaaaaaaatgaaaataaacaccaaaaggaaccctcaaaatcatgcaaatacataaaaattaaataatatgctcctgaacaatcattgggtcaaaaatgaaatcaagatggaaatttaaaaattctttcaactaaacaataagagtatcaaaacctatcaaaacctcttggatataacaaaagcagtgctaagacgaaagttcatagcattaaatgcctatatcaaaaagtgtaaaagagctcaaatagacaatctaaggtcacacctcaaggaactagagaaacaagaacaaatcaaacccacacacagaagaagaaaataaataaccaagatcagagcagaactaaatgaaattgaaacaaaaaactgcaaatgatatatgaaacaaaaagctggttctttgaaaagataaataaaattgatagactattagcaagattaacaaagaaaagaagagagaagatccaaataagctcaattagaggaaaaacaggagatattgcaacggataccacagaaatacaaaagatcattcaaggctattatgaaaacgtttacatgcataaactagaaaacctagaggacatggataaattcctggaagtatacaaattcctcccagattaaaccagaaagaaatagaaactctgaacaggccaataacaagcagcaagactgaaatggtaatttaaaagttgccaacaacaaaaaatagtccaggaccagatggactcacagctgaattatatcagacattcaaggaattggtaccaatcccattggtactattccaaaagataaagaaggagggaatcctctctaaatcattctatgaagccagtatcactaatagcaaaaccaggaaaggacataaccaaaagagaaaactacagaccaatatctctgatgaacataaatgcaaaaatcctcaacaaaatactagctaacagaatccaacagcttatgaaaaagatcatccaccatgatcaagtggatttcataccagagatgctgggatggtttaacatccacaagccaataaatgtgatacaccacacaaacagaactaaaaacaaaaatcagatgatcatcttaacagatacagaaaaagcatttgaccaaatccagcatctctttatgattaaaattctcagcaaaatcagcatacaagggacacaccttaaggtaataaaagccatctatgacaaacccacagtgaataatatactgactggggaaaagttgaaagcatccctgctgagaactggaccaagacaatgatgccaactttcaccacttctattcaacatagtactagaagccctagccagagcaatgagacaagagaaagaaataaagggcatccaaattggtaatgaggaagtcaaactctctgtgtttactgatgatgtgattacatacctagaaaaccctaaagactcctccaggaagctcctagaactggcaaataaattaagcaaagtttcagaaaacaaaattaatgtaaaaaattagtggctctgctatacaccaacagcgaccaagttgaaaatcaaatcaagaactcaaccccttttacaatacctgcaaagaaaataaaatacttaggaatatacttaagcaaggaggtgaaagacctctgcaaggaaaactacaaaacattgctgtaagaaatcatatatgacacaaacaaatggaaacatatcccatgcttaaggatgggtagaatcaatattgtgaaaatgaccatactgccaaaagcaatctatgaattcaatgcaattcctatcaaaataccaccatcattcttcacaaaactaaaaaaaaaaaaaaatcttaaaattcatatggaaccaaaatagtctgcatagccaaagcaagactaagcaaagcaaaacaaagaggaacattatataatgaaaaagaacaaatctggaggcatcatactacctgacttcaaactatactataaggccatagtcaccaaaacaacatggtattggtataaaaacaggcatatagaccaatggaacacaatagagaacgcagaaataaactcaaatactcacagtcacctgatcttcaacaaagcagacaaaatcataaagtgggaaaaggacaccctattcaacaaatggtgctgggataactggcatgccacatgtggaagaatgaaactggatccttgtctcatctctcaccttacacaaaaatcaactcaagatggatcaaagactgaaatataagagctgaaaccacaaaaattctagaagataacatcggaaaaacccttctagacattgacttaggcaaagacttgataaccaagaacacaaaagctgatacaacaaaaacaaagataagtagatgggacttaattaaactaaaaagcttttgcacagcaatataaataatcagcagaattaacagacaacccatagaataggagaaaatcttcacagtctatacatccaacaaacaactaatatccacaatctacaagaaactcaaatcagcaagaacaaaacaaacaatcctatcaaaaagtgggcaaaggacatgaataaataattctcaaaagaaaatatgcaaatggccaacaaacatatgaaaaaatgctcaacatcactaattaccaaggaaatgcaaatcaaaactgcaatgtgataccacctcactccttcaagaatggtcatattcaaaacaccaaaaaataatagttgttagcatggatgtggtgaaaaggaacacttttacactgttggtgggaatgtaatacaactactatggaaaacattttggagattccttaaagaactaaaagtaaatcaaccatttgattcagcaatcccactcctggatatctacccagagaaaaagaagtcattatatgaaaaagacacctgcacacacacgtgtatagcagcacaatttgcaattgcaaaaaatggaccagcccaaatgcccaacaatcaacaagtggataaagaaaatgtggtatatatatatatatggtatgcatatgtgtgtgtgtgtgtgtgtgtgtgtgtgtgtgtattcaggttgcagcaaatgtcattatttcattcctttttatggccaagtggtattctattatatgtatataatatgtatgtatattttatgtatatatgtggatggaactggaaaccattattctaagtgaagtaactcaggaatagaaaaactaaacatcttatgttctcactcataaatggaagctgagctatgaggatgcaaaggcataaaagtgatacgatggacattggggactcaggagaaagggtgtgagagggatgaagaataaaagactacacactgggtacagtgtacactgctcaggggatgggtgcaccaaaatctcaggaatcatcactgaagaacttattcatgtaaccaagctccacctgttccccaaaaaaacctattgaaatattttcaagtggaaaatctagaaaaaagaatctatatatcagcagaagacaggttgtctgcccttaacttctgttcctttttatctttttgtttaaacatctaaataactataagatgtatatacttgaagatattttaaaacaaatgaggtaatatatatgttaattagattgatttagccattccactatatatcagtgtaaatcaacacatcatgtggtacaccataaatatatttcatttttatttgccaactttttaaaagtgaaagatctgcttaaaaaacattagtacgtttaaaatttttaacaaaccaatgagcatggcaatagccactttcagataaaaagagtaaagctttggaagctaaagcatcacacagcaggtgagtgacagcaaaagacaacactgatgtctgtgccacctgcagcagatgtcaggccccgaccctgccaaaacacactgaaatgtgtaaacatctctgatttagcactaaagttggttagaataattgttgacttctcaaaagactgagaaaatgtaacttaacattcagtaagtattttattaactcaagacatttattgagcaatgaatcactgaataaggcccagccattcaagaataaaataaggcaatttccctattctcacaatctagggtgagacagatattataaagacaaaagtgactccatctcagatgctaatctgccatgttgacttctggttagccccaacaccatgaatgcctcctaattcctacttcatttactgttcttagtgtaagaacatgtgaaccttgatgttaccacacaaattataggttatgatgaatatagcattcttgcctgttctgcagggctccaattaattgtcttgctggaacatgtatacttttgcactatgatatataagccctgggcctaaggagtagtaccagagatctacctgtcttgcaaatgccaaagaccatgcttctgtctgtaagatctcccagtgaaacactcttactgacaaactggatttgtctgcctctttctttgtttatctgttcctttggcacttggggacaactttgcataaacagccctttcatggaacaggtacataaacatataaatgaaaaaagtgttaataaagatcagaatgttaggatatttaggaagagcctcacagaagagtaacatttaagctggatcaagaaagataagaagcagttgcttccagggtggctgaataggaacagctctggtctgcagctcccagcaatatcgaggcagaagaggggtggtttctgcatttccaaatgaggtacctggttcatctcattgggactggttggacagtgggtgcagcccatggagggtgagctgaagcagggcggggtgttgcctcaaacaggaagtgcaaggggtaaggggattccactttcctagccaagggaagccgtgacaggccatacctagagaaacggtacactctgagccaaatactgcacttttcccacagtcctagcaaccagcagaccaggagataccctcccatgcctgactcagtgggtcccctgcccacagagacttgctcactgctagcacagcagtctgagattgacctgcaatgctgcagcttgacagggggaggggcgtctgccattgctgaggcttgagtagctcacagtgtaaacaaagaggccaggaagcacaaactgggtggagcccaccacagctcagcaaggcctactgcctctatcgattccacttctaagggcagggcatatctgaacaaaaggcagcagacagcttctgcagatttaaacatccctgtctgacagctctgaagagaccagtggttctctcagcatggggtttgagctctgagaacaaacagactgcctcctcaagtgagtccctgacccctgtgtagcctgactgggaaacacctcccagtaggggccgacagacacctcaaacaggtgggtgttcctctgggacgatgcttccagaagaaggatgaggcagcaatatttgctgttctgcagcctccgctggtgatacccagtcaaacagtgtctggagtggacctacagcaaactccaacagacctgcagctgaggggtctgactgtttgttagaaggaaaactaacaaacagaaaggaatagcatcaacaacaacaaagaagacatccacaccgaaaccccatctttaggacaccagaatcaaagaccaaaggtagatataaccacaaacatggggagaaacaagagcagaaaagctgaaattccaaaaaagagagcacctcttttcctccaaaggatcacagcttctcaacagcaagggaacaaaactggacagagaatgagtttgaagaggtgacagaactaggcttcagaaggtcggtaataacaaacttctccaagctaaaggagcatgttctaacccatcagaaggaagctaaaaaccttgaaaaaaggttagacgattggctaactaaaataaacagtgtagagaagatcttaaatgacctgatggaggtgaaaaccacagcacgagcacttcgcgatgcatgcacaagcttcaacagccaattcaatcaagtggaagaaaggatatcagtaattgaagatcaaattaatgaaataaactgagaagaaaaggttagagaaaaaagaatacaaagaaatgaacaaagcctccaagaaatatgggactacgtgaaaagaccaaatatatgtttgattggtgtactggaaagtgatgcggagaattgaaccaagttagaaaacactcttcaagatattattcaggacaacttccctaacctagcaaggcaggccaacattcaaattcaggaaataaggagaacaccacaaagatactcctcgagaagagcaaccccaagacatataattgtcagatttgccaaggttgaaataaaggaaaaaatattaagggcatccaaagagagaggttgggttacccacaaagggaagcccatcggactaacagcagatctctcagcaggaaccctacaagccagaagagagcaggggccaatattcaacattcttaaagaaaagagttttcaacccagaatttcatatccagccaaactaaacttcttaagagaatgagaaataaaatcctttacagacaagtgaatgctgagagattttgtcaccaccaggcatgccttataagagctactgaaggaagcaccaaacatggaaaggaacaacaagtaccagccactgcaaaaacatgccaaatggtaaagagcatcaatgatatgaagaaactgcatcaattaacgggcaaaataaccacctaacatcataatgacaagatcaagttcaaacataataatattaaccttaaatgtaaatgggcaaaatgcccgatttaaaagataaagattggcaaattggataaagaatcaagcaccattggtatgctgtattcaggagacacatctcatgtgcaaagacaaaaataggctcaaaataaagggatggaggaagatataccaagcaaatggaaagcaaaaaaaagcaggagttgcaatcctagtctctgataaaacagactttaaaccaacaaagatcaaaagagacaaagaaggccactacataatggtaaaaggatcaattcagcaagaggagttaacatcttaaatatatatgcgcccaatacaggagcacccagattcataaagcaagtcatcagagacctacaaagagtcttagactcccaaacaataataatgggtgacttcaacaccccactgtcaataacagacagatcaatgaaagaggaggttaacaaggatatccagggcttgaacacagctctggaccaagcggacctaatagacatctacagaactctccaccccaaatcaacagaatatacattgttctcagcaccacattgcacttattctaaaattgaccacataattggtagtaaaacactcctcagcaaatgtaaaagaacagaaatcacaacaaactgtctctcagaccacagtgcaatcaaatcagaaatcagtattaagaaactcactcaaaaccgcacaactttatggaaactgaacaacttgctcctgaatgactagtgggtaaataacaaaatgaaggcagaaataaagatggtctttgaaaccaatgagaacaaagacacaacgtaccagaatctttgggacacatttaaagcagtttgaagagggaaatttatagcactaaatgcacacaagagaaaacaggaaagatctaaaattgacaccttaacatcataattaaaagaactagagaagctggagcaaacacattcaaaagctagcagaaggcaagaaataactaagatcagagaagaactgaaggagacagagacacaaaaaaatcttcaaaaaatcaatgaatccaggagctggatttttgaaaatatcaacaaaattgatagaccactagcaggactaataaagaagaaaagagaaaagaatcaaatagatgcaataaaaaatgataaaggggatatcaccacaatcccacagaaatacaaactaccatcagagaatactataaacatccctacacaactaaactagaaaatctagaagaaatggataaattcctggacacatactctcccaagactaaaccaggaagaagttgaatctctgaataacccaataacaggttccaaaattgaggcgataattaatagcctactcaccaaaaaaagtccaggacaagacagattcacagccaaattctaccagaggtacaaagaggagctgctaccattgcttctgaaactatttcaatcaatagaaaaagagggaattccaacactatgttctggccagggcaattaggcaggagaaggaaataaagggtattcaattaggaaaagaggaagtcaaattgtccctgtttgcagaccacatgattgtatatttagaaaaccccattgtctcagcccaaaatctccttaagctgataagcaacttcagcaaagtctcaggatacaaaatcaatgtgcaaaaatcacaagcattcttatacaccaataacagacaaacagagagccaaatcatgagtgaactcccattcacaattgcttcaaagagaataaaatacctaggaatccaacttccaggggatatgaaggacctcttcaaggagaactacaaaccactgctcaatgaaataaaagaggacacaaacaaacgaaagaacattccatgctcatgggtaggaagaatcaatatcgtgaaaatggccatactgcccaaggtaatttatagattcaatgccatccccatcaagctaccaatgactttcttcacagaattggaaaaaactattttaaagttcatatggaaccaaaaaagagcccgcatcaccaagtcaaccctaagccaaaagaacaaagctggaggcatcacgctacctgacttcaaactatactacaaggctacagtaaccaaaacagcatggtactggtactaaaacagacatatagatcaatggaatagaacagagccctcagaaataatgccacatatctacaacgatctgaactttgacaaacctgagaaaaacaatcaatggggaaaggattccctatttaataaatggtgctgggaaaactggctaaccatatgtagaaagctgaaactggatcccctccttacaccttatacaaaaattaattcaagatggattaaagacttaaatgttagacctaaaaccataaaaaccctagaagaaaacctaggcattaccattcaggacataggcatgggcaaggacttcatgtctaaaacaccaaaagcaatggcaacaaaagccaaaattgaccaatgggatctaattaaactcaagagcttctgcacagcaaaagaaactaccatcagagtgaacaggcaacctacaaaatgggagaaaattttcacatcctactcatctgacaaagggctaatatccagaatctacaaagaactcaaacaaatttacaagaaaaaaacaaacaaccccatcaaaaagtgggcaaacgataggaacagacacttctcaaaagaagatatttatgcagccaaaagacacatgaaaaaatgctcaccatcactggccatcagagaaatgcaaatcaaaaccacaatgagataccatctcacaccagttagaatggctatcattaaaaagtcaggaaacaacaggtgctggagaggatgtggagaaataggaacacttttacactgttggtgggagtgtaaactagttcaaccattgtggaagtcagtgtggcgattcctcagggatctagaactagaaataccatttgacccagccatcccattactgggtatatacccaaaggattataaatcatgctgctataaagacacatgcacacgtatgtttattgcggcattattcacaatagcaaagacttggaaccaacccaaatgtccgacaatgatagactggattaagaaaatgtggcacatatacaccatggaatactatgcagccataaaaaatgatgagttcatttcctttgtagggacatggatgaaattggaaatcatcattctcagtaaactatcgcaaggacaaaaaaccaaacaccgcatgttctcactcatagatgggaattgaacaatgagaacacatggacacaggaaggggaacatcacactctggagactgttgtggggtggggggagaggggagggatagcattaggagatatacctaatgctaaatgacgagttaatgagtgcagcacaccagcatggcacatgtatacatacgtaactaacctgcacattgtgcacatgtaccctaaaacttaaagtataataataattaaaaaaaaaaaaagaaaaagagggaattctcccaaactcattttatgaggctagcatcatcctgataccaaagcctggcagagacataacaaaaaaaaaagagaattttaggccaataaccctgatgaacattgatgtgaaaatcctctataaaatactggcaaaccaaatccagcagcacatcaaaaagcttatccaacatgatcaagtgggcttcatccctgggatgcaagactggttcaacatatgcaaatcaataaaagtaatccatcacataaacagaaccaatgacaaaaatcacctgattatctcaatagatgcagaaaaggcctttgacaaaatttaacagcctttcatgcaaaaaactctcaataaactaggtgttgatggaacgtatctcaaaataataagagttatttatgataaacccacagccaatatcgtactgaatggccaaaagctggaagaattccacttgaaaaccagcacaagacaaggacaccctctctcaccactcctattccacatagtattggaagttctggctagggcaatcaggcagaagaaagaaataaagggtattcaattaggaaaagaggaagtcaaattgtctctgtttgcagatgacatgattgtatatttagaaaaccccattgtctcagcccaaagtcttcttaagctgataagcaacttcagcaaagtctcaggatacaaaatcaatgtgcaaaaatcacaagtattcctatacactaataatagacaaacagagagccaaatcatgagtgaactcccattcacaattactacaaagagaataaaatacctaggaatacaacttacaaaggatgtgaaggacctcttcaaggagaactacaaacccacttctcaatgaaataaaagaggacacaaaaaaatggaagaacattccatgctcatggataggaagaatcaatattgtgaaaatggccatactgcccaaggtaatttatagattcaatgccatccccatcaagctaccactgactttcttcagagaattaataaaaaactacttttaatttcatatggaaccaaaaaagagcccacatagctaagacaatcctaaacaaaaagaacaaagctggaggcatcacgctacctgacttcaaactatactacaaggctacagtaaccaaaacagcatggcactggtaccaaaacagagatatagaccaatggaacagaacagagacctctgaaataacaccacacatctacatccatctggtccttgacaaacctgacaaaaacaagaaatggggaaaggattctctatttaataaatagtgctgtgaaaactgggtagccatgtgtagaaagctgaaactggatcctttccttacacctagacaaagattaactcaagatggtttaaaaacttaaatgtaagacctaacaccataaaagctctagaacaaaacctaggcaataccattcaggacataggcatgtgcaaagaccccatgactaaaacaccaaaagcaatggcaacaaaagccaaactagacaaatgggatctaattaaactaaagagcttctgcacagcaaaagaaactatcatcagagtgaacaggcaacctacagaatgggagaaaatctttgcaatctacccatctgacaaagggctaatatccagaatctacaatgaactcaaacaaatttacaagaaaaaaacaaacaaccctatcaaaaagtaggcgaaggacatgaacagacacttctcaaaagaagacatttatgcagccaacagacatatgaaaaaatgctcatcaccactggtcattagagaaatgcaaatcaaaatcacaatgagatgccatctcacgccagttagaatgtcgatcattaaaaagtcagtaaacaagagatgctggagaggatgtggaaaaataggaatgcttttacactgttgttgggactgtaaattagttcaaccattgtggaagatagtgtggcaattcctcaaggatctagaactggcaataccatctgacccagcaatcccattactaggtatatacccaaaggattataaatcatgctgctataaagacacatgtacacgtatgtttattgtggcactattcacaatagcaaagacttggaataaacccaaatgtccatcaacaatagactggattaagaaaatgtggcacatatacaccatggaatactatgcagccataaaaatggatgagttattgtcctttgcagagacatggatgaagctagaaatcatcattctaagcaaactatcacaaggacagaaaaccaaacaccgcatattcacactcataggtggagttgaacaacaagaacgcatgcacacagggtcgggtacatcaaacattggggcctgtcagttggtgggggctgggggagggatagcattaggagaaatacctaatgtaaatgatgagttgatgggtgcagcaaaccaacatggctcatgtgtacctaagtaacaaacctgcacattgtgcacatataccgtagaacttaaagtataataaaaaaaattaaatttaaaaaaaagaaagatgagaaggacataacaagcaaataagaagtcaggtatagaggcacagagcatgaaaagcctggctttgggagaagagtccagttgcatatgcctagagtctagtgttttgtgggcagggtaaggaaaatgcaactggagatgtatgatatcacgttttggaaggagagagtggaaaccaacagaaatctttaagcaggatgatggcatgagcctctttgttatgggggaagatgcctctggtagatatgtgaaagacaggctgcagtgggaagaagcagtagtgaaaagaccaaaagtggtaagctgttgtaatataccacacaaaagaagacagaggattgaaacaagacattgatagtgaagacagagagctaggggtaaattcaaaagaagtttctaatgtagaagggacaagatttgttaaaataagggttgtaataggtgaagcggggagaagaaccatagccaccaagcctctaacttgcacattttaagtttgaactgttaacataagtctacagatttgcagagtagagggaaacttaacaagcttgaatcattttatgaaaagagtagctctggagaccctaaccttgaatggattagaagataagggtaggatccacgttatgatactaagaagacagaaatacaagtttgagctcaggagagagattagtattagagaaaaatatctggcatcattggcatatatagacatgaaataggagaaagtaaggtaactcaagaagagtgcacagaggtgaattcagaagaggaccaaagatgtaggccctagaaacactactactgaatggattaaaagaagattagccatcaaaagagaattaaaaggaacaagaattaatttattccaaattgtccaaccactctattctattattattgatcacctaatacagaacaatcattgtaggtaccagggagtagggattataaaaattaatatgatagagtttctgggcaaggattgggctctaatggggttcacagaaaatttgagagacacttgcaaaactgttgcatagctgctacaacagaaaaacttacatggtggaaggagagtacaggacagcacccatttaaaggacaatcaagaaaaattatgaaaccaagagaaaagagattatcaaaaaacagtatcagcactgtcaaatgtgatctctgcacagatgttattaaaatttgaatgttggtatttatagtctctatcaagttgctccttccagtaaaacatgctgactcttaaccctcaaaacatttttagtggtcactttacacattctatcataacgtatcacagagcaattgaggcatgtctgagaggctgtgaaaaggaaagtaatcgtgttttataacttatacactcaaattaacactatttagactgcaaagtgatccttggacagtcaggaggttctagaaaatcccttgaagttccacagatactgtattttcccccctagagttacaagagtggtggaagaggaaaaacaatggctaatatagttttaaaaaatgttgctgaatgacattctatttggtcaggcactgagcaggccctgaatacccagcaaggcatgtagtgtggtttgacactgctaagtactatagatttgtgctcagtcccagctctgccccttgcatgctagattttaatgtttcattttataaaatgaatgatttgaatagaatattcaacattttgtggctcagtgagcctaacttgtatgaagaaaagatatagtctctaaggaataagcaactaataaacaaaaatgtacaacatggccaagaagtccttacgcataagattttgtcttctgtgagttatttgtttaataacaatttcaggtaataacagttaaagacctaaaaatcactaaagaacataacagaaaatcaaggtttacatggagaatgaatgagaacatgcagatcatttataatgagcacacacatgtattttctgtgtatatttaaaaacagttaatgtgcactgactgcttaccatccaccagacactatgctaaatattccatacacaatattactaatctccacaacaactcagtgaattaggaattattattattcccattttacagattagaaaggggcttagagaggttaaatattttgttcaaggttacaaagctaatcactgacagtagtaggttctaacacaatttacctaaatccacagcccatgttcttcaccattccacaatactatttataaatcatggtaactataaagagaggtgaaagaaaagtattgaatccagacatgtaccaactgattgaaaattatgtaaagtgaatcagagaaagtctcattaaggaaatagatcagaagatatgctttaaagttagattatcaagagatattaccataatactgatctaaataatccaaaagtgtttcactttcatggaggaaaaaactaagctagatatactcattttaagtcaacagttatcatctaatcactacagtaaattttacctcttatgtcatagtgagtactgaatttccacacaatttattcttcaattatagagtcacacaacttatacagagggtagactgatggatatcaaacattggactctgaatgaaaagtttattcaggagaccattagacaattacatccaaatatgtgtgcctctgataagaaaccaggctgcaatttaacaaattctctctgacagagacagcaggagaaaaaaaaaaagaaggaaaaaaggaaggtatctgtagaagttaagataaatatcactgagaaaagagagtcaagcttcatgagagaatctcagagtcagcattgtagggaagtggaggaaattctgaaaggaatttttaaaaaaacagaaaaagttagaatactgaaagcacattcaaaagcattgaacgacctatcaaaactgaattctgttaaatctaagcagctgctgtggtgtgtcatcatgttgctgagacagaagacccaattacaactttagtggctaaaccataaagatacgatgactggtgagagctggtaaaaaaaaatgccgagagtcagaaaaactatttgatataaagaatttctcttcctctggtattcaataataacactcatcagcatgacttttattcattcattctttaacaaatatttattgaggccactgttttgggtaccagaaacagagtaagttaaacaaaacaaaaatctctgctcctgcagagcttagattctggtccaataaaccatttttcagtgaaatatatatagtataaaagatggtgctaagaactatgaggaaaaataaaggaaggaaatgaaaatgaggaacatgggagacaagcccaagggaaatgcattttttaaaaggaatgagaggaaaggactcaataagcagataacgtttaagcagaaacctgaaggagatagagaaaagagtcatggagatattggaggaagaatgtagaatggccagtgcaaaggccctgaggcaagagtattcttggcagcttacaggaaaagcccaatgaccagtatgcctagattagagtgagagaacgaaaaatcataagaatgaagtcgaaagagtagtggaggtagagggaccaaatcatgtatgatgtttcaggccattataagaactctagtttaacttaaatgaaatggaaaaattttgcaaaatttttagcagagaagaaacataatcttctacatgttaaaaggtagtaaaggcaagcctagaagagaaccagttggaaggctaatgggtatattcatgaatgccttaaaattgctatcaattcttaaagaataatggttaaaacttaggctctggagtcaaacctgtgttcaaaccctaactcaactacatacccaagcctaaatttcttcctacatgaaataagaatccaaaaaagaagtattaaacaaccaaacaactgctgtgtgtcagaccctgttctatcatatctaatattagatttccttctgaagtggactaggaggcaagaatttgagtgcaatttgcttattagggaagaacaggaatcatatcacgggagtcacgaagcagcacaagcagggaaagtcagcctatgtagagtatgttaccacaccaactactgcagtggacagctgaaacttaatcacacagaaaaactctgggaaagagactacaacacagaattgtcccacccaagaagcagggagatggaataatacttatactccaagttgagtcagccatgagttataggcagctacagagaggtgttaatttccatgtactccagtctgtccctgtctttcatcagcagaatggctttctgcggttcttgaaaaagccctcaagcatggagaggcacatatggctgttggaagtcttttggagtacactgaaacaggctgatctgagggatatgggtcaggcaccgacagcaactgctatatatctagacaaaaaaaaaagactgacagtctataacacaaaatgctaaaagtatttatttctcaataacaagaattttttgtgttctgtattttattttctgggcacctttttatcttaaaaattctgtaacaaatatttattatttataaaataagatttaatatataatatctaatatttatagaaatcttttttttgattttggaattattttctttttttaattcaaaatacagagtttaatcataacttattgctgtgtaaccgtcagaaaatataaaaccagaaatagttaaaagaaattatccctgacatataacagaactgacatttgggtgggcagaattggtatttatcttctattgtaaattgttttgtactattatttttattattattattattattatactttaagttttagggtacatgtgcacaatgtgctggttagttacatatgtatacatgtgacatgctggtgcactgcacccactaactcgtcatctagcattaggtatatctcccaatgctatccctcccccctccccccaccccacagcagtccccagagtatgatgttccccttcctgtgtccatgtgttctcattgttcaattcccacctatgagtgagaacatgcggtgtttggttttttgttcttgcgatagtttactgagaatgatgatttccaatttcatccatgtccctacaaaggacatgaactcatcattttttatggctacatagtattccatggtgtatgtgtgccacattttcttaatccagtctatcattgttggacatttgggttggttccaagtctttgctattgtgaataatgccacaataaacatacgtgtgcatgtgtctttatagcagcatgatttatagtcctttgggtatatacccagtaatgggatggctgggtcaaatggtatttctagttctagatccctgagcatcttgtttcttactgagctcttatgacaacttagtgaggagaaggaattattattattatttcaattttacaaagaaaattgagtcattgagaaatcgaatggattgctccaagttgcatcagcagttattggttaagacagcttgtgtagatgtcatgattccattaccttttaccattcatagtctcaccaccttgaatatagatactaagtcaaacactttattttacagatgagacaaatagggtacagagtaattaaccccaggtcacatagccagagaaaaatgaaagcttcaggccttctgagtcctggtttacatgtaatctggttcacacaaggttaagaacatggactctgtatccacgctatctgggctcaaaggcatccagagccactttggcaaggtgaccttgagcagtttttcctccctaaaaggggaatataaaaatgtctacatcagggtaatggtaagcattaaaataacaaatgcctgaaaattatggtcaggagtatcatataataattgctattattaaaggagaaaaaaatggatacagaaaagaaactgcctaggattaaggagttcaatggatcttggaaggaaagagttttagcatttgtattgtagtccggttacacattaaagaatcttgaactcacttccaaaacttctgattaaggtcatcaagactaatgccaatgggaggcagttatatatctgggggggtggagaaataccgaatactgggcttgaactctggttctgacacagctatttgaccttcagcaaattatttaaactctctgtatgaagattttctcatttacaaaatgggaagagaagtacttaaaactcagaacagtgtctacactacataggaagtaatcaataaatgttgctcattatcattactagatgttggagctgctcagttcaacgcatattaaattaaaagagaagaactgtgaccgaatataacaggatttcatcctggagacaaaagatacaatttgatcctaggtagggatgtttacagtggtgggtccaggttttagtacggaatggcatagcatactagaatcttttattgtcagcagcattaaacatatgtgctcatgtaaatcactactgcaaaattgatggacacataagacaagaataagaagttagcaagttaatgaaaacaaagaggaaattgtacacttaagggtgtgaagtagaagaggctttttctctcccattatgagaatcagcacctcattttttatattacagatacactgcatttcatcttcttcaaagtgcaagagctgtcttgagcaagataaataaaatgtaatcactgtgaaactgaatattaatatatttattagtatgaatattaataaatataaattaagtacaaatcaggaccaatagtagcccataagccacttttgagtaaagtagaaaaaggtgcccctttctcaaaagaatttactttcatctgttaggaaattgtcataatataattattttcttataattaaacacttcactacaatctgccccaaaattgtaatgaatgtacaaatttaagatgtgagtgatgttagtggtatgccctaggattgtgtagtgaaaatatgaacaactgtataccagtgggtccgcttaatgtgtgtttaatgaatgaagtatttgtcataaaaattcactttgctaaacgctgaaaatgtgcatatttaagaaaatatggtctcagccctcatgaagctcacaaccaaataaacaaatgagtacactatggtatagtaagtgatgtgttacaggggagaaattcctaaactgagtaggagtctgtattaacagatttgcacatactttaatggcagtgattataaaaactaaaacagccacccccaattatctggagtaggtcgatgctcattattgtcactctttgcttcagttgacagatgccttaaaccaaagaaaacaaagccacagcaagtttgcttccagaggcaaactattcctatagttagtgaacctgctaggaaggcatagctaatttatcccactggaaagagataagggaaagaaggtaagtgaaagggaaataaaagcaagagatttgagggaatattcttcagagcagaaaacagaaaagcagaagtataaagagaacaagtacaaaggaggaggaatagtgggaaagaagagaaataagtgacatgatcaaggcagtaccttattattacatgcatgcagtgtacatctgcaaaaaattaaaagtaaaagaaaaataaggacaaaaaagaggaagcataaaatgagaaagaaaaagaaagcttggaaatgaagagaggaaacatggcatttagctagactccaagacacttacaaaagtagtctatgagtctcttgcagcgttaaagaacatagacattataagagagggtactagttgggatattgaattctcaaattgctttgacctcaagtttatcatgttgaatttgcaaatattaataacaaatttgttgttgaaatattaggcttgcagcatagcagttttgataccactaatttctattgtttcacatctgtaaaatataggtgttgcaaattgtacctaattgtgatgatcaatgtcattcagtcatatgcatacatccacattttgagcatacgaaatggataattattctgtcaacagatagatctgtaaaatgatagatgatacatttatttgattgatgggagtgataagcggtgttgaggaaaatagtgattttagcctcatggaagaattattcaagtagaaatatgagaattccaatacaaaaaatagctctaattctagcctaagaacaagaaatataaccaatttgcttattcatactatcacaaataagaaaaagccctccacttctacacctctgactgcagtgtcttttctcattctccaaacttatctaaatttaaatatttcaaggctaaaacaaaatgctcctctgcaaatccattctattctcccctatgctgtatcaccaatgtgtttttggtaattgaactcaggtccaatttgagctctgattagtctaagccaatcatgtttaaatcatgtcctatcttcttttccaggcctgagcaaatcaacccatgtcattcccctggtgatattttagagttaggaataagcatatggcctaagtcggctcaataagactgaaggaaatgatttttgttcaatagctggcaggaggcatccattctcttctgtttgataaaataaggaattgtatagtcctcattgctctggcaggtagctgaccacagaccatgaggaagaacagccctaggatgaaacaacatgatggatggtagggaggtaagacagaggaacctggattcctgatgacattctttttttcccataggttattggggaacaggaggtgcttggttacataagttctttagtcgcgatttgtgagattttaatgcacccatcacctgggcagtatacactgcaccatatttgtactattttatcctcgcccctttccattcttttccacggagtccccagagttcactgtgttattctaatgcctttgcatcctcatagctcagctcccacttatgagtgagaacatatgatgtttggtttttcattctatgtaatttcacttagaataatagtctccaatctcatcccagtctctgtgaatgctgctaactcattccttttgatggctgagcagtatttcacacacacacacacacacacacacacacacacacatatatatatatatatatatatatatcacagtttcttaatccactcattgatggatgggcatttgggtgggttctacgtttttgcaattgtaaactgtgctgctataaacatgtgtgtgcaaatatctttttcgtataatgatttattttcctctgggtagatagccagtactgagattgttggatcaaatagtggttccacttgtagttatttaagaaatctccaaactgttttccatagtggttgtactaatttacatacccaccagcagtgtagaagtgttccctcttcaccgcatccctgccaatatctaccattttttgattttttattgtggccattcttgcacgagtaaggtggtatcgcattggacttttgatttgcatttccctgatcattagtgatgttgatcattttgtgtatgtttgttggccatttgtatatcttcttttgagaactgtctattcatgtccttagcccactttttgatgaaattgttttcttcttgctagtttgagttcattgtagattctagatattaatcctttgtctgatgtatagattctgaagattttttcccactctgtgggttgtctgtttactctgctgactgttccttttgctgtacaaaagctctttagtttaattaagccccagctatttatctttgtttttattgtgtttgtttttgggttcttggtcatgaaatccttgcctaagccaatgtctagaaggatttttttgatgttatattctagaatttttagagtttccggtcttagatttaagtccttaatccatggtgagttgatttttgtataaggtgaaagatgaggatccagtttcattctcctacatgtggctagccaattattccagcaccatttgttgaaaaaggtgtcctttccacactttatgttttggtttgctttgttgacgatcagttagctgtatttcggtttgtttctgggttctgtattctattccattggtctgtgtgcctatttttataccagtgccatgctgtttgggtgactatggccttatagaatagtttgaaatcaggtaatgtgatgcttccaggtttgttatttttgcttagtcttgctttggctatgcagcctcttttttggttctatatgacatttagaatttttttttagttctctgaagaatgatggtggtattttgataggaattgcattgaatttgtagattgcttttggcagtacggtcattttcacaatattgattctacccattcatgtgcatgggatgtgtttccatttgtttgtgtcatctatgatttctttcagcagtgttttgtagttttccttgtagaggcctttcacctccttggtttggtatattcctaaatatttcacttttcttccagctattgtaaaaggggttgagttctcaatttgattatcagctttgtcgttgttggtgtataaaagagctactgatttgtgtacattaattttgttttctgaaactttgctaaattcttttatcagttctaggagctttctggaggagtctttagggttttctaagtaaacaatcacatcatcagcaaacagcgacagtttgacttcctctttactgatctggatgccctttatctcttcctcttgtctgattgctctggctagggcttgcagtactgagttgaagagaggtggtctgaaagagtgcttgatataatttcaattttcgtaaatttgttgaggctcattttgtggcctatcatatagtccatcttggagaaagtttcatgcgctgttgaatagaatgtatattctgcggtttttggatgtaatattctatatatatctgttaagtccatttgttccagcgtatagttttaatacattgtttctttgttgactttctctcttgatgatcactctattgctgtaagtggagtattgaagtcccccactattactgtgctgatgtctgtctcatttcttacatctattagcggttgttttataaattgggtagctccagtgttaggtgcatatatctttatgattgtgacattttcctgttggacaaggcattttatcattatataatgtccctctttctctttctttcattattatactttaagttctgggagacatgtgcagaacgtgcagattttttacataggtatacacatgccatgggggtttgctgcactcaccaactggtcatctacatgaggtatttctcttaatgctatccttcccctagccccacaccccctgacaggccccagtgtatgatgtacctctccctgtgtccatgtgttctcattgatcaactcccacttatgagtgagaacatgcagtgtttggttttctcttcctgtgttaattagctgagaatgatggtttccagcttcatccatgtccctgcaaggggcatgaactcatcctttttatggctgcatagtattccatggcatatatgtgccacattttctttatccagtctaacatttatgggcatttgggttggttccaagtctttgctattgtgaatagtgccacaataaacatacatgtgcatgtgtctttatagtagaatgatttctaattctttgggtttatacccagtaatgggactgctgggtcaaatggtatttttagttctagatccttgaggaattgccacactgtcttccacaatggttgaactaatttacactcccaacgacagtgtaaaagcattcctatttctccacatcctctccagaatctgttgtttcctgactttttaatgatcaccattctaactgatgtgagatggtttctcattgcgattttgatttgcatttctctaatgaccagtgttgatgagttttttttcatatgtttgctggctgcttaaatgtcttcttttgagggtgtctgttcatatcctttgcccactttttgttgggtttttttcttgtaaatttatttaagttctttgtagattctggatattagccctttgtcagatggatagactgcaaaaattttctcccattctgtaggttgcctgctcactctgatgatagtatctatcatcagatactaactaaactaaagagtggaagctctttagtttaattaaatttcatatgtcacttttgggttttgttgccattgcttttggtgttttagtcatgaagtcttggcccatgcctatgtcatgaatggtattgcctaggttttcttctatggtttttacggtttttaggtcttacatttaagtctttaatccatcttaagtttatttttgtaaaaggtgtaaggacggggtccagtttcagttttccgcatatggctagccagttttcccaacaccacttattaaatagggaatcctttccccattggttgctttcgtcaggtttgtcaaagatcagatggttgtagatgtgtgacattatttctgaggcttctgttctgttccattagtctattgtcaaagatcagatggttgtagatgtgtgacattatttctgaggcttctgttctgttccattagtctatacatctgttttggtaccagtaccatgctgttttggttactgtagccttgtagtatagtttgaagtcaggtagcatgatgcctccagctttgttctttttgcttagaattgtcttggctatacagactgttttttggttccatataaaatttaaagaagttttttttaattctgtgaagaaagtcattggtagcttgatggggatagcattgaatctgtaagtaactttaggcagtatggccattttcacaatattgattcttcctatccatcagtatggaatgttcttccatttgtttgtttcctctgtcatttccttgagcagtggtttgtagttctccttgaagaggtccttcccgtcccttgtaagatgtattcctagggattttattctctttgtggcaattgtgaatgggagttcactcatgatttggctctctgtttgtctattgttggtgtgtagaaatgcttgtgatttttggacattaattttgtatcctgaaactttgctgaagttgcttatgagcataaagagcttttcggctgagatgatgggattttctaaatatacaataatgtcatctgcaaacagagacaatttgacttcctctcttcctatttgaatatgctttatttctttctcttgcctgattgccctggccagaacttccaatactatatcgaataggagtggtgagagagggcatccttgtcgtatgccagttttcagagagaatgcttctagcttttggccattcagtatgatattgactgtgagtttgtcataaatagctcttattattttgagatatgttccatcaatacccttgtttattgagagtttttagcatgaagtggtgttgaattttatcaaaggccttttctgcatctattgagataatcatgtggtttttgtctttggttctgtttatgtgattaataacttgtattgatttgtgtatattgaacaagccttgcatcccagaaatgaagctgacttgatcatggtggataagctttttgatgtgttgctggatttggtttgccagtattttattgaggatttttgcaccgatgttcatcagggatactgacctgaaatattctttttatggtgtgtctctgccaggctttggtatcaggatgatgctggcctcatcaaatgagttagggaggagtgtctctttttctattggttggaatagcttcagaaggaatgacaccagctcctctttatacctctggtagaattcggctgtgaatctatctggtcctcagctttttttggttggtaggctattaattactgcttcaatttcagagcttgttattggtctattcagggattcaacttcttcttgctttagtcttgtgagggtgtatgtgtccaggaatttatccatttcttctagattttctagtttatttgcatagaggtgtttacagtattctctgatggtcatttgtatttctgtggcttcagtggtgatatcacacttattttttattgtgtctattatattcttctctcttttcttctttattagtctggctagcagtctatctattttgttgaacaaaaaaacagctcctggattcattgatttttttgaagggtttttaatgtctctatctctttcagttctgctctgatcctagttatttcttgctttctgctattttttgaatttgttttctcttgttcttctatttcttttaattgagatgttagggtgtcgattttagatctttctcactttctcctgtggacatttagtgctataaatttccccctaaatactgctttacctgtgtcccagagattctgatacagtacactttgtttttgttctcattggtttcaaagaacttatttatttctgccttaattttgttatttacccagtagtcactcaggagtaggttgttcagttttcatgtagttgtgtggttttgagagagtttcttaattctgagttctaatttgattgcactgtggtctgagagactgtttattatgatttccattcttttgcatttgcttaggagtgttttacttccaattatgtggtcaattttagaataagtgtgatgtgtgctgagaagaatgtatattctgttgatttggggtggagagttttttagatgtctattaggtctgcttggtccagagctgagttcaagtcctgaatatccctgttaattttctgtctcattgatctgtctaatattgacaatggggtgctaaagtgtcccactattactgtgtgggagtctatgtctctttgtaagtctctaagaacttgatttacgaatctcagtgctcctgtattaggtgtatatatatttaggatagttagctcttcttgttgcattgatccctttaccattaagtaattcccttctttgtcttttttactctttgttggtttatcagagactaggattgtaaccactgctttttgtttgctttccatttgcctagtaaatatccttccatccctttattttgagcctgtgtgtgtctttgcacatgagatgggtctcctgaatacagcacactgatgggtcttggctctttatcctattttccagtctatgtcttttaattggggcatttagcccatttacatttaaggttaagattattatgtgtgaatttgatcctgtcattatgatgctagctgtcagtaagttgatgcagtttttcatagtgtcgatggtatttacaatttggtatgtttttgcagtggcttgtactggttgttccttgacatattcagtgcttccttcaggaactcttttaaggccaggccctgtggtaacaaaatctctcagcatttgcatgtgtgtaagaaattctatttctccttcgcttatgaagcttagtttggctacatatgaaattctgggttgaaaattattttctttaagagtgttgaatattggcacccactctcttctggcttgtagggtttcttaagagagatctgatgttagtctgatgagattccctttgtgggtaacccaacctttctctctggctgcccttaatcttttttaccttcatttcaaccttaataaatctgtcgattatgtgtcttgggattgctcttcttgaggagtatctttgtggtgttctctgtatttcctgaatttgaatgttggcctacctttctaggttggggaagttctcatggataatatcctgaagcgcaagcatgttttccaacttggctccattcttctcatcattttcaagtacacctatcaaatgtaggtttggtcttttcacatagtcccatatttcttgaaggctttattcattccttttcattcttatttctctaatcttgtctgcatgctttatttcattaagttgatcttcaatctctgatatcatctcttccacttgatcaactcggctattgatacttgcatatgcttcacaaagttctcatgctgtgtttttcagctccattaggtaatttatgttatcctctcaactggttattctagttagcaattcatctaaccttttttcaaagttcttagcttccttgcattgggttagaacatgctcctttagctaggaggagtttgttattacccacattctgaagtctacttctgttaatatttcaaactcattccccatccagttttgttcctttactggcaaggagttgtgatcctttggaggtgaagaggcattctggtttttggaattttcagcttttttgtgctggtttttccccattttcatggatttatctacctttggtctttggttggtgacctttggatggggttttcatgtgcatgtcctttttgtggatgttgatgctattcctttctgttttttagttttccttctaacagtcaggcccctctgctgcaggtctgctggagtttgctggaggtctactccagaccatgtttgcctaggtatcaccagtgaagtatgcagaacagcaaagactgctgcctgttccttcctctggaagcttcgtcccagaggggtgcccaccagatgccagccagagttctcctgtatgacatgtctgtagactcctgctgggaggtgtctcccagttaggaatcttgggggtcagggacccactcgaggaggcagtctgtcccttagcagagcttgagtgtgctgggagatccactgctatcttcagagctggcaggcaagaatgttcaagtctgctgaagttgagcccacatccccccttcccccaggtgctctgtcccaaggagatgggagttttacctataagccccctgactgtggctgctgcctttctttcagagatgtcctgcccagaaaggaggaatccagagatgcactctggctacagtggctttgccaagctgtggtgggctctgcccagtttgaacttcctgacagctttgtttacactgtgagggaaaaaccaaccacctactcaagcttcagtaatggtggatgcccctccccccaccaagctcgagcatcccaggttgacttcagactgctctgctggcagcaagaatttcaagccagtggatcttagcttgctgggctccctggccgcaggatccactgagctagaccacttggcttcctggcttcagccccatttccagaagagtgaacagttgtgtcttgttggcattccaggtgccattggggtattaaaaaaataaaaataaagataaaataaaaatgaaaaaaacactcctgccactagctcagtgtccaaacagctgcccagttttgtgcttgaaaagccagggccctggtggtgtaggcacctgagggaatctcctgttttgtgggttgtgaagaccacgggaaaagcatagtatcggagccggagtgtaccattcctcatggcacagttcctcacagcttcccttggcaagaggagagagttccctgaccccttgcatttccctgcttcagcttgtcctttgtgggttgcacccactgtttaaccagtcccaatgagatgagctgggtacctcagttggaaatgcagaaatcacacccctcctgcgttgatctcgctgggagctacagaccggagctgttcctattcggccatcttaccagccatccatccctcccccttttttttttttaactgctgttgctttgaagtttgtttcatctgacataagaatagctacttctgcttgctttttgtgtccatttgcctgaaatgtcttttttcacccgtttaccttaggtttgtgcaagtccttatgtgttaggtgggtctcttgaaggcagcatatagttggttagtgaattcttaacctttctgcaattctgtatcttttaagtggaggatttaggtcatttacattcaatgttagtcttgaaatgtgaggtaccattccattcatcatgctatttgttgcctgtataccttggttttttgttttttgtttttgtttttcttgaattgtacttttgttttcttggtcctctgagatttaggctttaaacagtttccattttgatgtgtttccaggatttgtttcaagatttagagctccttttagcagtttttgcagtggtgggtcggtagtggcaaattctctcagcatttgtttttccgaaaaaggctgcatctttccttcatatataaagcttagtttcactggatacacaatttttggctgattattgttttatttgaggaggatgaagatagggccccaatcccttctagcttgtaaagtttctgctgagaaatgtgcttttaatctgataggttttcctttataggttacctggtgcttttgtctcagttcttaagattctttccttcatcttaactttagataacctgataacaatgtgcctaggcaataatctttttgcaatgaatttcccaggaattctttgtgcttacctgtatttggatgtctaggtctctagcaaggccaggaaaattttccttgattattcctctaaatatgctttccaatttttagatttcttttcttcctcaggaactcagattactcttaggtttggttgtttaacataatcccagatttcttggaggctttgttcatattttcttcttttccctttgtctttgttgggttgggttaatttgaagaccttgtcttcaagctctaaatttctttcttctacttgttcaattctattgttgagattttccagagcattttgcatttttataactgtgtccattgtttcctgaagtttttattttttttggtgggggggatttgtcggggtttctttgtttctttgttttttgagatgattctcttgcctcagcctctggaatagtggggattatagacacgtgccaccacatctggctgatttttgtatttttagtagagatggggttttaccacattggtcaggctggtctcaaacccctgacctcaagtgatctgctcatctcagcctcccaaggttctaggactacaggcacgagacaccacacctggcatgattggtttttatttctgctatctatttctttgaatatttctcccttcacttcttgtatctttttttttatttccttacattgggctttgcctttctcttgtgcctccctgattagattaataactaaactcctgaattctttttcaggtaaatcagggatttcttcttggtttgggtccattttttttgagctagtgtgatttcttggaggtgttaaagaaccttgttttgtcatgttactagagttggttttttggttccttctcatttggttaggctgtgtcagagggaaggtctagggctgaaggctgttgttcagattcttttgtcctacaagttgttctctgaggtagaactctcccctttttcctatggatgtggcttcctgagagctgagctgtagtgactattatcactcttctgggtctagccacccagcaagtctaccaagtactgaggcttgtctgcacagagtcctgggatgtgaactgtctgtggatctctcagctgtggataccagcaccttttccagtggaggtggcaggtggatgtactggatcctgtgacagttcttagctttggtggtttaatgcactatattttgctggttggcctcctgccaggaggttgagctttccagagagtatcagctgtggtaatatggggaggaacaggtggtgggcagggccatagaactcccaggaatatatgccctttgtcttcagttaacagggtgggtagggaagaaccactgggtgggaagagggctaggtgtgtctgagctcagactctccttgggcgggtcttgctgcagctgctgtgggggatgggggtgagcttcccaggtcaatggagttatgttcctaggaggattatgactgtctctactgtgctatgcaggttgtcagggaagtggggaaaagccagcagtcacagatctcatccagctcccatgtaatcctaagggctggtctcacacccaccatgcccccaccaacagaactgagtctatttccaggcagttggaaagcatggctgagaacttgccccactacctgcatcccagctgcaaaagcaaatatggcttcccttcttcccccacctacggagtctgtacaacagattcatgccctcccccaggttctggccaggaggcttcttgatcagttcaaattgttacaaagttcagctagagatttcccccatggccatttccccatggccttttcccagtgcctctggccaacctcccaaaggaccccatgaggccaggcaaaaatggcttgctaggggacccattgcttcgtctaccactgtattttgcttggctgtctacactgactcagctccaggtaaggtcaatatcgtctcccataatcaaggccttcagtttccctagctggggggtgtgttcaagggtggatgatccccctttcccactttcacaatttgggcactcacagtatttggatgtctcccaggtactgcaggagcaatcttcttttttcgggggatctgtgggttctctcaggtttcctgatttattcctgccatcactctggagcaaaaattcatgatgcaaggcttcatatgctgctctgtccatccaagtcagagctgcaatctagtcctacctcccatccgccatgacccccagttctcctgggatgacattcatgattcattgaataagacaaccctgaaacccagcctactgatatccagttagcagagtcaataaatttccttgacatttaaaccagtttgcattaggttttttcttatgtgaggctgaaagtatccaactgaagtagatcccaggggttaggcattactattctcttatatattacagatagtgaagcactaggtattattaacttcagagaggttaagtaaatggcccaaagttggtgaggtaagacgaagcagacctgacattcaaactctgattttttttaactctaagatctatattccaagctctctacaatgacaatgtgaggatacaagggaaaaacagccctccacaaatcaagaacaattccctcaccaaacactggatctcccagcacctgttcttcgacttcgcagcctgcagaatggtgagaaataaatttctgttgcttaagccaccctatctatggtattctgttataaaagcctgaactgactaagaaagtttccatggtcaccttaatccactgaagttagtacttctagagcaaaaaacaaacaaacaaacaaaaaaacaaacccaccacataaattcatgccttaccccataaaccagaagaaatactatatgtgaataacagattgtaaattacagaaagcagaataaactatttccaggtcttctgatagatgttaattttctaaggtttaaagcagaacatctcaaagaaaatgttgttaaatacataaaatttgaaacttcaatgcttataaacaacactaatacaaaaaagaatgcaacagagatgaaaaacatttgctctataaatgacaaaaggttaatacttataattttcaaaaaagttcatttaaatacagcagaataaaacaatattgaggtgctatcggtaaaaataacaaggatataaatggaaaatttaccataatgaacatatatattgtaaatagtaaatatttaaatatttatacccaatgtttttgaggttatggtaaaagtggtacactcatacattactggtaacactttaaattgaaaaaaaacttttagaatgtaacttgtcaattcattgtaagaatcataaaagtacctgtaccctttgacctagtaatcctactttcttaaacgtacaccaaaaaataattctaaacaagaaaaaaatcgggggtggaggcaagatggccaaataggaacagctccactctacagctcccagcatgagcgacgcagaagatgggtgatttctgcatctccaactgaggtaccaggttcatctcactggggagtgtcagaaagtgggtgcaggacagtgggtgcagcacaccaagcaagagccgaagcagggcaaggcatcgcctcacccaggaagcgcaaggggtcagggaattccctttcctagtcaaagaaaggagtgacagatggcacctggaaaatcgggtcactcccaccctaatactgtgcttttccaacggtcttagcaaacagcataccagaagattacatcctgcgcctgattcggagggtcctacccccatggagccttgttcattgctagcgcagcagtctgagatcaaactgcaaggtggcagcaaggctgagggaggggcgcccgccattgccgaggcttgagtaggtaaacaaagcagcagggaagctcgaactgggtagagcccaccgcagctcaaggaggcctgcctacctctgtagactctacctctgggggcagggcacagccaaacaaaatcctctgcagacttaaatgtccatgtctgacagccttgaagagagtagtggttctcccagcacgcagttggacatctgagaacggacagactgcctccccaagtgggtccctgacccctgagtagcctaactgggaggcaccccccagtaggggcagactgacacctcacacggctgggtactcctctgagacaaaacttccagaggaacgatcaggcagcaacatctgctgttcaccagtatccgctgttctgcagcttccactgctgatactcaggcaaacagggtctggaatggatctccagcaaactccaacagacctgcagctgagggtcctgattgttagaaggaaaactaacaaacagaaaggacatccacaccaaaaccccatctgtacgttaccatcatcaaagaccaaaggtagataaaaccacaaagatggggaaaaaacagagcagaaaaactggaaactctaaaaatcagagcacctctcctcctccaaaggaatacagctccacaccagcaatggaacaaagctgaatggagaatgacttcaatgagttgagagaagaaggcttcagatgatcaaacttctctgagctaaaggaggaagttcaaacccatggcaaagtagttaaaaaccttgaaaaaaaattagacgaatggctaactagaataaccaatgcagagaagtccttaaaggacctgatggagctgaaaaccaaggcacgagaaatacgtgatgaatgcacaagcctcagtagccaattcgatcaactgtaagaaagcgtatcagtgatggaagatgaaatgaatgaaatgaagtgagaagggaagtttagagaaaaaagaataaaaagaaatgaacaaagcctccaagaaatatgggactatgtgaaaagaccaaatctacatcgattggtgtacctgaaagtgaaagggagaatggaaccaagttggaaagcactctacaggatattatccaggagaacttccccaatctagcaaggcaggccaacattcaaattcaggaaatacagagaaagccacaaagatactcctcgagaagagcaactccaagacacataattgtcagattcaccaaagttgaaatgaaggaaaaaatgttaagggcagccagagagaaaggtcaggttacccacaaagggaaggccatcagactaacagctgatctcttggcagaaactctacaagccagaagagagtgggggccaatattcaactttcttaaagaaaagaattttcaatccagaatttcatatccagccaaactaagcttcataagtgaaggagaaacaaaatcctttacagacaagcaaatgctgagagattttgtcaccaccagccctgccctaaaagagctcctgaaggaagcactaaacatggaaaggaacaaccggtatcagccactgcaaaaacatgccaaatggtaaagatcaccaatgctaggaagaaactgcatcaactaatgagcaaaataaccagctgacatcataatgacaggatcaaattcacacataacactattaactttaaatgtaaatggactaaatgctccaattaaaagacacagactggcaaattggataaagagtcaagacccatcagtgtgctgtattcaggaaacccatctcatgtgcgaagacacacataggctcaaaataaagggatggaggaagatctaccaaggaaatggaaaacaaaaaaaggcagaggttgcaatcctagtctctgataaaacagactttaaaccaacaaagatcaaaagagacaaagaaggccattacataatggtaaagggatcaattcaacaagaagagctaactatcctaaatatgcatgcacccaatacaggagcacccagattcataaagcaagtcctgagagacctaaaaagagacttagactcccacacaataataatgggagactataacaccccactgtcaacattagacagatcaatgacacagaaagttaacaaggatatccaggaattcaactcagctctgcaccaagtggacctaatagacatcaacagaactctccaccccaaatcaacagaatatacattcttctcagcaccacaccccacttattccaaaattgaccacttagtcggaagtaaagcactcctcagcaaatgtaaaagaacaaaaattataacaaactgtctctcagaccacagtgcaatcaaactagaactcaggattaagaaactcactcaaaaccacataactacatggaaactgaacaacctgctcctgtatgactactgggtacataatgaaatgaaggcagaaataaagatgttctttgaaaccaatgagaacaaagacacaacataccagaatctgtgggacacattcaaagcagtgtgtagagggaaatttatagcactaaatgcccacaagagaaagaaggaaagatctaaaattgacaccctaacatcataattaaaagaactagagaagcaagagcaaacacatttgaaagctagcagaaggcaagaaataactaagatcagagcagaactgaaggagatagagacacaaaaaacccttcaaaaaatcaatgaatccaggagctggttttttgaaaagatcaacaaaattgatagaccgctagcaagactaataaagaagaaaagagagaagaattaaatagacgcaataaaaaatgataaaggggatatcaccaccgatcccacagagatacaaactaccatcagagaatactataaacacctctatgcaactaaactagaaaatctagaagaaatggctaaattcctcaacacatacaccctcccaagactaaactaggaagaacttgaatctctcaatagaccaataacaggctctgaaattgaggcaataattaatagcttatcaatcaaaagaagtccaggaccagatggattcacagccgaattctaccagaggtacaaggaggagctggtaccattccttctgaaactattccaatcagaaaaagagggaatcctccctaactcattttatgagaccagcatcatcctgttaccaaagcctggcagagacacaacaaaaaaagaaaattttagaccaatatccctgatgacaaatgggatctaattaaactaaagagcttctgcacggcaaaagaaaataccatcagagtgaacaggaacctacagaatgggagaaaatttttgctatctactcatctaacaaagggctgatatgcagaatctacaatgaactcaaacaaatctacaagaaaaaaacacaaccccaccaaaaagtgggcaaagcattcaaacagacacttctcaaaagaagacatttatgcagccaaaagacacataaaaaaatgctcgtcatcactggccatcagagaaatgcaaatcaaaaccacaatgagataccatctcacgccagttagaatggcaatcattaaaaagtcaggaaacaataggtgctggagaggatgtggacaaatgggaacacttttacactgttggtgggactgtaaactagttcaaccattgtggaagtcagtgtggcgattcctcagggatctagaactagaaataccatttgacccagccatcccattactgggtatatacccaaaggattataaaacatgctgctataaagacacatacacacatatgtttattgtggcactattcacaatagcaaagacttggaaccaacccaaatgtccaacaatgatagactggattaagaaaatgtggcacacatacaccatggaatactatgcagccataaaaaatgatgagttcatgtcctttgtaaggacatggatgaagctggaaaccatcactctcagcaaactatcgcaaggacaaaaaaaccaaacaccacatgttctcactcataggtggaaattgaacaatgagagcacatggacacaggaagtggaacatcacactctggggcctgttgtggggaggggggagggatagcattaggagatatacctaatgttaaatgacgagttgatgggtgcagcacaccaacatggcacatatatacatatgtaactaacctgcgcgttgtgcacatgtaccctaaaacttaaagtataataaaaaaaaagaaaaagaaagaaaaaaatttacatgattgaaatgttaattgtggtatcatttattaaaataaaaaattaggaaaaaatctaattatcctataatagcagtctaggtacaaaaatcattacatatctattgaacataatattctgaatccattaaaaatccaatttttaaaactttaacaaaatggagatattaatgatatcttatgagctaaaatgtgagaagtaaaaatgtaacaattcttagtactccatagagctcccaaaatatttgcttggtagctcagatttgacctcatttctgtgggtttgactgcaaacaggacagggtttatgtttgtaattgaatgctgttttctgggcaactttcacagatgcaactgaagctagtttttaagggggactgaactgtaaagcacaacactcaatcaggaaaacattctgaaaatcattgtcgtgagttttttctaatggaaaagctagccagtcaaaaaaaaaaaaaaaaatacagctgaggcacaagaatcacttgaatctgggaggcagaggttgcaatgagccaagattacaccactgtatttcagcatgagtgacagagcgagactctgtctcaaaaacaaagaaacagaaaaacagtgtaaaaaatgattttgggtttcaaataattggcttaattttttagttttttttatttctatacatcaaacatgtatagaatgcttctgtcaagtttttatgagaagatattcttgtttccaacgaaggagacaaagcagtccaaatatccactttcagatcctgcaaaacgagtgtttcaaaacggcatgtgaatcctgcaccagcagctgaggtatccatgttctgtcattaggactgactaatgacagctagggtgacccacagagaggaaggaagaccagtgtggtgcagtggaccacctgagagccacatgggacaggggagcccccacccccagccaagggaagtggtgagtgagcatgctacccagcctaggcaaccatgctttttccactgaactgtgcaacccatggatcagaagatcccactcgtgagcacagactaccaggaccttggctcccaaccacggagccctgcagattctcaacagccacatggctagaatctgcctaagcctgccaagttcccaggggaaggcagccattaccactgccactgctgcctgctggctaagccagttgagctccttgggggaggggtggcagccaacactgcagcttcagggccaacaactccaaccaggggctcagggaccaaactctgatttcccagagcctgagctcctagcgggagtggtgccacagtctccatgaaccagcagacatagtctttcctcctgctagctctgaggaatctggacaacccagatgagtggggtccccccagcacagcacacactctccaccaagggacagccaaagtgcttcattaaacaggtcctgcttcctatgccatccaactaggtaagagcccccaacaggggttgccagacatcctgtacaggagtgttcctactggcatcaggtcggtgcccctttaagtcaggaacccagaggaaggagcaggcatccatctttgctgttctccagccccatcaagtgacatctccaggcacaggagcaaaataaatgaatagggcctggagcgaactcccagcaaaccacagcagccctaccgaagaggaacctgactgttgaaagaaaaacaaacaaacagaaagcaacaacaatagcatcaatgataaaagtcccccaaaaaatctcatgcaaggatcagcagcctcaaagatcgaatctagacaagtttatgaagatgagaaagaatcaatgaagaaacattgaaaacccaaaagctcagagtgcctcttctcctccaaatgattacaacacctctccagcaagggtgcagaactggacgaaggatgagatagatgaattgacagaagtaggcttcagaatctgggtaataacaaacttcactgaggtaaagcatgttctaacacaatgccatgttcttggcaaagaagctaagaaccttgataaatggttacaggagctactaactagaataaccagtttagagagaaacataaatgacctgatgaaactgaaaaacacagaacaagaacttcaagaaaaaatacacaagtatcagtagccaaattgatcaagcagaaaaaagagtatcagagatggaataacggaggcaggcaagactagagaaaaaacaatgaaaatgaacaaaccaaacctcccagaaatacggaactacataaaatgaccgcagctacaactgattagagtacctgaaagagaggagaatagaaccaaattggaaaacacaccttgggatattatccagcagaacttccccagcctagcaagaaaagacaacattcagattcaggaaatacagagaaactgactaagatactccacgagaagaacaaccccaagacacataatcttcagattccccaagctcaaaatgaaggaaaaaatgttaagggcagccagagagaaaggctacatcacctaccaaggaaagcccatcagactaacagaagatttctcagcagaaaccctataagcaagaagaaagtgtgggccaatattcaacattcttaaaggaaagaatttttaacccagaatttcatatctggccaaactaagcttcatcagcaaaggagaaataaaatccttatcatagagcaaatgctgagagaattcatcaccattaggcctgctttgtaaaagctcctgaaggaagcatcaaatatggaaaggaaaaatcaataccagccactgcaaaacacacaaaaatataaaaaccaatgacactatgaagaaatggcatcaactagtatacaaaataagcagctagcgtcaggataatggaatcaaattcacatataacaacattaaacttatatgtagatgggctaaatgccccagttaaaagacacagactggcaaattggatagagtcaaaacccaccagtgttctgtattcaagagacccatttcatgttcaaagacacacttaggctcaaaataaagggatggaggaaaatttaccaagcaaatggaaagcagaaaaaagcagagactagttttgtcctagtctctgacaaaacaggctttaaaccaacaaagatcaaaaaagacaaagaagggcattacataatggtaaagggatcaattcgacaagaagtgttaactgtcttaaatgtatatgcacccaatacaggagcacccagattcataaaacaagttcttacagacctacaaagagacttagactcccacacaagaatattgggagactttaacacccagctatcaatattagacaaatcagcaagatagaaaattaacaaggatgttcaggacttgaactcagctctggatcaagtggacctaataaatagctacagaaatctccaccccaaaactacagaatatacagtcttctcagtgccacatggcatttactgtaaaattgaccacataattagagataaaacactcctcagcaaatgcaaaataactgaaatcataacaaacagtccctcagaccacagtgcaatcaaattagaactcaggattaagagttctaactcactcaaaaccaaacaattacatggaaattgaataacctgctcctgaatgactcctgggtaaataatgaaattaaggcagaaatcaagaagttgtttgaaaccaatggaaaaaaaagaaaacataccagaatctctggaacacagctaaagctgtgttaagagggaaatttatagccctaaatgcccacatcagaaagctagaaagatctcaaatcgacaccctaacatcacagttaaaagaactagagaagcaagagcaaacaaattcgaaagctagcagaagaagagaaataactaagatgagaagggaactgaaggagatagagacacgaaaaacccttcaaaaaatcaatgaatccaggggctgttttttttgaaaaaattttaaaaaaaaaatagaccactaacagactaataaagaagaaaagagagaagaataaaatagacacaataaaaaatgataaatgggatatcaccactgaccccacagaaatacaaactaccatcagagaatactataaacacctctatgcaaataaactaggaagtctacaagtaatggataaattcctggacacatataccctcccaagagtaaaccaggaagaagtcaaatccctgaatagaccaataacaagttctgaaatcaaggcagtaataaatagcctaccaaccaaaaaaagcccaggatcagattgattcccagccaaattctaccagaaatacaaacaggagctggtaccattccctcagactattccaaacagttgaaaatgaaggacttctcccagctcattttatgaggccagcatcatcctgacaccaaaaattggcagagacacagcaaaaatagaaagcttcaggccaatatccctgatgaacattgatgtgaaaatcctctataaaatactggcaaaacgaatccagcagcaaatcaaaaagcttatccaccacaatcaagtcggcttcatccctgggatgcaaggctggttcaacatatgcaaatcaataaatgtaatccatcacataaacagaaccaatgacaaaagccacatgattatagatgcaggaaaggtctttaataaaattcaacatcccttcacattaaaaactttcagtaaactaggtattaacggaacatatctcaaaataataagagctatttatgacaaacccacagacaatatcatactgaatgggcaaaagctggaagcattccctttgaaaacttggcacaagacaaggatgccctttctcaccactcctattcaacatagtgttggaagttctggctatcaggcaagagaaataaataaacggtactcaaatgggaagagagggaagtcaaattgtcgctgtttgcagatgacatattcctatatttagaaaaccacatcgtctcagcccaaaatctccttaagctgataagcaacttcagcaaagtctcagaatacaaaattaatgtgcaaaaatcacaagcattcttacacaacaacaagagacaagcagaaagccaaatcatgaatgaactcccattcacagttgccacaaagagaataaaatacccatcaatacagctaacaaaggggtgaagaacctcttcaaggaaaactacaaaccactgctcaaggaaataagagaggacacaaacaaatggaaaaacattccatgctcatggataggaagagttaatattgtgaaaatggccatactacccaaagtaatttaaatattcaatgctattcccatcaaactaccattgacattcttcacagaattagcaaaacctactttaaaattcacatggaaccaaaaaagagccctcatggccaagacaatcctaagcaaaaagaacaaagctggaggcatcatgttacctgacttcaaactatactacaaggctacagtaaccaaaacagcatggtactagtaccaaaacagacacatagaccaatggaacaggatagagtcctcagaaataacaccacacatttacaaccaactgatcttcaacaaacctaaaaaaaacaaaaaatgagtaaaggattctctgtttaataaatggtgtgggaaaactggttagccatacgcagggcactgaaactggacccttccttacatcttatacaaaaattaactcaagatggattaaagacttaaatctgaaacccaaaaccatagacaccgtagaagaaaacctaggcaataccattcaggacataggcatgggcaaagattttattatgaaatcaccaaaaacaactgcaacaaaagccaaaattgacaaatcagtcctaattacactaaagagcttctgcacagcaaaagaaactattacagagcaaacaaccatcctacagaatgggagaaaatttttgcaatctacccatctgacaaaggtctagtatccagaatgtacaaggaacttaaacaaatttacaagaaaaaaacaaacaactccattcaaaagggggcaaaagatatgaacagatgcttctcaaaagaagaaatcaatgcagccaacaaacatgaaaaaaacacagcatcattgatcattagagaaatgcaaatccaaaccacagtgagatactatctcatcccagtcagaatggcaattatttaaaaggaaacaacggataatggtgaggctatggaaaaacaggaatgcttttacactgttggtaggaatataaattagtccaaccattgtagaagacagtgtggtgattcctcaagggtctagaaccagaaataccattcgacctagcaatcccattactgggtatatacccaaagaaatatagattattctactatgaaatacatgcacatatgtttgttgcagcactgttcacaatagcaaagacatggaaccaacccaaatgcccatcaatgatagactggataaagaaaatgtggtacatatatatcatggaatattatgcagccataaaaaggaatgagatcatgtcctttgcagggacatggatgaagctggaagacatcattctcagcaaactaacacaggaacagaaagccaaacacagtgtgttctcactcataagtgggagttgaatactgaaaacacatggacacaggaaggggaataacatacaccaggaactgcgtggggagggatgcaaggggagggagagcatcaggacaaatagccaatgcatgtggggcttaaaacctaggtgacgggttgataggtgcagcaaaccaccatgccacatgtatacctatgtgacaaacctgcatgttctgctcatgtatcctggaacttaaagtaaaaaaaaaaacaaaaaaaaagagaagaaacaatgatacatattttctaagaagggtaacatgggatgtttcatacattgactgccaaaaagtcatagaaaatagaaaattaatttatttgtgctaatgtggcaacatcactctgtaaaatcagttattcattaagcatctactatgtacccagggtctttgctaagtattaggaataagagagagacaagatagtgctcttgtcctcagtgacctagtaggggacacaaatatacactactcaaaaaaagagtctatattttacaaactctattcaattattgagttattaatttctttacataaggcttaacagcacaaattttagagtaagtgaaataaatcatttgttttttaactagtgccaaaatttttaatttttttctttataatggaactaatataagttaatttaggaaatatagaagatatgtataattaaaagtaaaggaaaaaagaaaaaataaagtaaaataaagtgaatccttcatctgtagataaccttcatgaaaattttggacgtactcacccacactatcttctaaaaatacataaacacatagagaacaatactgtcttagcctatttgtgttgctataaaggaatacctgatgctgagtaatttataaagaataaaggtttatttgactcttggttctgcaggctgtacaagtagcatggcatcagcatctgcttctgatgagggcttcagagagcttctactcatggtggaaggccaagggggatgaggcactacatactgagagaagaaagagaaggatgggaaggaggtactaggctctttttaacacagagatctggtgggaactatagagcaagaactcactcattaccctaaggatggcatcaaactggtcataagacatctgcccccatgacccaaacacctcccaacggactccacctgcaacattgggaatcaaattttaacatgagatttggagggaaaaaatatccaaactatataaaatacttgctgtgacacaatttttttaacttagttgttgtttttcttgtctttattttctacaggaatattcatgccctgatatattttaaaattaaaatttttgttaagataattatagacttacttgcaattgtaaatatgtatatatccattacttttaatagcaaaaaccgcaattacttttgcaccaacctataatatacagagatatcttatacactttacacagtttcacccaatggaaatatttcataaaactatagtacaatatcacaaacaggatactggcattggtaccacacaatgatatcactcatatttcccattttacttgtcctcatctttgtgtgtgtatgtacatgtatatcatgtgtatataggagaattttgttctatacaattttatcatgtacgtaggttccagtttctactatcggagtcaagatactgaacagctgaatcgcaaggacacctcttgtccttttataaccccacccacctcatctcatccccacctctatctctaccctctgataaccacaaatctgtcctctatttctaaaattttgtcatttcaaaatgttatgtaaatggaatcaatcatatattatgtaacctttttgttttggctttttctacgcagcataattccctgaagagtcatccaacttatgtatatattaatagtttcttcctttttgttgctgagtagtattccatggtactaatataccacagattgtttaactgttcacctactgaatgagctggttccagattttggctattaaaaataaactgctgtgaacattcacatataagattttgtgtgaccatatggtaattgcatgtttcgttttataagaaagtattcaaccttttcccacagcggctgtgctattttactttcccaccagcaatgaatgaatgacccagtctagttgcaagttcaggatctgctacatgttaaccaggtgaacttaggcaagctactttattacttttaggcttcgcttcctcagcattttttttttttttttttgagactggacagcctcgctctgtcgcccaggctgcagtgcagtggcttgatctctgctcactgcaacctccgccttccaggttcacgccattctcctgactcagcctcctaagtagctgggactacaggcacccaccaccacacccggctaattttttgtatttttagtagagacggggtttcaccatgttagccaggatggtctcaatctcctgacctcatgatgtacccgcctcggcctcccaaagtgctggaattacaggtgtgagccaccgcgcccggcctgtttcctcagcttttaatccgaggatcacaatatgtttttagggctgttactgggattaaaagagatatatgtgtgaaacaaaaagtcaaaaagtagtaacagagtatagagtaatggctaagaagacacattgcatattaaagagccttattttatgaataaatgtttgcagtaaggaggaaaatgcctggagttaagcaggaagactggatattagaaaggaagagaatataaagtatagattagtgccatttttgcttaataaggtcataaacgctagatagaggtattttattttaatgtgtaaaaatcctaggctctgaaatcagactgtctggatttgaattccacctctatctcttactatatggcttaggtaggttacttatcttctttgtgctttaatacttttatctataaaattataatatgactaatatttacttcatcaatctgttgtgaagattaaaagtgttgatacacataatgaagttagacttatgcctacaacaaaataattattaaccattatcatttttaaatgtctgctttgtctcccttctatgtattcgctgtatgaccttggataaatcatgtaacaattgctgtgtctcagtttccttatctgtacaaaagaataaaatattatagaactatgataaagattaaatgtgataacatatttaagatgtttggtacatagcaaacatgatataaatgttagctcccttcccttcctaatcatcaattatgtcactatattgtaaccagacatttttctcatttctcccaggagtaaggctgtcacctgtcacttttcccaagagtatgcctttgtacagctgcttaacttgctgcgtgaagtttagagtacagaagctttgcaccaaagtatactttaatagttcacaagtgtctttatgctcaatttctagtaatagactgtttttgaaaattcattcctaaaaatgtgtgtctctcaactaggacaaagttgctatagtgatgattacttattttttccagagggaaataaattaggtaaacacaaccatattatcatcttgtctaacagtatattaaagaagaaagactaggctctttataagtgggtataaagcacagcaggtagagtggagattcctggcagaacttataggctctggtgttataaattccatgaaacatggggcctaggcaaccctatgaagtagataatttgggtctgtaaactcaaaattaataagatctcaaatagacttcctctgagaagcatggtggtaccttgtcacgtccatttgactcagctgttttgattcaggagcattttgatatttgggcattttgacacctcctaaaagcaaacaattaagctttcagcttttatgataactgtgtaacttgtattaaaacaggaacatcatccctaagtcttaaccctttgtgatggggtcaaggatgagatggaggagagcttaaacatctcacaagagcaccgaagtatatattttattaagatttcttctgtatatcccacagaaagcacagctcaggagtcaaatctaaactcatcactttctcccctgatcccactctcatttctcccccttaccgaccctactctaaatatggttttccttatatttgtaaatggtaccatcatccacactttcaaccagaagttaactcctccctcttcataaccaatcctttataataggcctgagtcttctccagtatatttcctatgtgcttcttaaatctctcatttccttttcctcccttctgccaatgattttgttaaggtcctgattatctttcaactgatcactgtaatactctccaaattggtatctctgactccagtctcaatcaatgatcacttattcattcagtcaacaaatatttattattattatatgttaagctctgaatatacaacggtgagcaaggtagccatggttcccactcttgtggactttatagctttcacaaaaagagaattaaattattgatagcacaaagtgtggtaaatgctatgattcactcatctaaaaactactgttaggcagaatctactaatgtataaaggcactgttctagtccctgaggatataaaaatgaatgacagacaaggatcctgtccaggaataaatacataattttaaaaatatgatagtttcaagtaatggcgagtgctatttaaaacataataaatagtaatatgatagagcacaagtggaagatgtaaggatagctaagtagtcttggtggtaaaggaaggattttctgacttaagctaagaccagaatgatgagaagaaaaccagccatgaagagatccagaggaaagtatcccatacagaagaaaaaatcaatgtaaaagctgttagggacaagctgagacacaatgagcaaggaaataagtggcaggagatgaagtcggaaagctccatagagaatatattatgtatatctttacagaacatgtcaaaagatttggatttttatcctaagtgtagtagaatgccatttaaaacagagaaatgacatgatcaaacttacatttttaaagaagacttctgactgctgtggtaaaaatggataccaggagcaaaagtagaattaggaaggccagtaagtcaactcctaaagtactctaagcaagacatcatgttggcttggactagagcagtagcagtggcatatacaagaagtataaatatggtcaagttatatttagagttagagacagtgagacttgatgatagattagacgcggggatgaaaagaaagtggaatcaaaaatgactcatcagagtttagcatgagaaacctcggtatatggtggtgccattaccagggatgagaaagttagaaataaaaggatagcaaaagagaaattaaaagttttcttttgggtcaggtacaatggctcgtgcctgtaatcccagcactttggaaggccaaagaaggaggatggcttgaggtcaggagtttgataccagccttggcaacatagcaagacctgtctctacctaaataaaaaaaaataaaaaataaattaaaaaaaatagccagacatggtggcatgtacctgtagtcccagctattcaggaagctgaggcaggaaggttacttgaggccagcagttcaaggcagtgagatttcatcacgcgactacactccaaccttagcaaaagaacaagaacttctctcaaaaaaaggaagaaggaagaagaagaagggaagaagaagaaagaagaagaaggaggaagaaggagggaagataaaaaggttttctttttgaacaagttaagttgttaggcaaagtacagtgctatgacaatatacaacggggggaaatataacaaactaatggtgtcaggaaatgattccaatagaaaataagatgtgaaaaaaaagaattgaaaaaatcctccgtaatagtcagtgtaatctttataaaatacacatttgactagaacatttttcttaagatctgtcactaatttttttatctactacagcacgatttctctgaataccctttaagatgtcaatctcctccatcagactgtgagtcccttgggtgaagaattcattgttgttcattcacaatttatcacaataactagaaaatagtaattgtgacttcaacctaaaacacagtacttgttacattgaacatagaacatagccctgtgttaagtgggtaatctagctgtgtaattgtcaagtcgcttagtctctctgaggcttatttcttcaattatgaaagacagaacctctttaagatcacctccaactttaatattctatgtttctctgtgatatgtgaaaactttacgtttgaaagtcatttgcaatcaattagaattccaatccagacttgtgtgactcttaaatgtgctacacagtttctcaacacctctgtttcttcatgtgtgaaataaaaaattaaaatattgctccacttcatagaaaatctcattgatgacataaaccatatttaaatgtcaaatgattaaaatagtaagcaaaattctgcaaatgaaagaacattttttcttaaatgatttgtgatcagaaatgagacttgttgcctgctaaattatgccttactacatttggaaggaatatgttcataactaatgatttctctttgttttgtcttttatcaagctgttctttggtgtgtgtgaatcattacaagaacaacaaagtaagccctaattttttcaggagtatgtttgtgaaatacaacacaaatgtacaacctcttccagctctttatattcttcaccagccttctctattttgtttttaccattgtatcaaatctccaatttttaaatattcaccaatggcaaagtatgattttatgtagaaccaacttttcaagaacattatatcctattatatgatattcactctatgttcaataattttacttcattcacctactacctcaatgtgttttacagtggaaaattttaactccaacttaaaaaaatgctaccaaaatcaaaaatcttttggaaacacaacagaaatgaaacataattcaagaaatctaaaaatataaactggaaaaacgtatactgaaatggaatgaacaggggtaggaatgccagcactggtaggagttatccttgaccacgacatttgcagctatagctgagtaaaaaaaaaagttaatcccagtggaattgctctatggctaacaggcagtatgtaaagagtgttataatatcagtttgttttcaggataatacacccttttaaaagctagacacattttggtggaaactggctaacattcaccaatcctactacctttgcttccttaggcacagttagattctactaccaagatcctttggagctaggtgcagccagatgtccaaattgtggccagtggaatatggataaatcttctccacaaggcaacatgcatgccctcgacaagagctatgcccatctcttctggctgccaggccagtaaataaaagatctctggtctatgttcatgagacagctggtgggaaggaacacagcagctacctgttataggcttctgtctttgattttgcataactatgcttctaatacatttactagaaagttaagttggtacaaaagtaattgtggttcttgtagttacttttaatagcaaaagccacaattacttttgcaccaacctaatagtgtatattgcctttcttagcaaaaactgtacttgccagaaccattgctgagaagatttataactttgtttacaaggttaaaaataaaatataaccatgagaataaaaaggattaggaggttgaatttaaaacattaaaaccaaaaataaaataagagaaagaacagataaaacaacataaatctggggaataaaagtgtactaaaacaatgatagaccaacatctacaaattctaccaaaaatgctgtacctggtagatattaaatagcatatgctgttgaggaattcaatatcttgaaatcaggacaaatactatctgcaaagaggagtagttaaaagatttaatgtaaaggattttggatggtggggagaaacaattacaaggaaacaggcagaaatggactccagacatgtttttgagagggtttagactctcccatctcctggacaaatccagaagccatacctctggagaagagccacaacaaagcccattgtgataggagtctcaaaattgaaagcactggccgggcgcggtggctcatgcctgtaatcccagcactttgggtggccaaggtgggtggatcacctgaggtcaggagtttgagaccagcctggtcaacatggtgaaaccccgtctctactgaaaaatgcaaaaaattagctgtgcatcatggcctgcgcctgtaatcccagctactcaggaggctgaggcaggagaatcgcctgaacctgggaggtggaggttgcagtgagccgaggttgcaccactcctgtccagcctgggcaacgagagtgaaactccgtctcaaaaaaacaaaaagattgaaagcactaatcagaacaggcacacctcatttaaaaagagacacattcctaaaagtggtatagagttttaatttttattttttcttttaaacacacaatttccttttttagaacctaacacagtgggcactctataaaaattttgggattgatgaaaccattgatggaggaaaccatggaggctttccatccattactcacacattgctctatatattatgtacactgcctctaatctacagatgagaaattttaggcacagagatattaaacaacttgcccaaagccacaaatatgtctgctgactctaaaacccattgtttacaacttgtggctttgtttgttaaaagatcccttcctctttaagtaaaagagcaaattttaccttacaaaccatcagaccctaaattaatctacctgaaaaataaaatgttggtatggtgttttgagttgtttcaaagtgagacacattaaggacaaagtatttgagaacatttaaaggtcttttaacttcattagggattttaagtctgatagatttaacatgcctctacaaaatgtacaatctaatcatgttgaaagatcaaatctagaataagccctatcaattagcacaagaataacagtgccatttgttgccattggaggaaatggttttgttatagatttctaagagaaattagttagattttactttgaaggccataaaatgttgtttatattctttttcaaataacaattcttgtaataagataacaaagacatactgctttgtaattcttatgaaaataaatttgttaataatcacttaaaataatagcttccatttgtttagtaaatatcgatcaggtaaatgttctaggcactttataaacatcttatttaatccttgctacaactatttaagataaaatactatttttcacattttataggttcattaaggcttaaataactaaaattatgtagcgtgaatcatacaaccacagatgcatcttattctaaagcccatgctatctccattgtgtcctaactggagctaccttaaaagaaatattactcagtgacaactccagtttgaagggatatagtatatgtgtgtgtgtgtgtgtgtgtgtgtgtgtgtgtttatatattgatatataatattttaaaatttagaatgtaaatttgttttaaaatgaaaaacttctaagaaaaagctttgtatatcaaagacaataaatacattctgccatttgaataaaatcttttagtctaatgaatcacggcaattttacgttatttaaaaagagaaaggcaacacagtgtgcattggtcataagttgaaaatattccattgtaaagtcaaaaaatcataaatagaaccattataaattaaagaccaactgtacagaagttctaatctgccatttaattgactagttgtataactaatcttacaattttcactttaagtcttcaaacttcacccatactgataatctagctttcacttctttatttaacaaatactaaattctagaaacattgacagactccaagaatactatgatgaaaaacacatttgttatggactgaattgtgtctcccctgccccctgcccaaactaatatgttgaaattctaactcccagtacttcagaatgtgactatatttagagatggggtctttaaagaggaaatcaagttaaatgaggtaattagggtggaacctaatccaatatgactggtgactttataagaaaaggagaagattaggacacagatacagaaggaagaccatatgacaatacaaggggaagatagccatctgcaagccaaggagagaggtcccaaagaaaccaaccttgccaaccattgccaaccaccttgatcttggaatattagcttcaagaattgtgagaaaataaatttttgctctttaaacaattgaatttgtgatatttattatggcagctctagaaaactaatacatatttcatgatttatttgtgttccctcagtcattaccctaaacattaaagtaaaaatttgaagcttaaaatttctgaaaaaaaaattatgaaaaggtcaaatcccaagaaagcaaagaaaccataagtatttttattttggaactttaactgaaattagacttgtacatcaataaatttgagagggatgagatagacagaaaaggcaattgtttcccaaactgatcttaaccaatctctttgaaaatgttttcccaaaagtctaataattctaggaattctctgaacttggaggcagcttagagcaatggacagatcgttgaccttacagacagttaaatctcagtagctagctgactctgggcaagttatttagcatttcttagcctcgattgctaatatgaaaattaagaaactcatagtttgactcaaatgaaataatccaaattaaagcgatttttatacttgaaagtaccttacaatgttttcatgaggaataattttcctgctttagcaatctaaaaagccctatcagaaaaggatatcaatgaatttctaatctaaactagactattgctaagaaacaacattaagtttaccatttcctggaaactattcatttttaaaacactacattcagtattctggaattgcctcaattctccttgagcattcaaataatgagcagagaccttgagataagatttggggtgagaaagtaaaaataaattcagacaccaaaaatctgccctgacattcatcaggctggaataataggcccagataaagctggctggaaagttaaaaggaaacactatttcacccaaggatatgctgccattataaagtatcatcacaacccctttctttgaatgcctactgctttcttactgaaaaactttgttctataaaatcaaagacaatcagagactttgcttctgaaattctctcagtaaaaatgaaatatcccactcttgtctggagattctaagtcactttgacacagagaagtagcctctatttaggatccaggaaataccttcagataagggtttggggacccaatattcaacatctatcttatctttattgcttccaaggaaacaagtccattgccacatccacatctaaagcatttacacatagccttgctccttcctttcctttgagcctatcaaacactaatatatttaaagtagttcccattcttcatttctgactgtgcttatttatgcttctctctccctctccctcctcctcttccttccactctcttttaagtcaaacatggcagaagttgtttacgttaatcttatcaaatgaaactcagtcattattgatcctctttattctgtgttttgtttgttcaatcagtatcttctctattatttccttttttccattttattgaatttattctgtcctttttctaacatgttaaattggatacttggcttattaatttttttcctttcctttttctatttattttccttggttagaatttttatgcttcctgaaacagagaattatgtcttccatcaattctggaaatttttcatccaggacttaaaaattgcttctgccacattaattctagtctcttctggaactccaatgggtgatatcagctcttgtcattctaatgtccatgtcttttaaccactcttttatgtttttcacctctttgtgataatttctttaactctatcctttatttcattaatttataattttcttttgtataatcttctttttaaccatctactttttagttattataattttcatttttaggaggtctattttgtaatttttatttcctattctgccccttctttttaattatatcttattcctttcttatattagagagtacatgctttatttaaacattttaaacattatatgaagtgtttagtgatattttctggtaagtctcacttatagtgatttatttctcatgtattttgtagttttcattctcaatttatgttttattaaagctgtttttaggtaactccatgaagcctgggttgaagctacattcagtgaaagatgatatgcatttgcttctgccaatcacctgagtgctttcgaattggaactacctaaagtttttttttttttttagctctagactgctcagactacaaaaatgacgtaaattttgactaggcacagtgggtcacgcctgtaatcccagcactttgcaaggccaaggtgggtggatcacctgaggtcgggagttcgagaccagcctgaccaacatggagaaatcctgtctctattaaaaatacaaaattagccgggcatgatggtgcatgcctgtaatcccagctacttgggaggctgagaaaggagaatcgcttgaacccaggaggcagaggttgcatggtgagccaagatcgcaccactgcactccagcctgggcaacaagagtgaaactccgttttaaaaaaaaatgacataaattttaacttgaaagcgatatcagggcagcctttgtggttatcaattttcagagcagatatttctattgttttctatgagagcccaggctaacacataccttcttgccaagttgtcttgcttatcttcgttatttgacagggagacattttttttcacctctaccctcatattaatcatagagttaatttctggctttatgtgggttctcagagatatcttcacatctgtgtatatactaggctttttctcctccactgcctggtcattaaaacaggattaccataattagcaaatgccctctagatagctatgatatcagcaaccacctacaattctatttccaactcatcttcttttttggcccccacagacttcctttacttatttgtgagctcacttaggaattttaaaatattgttgctactccatcaagtaattgtaaatatcttatattagagattttttcaggacattttatctgcaattttgctggtaatgaaactcagttcactcttcaaccaaccccaatctggggcttttactctcatcattacattgaaactattcgcacaaagataaaacttagctataattttctatgaatctcaatttatttggcctctcagaagttttcggtggaattgaactatctttccttcttctcttttctcagcttccataactctatattctttttgtttcctcctacccatgtagcttttttctgcctcctttgcttgctcttcctccatatttctaaacattgaaaccactcagagcttgtttctaatcatctcctcaatctacattctcatcctaagaaatcttgaccacttccatgactttatattattcacatgccaacaactcttaaatgtgtatcaccaacccaaaattatcctctaaattccaaatccacatctctaactacctacatgtctgcctgtacatcgcatagggatctcaaacttcatcttctaatctaacccatatctgcaaatgatacatccatcaacctacttattattgtcaaaagtctaatggctagccttgataacttcttcaacttctctgccactaactcacaaccaaaccattaccaaattccataaatattacctaaaaatacatatcttaaatcaacccacttctctccaacagcagaccaagtcaccaacatttcttacccacaatattgcaacagatgtaactgatttaactgtttactcagtaaccagcaccctccacccccaatacacaatatctgtagtgatttgaaaatattaaactggctcatgctgctctctaaaccaaaaaaattgtgacttgctttattgtaatattcactttcttgcagtggtctggaactgaaatcacaatacctccaagctttgtttatatatgtaacttctcataagcttcttaactcttctcagactcaaattttgacatttattaaataaggatagtaaaaatacctaactcagaattattgtgacaattaaattagataatttagataatttgtatatagtacctagcacagtacctagcccacagtaagcccccagtacattcttttaatgcaacagggtctcgctgtgttgccaaggctggtcttgaactcttggccccaagcaatcctcttgcctcagcctcccaaagtgctatgattacaggtgagccagcatgccctgcccaatttttaattttgtttatttttatattgctctgtcatggaaattgagactagctggttttaattccttttatattctataaactcattcgaggcttttgcatgttgagtagctgaaatttcttttttttatttcagtataatactgtattttccaatgtattaaatgaaagccaagaaaatatcaaattaactttaaaagcaaatctttactctttaaagaaaaaatacaaactgtggtatttttataatagattatattttacataatataaataaaatcactaatgcatctatatgcttggtttccttaaactacaatgaaccatagaatgtgtggaaaatgggtttagtttttggtgaaaaacaaacatcttgggaaaaacaggtagttgtttttttttttaactgtctatgcacaggcactgacataaccaagccttaatggccaccacttccttttccttgtccaaagcagccatttccatagctctcccttccatatcctcactggcatctcccagatcctctgaaacctccactagaccttctgtagtctccaccagagctaccactatagccacctcagttatgtcctctatagtctccaccaccatctccaccatatccttcctgacagggtggagtagtgccaccatagcctccactactatagcctccatcactgtagccactgccatagcctccaacaccataactagaatgtaccctcctatatctacttccattgtcatatcaggccatcttgggaggatgtggaccatctccatactgtgtattgccaaccacaagattgataacaggagctaagggcctagagatttggtggataatgttcagcatatattaattaaaagggtccaactggctgaagatatcaggttgtttgttacttcaacaaccagaggttgttgaatcttcaactccaagatttcctggaaagcagtaatgcaggcagcagcttcatgggatatttgcagtttaattcagtcatctacaagaacaatctgcctatcacattatactttcttgaaggcaaagagaagcaacttcagggaggtgactaaggtcatgcctttagcagagatggctcagattcaagtacacctgatcaaagacagtatttgaacccgagccatctctgctaaaggcacggccttagtcacccccggcttttcaccaaacacaaagaaaagagaggagcactttttgtcttgctactaaaaaaacaattaacagacaatttgtggataagtgcattatgcccttcatggtgagaatatttctcttttccttctgatagcatcatttgggtacacaccaaaggccaagagggagataacagcatccaaattattatctggtccagtgttagtaaacacttgtgtcaataatcttctggaaatccagaattaatatgaatctctttgagctaaactttggcttcataagtcattcttagtgtagccctattgagtcttttgtgctcacaaaattgaatctgagtttcttctctacccgttctagaatcattccaggattggaatactgataaaagggacacataatcagaaaatgggtttccagcaaaatttcggtggatatatcccactttccttcatcaatgaaaacaggtagcagcagagatggtatagacaggatctctctcatagaaaatacaccccattatcatcgttttgccaagatgaggctcaatggagagtttagtcaggacccatcctagagaattaaacttatcattgccatataatgcatcaagctctccaagagtgtgctctgcctaaatcacaggatccaaaggtggaggtccttggattgccttggccagaaattagccaatttctcccagacacaggagtttcatactcaacataatcacccctcacttttgtctttttttaaattttatttgggtttaggggtacatgcacagaattgttgtataggtaaactgtgtcacaggggtttggtgtccagattatttggtcacccaagtaagcatagtacccaataggtatttttttatgctctccttcctcccaccctccacccttaagcaggccctggtgtctgttgttcccctttgtgtccatgtgttttcattgcttagctctgacttgtaagtaagaacatgtggtatttggttttctgttcccaggataatggtctctagctccaaccatgttgctgcaaagggaatgatctcattcttttttatggttgcatagtaatccatggcatatatgtaccacattttctttatctagtataccacgtgtataagcattcccctttctcctcaacctcaccatcatctgttactttttgagttttaataatggccagtctgactggtatgagatggtatctcattgtggttttgatttgcatttccctaaaaattactgatgttgagcatttcttattcttgttgaccacatgtatgtcttttgacatgtatgtcctttgcccactttttaatagtattgtttggtttttgcttgtaaatttgatcatgttctgtatcgattttgcatattgcacctttgtcagatacatagtttgcaaatattttctcccattctttaggttgtatctttattgatattatagtttctcgtgctgtgcaaaagctgtttagtttaattagatccaatttatcaattattatttttgttgcaattgcttttggcatcattgtcatgaaatctttgccaggtcctatgtccagaatggtatttcctaggttttcttctagagtttttatagttttaggttttacgtttaagtctttaatacatcttcagttgattttatatacggtgtaagaaaggggtccagtttcaatcttctgaatattgctagccagttatcccaccactatttattgaatagcaagtcctttccccattgtttgtttttgttagttttgtggaagatcagatagttttaggtgtgcagttttacttctgggcctcgattccgtttcattggtctatgtgtctgttttcgtatcagtgttttcattactacagccttgtagtatactttgaagtcaggtaacatgatacctccagctttgttctttttgcttataattgtttggggtatttggattcttttttggctctacataaattttagaatagtttctttctaattctgtaaagaatgtcattgatagtttgataggaatagcattgaatctgtaaattactttgggcaatatggtcatttttataatattgattctccctatccatgagcatggaatgtttttccatttgtgtatgtcatctctgatttcttggagtagcgttttgtaattgtccttgcagagattttacacctccctagttagctacattcctaggtattttattctttttctggcaattgtaaacgggattgtgttcctgatttggctctccacttagatgttgtttgtatataggaatgctacaaatttctgtacattgattttgtatcccaaaactttgctgaagttgtttatcagatcaagaagcttttaggcagagactatagagtttgctagatattgaatcatgtcatctgcaagcagggatagtttgacttcctcttctcctatttggatgccttttatttctttctcttgcctgactccttgggccaggactaccagtactatgctgaataagagtggtgagagagggtgtactggtctcattctggttatcaaggggaccacttccagcttttgcctattcagtatgatgtaggctgtgggtttgtcacagatggctcttattattttgaagtatgctccttcagtgcctagtttcttgagggtttttacataaagggatgttaaattttattgaaagcttttttgcatctattgagataatcatgtggtttttgtttttaagttctgtttatgtgttgagtcttattgatttgcatatgttgagccaagcttgcatcccagggatgaagcctacttggttatggtggattagatttttgatgtgctgctgagttcagtttgctactattttgttgaggatttttgcatctattttcatcaagatgttcagctttttattgtgtctctgccaggttttggtatcaggatgatacctgctcctcaacttttagaattagtttcactaggagtggtactagctcttctttatacaactagttgaattcaactgtgaatctgtctggtcctgggctttttttggtaggtaggctttttattactgattcaattttggaattcactattagtctgttcagggattcctggttcactcttgggaggttgtatgtgtccaggaatttatccatttcttttaggttttctggtttgtgtgcatagaggtgctcatagtagttctgatggttatttgtatttctgtggggttggtggtaatgtcccctttgtcatttctgattgtgtttatttggattttctatattttcttctttattagtctacatagcagtctatctatcttacttattctttcaaaaaacaaactcctggatttattgatcttttgtatggtgttttcacatctcaaattccttcagttcagctctaattttggttatttcttgtcttctgctagctttgagattggtttgctcttgtgtctctagtttctcaaggtgtgatgttaggttgttaattttagatctttcaagcctttcgacgtgggcatttagtgctataaacttccctcttaacactgccttagctgtgtcccagagattcttgtatgttctgtctttgttttcatttggtcaaagaatttcttgatttctgccatagtttccctatttatccaaaaatcattcaagagtaggttgtttcatttccatgtaattttacggttttgagcaattttcttggtattggtttctattttattgtactgtgatctgaaagtgtggttggtatgatatcaattgttttgaatttgccaaggattacaactttagagttgtgccatgtggtgatgagaagaatgtttttgaacagagagtactgcagggttttattaggcccatttggttaagtgttgagttcaggtcctgaatatctgttaattgtttgcctcaatgatctgtctaatactgtcagtggggtgttgaagtcctgtactctaattgtgtgggaatctaggtctctgagaaattgctttatgaatccaggcactcctgtgttaggtgcatatatatttaggatacttaagtcttccagttgaattaaaacttttgcattatgtaatgcccttctttgtcttttttttttttttttatctttgttgggcttaaagtctcttttgtctgaaattaggacgtcaacccctgcttttccatttgcttggtagttttccatttgcttggtaggtttttctccatccctttgttttgggcctatgaatgttgctgcatgtgagatgggtctcctgaagacagcataccattaggtcttgcttctttatccagcttgccactctgtgccttttaactgggggaatttagcccattcatattcaaggctaatattgatatatgccaatttgatcctgtcatcatatcgttagctggttattatgcagacttgcttgtgttgttgctttatagtgtcacttgtctatatgcttaagcatgtttttgtagtggctggtaatggtctttcttttccatatttagcactcctttcaggacctattgtaaagcagcaagtctggtggtaatgaattccctcatttgcttgtctgaaagggattttatttctcatttatgaagtttagtttgtctggatataaaattctgagttgaaaattattttccttaagaatgcttaatataggcccttattctcctctggcttgtagggtttctgctgaaaggtccactgttgacctgatgggatttcctttctagatgaacgtcccttctctctagctgcctttaacattttttctttcatttcaatgttgaagaatctgatgattatgtgtctcggggatggtccccttatttagtatcttgctgaagttctctgcatttcctgaatttgaatgttgacatctttagtgaggttggggaagctttcacaggtgatattctaaaatatgttttccaagttgcttgctttctctccatctctttcagggacaacagtgagtcatagatttggtttctttacataatcccatatttcttggaggttttgttcattcttttatattctttcttcttcatttttgtctgacaattatttcaacaagacagtctctaagctttgacattttttcctcagattggcctattctcctgttaacacttgtgattgcattataaaattcttgcagtatgtttttcagctctatcaaatctgtttggttattccttataatggccatttttatctatcagcctctgtatttttttaatgatccttagctttcttgcactggactttgacattgttttcaacctcaatgatcttcattcctatccatattctgaattctatttctgtcatttcagccatttcagtctggttaagaatacctgctggggaactagtgaggtcatttggagacactggctttttgagttgccagagttctcgcactggttctttttcatctgtgttggcttgtgttctgataactgacgtgtagtttcagtacagttagtacacttcttttctgggtgttttcagagggctgaggctttgtgcaaggtcttatttgtagttgaattctttttcttggtttcaaatattagtaaagtatttttggtattgaattttgggctgtgatccagtaggtggcacttacacatagtggcctgtaggcagccacttaatcaacagtgtggctcctctttatttcctcatgattgcagccatgcttcttctcagtgctttgaaagtatgggttcctctcccacttgagtgctgactgcaaatcttggcttgggactcttgggcagaaggggaagggatcttagcagtggttatggcagagagcctttcacttgcctcttggggttccaacccagagagatgtggacccattattaatcagtgcaattggccctggatggggcacctgtgctttgggctcaagctaggaaggcccgcctggtgatgagagggtgtcagggacaggtaacagggagacagactggcctcttctccctagtgcaagagcagcttgctggaggtgtggttaaagcactcagggtcttcgctgcttctccaattcaaggacagcaaggtcactaccactgcagtggcagtagcagagggccttttggttgacttcaggagctctacctcagaaaaatgtagagccactgctactgggaaaattcagccaggaggtgagacagttgttctactggctctgcttgttgaggagtgggggttcgagtgctcacagggatgagcgaccaggcttctctccatatggtgactgtggtgtattggaagctcaggtgaagccctcaggctcttggtttcttccccagaccaagggtagcaggggcagaaccattgctgtggcagtggcagagggtctgccagttgtctcagggagccccaccccagggaaactcagagacattccgtgggtatgcttagctgtggatgggtggctattatgtggtgcaaagccggggccctgcctggtaaagagtaaggggtgggagctcccagggaagacagatcactcctttccatatagtggctgtagtgtgctggagatgcccatgtagtgactggccctttgttgctttcacaccaagagtggttagggtgataccactgcagctgcaattccagaggggttgtgggctgtctctgggatttcctcctcagagtaatgctgaaccacctgcaactgaaatgttcaggttgaagcaagttagctgtgctggaattccaggctgagaggccctgcctagtaagaaacaagtaaggtccaggactcatgtgtagaacactctggccacttttccatgggatggctgtgctgtacaggagatctgtaccactccctaaacattaagtactctgcagagcctgaaggctatattggcaggggctgacagacgacaaaggtaaccagcctctctttctgggagctccatcccagggaagtgcagagctgctaccagcccaagagcacagacagggggtggctggagacccagaccactgggcctcatcctgtgaaatgcagtggaggtgaagcctggagtccactgctgctcagccctctggattcagccactttcctgggggaatgaagggagcccgacctctcctactgctggagctccagtcactaatgctgggatacctaggaattcatggctcccaggattccatgtgtgcctgggcagcagctctgcccagactccacacagctctcattgtcagtctggaagctctggtggggtaggcttatgcatggatcacctgagcccagggttgcaaaggtccatggcagaactgtgggtccctggggactctcactcactcacaatttcctggcagtgtgggagcctactctggctccatgccactcctgggtgggcagttgtcctgtctcactttgctccattctccatgggtcaagttgtttccttgatgaaccctaatgtttccatctagatgttccagttgaagatacagtagttaatcaccactttcttctctctgtgagagaggtgcacactagctactaatagccatcttggcctctcccatgatcacccctcacttttcaatattttaatcaatttgccttgtctttagtccaatttcttcacagttgttctccattgaaggatcctgaagagaagctctagtatcttgatctttgtagagcaagttcctgctttgaaaaactaagaccaaggttagacatcttgtaatttatgtatatttgtgaggtttatgtttgtcgatgatgctgttggttaggttttatttgggatgagggttgaggttttgtattttcatttgttttgccttttggcttatttgttggtttgatttgtggtggtgctcatttattggccttcattagaaaatgaagagtaatttctcaaagaaccactgcaaatatatgttttcatttaaaagcttctattcttaaactttaccattcatacagaaacagcaatcattttaactggacttggattcctacggaagttatacacaccagggaatccagcatatcaagataaacaggctgtagagtacatatatattaacatcatttcttcctacttattgtaaaacactcttctcatcacttttcctctcttggtttcctttttcagccttaagtttattatatactccatttgaatgtgtcaggatgcttgccaaagttaatagaagagagaaaagaatacagttgagggagaaaatagatatttctcttctttcaggtgtattgacaattgtgacaaaacttatttttacaaggaaagagaacacaagaaaactgacatttgggcaaaaaacagttatgcagtttcctggctgatctctaccatatttgagtctgactatgctgccatgagtggagtatatactgtagcaatactgagagtgagagaagtccttgagtacctgtgactgaagaggccagtgatgggaagtactcattcatttttttaacagttttaatgtgtttacttaggcatggggaatactccttgatctttatctttattatctctactatcttcacttccccaagccacatgcagcagcaaaaaaggagacggaaactgacaaagggagatgtcaatctagcatgtagtgaactccctattatggactgaataaagtaatggcaacaaaagccaaatttgacaaatgggatctaattaaactaaagaacttgtgcacggcaaaagaaaataccatcagagtgaacaggcaacctacagaatgggagaaaaattttgcaacctgctcatctgacaaagggctaatatccagaatctacaatgaactcaaacaaatttacaagaaaaaaacacaaccccaccaaaaagtgggcaaaggatattaacagatacttctcaaaagaagacatttatgcagtcaaaagacacatgaaaacatgctcatcatcactggccatcagagaaatgcaaatcaaaaccacaatgagatatcatctcacgccagttagaatggcaatcattaaaaagtcaggaaacaataggtgctggagaggatgtgcagaaataggaacacttctacactgttggtgggacggtaaactagttcatcctttgtggaagtcagtgtggcgattcctcagggatctagaactagaaataccatttgacccagccatcccattactgggtatatacccaaaggattataaatcatgctgctatgaagacacatgcacacatatgtttattgtggcactattcacaatagcaaagacttggaaccaacccatatgtccgacaatgatagactggattaagacaatgtggcacacatacaccagggaatactatgcagccataaaaaatgatgagttcatgtcctttctagggacatggatggagctggaaaccatcactctcagcaaactatcacaaggacaaaaaaccaaacaccgcatgttctcactcataggtgggaattgaacaatgagaacacatggacacaggaaggggaacatcacacaccggggcctgttgtggggtggggggagcggggagggatagcattaggagatatacctaatgttaaatgacgagttgatgggtgcagcacaccaacatgccacatgtatacatatgtaacaaacgtgcacgttttgctcatgtaccctaaaacttaaagtataatttaaaaaaaaaaatgaaaacctaacttacactgtggctacatttggagataaaacctctaaggaagtcattaaggttaaatgaggtcagaaaggtgggtcatcgatctgttaaaatcaatgtccttataagaaggttcacaagcaagctgtatctctcttcacacatgcataaagaagtcatatgagtagacagcgagaaggcagccatctgcccaaggggagatccttcacaagacaccaaccataccagaaccttgatcatggaattccagtgtccagaactgagagaaaataaactgttgtgtaaactacccagtgtatagtattttgttacgacagccctaacagactaatatattccctaagatggggaatcattttatttttcattgtatcctcaggagtatcaaggttggatacattatctcttttatgggtcccatgctaaattaattactcaataataactgcaaagtggttaaaaatgaaagttcaatcagaagaaaactaggcaatactgtatttttcttgaataatcctcagaattttgaaatatccttagcagaaaatgtctatgaaaacagaaagcatcaaaagattcacaataggttagtacaccacacaagaagaaggagagataaaaggaagataatagaaataagaaatgtgtagaatgaattaccaaaaaaacttgggatgggtgcagtggcttgtgccagtaatcccagctctttgggaggccaagaatggagaactgctggaggccaggagtatgagaccaatctgggctacatagtctataaaaaaattttttttaaattaggcaggcatggttgtgtgcatctataatcccagctacttcagaggctaaggcgggaggatgacttgagcccaggagttcaaggctgcagggagctataatcatgccactgcattctagtctgaacaacacagaaagaccttgtttaaaaatttaaaaattttaaaaaacctcgtcagatattggtattgagtacatgagagagaactgtgtcaaggactgaatgtgacaaaggagagcatttagaattatatcaatggcagacactactacctttgtagatagctactacacagcaagcactatactatgaatttaatatactgtactatttaatatatattatgcaccatatagacatacatgtacacacacacacacatacacacacacacacacacgccccccgagagagagagattgaaaggggagaagggtaggttgtatcatatacaaggtgctatatcatttgccagatatacagtgataaaacaatccctttctatctgaaacttaagtttagtttccaacactacatcatggtgcagaatcttgtacttatacatgttcttctaaaatattctatgcattttgtaatcaccagatggattcttcctgcctgctgcacagacaaaatcaatccactgagaccacagcattgcatgagagagagtttaactgctgtgagaccagccctcacagaagaactggagttaccactcagatcagtttccctgaaggcttggaggttatggtttttacggacaacttggtgggcatggggcaagggaaggggtgctcctgattgttggggatgaaatcataatggtatggaaaatgttccctgtgagcttagtccacctctgggtggagccacaggatcagctgagttacaggtcacaagttcgggtggcatcagtctgaaagatatttcaaaaaaacaatcttaggtactataacagcaaagttatctataggaacaattggaatagtcacaaatcttgtgacctctggtcacatgacccctgggcagtaaaggattatagaaactattcccattttagcagaattcaggcccttatcataatcctaatgttgtggcctttcattagatttttacaaaggcagtttagtttgggaagacagcttgggggtcagaagcatgattgaggccaggcgcggtggctcacacctgtaattccagcactttgggaggccgaggcaggtgaatcacaaggccaggagtttgagaccagcctggccaacatggtgacaccccgtctctactaaaaatacaaaaaattatctgggcatggtcacaggaacttgtaatcccagctacttgggaggctgaggcaggagaatcacttgaacctaggaggtggaggttgtagtgagccaagattgtgccactgtactccagcacgggcaacagtgcagaactctgcctcaaaaaaaaaaaaaaaaaaaaaaaaaaaaaaaaaaaaaaaaaaaaaagaagcaagatggagtcaacaatataagatttttttttttttgaaacagggtctttctctgttacccagggttaattgtcgtggcacaatcatagctcactggaaactcaaactcctgggctcaagcaaacttcccacctcagcctcccaagtagctgtgactacttcatagccactgcaactggctaatttttttttaattatactttaagttctagggtacatgagcacaatgtgcacgtttgttacatatgtatacatgtgccatgctggtgtgctgcacccagtaactcgtcatttaacattaggtatatctcctaatgctatccctccccgctccccccaccccacaacaggccctggtgtgtgatgttccccttcctgtgtccatgtgttctcattgttcaattcccacctatgagtgagaacatgtggtatttggttttttgtccttgcgatagtttgctgagagtgatggtttccagcttcatccatgtccttacaaaggacatgaactcatcattttttatggctgcatagtattccatggtgtatgtgtgccacattgtcttaatccagtctatcattgatggacatttgggttggttccaagtctttgctattgtgaatagtgccacaataaacatatgtgtgcatgtgtctttatagcagcatgatttataatcctttgggtatataccgagtaatgggatggctgggtcaaatggtatttctagttctagatccctgaggaatcgccacactgacttccacaatggttgaactagtttacagtcccaccaacagtgtaaaagtgttcccatttctccacatcctctccagcacctgttgtttcctgactttttaatgattgccattctaactggcgtgagatggtatctcattgtggttttgatttgcatttctctgatggccagtgatgatgagcatgttttcatgtgtcttttgactacataaatgtcttcttttgagaagtgtctgttaatatcctttgcccactttttgatggggttgcttgtttttttcttgtaaatttgttggagttcactgtatgtagattctggatattagccctttgtcagacgagtaaattgcaaaaattttctcccattctgtaggttgcctgttcactctgatggtagtttcttttgctgtgcagaagctctttagtttaattagatcctgtttgtcaattttggcttttgttgccattgcttttggtgttttagacatgaagtccttgcccatgcctatgtcctgaatggtattgcctaggtattcttctaaggttttatggttttaggtctaatatgtaagtctttaatccatcttgaatgaatttttgtataaggtgtaagggagggatccagtttcagctttctacatatggctagccagttttcccagcaccatttattaaataaggaatcctttccctacttcttgtttttgtcaggtttgtcaaagatcagatcgttgtagatatgtggcattatttctgagggctctgtcctgttccattggtctatatctctgttttggtaccagtagcatgctgttttggttactatagccttgtagtatagtttgaagtcaggtagcgtggtgcctccagctttgttattttggcttaggattgacttggcaatgtgggttcttttttggttccatatgaactttaaagtagtgttttccaattctgtgaagaaagtcattggtagcttgatggggatggcattgaatctattaattaccttgggcagtatggtcattttcatgatattgattcttcctacccatgagcatggaatgttcttccatttgtttgtatcctcttttatttccttgagcagtggtttgtagttctccttgaagaggtccttcaaatcccttgtaagttggattcctaggtattttattctctttgaagcaactgtgaatgggagttcactcatgatttggctctctgtttgtctgttatgggtgtataagaatgcttgtgatttttgcaattgattttgtatcctgagactttgctgaagttgcctatcagcttaaggagattttgggctgagacgatggggttttctagatatacaatcatgtaatctccaaacagggacaatttgacttcctcttttcctaattgaatacccgttatttccttctcctgcctgattgccctggccagaacttccaacactatgttgaataggagtggtgagagagggcatccctgtcttgtgccagttttcaaagggaatgcttccagtttttgcccattcagtatgatactggctgtgggtttgtcatagatatctcttattattttgagatatgtcccatcaatacctaatttattgggagtttttagcatgaagggttgttgaattttgtcaaaggccttttctgcatttattgagatagtcatgtagtttttgtcattggttctgtttatatgctggattacatttattgatttgcgtatgttgaaccagccttgcatcccagggatgaagcccacttgatcatggtggataagctttttgatgtgcccctgaattcagtttgccagtattttattgaggatttttgcatcgatgttcatcagggatataggcctaaaattatctttttttgttatgtctctgccaggctttggtatcaggatgatgctggcttcataaaatgagttagggaggattccctctttttctactcattggaataatttcagaagtaatgctaccagcaactccttgtacctctggtagaatccagctgtgaatccatctggtcctggactttttttggttggtaggctattaattattgcctcaatttcacagcctgttattggtctattcagagattcaacttcttcctggtttagtcttgggagggtgtatgtgttgaggaatttagccatttcttctagattttctagtttatttgtgtagaggtgtttatagtattctctgattgtagtttgtatttctgtgggatcgatggtgatatcccctttatcattttttttttgcatctatttgattcttctctcctttcttctttattagtcttgctagcaggctatcaattttgttgatcttttcaaaaaaccagctcctggattcattgattttttgaggggatttttgtgtctctatctccttcagttctgctctgatcttagttatttcttgccttctgctagcttttgaatgtgtttgctcttgcttctctagttcttttaattgtgatgttcgggtgtcaattttagatcttttctgctttctcttgtgggcatttagtgctatagatttccctctacacactgctttgaatgtgtcccagagattccggtatattgagtctttgttctcattggtttcaaagatcatctttatttctgccttcctttcgttatgtacccagtagtcacacaggagcaggttgttcagtttccatgtagttgagcggttttgagtgagtttcttaatcttgagttctagtttgattgcactgtggtctgagagacagtttgttataatttctgttcttttacatttgctgaggagtgctttacttccaaataagtggtcaattttggaataggtgtggtgtggtgctgaaaagaatgtatattctgttgatttggggtgcagagttctgtagatgtctaattttttttaaatatttatagagatggagtctcaccacattgcctaagttggtcttcaacttgtgggctcaagcaattcttccgccttggcctccccaagtgctgggattacaagcatgagccactgttccctgcctgtcagatttctgacataatcttgcaaaggtggtttcactctttcctttattactccattcaatatatgtttattgagtgcacgtactcttttacctcaataaatggaacctagattcttccaatcgggcaagtcaagaaccatgaaagtattatcactgttctatttctctcatatccaatccatcagcaagtcctatcagctcctcattctaaatatagctcaaatatgactgcttcttaccacctttaccactttggtcaaaagagctatcatttctcacttgagtgatttcaagagccactttattggtctccttgctcctactcattccaactctggctccttgttgtgcaaataaaatcaatcagatatcagactttctgctacagtatttattgagagaactgcatagcaaaacaaatagtagcatatgtgtaagttcacctttgcccactgaattctgaaataacaaaaaaggatctaatgggactgaacatcaaactccagccattggattgtagggcttttaagctacctaatgagggaaacaccaaactactctggtatgatcacagaggcatccaactgtagtaattatgtcatggccaaaattgatcttcagtcctcttccaccacgttggcatccttcagttaaaggaacaacagcctttcacctggtgtggtcagtggattcgcatacaaggtttgtagttcttatttatgatgtgacagaccagtgatctacttcgccatttcagcatcctgtcagaattgattgccttaagtatttggttttccagggagctctaaaagaagccaatttctagtctaggaggccagttgaagggaatcagtattgaatatgatgatcctaccagctatccatctaaataacttaacacaagcagtaaatatgacccacctaaatcaaaactcatataatgcccttcctctattccaaggcctccagtagtttcccatttcactcagagtaaaatccaaagcccttactttagcctacaaggctctacaagatctgcctacctttctacttcctcttcattcttactattatccccatcactcactcctatccatccacactgttcctctgacaatctcaccaagcttttgcatttgctgttccttctgcctagaatattttctccctagataccaacaatgtaaaaaaaaaaaaaagtaactttggtgaaaaatcagaaagacatgaaaaccaaattaatctacttggtttttttttttaataaaaatccccccaatcatttaaaatagaaaaaaaaacaaaaacaaaaaaccctggcccattgatatcactaggacactcagaagaagccatagcaaaatcattttggatgacaatttttatgagctaggccacaaaggatttgcacagttggggtaggggtgagaaggagaagagttccactgaagatattatagtgagtaaattaatatttttggccaggtattgtggctcatgcctgtaatcccagcactttgggcggccaaggcaggtggatcacttgagatcaggagttcgagaccagcctggcccacatggtgaaaccccatctccactaaaaatataaaagttagctgggcatggtgttgcattccccagctactcagggggctgaggctgaggctgaggcatgagaatcacttgaacctgggaaacggaagttgcagtgagccaaaatcatgccacagcactccagcctgggtgacagagtgagactctgtctcaaccaaaaataaaaaagaatattttcatgttactagatggttctggctttctgagcaaattttaccagaagctaaattagaggccaagacttggaagttaaatgatgacagaatagacagtgagaggactttttagagatataccttcctggatgtttacatttcaaaggaggataagacacagagacattcaggcattgtaaatccagacgcaactgtcttatcttctgccttgcaacacttatttacattgcaaagtgtaagtacccaggactccttcttttctcttcccttatttacatttgaaagactaggtttctctcactctgaggtgggcaggatggcagatgtttaaactatcctatataaactgcccgaatcataatatcagagttccttttctgcagtatagttcctggtacatgtagaatgacttagactctcaccatattgttccagaggatgaaaaaattgggcaagaagaacgaatgcagttattgatgtaagaaataatacctttgatctctgcttcagaaacttcatgtttatattcaagttaagatatataaacatagattttttagacttattttaaaatctaaactcacaaaacacacaagaaaataatcccccatgaaaaatagccgacctatcaaatggaaggatgagcagcccaggaacttgaaaaaagggaacaatctgaaaaggactataaaatgatggtatttaaatgtttttaaaagataaaaggaggcacaaaacacgtaaggaacaagacagcatgaaggaaaaatagacaaatttaaagagaatcaaacataaattcttgatttgaaattaatagactcaatggcttaagtttgaaagctgttaggaaacactaaagagaaacaactagtataagattcccatgcagaatacaatacaaagagatagagataaaaaagcccaaaggaaggttaagagatacagaagtgagaatgatcaagcacaacatacttgtaagagcagtcccagaaagcaaatagcaacaatatgagagaagcaataatcaatgagctaaaggaagaaaatttttaataattgataaaaagacatgatttttttcatgttgactagcacaccaaattaaaaataaatagacaaatcctagacaccaatgacaaagaattatataagcaatcttagatttaaaaaaaagacccacaaggaaccataatgtgacttttagataataacagaataatatctacaaaattgatcacagcaggaggcagacaaattcctaggcagacaagggtgggtccctggtgaaacccgaccttcaaaccaaagacaaattaaagcctgaaaaccaagctgccagtctgggtgaagtccctgaccagggtgagaatttccttgatgccttttagccaatcaagtgatgctttttccagtgctgcccatggaccaattggcacacactccccattctgagcccataaaaacctcagactcagccacatgctgggactacctgccttcaggtaggggctacccacctcaggtcctctcaactgagaactgttttttgtttttgtttttgtttttgagacagagtctcactctgtcaccaggctggagtgcagaggcgtgatctcagctcactgcaatctccacctcccgggttcaagtgattctcctgcctcagcctcccgagtagctgggactacaggcacaccaccaagcccagctaatttttgtatttttagtagagacagggttcctccatgttggccaggatggtcttgatctcttgacctcgtgatccacccgccttggcctcctaaagtgctgggattccaggcgtgagccaccacacccagccgagagctattctgttgctcaacaaaattttctccaccttgctcactctttggttatccttgtaacctcattcttaaatgtgggaaaagaatctgggacccgccaaaaggcaggtgccaaaggagccgctgtaacagtatagcccccgtgtactccaccagcaccagacagccaccccatgcaacaggaaacaaggtgccaggccagcccagaagccacagcccagaatcgggcgaagggactgaatgagctgtaacacaaactaactgaaacccactccttctgccaattcactgtgctgctggaagcaagaagagaagagttgcaacccttctgggagcccagacctcagggctcctcaggccagagctgtgacatgctgtaacactgcctttggggttctgtggttgctggcatctccaagttttgggggcaccactgctttccccttgtctagacacgggcgtctaagatggaagcctcttgcagtacgtctggtctagctgcagcctcacacagagctggcacctgaagccgcctgccctgcagcagtagccggcacacctggcttgcccttggtgggcctgagatctaggccagtagcaaaagccaagcacagcctgctgggctgagtgggcggagctagctcagtcatcctgagtgaaacttgagcagaggcaccattggccacaaggtccccagctggcaaaacagccccccaaaaatcctgtgtcaaaatgttggaaaataataatcagttctggacttttgcccagttaaataattattcaaaagcagaaggaaataaaaacagcttcaaacagttttaaacaagcaagagcaatgtttatcattagcatatatgtttaaaagaactatattttttaaaaaatttaatgaagaaaaacattgaacatgaagagaccagagtgaagaaataaattagcaaatatgagtatatctgaaaaagtattgactataaatgtaaatttttaacataatgaccacttttaaaaggtttaaaaattaaggtgaaaataaaatattatacaatgtatcaaaaaatagaataaataaaaaagaaaaagtattctacagttcagaaacaaggtatattccctagaggtagacttgtagaaaaaaatacataaatattggttaaatttagaatttattgagtcaaatatgcatgttaaaaatgaaaaggtagcaaagaacagaagtagaagtcacaactttcaaaccagtaaaaggaagaaagaataaagaaaatttgatcaatctgatacaaagcaagaaaggaaataaaaggaagtataggaaaatacatatagtaaataaaaaccacaaaagacgatagaaataattccaaatatatcggtagcctcaataaatataaacagaataaacaactacttaaaatatagatagtcatgttgaactacaaaactccaactctatgtttcttacaacagatgtacctaaagtataacaatgaagaaatactggcagtaaaagtgtgaaaatgatgaaataaaaaaattaaccaaaatagttaaattgttaacaaccaaaatagactttaatgcaaagatcattattgataaagaagctatttatgtaatagtcagaagactaatttaccaaaaaaatagaacaagcctgaaactgtatttacttcacaacatagcctctcaatagataagcaaaaaattacagacatgaaaatttgaattgaatctgtatatatcttatcatatagactcaaaatccacaaacaagaacttaacaagattacaagaaaaaattaacaagtttccaaccatggtgagcttttaaaatatatttccattagtaattaatggatcaagcagagaaaaaattgaactgtgctgttctaaaggattagattttaaaatactaactatttgagaataaattcttttaaaaacccagcctatgaaatatatcaagaaaaagactgtactcttttgaggtcatttctcaattatagatatgctgatcaggagcaactgtatccaatagacctttcagcaataataaaattgttctctatctatgcagtcaaataaggtagcctttaaaatcaagtgtgattaaaacaactaaggaattaattttaattttagttttaattcatttaatttaattaaaatttacttaatgtaatttattaatttattctatttaatttaaatttaaatggccacatggttaccatattgacagtgaagttttagagtagtattagtaaaaagtttatatctttcaatgcttacattagaaaagaaaaattgtcaaaatgaacaagcaaagttcctaatttaaaaggcagaaaaatataaaatcaaagaacatagaaaggaaaaggtaacaaagagtagaaaataataaaatttctaaaaagttacaaaaattttaaagactaataagataagcctctggcaaaaataattaagaaaaatgaaatacataaatgtaaaattttgggagtgaaaaatgtacagcaaactttttaaacttaaccaagtacaataaatacaatttttttaagtttaaaaagaaacagaagaaataaatagatttaaacttaaaaagacatcaaagtagtagcaaaactgtaccaagataaaacagagcaaaacaaaaatcttcccagatagtttgaccaattctaccaaaactaaaaaattaatctctaccttctataaacattctaaaaaatagaaaaaaaattaaattctaacccatgtattatcctaatataaccttgaaaccaaaatcaaccagagtacaaaaaataaacattatatgccaattttatttatgtgtcaaaactctataaaataatattttctagcaatgtaatttttaattataccacataaaactatgaaagcaaggatgctttgctaatataaactctattgctgtaatttttccaatcaacagagtaaagagaaactaacaaaattatctcaaaagagaatactattagataataataaagactgctggctgtgttccatagttcaaagttctgcatctataaatttatttattctttacaacaacgtctgatgtatttttattttcattttattttcttattaggcattgtcattgactaacaaaataggcaataacaaataacaaagctgtggcagagagaagctcaatgtcatccagcttactagtggcaagtccaggatttgaaatcagactgatttcaacatccatgctcttaactacaacatatgttctttctcaagtcccagttgctatttttagggggaaatcttagcaaactacgaatagacgtaatatccaaagatctaagaaagtatctactaacaaacaatctatagttatgcattgtttaatgacagggatatgttctgagaaacatatcgttgggcaattttgccattttgttaacacaatagagtgtacttacacaaacctagatggtacaccctactacacacttaggctacatggtatagcctatcgctcctaggctacaaacctgtacagcatgttgctgtactgaatactgtaagcaactgtaacacaatggtatttgtgtatctaaacatagaaaaggaaaaggtacagtaaatatatgaaagatttttaaacgatacttctgtataggcacttaccatgaatggggcttacaagtcaagtctggaagttgctctgggtgagtcagtaaaggagtggtgagtaaatgtgaaggcctaagacattactctacactactgtagactttataaacactgtacacttacgctacattaaatttattttattttacaataataaattaaacttagcttactgtaacttttctactttacacatcttttaatttttttactttttgcctcttttgttgttacattttagcttaaaacacaaacacacattatagagcaatacaaaaatcttttctttctttatatccttattttatgagattttttctatttttaattttttacattttaaacttttttgttaaaaactgaaacacaggaacacacactaacataggcctacatgaggtcaggaatatcagtatcatagtctgccacctgcacatcttgtcccaattaaagctcttcagggacaataacatacatggatctgttatctactatgattaacaatgccttcttctagaatacctcctgaaggacctgtctgaggctgttgttcagttaactttttttttaataagtggaaagagtacactctaaaataataataaaaagtatggtaaatacctaaaccagtgacatgtattatttatcaagtattatgtactgtacataattttatgtgctatacttttaaatgactggcagtgcaataggttgtttacaccagcatcaatacaatgacaagagtaatgcactgctctacaactttaggaaggctacaaatgcactagttgataggaagttttcagctccattataatcatatgggaccataatcatacatgtagtcggctgttcaccaaaacgtcattatggagcacacaactgtacttcataataaaatgttgaacatcctatttaaagacacaaacaagaaaaaatgcatgcatgtttctagatagctggctatttttatgataaaatataaaatcacaccaacacctcgtatgtatacaaaattaattcaatatgaacttaagaccttggtatgaaaagcaaaacttactatagtagaacatgtttgtgacttgaaggtagagaaggatttcttaaatgagacacaaaaaacaaaaaccagaaaagaaatggtcaatgaacttgaccataggtaataaccatgtattctactactacggaagattacagacattagagaataaatagtggtaacagttattctacatttactaatctaatctttgccaccatttcttttttctggctagtgtttctgagttacttgtgttaaattgctgtatgttctttaggtaggggtatgtataatcagggctgatagcctctacctaaaacataccattttcacaaataacctctatgctatgagaaaagctccaaattattctatttctgtcatttaacactatcagagtgccaaaaaagagtaacatggaagatatttcaaactatctcatgagccttgacaggattacatcataaggacaatagaaagtatttttgaatctacctctagcactaatttaataatgtattcatagcgtttcttttgttctttcaaaaatatttcttattcatttgctgtccacaaggttcttagcacacattaagacaggtagaaatatttaaactaacagtttctctggcttggagaagttgggtattgggagggctgagtggaacaatagcacttttttttttttaagagacagctttcgttctgtcacctaggctggagtgcagtgatgggatcatagctcactgcagcctcaaactcctgggctcaagcaatcctaatgcctcagcttcccaaggaactaagactaaaggctttgtcaccatgccctactaacttattttatttatttatttatttattttgtagagagagggtctcactatgttgcccaggctggtcttgaattcctggcctcaagctgtcctcccacctcaaccttttaaaatggtgagatgacaagcatgagccactgcacctggacccaaatattttcaatagagtgtaattattctaatagaattaagtggcctcttccctttctctgctccaagccctcagatgacaatctttataggactgtcttgtgccaacacacagtatatttattcataaaaaaaatttctgaacctactatgttatcattcttgattactaaatttctcaattatctttgctttatctacaatgtgaaatttgtcagaaagaccaaagctcaaatctcaattctactacttgctaattatgtgaccttgaacaatttatttcactactctgaggctgagtttgcttatttgtaaaatacagataattaacaactgcctcccattgttgttaggatttcataataatatgtaagtagggcacagtcctgttatgatggtggttctacctctctcttttagggaaggaattatctcctgtagcattctatatattgctctgaacacagtatatgtaacaaataattggtgcttggttgtttaagcaattaaataagtcaacaaaaattgtgaatccttaatgcataaaaacaaatgccaaataggtttaagacctaaattttgaaagcaaaattttaagattcttagaagaaaacataaaaatgttacccttatggtctttgagcagaaaaactttgtaaacaagatatagaaagcataaacaatgaagaaaaagatttcttaagctgactacatgagatttttaattttctgcatcaaaaaccatcatttaaaagaaaacaatcataaaagactggaatttatacattcaacaaaggagtcagcatcaataatatttaactagtacatttgtcttagtccatttgggctactataccaaaatatcaaagactctgacttatgaacaataaacatttacttctcacagttctggagactgagaagtccaatatcatggcaaaggcagattcactgtctcatgagggcccgcttacttcttagaagacagctgtcttttccctatgtcctcaaatggcaaaaagggcaatggagctctctaggacctctttcctaaaggcacaaatctcattcatgagggttccaccctatcacctccaaaaggcctccaaataccgtcatattggagattaagtttcaacatgtgaattttgggaagacataaacattaagtctataacagtatccataaaaacattactttaaaataatataaacacttatgaatcagtataaaaaatagaaaacggattcattatgaacttttgaaatgatgctcaacctctctacttatcaggaaaatgcaaattaaaaccaaaatgagatcgcttttcatattcattgaattggtttgcgagaactacagtaattaagtacctgggtagcttaaacaacagtaatgtctattctcacagttctggagcttagaaatctgagatcaaggtatcagtagtgttggtttctcctgagagttgtgaggaaaggatctgtgccaagcctctctccttggcttgtagatggctgtcttctcccaatgtcttcacattgtcttctgttcaaatctttgttcaaatttctccttcttataagaataccaatcatactggattgtggcccaccctaaagacctcattttaatttaattacctcttttaaagaccctatctccaaaataccattacgttctgaggtactaggggtaggacttcaacacatgaattttgtgggggaggggacacaatacagcccataagacttaaaaaattggcaaataatttttcagtctggtaacaccaagtattggcaaggaatggggagaaaaagaaatctcatactttgctgatggaagtataaatcggcacaatcactttagagaacatgcagtaaacctgaagatagacattgtaatccagtaattccacaactatgtatttagtctagagaaacactggcaaatgtgactcaaaaacagttacaaaatattctagctacattatgataaacaaaatatggaaatatcctaattgtccatcaacaggagaaaacacaagtacattctggaatgtctttataatgatataccatgaagcaagaaaaaaaaagtgaacaggagctacaagtatccataaggatgaatctcatagatgtgatattgaacaaaaaaaggcgagctgcaaaaaaatgcaacatcataacatttatatgcaacttaaaatatgcaaaataaaacatatattgtttatggatatacatgtgtaatgagagcatatgcacacttaactatttttaaaccaataaataaattcccaaatgttaactatttttccaccagaacattcaataatataaattcttaattaggctccaagaaataagtactcttaccaaaagcacacacaagtcaattaaaaaacaagtgaactgtaaattcagtgacaattaaataaaaagaatctattctggagcctttaaggttctgtctttttcagctgcacacaggaaaaaaaactaaatgtcatgtttcaatagtgtttaaactatcctgcacacatgcaaaaaaaataccacatgcacatttaagtaaaactctttcaaaataggcaaaacaggatggtgtagcacaaagagactacatttactccaatctgtaatgaaatcctggttttgcctcgctggctgggtgggtttagcaagtcacttattcaacttatctcagcctcactttcttcatatgtaaaatcatataaacttcagttttctcatttgtaaattccctcactttcttcatatgtaaaatcatataaacttcagttttctcatttgtaaattccccattcagtttccttctggaaaggtttgtgtttatgttcggtatctacacataacgtgctcaaatggcacctgtacgggtagaatggtatttgatcagtacagtagaaattaagataaaagtgttattgagtatcagcaagatggcagaatagggctctctaatgcttgtctctcccacagaaacatcaatttgaacaattgtccatgcacaaaaatactttcacaataggtaaggaaaccaagagattacagcacctgggtacagcaccaaaataagaaaacatgcatggaagagggtagaaagaacagctttacattacccatttcacccaactccaggcagcacagggagagataccttccacttgagagaaggagagggcagtgagtacaagactttgcctcagattccaaagctaggcccacccccaataaagcctagcaccaggaagacccccaacagccccaaactccaggtctgtatagcaaattaagtatccaggctgccccatgaccaggctgaccccagtggccccagtctgtagactgcccccagcatcaggctagccctcacagccacaggcttcaggcctgccccagtaccaggccaaacccacatagtcctagtcattgggccagaacctatggacccagcccccaggccagccactgtggatggagactccaggcttgtccagtgccagaccagccccctgcagccccagactcctggctgctacccgcagactgagcttccaaacctgccccaacactatataggatcctgcagccccagggtccaggtctacagagcaaatttgagctccaagcctgccacagcacaaggctaagcccagaggccccaagctccagatcagacccagcagaagacatgacctgcagaatcaggctccagaccaaccccaaggccaggccagcccctgtggccccaggctgcagaccacccctagcaccaagctggatgccaaagtcccaagcttcaggcccacttgaccatcaggccaactcctgcagccttaatgaccaggccagaacccatggaccttgcctccaggaagacctctgtgaatataggatccaggctccacccagtccaagctagctcctatggccccaggcttctatcccaccccaatgccagcttggctcccctggccttaaacagcaggcaggcaccaagacctaagctccaggccttcccagtgcaaggccagtccccatggtcccatgctcaaggccagatcctatggtccaatgatgctacagtaacccagagtccaggagaccccagaagaaccagtccccacgaacccaggctctaggaccacctctgtgtacctactactcaatctggttccttgtcccaagacccaggctaggctttatggatccaatccctaggccaggtcctagacctgtgcctctaaggcaataccagcaggcacaggctccagacccaaagatcccaggctccaggccagcctaatggtcccaggtatcaggcaagtacttgtgatcctaagctccaaaccagtgcccacagacccaggctccacatggaccccagcatcaggctaaccccaggctccaggctggtcccagtggcccagactctagaaaacccagagtccagacctgttccagcagacccatggtccacccccagtcccagtctagaccttacagactaaggctccaagaccaccccttctgacccaggttccatgatagcctttgtggacccaggaaatatttgatatatatctgctatataagatatctgatatataggaaaatatacatatatctctctgatatataagatttcataaaggagaaaagaaagagaaagacaaagcgtagcagaaaacttttcaaatttggagaaagatataaatatccaagtagaggaacagatacaggcctccagtcagattcaacccaaacaagactacaaaatgacaatatgtcaaaaatcaaggacaaagagaggatcctattagcaagagaaaattagcacgaggatccttattagtgagagaaaataagcaaaccatatatgaataagttccaataaggctagcaacaaatttctcagcagggacgttacaggccaagagagagtgagatgatgtattcaaagtgctgaagtgtaaaaaattttttttaaaaaatgtgccaactaagaatactgtatctagcaaagctgtttttcagaaatgaaagagaaataaagactttcacagacaaacaaaagctaagggagtttatcaccaacagccctatcttacaagagatgctagagggagtattcaacctaaaagaaaaggatgctaattaataagtaacgcaaaaacaactaaaagcataaaactcaatggtaaaagaaagcagacaatcaaatccagaatactctaactgcaatggtgatatgtaaatcacttataactttagtatgaaggttaaaagacaatctattaagaataataggccaggcgtggtggctcacacctataatcccagaactttgggatgccaaggcaggtagatcacttgaggtcaggagttcaagaccagcctggccaacatggtgaaaccctgtctctactaaaaatacaaaaattagccaggcatggtggagggcacctgtaatcccagctactcaggaggctgaggcaggagaatcacttgaacccaggatgcagaggttgcagtgagccaaaaaaaaaaaaaaaagaataataatagctacaatactttattaaggtatatacaatataaaaagatgcaaattggcccgggtcttccaggagtcgggttgcttgggaatgcagcccaaagcgggtggtaaactccatttaaggctaaataccggcacgagaccgatagtcaacaagtaccgtaagggaaagttgaaaagaactttgaagagagagtacaagagggcgtgaaaccgttaagaggtaaatgggtcaggtccgcgcagtccgcccggaggattcaacccggtggcggatctttcccgccccccgttcctcccgacccctccacccgccctccctctcccaccgcccctcctcctcctccctaggcattaccattcaggacataggcatgggcaaagacttcatgtctaaaacaccaaaagcaatggcaacaaaagccaaaattgacaaatgggatctaattaaactaaagagcttctgcacagcaaaagaaactaccatcagagtgaacaggcaacctacaaaatgggagaaaatattcgcaacctactcatctgacaaagggctaatatccagaatctacaatgaactcaaacaaatttacaagaaaaaaacaaacaaccccatcaaaaagtgggcgaaggacatcaacagacacttctcaaaagaagacatttatgcagccaaaaaacacatgaaaaaatgctcaccatcactggccatcagagaaatgcaaatcaaaaccacaatgagataccacctcacgccagttagaatggctatcattaaaaagtcaggaaacaataggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggattataaatcatgctgctataaagacacatgcacacatatgtttattgtggcactattcacaatagcaaagacttggaaccaacccaaatgtccgacaatcatagactggattaagaaaatgtggcacacatacaccatggaatactatgcagccataaaaaatgatgagttcatgtcctttgtagggacatggatgaagctggaaaccatcattctcagcaaactatcgcaaggacaaaaaaccaaacactgcatgttctcactcataggtgggaattgaacaatgagaacacatggacacaggaaggggaatgtcacactctggggactgttgtggggtggggagaggggggagggatagcattgggagatatacctaatgctagatgacgagttagtgggtgcagcgcaccagcatggcacatgtatacatatgtaactaacctgcacattgtgcacatgtaccctaaaacttaaagtataataacaataaataaataaacaaatagaaaaaaaaaagatgcaaattgtgacatcaaaaatttaaaatgtggaaggatgggtcaggatcactcattagaagcagctagtacacacctcctccatgaaaaggaaccagaatagtaaataaacactttgaatagatcatctaagagagacttagattcaacaaagaagtgatgagaagtactgaatgtgagtaaggagagggaagggggcagctctcttggctggggatcagctgggagccagaaaaagctcctggatgcagggaaagggtaaaagagaaacccccagggttctacactctcaccgcaggcttttgcattcttggctatgagagaacctcttggcccacagacctttggcctgacatgaggaacagactagagactgtaccaagatgtcgctccagacggggaacccacatggagtcccacaggtatctgagccctgagcagctgcttcttggtgccatcctgagaactttgctgcttagaatctgcatcctgtcctgaggcaggactgacacagccagtgcagctgccaccactaggctgggacgggaaaggggagactgggcactcccacagacaactaggatagtccacatcatcatgctagaggctactgtgaaaccaaagaatgagtagacttcactcctcatgtctacttgcccacagtgcgccatctgagaggggcccagccttccctggtggtaggcccacagctgacattttgacagtttagtcactggaggtctgcaccctacccttgagctgggctagggttgttgctgctgcagcagctgccagtccaaaaagggaaagaggagaccaggcactcccatgacccctagaaaagttcccactgccctgtgtgggctgctgtgagaccagagcaagagcagtatgcattccccaaagcttcttgcccacaatgctctaactgagaggggcctcatccttcctggtggtaggcccacagcacagccaccaaagcccacagggaacattccaccagtacactggaaatcaccctgcctctgcctatttcagccagtgcctaaacacactaccagggagcctgtgaacaagtctacttgcctaatcctatcccccaagtacttgagcatgccatccagaagcctggaaattttttagcccagtctaccaccattggcacctgattagtcctgccaagatttgaggtcaggctgacccaacctactgataccaccacagctgacacccacacacacatggtaccagcaggccaggggactggaatgcccacccatagcagtcaccaccaacaccagtatggatcacttggattccagtaggttgctttaccactgctactgccatcacccttatcacacctgctgcccagggcctgagtgcctgcccacaagcctggccccccctgctactaccagcatccaagcaagccacctggggatccaagaattggcgctccaggaccactaacaggtgcgagagtaatctgctctggggccttaaaagagacaccaccactgccaccaccaagacctaaacaatggtccaactagtgtcctagtcccatgcataacttcaccaacatctccactaataatcataccctaaaccaccgagaagttcaagataccactgaccctgtgtgctgattaaaaaaaaaaaaacagagatcacactacttgctgcaggccccaaaatcaaagccaaaaacttcctattcagccaacaatgtatatacaagatatatatatatcttgtatgtcttcaggaaaaatcctcccccatgaaagcaacttcagaaaaattggaagaagtgactattacaccagatatgtagacatgaatgtaagagcacagaaaacagcaaaaagcaaggaaatatgataccatcaaaggaacacaacaattccctgaaataaatcacaatcaaaaataaattcacaaaatcccagatcaagaattcaaaatactgattttaaagatgctcagtgagatacaagaaaactctacaaaataataccaaaaaattaaaaaaaaaaaaaaacctcaggatatgatgaaaattttaccaaaaagataggtatttctaaaaagaaccaaatagaacttatggaactgaaaaattaattggagaaaatacaaaataaactcaaaagttttaaaaatagactagagcaagcagaagaaacaatttcataacttgaagacaggtattttgaaataatccagtcagacaaaaatttttaaaaaaataagaaagaaaaaagcctttaagatgtttggcagtacataaaatgacaaaatttacaaattattggtagttccaagggtgaagagagatcaaaagacttagaaaaaataatagatgaaaatttcccaagtctagcaagacatttagacatacagatacaggaggctcagtgatccccaggaaaacaatgcaaagaagattttgccatggcacattataatcagactgtctaatatggtttggctctgtgtccccacccaaatctcatcttggactgtactcccataattcccatgtgctgtgggagggacccagtgggagataattagaatcatgagggtggtttccccatactgctcttgtggtagtgaataagtctcatgagatctgatggttttattagggatttttgcttttgcatcttcctcatttttctcttgacactgacatgtaagaagtgccttttggctgggtgcagtggctcacgcctgtgatcccaacactttgggaggctgaagtgggcggatcacgaggtcaggagtttaagaccagtctggtgaatgtggtgaaaccccatctctactaaaaatacaaaaattagctgggtgtagtgtgaggcacctatagtcccagctattcaggaggctaaggaaggagaatcgcttgaacccaagaggcagaggttgcagtgagccgagatcgcaccactgcactccagcctaggtgacacagggagactgcgtctaaaaaaaaaaaaacaacaacaacaaccacaacaaaaagtgtcttttacctcctgccatgattctgaggcctccccagccatatgaaactgtaagtccaattaagtccaattaaacctctttttcttcccagtctcaggcatgtcttcatcagcagtgtgaaaacggaccaatacactgtctaaattcaaactgagagactgaattctaaaatcagcaagagaaaggtatcaagttacctataaaggaaacccctttaaataaacaagagtattcccagcaaagccttatgggccagaagagaatggaatgacatattcaaagtgctgaaagaaaacaactggaagcccataattctatatctagcaagattaatgttcataaatgaaggagaaataaagtctttcccagacaaggaaatgatgacagaattcatcaccactatacaaaccctaaaagaaatgttcaatgaagtcccaaacttggaagtgatggaacaacattcaccatcaagaaaacacaaagtataaaactcattggtaaattaaacacaccaaagaggaagaaaaaagaatcagatgataccactatagaattctaccaaaccacaatgacagggaaaaagaaataaataatttagaaaacaaccagaaaaaattaacaacatgacaaagaaaagctcatatatcagtattaaccttgaacatatacaattacaggctccacttaagagatacagattggaaaaatgcatgaaaaaaatcatccaactatatactgcttataataacccaatcttacctagaaagaaacacatagactaaaagtaaagaggtagaaaagaatattccacacaaacaaaaaccaaaaacaagcaagaatagctacacttacatcagataaaatggtcatggacagtgaaaaaacattatgtcactatataataataaaggtatcaactcagcaagaggatataatcattctaaatatatatgcacccaacactgcagcacgcagattcagaaaacaaatattattagacctacagagagagggacagtaaaacaataatagtggggacttcaacacccccactgataacactagacaaatcatcgagaccgaaaatcaacaaaaaaacatgaaaccgaaattggactttacacaaaagggaccaaaccagaacattttactcaacaacttcagaatacacattctttacatcagcacatggaaggttctctaagatgaaccatatgttaggccacaaactaagtctcaacaaatgtttaaaaatcatatttttgaaaatcaaaatcatatcaagtatcttctcagatcatagtggaataaaactagaaatcaacaccaagagaaacttcagaagctatacgaacacatggaaattaaacaacatgctcctaaattatcactgtgtcaacaaataaattatgaaggaatttttttaatgttttcaacttttctttgaaaggacatgcaaaaaatgagtaaataaaaataaaaatatttttttcttgtccaggtgtggtgcagcactttgggagaccaagctataaggattttttgaagtcaggagttcaagactaccttggacaacaaagcaagatccttgtctctacaaaaacttaaaaattagccaggtgcagtggtatgtacctgtagtcctagctactctggaggctgaggtgagaggatcaattaagcccaagaatgtgagactgcagtaagctataatcatgccactgcactccagcctgggtgacagaataaaatcctctctctaaagaaaaacaaaaaataaatatatttgaaacaaatgaaaatgaaaacacaaacataccaaaccctgtggaacacagcaaaaataatgctaacagggaagttagcactatttttgtagaaaatagtgaaaaaatagtagaaagtagaaaaattacaacttaacaatctaacaactagttagattgaacaactagttcaaggaactagaaaagcaagaacaaaccaaacccaaagctagaagaagaaatgaaataacaaacatcagagcagaactaaatgacaaaaaaatcttaataatataatcaatgaaatgaaaaatttgttctttcaaaagaaaaacaaacttgaaaaaccatgagctagaataaccaacaaaaaaagaaagaaaactcaaataaacaaaatcagaaatgaaaaaggagacattaccagtcataccacagaaatacaaaagatcatcagagatgattatgaagcactatatgctcacaaactatatgctcaaaacttagaggaaatggataaatttctaaaatcatacaacctccccagattcaaccaggaaaaaatagaaaacctgaacaaaccagtaacaagtagcaagactgaatcactaatttaaaaaacttccaacaaagatgaattgtaccaaaagtacaaagaaaaactaataccaatcctcctgaaacttttcaaaaattcaaaaagggaagaattatcccgaattcaatctatgaggccggtaccatcctgataccaaaaccagacaaggatacaacaaaaaagaaaactatagaccaatatccctgatgaatatatacataaaaactctcaacaaaatactagcaaactgaatccaacaacacaataagaagataatacattatgatcaaatgggttttataacagaaatgcaaatgaattttatactagagatgcaacaaacgtgataccttatataaacagaataaaggacaaaagccatatgttcatttcaatagatatagaaaaggcatttgataaaattcagcatcctttcatgataaaaactctcgaattaggcatagaagaagcatacttcaaaatagcaaaggccatgtgtgacaaacctacagttaacattatactgaataggaaaaagatgaaagcatttcctctaagaactggaacaagacaaggatgaccactttcactcctgttcttcaacatagtactggaagttctagccagagcaatcaagcaagagaaagaaatagtcacccaaattgtaaagaaaaaagttaaattgtccctgttggcagattttcatgatcttacaaataaaaacactaaccacatcaaaaaaaactattctaattaaataaagttgcaggatacaaaatcaacacaggaaaatcagtactgtttctacatgctaacaagaaactatccaaaaaagaaatttatttaaaacctacttacaatagctacaaaaaataaaatacttagaaataaatttaaccaaggaggtgaaagacctgtatactgaaaactaaaacactggttaaagaaataatggaagtcacaaataaatagagagatatcctatgttcatgaattggaagtattagtattattaaaatatccatacaacacaaagctatctatagagacaatgcaatcactgtcaaaattttaatgacattttcacagaaataaaaaaatcgtaaaattcgtgtgaaactacaaaaggccctgaatagccaaaccaatattaagcaagatgatcaaagctagaggcatcacacaacctgactttgaaatatactacaaagctagaatatcaaaacagcaagatactctcataaagccagacacataaatcaatggtaagaatagttaacaatgtaatatattcttgaaaattgtttagagcaaattttcagtgtagtcactacaaaaaaagataactatatgaagtaatatacatgttaattcgctcaatttagccatgccacatatgcatatttcaaaacaatatgtacacaataaatgtgtattcggttggtgcaaaagtaattgcagcaaaatttgccattaatggcaaaaaccgcaattacttctgcaccaagctataaaatttgcatttctcaatcaaaaaattgtaattgctattaattacaatgaagccatttatctgcattttatatataactacaaaaaacaaaccactaatatagaggaagctgtctagatataccatggttttctaaaaaaaactgcagtgtaaactttcacattcaaatcagatagtcatgactaaggtaaccccactcatctgtatttctgttttcttttaacattaatattccatttatatttaacatttttgttttgctttttatcatctcaaattctttttggagaagtacagaaaatagatttatacaaataaaattaagtgtctgcttccctttattatgtcaaatgaatgcaaccggatatattagcatcaaattgggagggtatatttgggatggtctgacttaaaatataggttacatggcacactaaaattcatggagtgtccctagggaggtaccttaaaaggataaacaatgaacttcttctagcagctgaacctgaggtataatgagtagctcaaatgacggttgatagggagaaacatcatattgttaaggtataaaaagaaaaaataagttgcctttacatgccctaaattaaaagtcacaacatcagacatttcaagctgaagatgctgatttttgttggagtgacttttgaaggagttagcgctaagtatcatactccaagctataaaaaaaaaagagctttattttaaaaaccatggttaataattttcctgagtcatattggcaggctaactataagtaaaaatatgttgaaataaccagaaacaactagtaatcaggaggtttatgaactgagtactgatgagttgattaaagtacccaggaaggtttatatggtagtagtacatgaggtgcaatgtattagattaaaacaagcagattttaaatgcttttgaaagcattttcaaataagtagaagctgaataaacttacaactacactatactccaaccacactatcttgctcatttccatcttatggcctttgcaattgctgctctctctgcttttctccaagatcttttcaagccttactcctcatttcactaagtctctgcttaaatgtcaccttctaaagaggacttctttgacctcatccaaaataacgctgccttagtatgcttgtttgctagaacaaagtaccatgaactgcgtaatttataaacaatagaaatttagctgggttcactggcatgtgtctgtaataacaactacttgggagttgttattttggcaggagaattgcttaagcccaggagttcgaggtgcagcgagctatgattgtgcccctgcactgcagcctgggcaacagagcaagatcccatgtcagagaggagagaaggggaggggaggagaggggagagaaaaggaggggagggtaggagagaagaggggagggggagagaaagagagacagagaaagagagagggagggagggaaggagggaggaaggaaaggagggaaggagggaggaaggaagggagggaagagagggagagaaaagaaaagaagaaaggaaagaaagaaaaagaaaaagaaatttatttctcatagttctggaggctgggaattccaagatgaaggcaccagtaggattggcattcagtgagggctgctctatatttccaagatagtcccttgttgctgcatcctctggaggaaagaaaaatcatgtcttcatatgacaggagagaaagaagggtaacagagtgcttccttcaatcttgaccccttatataaggatactaatcccacttgtgacggcagagccttcatgacttaattacctcccaaagattacatctttaatactgttgcattggggattaagtttcaacatgactgttggagggaacaccatcacttgaaccacagcaaaccttactgtcttttattttactctgctttaatttcctttataacatgtattgatttttggtaaattacccatgctccaaacaaggtagaaaataattaaagccttagaaaagaaaaggaattgttcttaaaaaaattactgaacaaaatagctcagtgtgtctagttatatatttacagcccaaaatcttggttgatgtggtaactgggaaaaacaaaaccactatctttatttcatcaattgcttcagataaaaaagcatacacaaacaagattaaaaaaaaggaaagtaagcaatgttaaaatttggagtggcttttttttaatcttaaaagtaagacagtctcctggattatgctgctgacatacattttatatattacataagcttataaaatactcttggaaaatgccttccctgtgttttatctttaaagagtccaaagattaatgaatctcataaaaatgataaattagtatttcaaaagcacatttgcaaaagaaaccaataaagagttttggctttaaaagaaagttaagacgaaatatgaaagaagaaattatgaagctcttcaaagaaacatagaagatataattaaataacattagattgtagaatatttttttaaaagaaaacacaaaaagcaacaatcatgaagtaaaagtgataccataaaaaaaacagtgaaaaacatgctactaaatgagacatttatcccattaaacaaacaacaaaggcctcattcatggattttataacaaagtcccacacatcaataaggaaaagacaacctgttacaatagtggtcaagagacttaaacagatattttacaaaaataatatacaaatggccaatgaacatataaagagattattaacctcactaataactaaaataatagaaattaaaacagaaataagcaaatactcatccactacattggcaaaagtactgacaataaacgttttggcaaaaatgtagaacaatataaaatcactgctcttgaatgtttaagttggtatacctactttgaaagctggcaatacctacttaaatagaagaatcacatgctctaaaatctagcaattcatctcttagaaatatactctagaagtgaacaggcaacctacagaatgggagaaaatttctgaaatctatccatctgatgaaggtctaatacctagactctacaaggaacttaaacaaatttaaaagaaaaaacaaacaaccccatcaaaaagtaggcaaaagatatgaatagacacttctcaaaggaagagatttatgcagccaacaaacatgaaaaaaagctcatcatcactagtcattagaaaaatgcaaatcaaaaccacaatgagataccatctcatgccagttagaatggtgatcattaaaaactcaggaaacaacagatgctggtgaggatgtgaagaaataggaatgcttttacactgttggtgggagtatcaattagtttaaccattgtggaagacaatgtggcaattcctcaaggatctagaaccagaaataccatttgacccagcaattccattactgggtatatacccaaagtattataaatcattctattataaagacatgcacacttatgtttattgtggcactatttacaacagcaaagatttggaacgaacccaaatgcccatcagtgataggctgcataaagaaaatgtggcacatgattggcttccaagatggccaaacaggaagagctcagctctacagctcccagtgagatcgacgcagaagacacgtgatttctgcatttccagctgaggtacctgattcatctcattgggactggttggacagtgggtgcagcccacagagggcgagccaaagcagggcacggtgtcacatcacacaggaagtgcaactggttgggggatttccctttcctagccaagggaagccatgagttactgtacctggaggaacagtatactcctgcccaaatactgcacttttcccacagtcttcacaatcagcagacaagaagatcccttcctgtgcctggctcagcaggtctcactcccatggagcattgctcactgctagtgcagcagtctgagattgacctgggacacgggagcttggcaaagggaggagcatccaccattgctgaggcttgagtaggcagttttatgctcacaatgtaacaaagtggcagggaagctcaaactgggtgaagcccactgcagctcatcaagaccttctgcctctctagattccacctctggggacagggcatatctgaacaaaaggtagcaaacagcttccccatacttaaacgtccctgctggacagctctgaaaagaccagtggttctcccagcatggcatatgagctccaataacagacagactgcttcctcaagtgggtccctgatccccatgtagcctgactgggagacacctcccagtaggggccaacagacacctcatacacgctcgtgcccctctcagatgaagctctcagaggaaggatcaggcagcaatatttgctgttctgcaacctccaccagtgatacccaggcaaacagggtctggagcagacctccatcaaactccaacagacctgcagctgagaggcctgtctgttagaaggaaaactaacaaacagaaaggaatagtatcaacgtcaacaaaaaggacgtccactcagagactacagccaaaagtcattgactttaaagaccaaagctagataaaaccacaaagacggggagaaaccacagcagaaaggctgaaaattccaaaaaccagaatgcctcttctcctccaaaggaaaacaactcctcgccagcaagggaacaaaatgagatggagaatgagtttgatgagttgacagaagtaggcttcagaaagtcactaataacaaacttctctgagctaaagaagcatgttctaacccgtcgcaaggaagttaaatccttgaaaaaaggttagacgaatggctaactagaatagccagtgtagagaagaacttaaatgacctgatggagctgaaaaccacagtacgagaatttagtgaagcatacacaaacttcaatagccaatttgatcaagcagaagaaaggatatcagtgattgaagatgaactcattgaaaaaaacaaggagacaagattatagaaaaaggagtgaaaagaaaagaacaaagcctccaagaaatctggaactacgtgaacaggccaaatctacagttgactggtgtactggaaaatgactgggagaatggaaccaagttagaaaacactcttcaggatattatccaggagaacttccccaacctggcaagtcaggccaacattcaaattcaggaaatacagagaacaccacaaagatattccttgaaaagagcaacaccaagacacaaaattgtcaatttcaccaaggttgaaatgaaggaaaaaaatgttaagggtaaccagagagaaaggtcaggttacccacaaagtgaagcccatcagactaaaagctgatctctcggcagaaaccctacaagccaaaagagacagggagtcaatattcaacattcttaaagaaaagaattttcaatccagaatttcatatccagccaaactaagcttcataagtgaaggggaaataaaatcttttacagacaagcaaatgctgagagattttgtcaccaccaggtctgcctcacaggagctcctgaaggaagcaccaaacatggataggaacaactggtaccagccactgcaaaagcatgccaaattgtaaagaccatcgatgctatgaagaaaccacatcaattaacaggcaaaataaccagctaccatcataatgacaggatcaaattcacacatgacattattaaccttaaatgtaaatgggctaaatgccccaattaaaagacacagactggcaaataaaataaagagtcaagaaccatcagtgtgctatattcaggagactcatctgatgtgcaaatacacacacaggctcaaaataaagggatggaggaagatctacaaagcaaatggaaagcaaaaaaaagcagggattgaaatcctagtctctgataaaacagactttaaacgaacaaagatcaaaagagacaaagaatgccattacataatggtaaaggtatcaattcaacaagaagagctaactatcctaaatatatatgcacccaatacaggagcacccagattcataaagcaagtcctgagagacctaaaaagagacttagactcccacacaataataatgggagactttaacaccccattgtcaatattagacagatcagctagacagaaaattaacaaggatatccaggacttgaacacacctctgcaccaagcagacctaatagacttctacagaactccccaccccaaatcaacagaatatacattcttctcagcaccacatcgcacttattctaaaattgaccacataattggaagtaaaaacactcctcaggaatgtaaacaaacaggaatcacaacaaactgtctctcagaccacagtgcaatcaaattagaactcaggattaagttctaattaatcctaaactggctcaaatctgcacaactacatggaaactgaacaacctgctccagaatgactactgggtaaataatgaaattaagaaataaagatggtctttgaaaccaatgagaacaaggacaccatgtaccagaatctctgggacacatttaaagcagtgtgtagagggaaatttatagcactaaatgcccacaagagaaagctgaagagatctaaaatcaacacatcaaaattaaaacatcacaattaaaagaactagagaagcaagagcaaacaaattcaaaagctagcagaaggcaagaaacaactaagatcagagcagaactgtaggaagtagagaaacaaaaaaccccttccaaaaattaatgaatcctggagctggtttttttaaaagataaacaaaatagaccactagcaaaactaataaagaaggaaagagagaagaatcaaatagacgcaataaaaaatgataaaggggatatcaccactgatcccacagaaatacaaactaccatcagagaatactataaacacttctatgcaaataaactagaaaatctagaagaaatggataaattcatggataaatacaacccccaggactaaaccaggaagaagtttaatctctgaatagaccaataataggttctgaaattgaaacaataattaatagcctaccaaccaaaaaaagtccaggaccagatggatttacagccagattcaaccagagttacaaagaggaactggtaccattccttctgaaactatgccaatcaattgaaaaagagggaatcctccctaactcatttcatgaggccagcatcatcctgataccaaagcctggcagagacacaacaaaaaaaagataattttagaccaataaccctgatgaatattgacgtgaaaatcctcaataaaatactggcaaaccaaatccagcagcacaaaaaacagcctatccaccatgatcacgtctgcttcatccctggggtgaaaggctagttcaacatatgcaaatcaataaatgtaatccatcacataaacagaaccaagaacaaaaaacacatgattatctccatagatgcagaaaaggcctctgacaaaattcaacagcctttcatgcttaaatctcccaataaactaggtatcaatggaacatatctcaatataataagagctatttatgatgaacccatagcaaatatcacactgaatgggcaaaagctagaagcattccctttgaaaactggcacaagacaaggatgccctctctcaccactcctattcaacacagtgttggaattctggccagggcaatcaggcaggtgaaagaaacaaagtgtattcaaataggaagagaggaagtcaaattgtctccctttgcagatgacatgattgtatatctagaaaaccccatcgtctcagcccaaaatctccctaagttaataagcaacttcagcaaagtctaaagttacaaaatcatcattctcagtaaactatcgcaagaacaaaaaaccaaacaccgcatattctcactcataggtgggaattgaacaatgagatcacatggacacaggaaggggaatatcacactctggggactgtggtggggtcgggggaggggggagggatagcattgggagatatacctaatgctagatgacacattagtgggtgcagcgcaccagcatggcacatgtatacatatgtaactaacctgcacaatgtgcacatgtaccctaaaacttagagtataataaaaaaaataaaaataaaataaataaataaataaataaagttacaaaatcaaagtgtaaaatcacaagcattcctctacaccaataacagacaaacagccaaatcatgagtgaattcccattcacaattgctcctaagagactacagtacttaggaatacaacttataagagatgtgaaggacctcttcaaggagaactacaaaccactgctcaaggaaataagagaggacacaaacaaatgcaaaaacattccacgctcatggataggaagaatcaatatcgtgcaaatggcattactgcccaaagtaatttatggattccatgctatccccatcaagttaccactgactttcttcacagaattggaaaaaaatactttaaatttcatatgcaaccataaaagagctcccatagccaagacaatccttggcaggaagaacaaagctggaggcatcacactacctgacttcaacctttactacaagtctacagtaaacaaaacagcatggtactggtaccaaaacatatatataaaccaatggaatagaacagaggcctcagaaataacaacacacatctaccaccacctgatctttgacaaacccgacaaaaacaagcaatggggaaaagattccctatttaataaatggtgctgggaaaactggctagccatatgcagaaaactgaaactggaccccttccttacaccttatacaaaaatcaactcaacatggaccaaagacttaaacataagacctaggaccataaaaatcctagaagaaaacctgtgaaataccattcaggacataggcatgggcaaaggcttcatgtctaaaacaccaaaagcaatggcaacaaaagccaaactagacaaatgggatctaattaaactaaagagcttctgcacagcaaaagaaactatcatcagagtgaacaggcaacctacagaacgggagaaaatttttgcaatctatccatctgacaaagggctaatacccagaatctacaaagaacttaaacaaatttataagaaaaaagcaaacaacccatcaaaaaatgggcaaaggatatgaacaaacacttctcaaaagaagacatttagctagccaacagacatatgaaaaaatgctcatcatctctggtcattagagaaatgcaaatcaaaaccacaattagataccatctcacaccagtcagaatggtgatcattaaaaagtcaggaaacaacagatgctggagaggttgtgaaaaataggaactcttttacattgttggtgggagtataaattagttcaaccattgtggaagacagtgtggcaattctgtaaggatctagaactagaaataccatttgacccatcaatccgattaccaggcatatacccaaaggattataaatcattctacgataaagacacatgtacacgtatgtttattgtggcattattcacaatagcaaagacttggaaccaaccgcaatgtccaccaatgatagactggattaagaaaatgtggcacatatactccatggaatactatgcagccataaaaaaggatgagttaatgtcctttgcagggacatggatgaagctggaaaccatcattctcagcaaactatcacaagatcagaaaaccaaacagctcatgttttcattcataagtgggagttgaacaatgagaacacatggagacagggaggggaacatcacacaccaggacctgtgtggggtggtgggctaggggagggataacattaggagaaatacctactgtaggtgatgggttgatgggtgcagcaaaccaccacgacacgacacgtgtatacctgtgtaacaaaactgcacgttctgcacatgtaacccagaacttaaagtataataaaaagaaaaaaaatgtggcacatatataccatggaatactatgcagccataaaaagaatgagttcatgtcctttgcagggacatggatgaaggtggaagccatcattctcagcaaactaacataggaagagaaaaccaaacaccgcatgttctcacttataagttggagctgaacaatgggaacacatggacacagggaggggaacatcacacactgaggcctgtcggcgggttgggggcaaggggagggagagcattaggacaaatacctaatgcacgtggggcttaaaacctagatgatgggttgataggtgcggcaaaccaccatggcacacatatacctatgtaacaaacccgcacattctgcacatgtattccagaagttaaagtaaaatttttaaaaaagaaatatactctagaaaaactcatgtgtacctggatacacatataaagatgttcatagcagcattgattttaatagcaaaggctggaaacaacccaaatgtctacacactctacaatggatacattacagcataatcctgcaatagaatgatatataccaataaaaaatgaacaaactaacactattccctacaatatagaagaaactcataagcatactcccgtatgaagaagaaagaaccaaaagaatacataaagtattattcaatttatataacattcataaacaagcaaactaaactatatattttagggatacctacagaggtgattaattattacactgtatagtaattacactgtaccattatattttatacttttttgcattcaagctttttaaggttaagttttaaaagactgaaggaaaatacttttcttgacacttcttttcttactcccctactttgagccatcgacaaattctaatgacaatatatatttagtatccagccacttctcaactctttgatctgagtcactatattctctttccttttccattgcagttgacttctaaccagtctccctgttttcccatataacctattcacaaagtatccaggatgggtgctatggtttgaatgttccctccaaaatgtaagttgaaacttatctccaatatgacagaattgaacagtagggtttttaaaaggtgattggataatgaaggttctgccttcatgaatgaattaatcctattcatagattaatgggttatcatgggagtggaactggtggctttataagaaaagaaacaaagaccaggaatggtgacccatgcctgtaatcccaacaccttgggagcctaaggtgggaggacagattgagttcaggagttcaagaccgagccaggtaacacagcaagacattatttctactaaaaatcaaaaaattagttgggcatggtggcacacacctgtagtcccagctattcaggaggctgaggcatgaggatcacttgagccctggagattgaggctgcagtgagctatgatcatgtcactgtactccagcctgggcaacacagtgagaccctgtctcaagaaggaggaggaggaggaggagggacagtgatgatgagcattttgtcatgtgtctgttggctgcataaatgtcttcttttgagaagtgtctgttcatatacttcgcccactttttgagggggatgtttgattttttccttgtaaatttgtttaagttctttgtagattctggatattagctctttgtcagatgggtagattgcaaaaattttctcccattctgtaggttgcctgttcactctgatggtagtttcttttgctgtgcagaagctctttagtttaattagatcccatttgtcaattttggcttttgttgccattgcttttggtgttttagtcatgaagtccttgcccatgcctatgtcctgaatggtattgcctaggttttcttctagggtttttatggttttaggtctaacatttaagtctttaatccatcttgaattaatttttgtataaggtgtaagggagggatccagtttcagctttctacatatggctagccagttttcccagcaccatttattaaatagggaaacctttccccatttcttgtttttgtcaggtttatcaaatatcagatggttgtagatgtgtggtattatttctgaggactctgttctgttccattggtctatatctctgttttggtaacagtaccatgctgttttggttactgcagccttgtagtatagtttgaagtcaggtagcgtggtgcatccagctttgttcttttgccttaggattgtcttggcaatgcaggctcttttttgattccatatgaactttaaggtagttttttccaattctgtgaagaaagtcattggtagcttgatggggatggcattgaatctataaattaccttggacagtatggccattttcacaatattgattcttcctatccatgagcatggaatgttcttccatttgtttcatcctcttttatttcattgagcagtgctttgtagttctccttgaagagatccttcacatcccttgtaagttggattcctaggtattttattctctttgaagcaattgtgaatggaagttcactcatgatttggctctctgtttgtctgttattggtgtattggtgtacaggaatgcttgtgatttttgcacattgattttgtatcctgagactttgctgaatttgcttatcaggttaaggagattttgggctgagacaatggggttttctaaatatacaatcatgtcatctgcaaacaggaacaatttgacttcctcttttcctaattgaataccctttatttctttctactgcctgattaccctggccagaacttccaacactatgttgaataggagtggtgagagagggcatccctgtcttgcaccagttttcaaagagaatgcttccagtttttgcccatttagtatgatattggctgtgggtttgtcataaagaggtcttattattttgagatatgtcccatcaatatctagtttattgagagttcttagcatgaagggctgttgaattttgtcaaaggcttttctgcatttattgagaaaattatgtggtttttgtctttgttctgcttatatgatgaattacatttattgatttgcgtatgttgaaccagccttgcatcccagagctgaagccgacttgatggtggtggataagatttctgatgtgctgctggatttggtttgccagtattttattgaggatttttgcattgatgttcatcagggatattggtctaaaattatctttttttgctgtgtctctgccaggctttggtatcagaacgatgctggcctcatgaaatgagttagggaggattcccgctttttcaattgattggaatagtttcagaaggaatggtactagctcctccttgtacctctggtagaatccagctgtgaatccatctggtcctggactttttgtggttggtaggctattaattactgcttcaatatcagaacctgtttttggtctattcagggatttaacttcttcctggtttagtcttgggagggtgtatgtgtccaggaatttatccatttcttctagattttctaatttatttgcatagaggtgtttatagtattctctgatggtagtttgtatttctgtgggatcagtggtgatatcccctttatcattttttattgtgtctatttgatttttctctcttttcttctttattagtctggctagtggtctattttgttgatcttttcaaaaaaccagctcctggattcattgattttttgaagggttttttgtatctctgtctccttcagttctgctctgatcttagttatttcttggcttctgctagcttttgaatgtgtttgctcttgtttcaccagttcttttaattgtggtgttagggtttcaattttagatctttcctactttctctagtgggcatttagtgctataaatttccctctacacactgctttaaatgtgtcccagatattctggtatgttgtgtctttgttctcattggtttcaaaggacatctttatttctgcttttatttcattatgtacccagtaatcattcaggagcaagttgttcagtttctgcctagttgtgtgatttttgagtaagtttcttaatcctgagttctaatgtgattgcactgtggtctgagagacagtttgttatcatttctgttcttttacatttgctgaggagtgctttacttccaactatgtggttaattttggaataagtgcaatgtggtgctgagaagaatgtatattctgttgatttggggtggagagttctgtagatgtctattaggtccgcttggtgcagagctgagttcaagtcctggatatccttgttaactttctgtctcgttgatctgtctaatgttgacagtggggtgttaaagcctccaactattactgtgtgggagtctaagtctctttgtagatctctaaggacttgctttatgaatctgggtgctcctgtattgggtgcatatatatttaggatagttagttcttcttgtcgaattgatccctttaccattatgtaatggccttgtctcttttgatctttgttggtttaaagtctgttttatcagactgggattgtaacccctgcattttttgttttccattttgttggtagatcttcctgcatccctttattttaagcctatgtgtgtgtctgcacgttagatgggtctcctgagtacagcacattgatgggtcttgactctttgtccaatttgccagtctttgtcttttaattggggcatttagcccacttacatttaaggttaataacgttatgtgtgaatttgatcctgtcattatgatgttagctggttattttgcttgttagttgatgcagtttcttcctagcatcagtggtccttacaatttggcatgtttttgcagtggctggtaccagttgttgctttccatttttagtgcctctttcaggagctcttataaggcagacctggtggtgacaaaatctctcagcatttgcttgtctgtaaaggattttatttctccttcacttatgaagcttagtttggttggatatgaaattctggattgaaaattattttctttaagaaagttgaatattggaccacactttcttatggcttgcagagtttctgccgagagatcagctgttagtctgatgggcttccctttttgggtaacccgacttctctggctgcccttaacattttttccttcatttcaactttggtgaatctgacaattatgtgtcttggagttgctcttctcaaggagtatctttgtggtgttctctgtatttcctgaatttgaatgttggacttccttgctaggtctgggaagttctcctggatactatcctgcagagtgttttccaacttggttccgttctcccatcactttccagtacaccaatcagacgtagatttggtcttttcatgtagtcccatagttattggaggctttgttcatttcttttcactcttttttctctaaacttctcttctcacttcatttgattcatttgatcttcaatcacttatactgtttctttcagttgatcaaattgctactgaagcttgtgcatgcatcatgtagttctcgtgccatggttttcagctccatcaggtcatttaaggtcttctctatgctgtttattctagttagccattcatctaatcttctttcaaggtttttagcttatttgcaatgggttcaaatatcctcctttagctcggagaagtttgttattaccaatcatgtgaagcttacttatgtcaactcgtcaaagtcactctccatccagcttgacagaggatctttttaaacacaagtcagatccctcctttgctcactctgctgcagccacagtgacatgcttgatgtttctccaacatgccatctacaccatgtacactcctgccacaaggcccttgcacttgctattccctctgcctgattaaccctatacctctctcaagtcattcggctctctaatcaatgtcactttattagaaatgcctttcctttctaccttaggtatgttctttatccccctactctgttttattttttgtggtgcttaccagctgacctattaaatactttatttattttacatctctgctcactaggttgtaagctccataagaacaagaatttcatctattttgttaactgatatatctctagtttctagaacaattgatggcaaattatacgcacccaatagttattaaatgaatattaaacaaaaacaaacataccaaagtgttaacagtagagggtaaaagtatttgtgttctttgtattttccaaatgttctactttgaaattgtattaagtttataaacagaaaaataagctattattccgagacagtaaaatagcacctagcttagcatctgacagatagtagacaagcaataaacatttattaacttgttatctaatctagatgagaaaggctaacaatgaccaacatatacatatattgactatgttgatgttgaagcatataaaaaagtaatagtatagtttatttcagtctttaatttatacatgctgcaactttcattgtttcctcctaaatcacaagagtgaatatgggtttttattgtgaaatgctgcccaagaaatatttactacatattactgattttgaagctcatgatttcacttacacagaaaatttcgcagtgagttttaggacttacagaagtaaatttcttttaatcacggttcaaggaatcccatgcctatctacacctgagtcctgaaaagaaataaatctaacagaaaccaagagtttttcttcaaaagattacctatatggaaattaaactactgcatgtaaaataaaccaaaagcttaaaatcatactctagaggctaatctcataaaagctatttcttattctaacatagatttttggaacctaaaggaattctcaaaagttgggcattactttaagaagtaagtgccttactacacagtacaaggcacattgactaacccgaatgcttgcagaggagagcaagcaaccaggacggtggagggctctggtttgtcagaggaaagacaatctaaggacaggatatgtatagccttttcttgtgaaagacaaacacacgttctagctgtctcaacattttttaaagaattgtcacattgaagaaccgatatcctccgatgtatctaaaatgcagacctattattatttttcattcattttattcaacaaatatttactgcatacctgccatgagtcaggtgctgtgataaatgctgatgatacatagtgaacgaaaatactgggatagaggttaaaaagacattaatctatgaatcactgatgaattaaaatcacaactgtgatataagctacaaagaagtacagaacactatgaatgcatataactggagaatttgatctaatgaggcagatcatggaatgcttcattgaagaaatgattgtgctgagatctaaaagacaaaggttagttcggcgctcacttcagcagcacacatactaaaattggaatgatacagagaagattagcagggcccctacaaaaggatgacacacaaattcatggagtgccccatgtttttaatcaaaaaaaaaaaaaacaggttagttttgtgaaagctgaaagaaaattaggaagaaagctacccaggatgaaggagagcaaaagaaaaggctctgtagaagagtaaaacaaagaaagaaaaactaaaagaaggccagtctggctagaagtgattggttaagaaaagaatcatacaatatgagaggctaaagaggtaggcagaagtcataccaggaagaactgataggccaggataagaaatatgtcttaatccttaggcatgggcaaggacttcatgtacaaaacaccaaaagcaatggcaacaaaagccaaaattgacaaatgggatctaattaaactaaagagcttctgcacagcaaaagaaactaccatcagagtgaacaggcaacctacagaatgggagaaaattcttgcaacctactcatctgacaaagggctaatatccagaatctacaatgaactcaaacaaatttacaagaaaaaaaaacaaacaaccccatcaaaaagtcggcaaaggatatgaacagacacttctcaaaagaagacatttatgcagccaaaaaacacatgaaaaatgctcatcatcactggccatcagagaaatgcaaatcaaaaccacaatgagataccacctcacgccagttagaatggtgatcattaaaaagtcaggaaacaataggtgctggaaaggatgtggagaaataggaacacttttacactgttggtgggactgtaaactagttcaaccattgtggaagtcagtgtggcgattcctcagggatctagaactagaaataccatttgacccagccatcccattactgggtatacacccaaaggattataaatcatgctgctataaagacacgtgcacacgtatgtttattgtggcactattcacaatagcaaagacttggaaccaacccaagtgtccatcaatgatagactggattaagaaaatgtggcacatatacaccatggaatactatgcagccataaaaaatgatgagttcatgtcctttgtagggacatggatgaagctggaaaccatcattctcagcaaactatcgcaaggacaaaaaaccgaacaccgcatgttctcactcatagatgggaattgaacaatgagaacacatggacacaggaaggggaacatcacacaccggggcctgttgtggggtgggggaagagggaagggatagcattaggagatgtacctaatgctaaatgacgagttaatgggtgcagcataccaacatggcacatgtatacacatgtaacaaacctgcatgttgtgcacatgtaccctaaaacttaaagtataataataataaaattaaaaaaagaaatatgtcttaatcctaagaacagtaagaagacaatagatttgagttattaatttcaagaattcaatggcatctctcttagaacagagattataacattttaacaactgaacccatctaacaataaaatgggttgcctcagagactgaacatcccattactgcaagtaatcaagcagaacctaaatgatatctttcaagaatgcaatacaagggactatgcatgtcttggaaatttatcactgaggcttcatccttcattaagattaaatgtttcaattattcaaacaccaaataaggattttccaacacactgtaaatgtttgaagtttctttttttttttttctggttagagacactctgttgcccaggctaaagtgcagtggtgggattatagctcactgcagcctcaaactcctgggcttaagtgatcctccagcctcagcctcccaaatagctaggaccacaggcattaggactataggcacgtgccaccaagcctggctaatttcttgttttttgcagagacggggtcttagtatgttgcccaggctggtaaacctttgaagcttcaaaatgaaatattaattgttcataccaatgtgaaaaacaaaaatatttgactgcagttccatggtgtttctcaggaaggatcataatattatataataggagatccattttcagtgtggattacattgagggagtggctcttttcccctgtccattgccaaagaacaggtacagcaataagcacaggagaaagggcatcaaatgaaagatttctgtggaactagcatgaagggattcaaaaaatagcaataacaaagaactccaacctggtgcaaagcaaagattattttcttggccacactactaaggggttctcatcattcctttagcaaagatgtagatagaacacaatggataagtactttagttgaagtgactatgctgaagttaactgtagagtggaatgcatacagtttttattctaaaacaagggttgagatatttaaaaactaatatttgactatcttcatcaaataattaagtgcctttggatactgtgtctataaatattatattgtgacctttctctataaataatataaccctatttatagataacgtatcttgagttaaacagtgcctactttactgtcactgtcaaaaatggataaaaccatcatttaataaatcagtctcctagccaggtttattcttgctcagtgtgatacatgtcatactaatacaacttctttagtaacaactttttaataaaaagtcaaaaaataacagatgttggtgaggttgcagaaaaaagggaatgcttatacactattggtgggaatgtaaattagtttagtcccttggaaagcagtgtggagatttctcaaagaactgaaaatgaaattatcattcgacccagcaatcccattactggtaatataccaaaaggaaaataaactgttctaacaaaaaaactcctgcactcattttatttattgcagcactattcacaacagcaaaaacatggaatcaacccagttgcccatcaacagtaaactggacaaagtaaatgtggtacatatacaccatggaatactacacagccataaaaaagaacaaaatcatgacctttgcaccaacgtggatgcagctggaggccattattctaagtgaattaacacagaaagagaaaacaaaacacagcatattctcacttataagtgggagctaaacattgagtgtacatggccaaaaagatgggaaaaaataaacactgaggattctagaaggggaaagggagggaagggagaaagtgttgaaaaactacttattgggtaatacgttcaattagcaatgggatcattagaagcccaaacctcaacgtcatacaatatacccaaataacagacctgcatatgtaccctctgaatctaaagaaattttaaaaattaaaaatagagtttttaatatgaaccaaaagaaaaaaggtaaacattatggattttaaaaatcaagccagattttgtacttcaagagacaaattgagatgtcaatagtgagcaaaccaatactatgtcacatgaacttatcagttgaaaccttagagttaattagctctatgagttttggggttctttttatgtaacggtagtatcttcaatgagcacttatctttcactagtatatcttcttgcctccccatttaatcaccagcaaggtacaaacttctactttctaatagctccttccatgtcttaatctccattttgatctaccccacctttctttaggctcataccatttacttctcccaccagactggtcttgctgtcatgccattagaagtatctttttgttattcaaaaaaataacaacacctatttgatatgtcttatatttaacctattgatacttctaacagctgttcttcattatccaacaatctcccaaatcccccaaatctgattagttaccaagtcctattaattacctttctaaatatctttcaaggtcatcttctgttccccatcctcattgtttcttctttagttgaagtattcactagctttcttttgaacaatttagttttctcttgaacaccttctgggtgtttttccaactactagttccttctcccttgtaatacatatttcagacccttgcagagtaattttgtaaaactcagatttattcatgtccttcttgttcttatataatctataataattataggtatcatttcctgtgtgtgtttgttaggcactgtgccagatgcattataaacactgtctttaatcctcacatcaactttgtaagatagatactagtatccctgttaacaaatgcagaaatgtaaggctcctggtagttaaataatcttccaaagtttttacagctcattggtggatgtgaaacagagcccagatacacctaggtttaaagagtcagagaatatgccaactggcaatatctgtgaatgaaatcacataggagaaatttttgaatatgcttttattattttaccttacttttcaatacaattcaactttcatattttgacatcttctctaactttcctggtggaaagtgctttcatctctgggtataggtactttacagattcttacagcactttttggaacactgaataccaaacagttatcattcctctaacagattcttatagcactttttggaatagtgaatactaaacagtcaccattcctcatgtatttttacaacttgttttctctatgcattagctgttttgttttaaacagagttgttaaatagatgtttaaatctttaaaaatgtctctttaaaaatgtctctttctgttgcttacctttcttttcatacgctcttggtttcagtgtatctgagtttcaggaaggagtcactccccctacatactgggcagaggtttcatattgggctctctggaaatatatacttttgctgtacaccaataatcttcttgaattatttcactggaggaaaataaatcaagaaaatatactttcgttgtacatctatcatcttcttgaattacttggaggatttctgggagctaaggtaaaaattgagagttgggaactatagaatcatctatatttgtgagtgataaggtggactgtcaagacaatattaaaaataatttggtggatggtatggctgtagtcagataactggagttggtaggaaatataatttgattgttggaatataaaagacaaaaggagaagtcagagtcacgtttaactaactaattttgacctagtccatccagtaagagaattgttcagtgtacgcctagattattctaatttcaaaactatatcttgtttatacgacacagtaaattaatggaatatgagttctctaacgggggcagatactgtgagtagtggacctaaacattttatgatggcaagaacttgtgtaggtatgattaatacgtggttaaacttggacttttgtgtcaagcagacctgattgaatctctgttccacaacttactagctgtgtaaatttcagcaattcctaaatcatcacttttcattttgtaaacctcttagtcttaagacttgatttcttcagctgaaaattgaggatattaatagtgtctatcttaatgcttaattcataataccttgaatctagcaagtgatcaaaataatatgggttactaccattattattgattttcagatcagtctttcttgtgttcactctcaatgacataaagagaaacaacagggtaatataagaactgactagaagtggcaacactggttttgtttttgtgttatgataacatagctatcctgtttgctaggttctcattcatatagtagaaatttgtgaggttttatgaatcttctatccataaatggttatgagaatacaggatttgaagatctggtttgtgatgagtaaaagcatgatactaaatccttatcatagtctagatatagttcaagtctaacagaatatgacaagaaagaaatagaatcagttctccttgattacaaagtaaggttatgtaatttgtctccaaatagcactaaaaaattctgtaattcacagagtgaaatcccaataattgccctgattacattctattttccatttacttttcctaatcaaatacattgactctctctgctaaatcttaattatcatatcaagtcacttctcagaccacagtggaatacaactagaaatcaattctaagaagaactctcaaaaatatacaaacacatgaaaactcaacaatcttctcctgaataatctttgggtcaaggacaaaattaagatgtaaatttaaaaacttttggaaatgaataaaaagagacacaatacaccaaaacctctgggatataggaaaagactaagagggaagttttgagcaataaatttatacatccaaaggacagaaagatcacaaattaacaacctaacattgcacctcaaggacccagaagaataagagggaaccaaaactgcaactagcagaaggaaaaaattcaatgatcagagcagaattaaatgaaattgagaccaaaaaaaagaatcaaccaaatgaaaagtttgttttctgtaaatgtaaacaaaagtgatagaacactagctagattgaccaagaagagagacaattcaatcagaaatttaaaaaaggagacattacaactgaaaccacagaaatacaattgataatcagaaactactatgaacatctctacactgacaaactagaaatcctagaggaaatgaataaattcctgaacacatagaaccttccaagattgaaccctaaaaatacagaaaccctaaaaagaccaaaatgagtagtgagattgaatcagtaataaaaactttcccaataaaggaaaacccaggaccggagggattcacagctgaattccaccaaaagtacaaaaaaagaaacagtatcagtcctactgaaactgttccaaaaaattgagggaaggaaatcctccctaactcatcctatgaaaccagtaccaccctgatatgaaaggcaggcaaaaacataacaaaaaaaaggaaaaactacagaccagtatccctgatgaaaatagatataaaaaccctcaaaaaatatgagaaaaccaaatccaacagcacatcaaaaagatagtacaccatgatcaagtagggtttattccagagatgcaagagtatttcaatatatgcaaatcaataaatgtaactcatcatataaagataattaaaatcaaaaaatgatatgatcatctcaatagatgcagaaaagacattcagtaaaattcaacatcctatcatgatttaaaaaaaaaccctccccaagataggcatagaagaaacatacctcaaaataataaaagccatatatgatgaacctatagccaatgtcatactgaatgtggaaaatttgaaggcattccccctaaaactgaaacaagacaatgactcctactttcaccactcctgttcaacacaatactagaagtcctagccagggcaatcaggaagtagaaagaaataaacagcatccaaattgaaaaagaggaagtcaaatgatctcttcttggtgatgatatgatcatacacatagaaaaccccaaagctttgggaaacaaattcagtaaatgttcaggatacaaaatcaatgtattaaaaatcagtagcatttctttcttctttttttttttttaagagacagggtctcactctgtcacccaggctgaagtgcaatggcacaatcatagctcgctcactgcagtcttgaatctgggactcaagtgatcctcccaagtagctggtactacaggcacatgccaccatacctggtgacatggcttggctgtgtccccacccaaatctcatcatgaattcccacgtgttgtgggatggacccagtgggagataactgaatcatggaggcaggtctttcctgtgctgttctcatgatagtgaagtaagtctcacaagatctgatggttattataaggagagtttccctgcacaagttcttttccctttgcctgtcaccattcacgtaagatgtgacttgctcctccttgccttacaccacgattgcaaggcttccccagccatgtggaactgtaagtccaaataaatctctttcttttgtaaattacccaatctcaggtatgtctttatcagcagcatgaaaacagactaatagagtaaattgataccagcagagtggggcaatgctgaaaaggtacctgaaaatgtggaagtgactttggaacttggtaacacgcaaagttggaaaagtttggagggctcaaagaagacaggaaaatgtgggaaagttcggaacttcctggagacttcttgaatgactttaaccaaaaccctgatagtgatatagacaataaggtccaggctgaggtggtctcagatggagatgaggaacttgttgggaactggagcaaaggtgactactgttgtgttttagcaaagagattggaagcatttggcccctgcactagagatttgtagaactttcaacttaagagagatgaatgatttaggatatctggcagaagaaacatctaagcagcaaagcattcaagaggtgacttgggtgctattaaaggcattcaattttataagggaagcagagcacaaaagtttggaaaatttgcagcctgacaatgtgatagaaaagaaaaacccattttctgaggataaattcaagctgactgcagaaatttgcataagcaacaaggagccgaatgttaatccccaagacaatggggaaaaatgtctccaagacatgttagagatcttcacagcagcctctcccaacacaggtccggaggcctaggaggaaaacatggcttggtgggccaggcccagggaccctctgttgtttacagtctagggactttgtccctgtgtcccaggtgctccagccatgactaaaagtggtcaaggtacagctcaggttgttgcttcagagggtagaagccccaagccttggcagcttccacgtggtgttgagcctgtgggtgcacagaagtcaagaatttaggttttggaacctcctcctagatttcagaagacatatggaaagacatatggaaacacccggataccgagacagaagtttgctgtgggggcagggccctcatggagaacctccactagggcagtgcagaagggaaatgtgaggttggaggccccacacagagtccctactggggcactgcctaatggaactgttagaagaggaccaccatcctccagatcccagaatggtagatccactgacagcctgcaccatgcacctggaaaagctgcagacagtgccagcctgtgaaattagccaggatggaggctgtaccctgaaaaaccacaggggcagagatgcccaggaccataggaacccccttcttgcttcagagtgacctggatgtgagacatggagtcaaaggggatcattttggagctttaagatttgactgccaccctggatttcggacttgcatggggcctgtagcctctttgttttggccaatgtctcctatttggaatgtctgtacttacccaatacctgtacccctgttgtgtctacaaagtaactagcttgcttttgattttacatactcataggcagaagggacttgccttttctcagatgagactttggactgtggacttccgttaatgctgaaatgagttaagtctttggggaactgttgggaaggcatgactggttttgaaatgtgaggacataagatttgggaggggtcaggggtggaataatatggtttggctcatccaaatctcatcttgaattcccacgtgttgtggaaggggcctggtgggaggtaatttaatcatggggtcaggtctttctgtgctgtagtaagtctcatgagacctgatggttattataagggggagttttccagcacaagctctcttctcttgtctgccaccatgtgaaatgtgcctttcaccttccaccatgattgtgaggcctccccagccacgtagaactgtaagtccaataaaccccattcttttgtaaattgcccagtctcaggtatgtcttatcagcagcatgaaagtggactaatgcacctggctaatttttttttttttatatttggtggagatggggcctctttatactgcccagcctggtcttgaacttctggccccagcaatcaccccatctcagcttcccaaagtgctgggattacaggcatgagccactccacccagccagtagcatttctatacaccgataatgatcaaactgagaataaaatcaagaactcaatcccatttacaatagttatgaaaaataatgaaatatctaggaataccttcaagtagataaaagatctctataatgagaacgataaaacattgatgaaggaaataaaagagaacaccacaaaatggaaaaatactccatgctcatggattggaagaatcagtattgttaaaataacctttctacccaaagaagtctgccaggttcaatgcaattcttatcaaaataccaatggtattcttcacagaaacagaaaaaaatagtcctaaaatgtatatggaaccacacacacacacacacacacacacaaagaataaccaatgctacccttagtaaaaagaacaaaactgaaggaatcacattacttgacttcaaggtataccacagagctatagtaaccaaaacagcatggtattggcataaaaaaaaaacacatggaccaatggaacagaacagagaatctagaaagaaatcaacacacctacagtgaactcatttttgaaaaagatgccaagaacatacactgaagaaaggatagtctcctcaataaagggtgctgggaaagctggatattcatatgcagaagaatgaaattagacccctatctcttgccatatacaaaaatcaaatcaaaacggattaaagacttaaataccaaggcttcaaactataaaattactaaaaaaaaacatcagagaaactctccaggacatttctctgggcaaagatttcttgagtagtaccctataaggacagacaaccaaagcaaaaatggacagatgggatcacatcaagttaaaaagtttccgcatagcaaagaaactaataaacaaagtgaagagacaaccaacataatggaggaaaatatctgcaaactatctgatgtggtctggctctgtgtctcaaatcttatcttgagttgtaatcctaattataatccccatgtgttgggtgagggaccttgtaggaggtgattaaaccattggaatgattcccccatgctgttcttatgatagtgagtgagttctcacaagatctgacagctttgtgaggggcttttcccccactttgctctgcacttctctcattcttctctctcctgccaccatctgaagaaggatgtgtttgcttccccttctgccatgattgtaagtttcctgaggcctccccagccatgtggaactgtgagtcaattaaacttctttcctttataaattacccagtcccaggcggttctttatagcagtgtgagaatggactaactggtgccacagagagtggggtactgctataaagatatctgaaaatgtggaagcaactttgaaactggctaacagacagaggttggaacagtttggaaggctgagaacaagacaaaaaaaaatgtgggaaagtttggaacttcctagggacttactgaatggctttgaacaaaatgctcatggacctgctatatggacaattaagttcaggctgaggtggactcagatgaagatgaggaactttttgggaactagagaaaagttgattcttgctatcctttagcaaaatgactgatggcattttgccctgccctagagatctgtggaactttaaacttgacaggaataatttaggatatctggcagaacacatttctaagtggcaaatcattaaaaaggaagcagaacataaaagtttggagaatttgcagcccaacgtgacagaaaaaaaaaattctggggagaaattcaagccaggtgcagaaatttgcataagtaacaaggagctaaatgtcagttactaagacaatggggaaaatgtttctagggcatgtcagagagcttcacagcagtccttcccatcacagaccccaaggcctaggaaggaaaaattgtttcctgggttgggtccagggccctcttgctgtatacagtctcaggactgtgtcccagccactccagccatggctaaaaggggccacggtatcactcaggatgttgcttcagagggtggaagccccaagccttggcagcttccacacagtattggttctgtgggtgcacagaagacaagaactgaggtttggggaacctctccctaggtttcagaggacataaggaaatgcttggatgtccaggtagaagtctgctgccagggtggggccctcatggagaatctctgctagggcagtgcggaagggaaatgtggggttggagcccccatacagaatcccccctagggcactgcctagtggagctgtgagaagagggccaccatcctccaggccccagaatagtagatccaccaacagcttgcaccctgcatgtggaaaagccacagacactcaatgtcagccatgaaagcagctagggcaggaggctgtaccctgcaaagccacagcttcccaaggccatgggagcccaccgtttgcatcagcatgaactggatgtaagacatggagtcaaaggagatcactgtggaactttaaggttcaatgactgttctgttggatttcagacttctatggggtctgtagccctttgttttggccaattttcccattcggaatgggtggatttacccaatgcctgtacccccattgaatctaggaagtatctaacttgctttctattttacaggctcacaggcataagggacttgccttatctcagatgaaactttgaacttgaacttttgggttaatgctggaatgagttaagacattgggtgactgttggaaaggcaagattgtgttttgaagtgtgaggtcatgagatttgggaggagacaggggcagaatgatatggtctggctttgtgtccccacccaaatgtcatcttgaattacaatcccaattataatccccatgtattgggggagggaccttgtgggaggtgattgaatcatgggggaagttctcctgtgctattctcatgacaatgaatgagttctcacaagatctgatggttttgtgaggggctttttcccacttcactctgtacttctctcattctctctcccactgccatgtgaagaaggatgtgtttgtttcccctcccaccatgattataagtttcctttaatagcagtgtggaaacagactaatactctatccatctgacaagggattaataaccagaatatataaggagctccaacatctctataggaaaagactcaataatccaacttaaaaatgggaaaaagatctaaacagacatttctcaaaagaagacatacaaataggcaaacaagtacatgaaaaggtactcaacatcattgaacatcagagaaatgaaaatcaaactacaataagttatcatctcccccattaaaatggcttttatccaaaagacaggcaataacaaatgctgatgaggatgtagagaaaagggaaccattacacactgccagcgagaatgtaaattagtagaatcaccatggagagcagtttggagattcctcaagaaactagaaatagaactaccatacaatccagacatcccactgctgggtacatacccaaaagaaagaaaatcagtattttgaagagacatctgcactcccacgtttattgcagcactatttacaatagccaaaatttggaagcaacctaagtgtccctcaacagatgaatgaataaagaaaatgcggtacatatacacaatggagtactattcagccctaaaaaaaagaatgagatcatgtcatttgcaccaatatggatggagctggaggtcattacgtaaagttaaataagccaggcactgaaagaccactttgcatgttctcatttatttttggcagctaaaaattaaaacaactggactcatggagatggagagtagaacaatggttaccagaagctgggaagggtagtgaagtgttgggagggattaaagtagggatgattaatgggtataaaaatatagttagaaagcgtgaataagatctagtatttggtagcaaagcagggtgactacagtcaacaacaatttattgtacatttaaaaataactaaaagagtataactggattatttgtcacacaaagaagggataattgcttgaggtgatgaatagtcaatttgccctaaggaaataatttcacattgtatgcctgtatcaaaatatctcacatatgccataaacatatacatctaatatgtacccacaaaaattaaaaataaaaataaataaaaatgaaaatttttaaaattaaacaattttaaacagtatattgagttaaggagctaggctcaaaaagagaacttctctaattttatttcatttttttgagacaggatcttgctttgttgaccagggtggaatgcagtggcatgatcccagctcacagcagcctccacttcctgggatcaagcaattatcttatctcagcttcccgagtagctgagactacagtctcgcactgccacattcgactaattttgtttattttttgtagagatgaggtttcactacgttgcccaggtgggtctcaagctcctggactcaagctgtcctccaacctcagccttccaaagtgctgggattagaggtgtaagccactgtaccccactgctactctaattttatttatacaaagttcacgaacaggcaaactcaatctctggttattaaaaaaaagaaattattgtttcagggtggacacaagattgacagaaagagtatgagagaaacgtctggtatgatggaaatgttccatgtttgtgaatctcaatgggaatactggcatacatttgacaaatgtatatacctggtataacttccttccttccttcctttctcttgttctttcctattaagaaaaaaacatgtaaaattataacatttgtcaaaactcatttattagtacccttaacatccatttacactatataaattttacctaaaaaatagttaatgtaatttaccaaattaacagaataaaatttaaaatcctttgattatctcagtagatgcagaggaagcatttgaaaaagtacaacacaatttttttagtaagaaaatatttgcaacttaggagtagaagagaacttcctgaatgtaatcagtgacatctacaaagaacttttaaaaattgtatttgatgtaaaatgttaaaacctttcccagtgaggtcaggaatgaaactaaggttttcattatcattatctatccttgtctgttcaatatttaccatatatcctagctagtgtagtaaagcatgaaaaagaaaaataaagaatgtaaagatttttaaaggaatatacgaaatacttattagaacagaaaatcctgacaacttttcttccaaatatgtacagactcctgagagatttctactatgaaacaggatggagtaacagatacaaaatttactatctaaactgaaacaagtaaaaatatgagcaaaatatatgaaataataattttcaaggcattggaaaaagcacaaaggacagtaatgcctgagatgtggtaaagaaatgaggtaagccctattctcacagattactgccaggagaatattttcaggccacagcacagaaatagagaactcagtttatgcatgtagtctctctgagaagatgaagctgggaatctgcagagatcaaggcagtgagaatttaaaggacagagactagacaggagagatctcagagagtaccggagatctacagaggatccgcctttagtctttagcagagcagttatcagtacatgaacgagaggaaactatctgaagctgtgaaaagaaccacccaaaaggattagagaaaacagtacttaaggctgacacagatctaggaatatttcctcttcccactagccaaaatgtaaaccttcttaattcactaggcattgggtagaatgcctgagaagtgtattgtttcactagtggggaagaattagccctagactaactgctactctagtcttgtttaacaaagcacaagagcaaaaattaaaaggataaaacagatttcatgtaactgaagtatcatgaagaaaactatacagagcacttcataattaaattgcttaaaatcagtgatacagagaaaaatcttaaaagagtcagaggaaaaaagacaccttatatagaggaacaaagataagaattacatcagacttctcatcagaaaaatgcaagccagaagacagtagtgcaacatctttaaagacctgacagaaaaaaatgtgaacctagagttctatatccaaatatctttcaaaaatgaacacaaaataggacattgaaatgctgaaagaattcattaactgcagaaccacacaataagaaatgttaaataaagtcattcagaaagaagaaaaatgacaccatatgtaaatctggagttataccaagaatgaagagcattagaactggtaactacatgagaataatagttaattttatgtgtcaattttactgtgctaagggaaactctgattgctagtaaatagtttttctggatgtgtctgtgaggatgtttctggaagagattagcatttgaatcagtagaccaagaaagaagatcaccttccttctctaatgacaatagcctttttgttacctagagacctttgtacttgtttttttctgtaattgggagcaaaaaaggggcccaacataaatactaaaggtcaaaacacaacatgtgaatataataatattcattgactctaattttaggcctctgcattgataggatgtaaatcactttttcaatgaaaaaatttaaggctcacaggagacaaccaaaatgtgtatattttatccattgtttattctgtagttttcctaactgacatggtcaaaccaacttttaaaatgggcaagagtcttgaatacaaactttcacaaagaagatgttcaaattaacaacaaacacatgaaaaggtgctaaatttcttggggttttttgtttgtttgtttttgcctaaaggatgtttttatttttttttttttttattttactttaagttctgggatgcatgtgccaaatgtgtgggtttgttacatagatatacatatgctatagtggtttgctgcacctatcgacccatcatctaggttttaagccccacatgcattaggtctttgtcctaatgctctctctccccttgcgccccacccctcaacaggctctggtgtgtgatgtccccttccctgtgtccacatgttgtcattgttcaactcccacttattagtgggaacatgtggtgtttggttttctgttcctgtgttagtttgctgaggataatggtttccagcttcattcatgtccctgcaaaggacatgcactcattattttttatggctccatagtattccatagtatgtatgtgccacattttctttatccagtctatcattgatgggcatttgggtttgttccaagtatttcctattgtaaatagtgctgcaataaacatacttgtgcatctgtctttatagtaaaataatttataatcctttgggtatatacccattaatgggattgctgggtcaaatgacatttctggttttagatccttgaggcatcaccacactgtcttccacaatcattgaactaatttacactcccgccaacaatataaaagtgtttctatttctccacatcctcaccagcaacggttgtttcctgactttttaatggtcaccattctaactggcatgagatagcatctcattgtggttttgatttgcatttctctaatgaccagtgatgatgagcttttttgcatatgcttgttgtcttctttgagaagtgtctgttcatatcctttgcccactttttgatgggattgtttgtttttttcttgtagatttatttaagttctttgtagattctggatattagacctttgtcggatggatagatttcaaaaattttctccaaatctctaggttgcctgttcactttcatgacagtttcttttgctgagcagacgctctttagtttaattagatcccatttgtcaattttggcttttgtcacaattgcttttggtgtgttagtcttgaagtctttgcccatgcctatgtcctgaatggtattgcctaggttttcttctaggattttcatggttttaggattttaaatataagtctttaacccatcttgagttaatttttgtataaggtgtaaggaaggggtccagtttctgtttactgcatatggctagccagtttgcacagcagaaaaggtgctaaatttcattcatcattaggaaaatccaaaataaaacacaatgagatgttaagttaatgttaataatatgaagcagtaggaaatctcatacactgttggcagtagagtaaactggtacaacactttggaaaacagtttggcatttaatcctgagttgaatttatgcataacctacaaattagcaattctattcctggcactcaaatgggttatgcttcatgaataaataaatccccaaatcagagtagttacatgagtatgtgacccatgcaattgcacagggccttggacttagaaggaccctgtgcttagtttaattatctgctatagttgtcttgaaattcttaataaatgttgaacaacagacttaacattttcattttgcagaaagacgcacaaatattcagctggccctgtttctaagcatataactaacagaaatgtgtacaccaagggaaatacagaggtgtgcctatacaacaaaactagaaacaactcatgttattcaccaatagactgaacaaattgtggaatattcataacatgaaatactatacagcaatgaaaattaatgaagtatagctgtatgcaactacattattaatctcacaagcataatgtcaagaaaaagacgaatctacgtgtattttagaatcatcttgccagtttcacacaaatatatatgcacacacaattgttgagaggtcgtttgcaagttgtcatatccctcattcctgctttgagaaatgtaggagcatacagatggaactctccttcacctacattcctgagtgaggtccacgtaaagagccctaccatcaccacctgttccccgacaaattatgaacatgtaacatgaacaaaaaataaacctttggtcttctaaactactgagatttcagaaattatttattgctgcaccattatccagccaaatctgactagtgtacaaattcatctaatgaccaaataagattatcaatctttttaaatccatcctagaaatatctattttttatcttgttcacttgctacaagaataaagtcctatggcatctagtagtcatctgatagaaaaatgttcccttttattttcctaaaataattttcatcatgctttaaaaagttccccttagttctagtattcttgactttggtgaacaagtctactcagactcttcatacactttacaattttaatgactctgatcatacccaccatttacctttccatttctatattaaagtttcttaatctcagatataactttgcacataaaatctccatgcctttgattattgtaccaactttcctttcctcaaacactttaggtccagtgtctccaggaccaccaaatacagttatatgttttacataaaacaacaaaggctcccagacaaggagatgagtttgtctttatctactagtcatgttacacatcctcacatgaaactatggcaggaggattgtaaaccattttctttaaaccaatttaccactttctcttctagccaagtaaacttaggggtagatctgcctagagagggtttgtttttttttttttttttttgaggtggagtttggagtttcactcttgttgcccaggctggagtgcaatggcacaatctcacctcaccacaacctccacctcatgggttcaagcgattctcctgcctcagcctcccaagtagctggaattacaggcatacaccaccacacccagctaattttggatttttagtagagatggagtttctccacattggtcaagctggtcttgaactcccgacctcaggttatctgcccacctcagcctcccaaagtgctgggattacaagtgtaagccactgcgcctggcctttttttatttttattttatttattttatttatttttttttttgagacagagtctcgctctgttgcccaggctggagtgcagtggcatgatcttggctcactgcaacctccgcctcccaggttcaagcgattctcctgcctcagccttctgattagttgcaattacaggcacatgccaccacgcccagctaatttttttgtatttttagtagaaatggggtttcaccatattggctaggctggtcttgaactcctcaccttgtcatctgcccacctcggcctcccaaagtcctgggattacaggtacgagccaccacacctggctagggtgtttttctaatgcttttttatagactaatagagtttctgagtttgcctattgctcaaagtattctgcaccccaggtactaagacaataaggtttgctttggttctgctttgttttggctaccattcttacacttccttttggggcctcaacagtttattgccaagatcagcttcctgagtctattggcctaatgccttgtggttagaagtagagttaaaatgctttgtccctctgtatattacatagctatcacacactactttcaaagccacttactttgacttagttgtataataatttcctgaacttgagcaggaagagttaggggaccactcagaacttcttagaggctttctgccctccccctatttccctcgtaaataaaataaaattttaaaattagactgggatttcttaaaataagtaaatgaaaatagaagaaactcttaatacaatgtattcttacattattccctttccttactggtcattaaaagtatttataacaactaattcaattatttttaaatgccaagagtatgaaatcattatagtgatatcaaactttaaaacaataattgtaaaatgatgagtgttgttattcccttatcctacattcctaaataagcttgctgttggagaggctctttcaagtgttgcagcatatacatcatcaccagatgttagtacaggagcatgaagcaagaccatgccaaacagggtgatttaagaataactgctaccccgaatttctacaacctcagatgctcaagccagtatttaactcaattcaatacacatgtttttatatctgctttgtgccagcactttggggtattcaaaaataaatcacaactgaaaaattagagcctctcatccaagacgtcacaaaccaatggaattttaaaatgtagactgattgttgctacaggaaaggagttttgaaagaggaatgaaaaaacttgagaaggctagaaggaaaagagctagtgggaggaagagaccagctctgagcctatctttgacaggaagagaagtgggcgtagacacctgtgaaggcatgatacaataaagtgagcctgtgactgaatcaggttacacagcggtggaggggtggagaaagacacacgctgcaagataaaattagaaaagaaggcttctttcttaccctggagttcatagcaataacatattaaataatctgaatagattataaatctcccaataaccctgtgagaaagatgctaatatgttccctattttattgacaaataaactaaggaacaaaaatgttaagcaactttctcaaagtcacataactggaattttgagagacccaggataacaaaatccaaaacctaggcatttaaccatataattttatacccattattatccaaggagagatccaatataaagaaaaaagttgtttaatacatttaggtatagtttatatgcaataagaaaaaatatttcaatatcataatccctcgcttttctaggttctcacttacatagtcctctacactacgcagtatatacaaaagaaaaagtggtcttacgtatgaaatacaagcacatgttaaaaagcaaactaatgtttatatgtcttttaattattatttattcataataactagatggaaacacctagtaatgaacaaggacagcagaaaactagagggaactggctctagcagagcttcctggaagatattttccaagactagtttccctcatctttgttccatatgaggagcaggaaggctttaggtttagtgattctgccacagatcacctgctgctatcctctatacttccttgtagaaatactgattcagaaatatgatgtattcatttgttgttattccttttctatgcctttgaacagaaatcaattattggctaagttacatgagtatcacagagcacaccaactattgttacctatatgtatggtctacagatagaacagatcataatttccagtgcagtaatatttggatgggcagtgctgtcatatgtcacatcctttctttttaacttaatctgttaatagctccactggaagagaatactcttccaacttagacagtaaaaggtaagaattctcttatatactaatgatctgcccatagaaaaggctctgagtagataactaaccctggtttttaatttctatcagtaaggattgcaagtaaattgtcctgaaatcaaagctattttttttaatgtcccacacctgttccttatcttatgttaaaaattccacgaaacaaaaaacaatgcattttgttaaagtatacattttagaaacaggttatcttagaatatatgaaaagaaattttgtgactcaaaattagagatgcctaaggtgtttttgttgttgttgttgttgttgttgttgttgttttgagacggagtctcagtctatcactcaggctgaagtgcaatggcatgatctcagctcactgcaacctccccctcccgggttcaagcaattcccctgcttcagcctcccaagtagctgggattacaggattacatcaccacacctagctaatttttgtatttttagtagagatggggtttcaccatgttggccaggctagtctcgaactcctggcctcaatcgatccacccacctcagcctcccaaagtgctgggattacaggcatgagccaccacacccagcctcctaaggtgttttattgtgattttttttaactggctaaggtgtgcctttggttttacttgctttttaaaatacatacacacactatatacatattgaaatatatatatgaaatacatatatatacataaaatacatatatatatatatatataattctttttaatagctgaatagcattccagggtgtatacgtactacattttctttatctaaatccatcactgatggacatataggttggttccatgtctttgctattgtgaatggtgctgcaataaacatgcaagtccaggtgtccttttgttagaataatttattatagatatagatagatatacacatatatatcccacagcatccagtggcaggcacttctttccccttattggtttgtttgatctacctcttgtaagaatctatctggattgtgaatcggaaaacattctttaggttcagcgctacgcctgagagaagggaatactaatgtagctgagctaatcagaagcctccacaagtttatacagctttagaggaaaagctaaagaataagattagctaagaaggctgtttacaaatgtttaaattccatttaaggaaaactctaggtttattttaatagaacaatatatgcccactaaaatgttgctctctggttttttgttttttgtttgtttgtttttgagacagagtctcattctgttgcccaggctgaagtgcaatggcgctatcccagctcactgcagtccccacctcccaggttcaagcaattctcctgcctcagtctcccgagtagctgggactacaggcaggcgcaaccatgcctggctaatttttgtctgtctctaactcctggactcacatgatccacccacctcagcctcccaaagtgctgacattaaaagtgtgaaaggtgcgcctggtctactctcagtattttagaaagcaattcaaattaaattaaattaaatttatattaactaaaaaaaggtcttttttatttcatttcctccatgaaatataattttttttaattttagatttgggggtacttatgcaggtttgtcacccgggtatattgtgtgatgctgaagtttgggcttctaataatcccattacccatacagtgaacaaagtacccaacaggtagtttttcagcccttgccccactccctacctccccacttttggagtccccagtgtctattgttcccatctttatgtcaattgtgtacccaatatttagctctaacttataaataagaacatgtgatatttggttttctgtttctgcattaatttgcttaggataagggcctccagctgcatccatgttgccacaaagaacatgattatagctgaatatcagtattccatgtgtgtatatgtaccacatttcctttacgtattccatcgttgatgagcatctagcttggctccatgtgtttgctattgtgaatggtgctgcaataaacatatgagtgcaggtgtctttttggtaaaataacttattttcccttgggtatgtatgcaataatgggattgctgcgttggatggcgattctattttcagttctttcagaaatcttcacactgttttccacaagggctaaactaatttacattttcaccaatagtgtattagcgttcccttttctccacaacctcaccaacacttgttattatttgactttttaatatagtcattctgactggtgtgacatggtatctcactgtggttttgacttgtatttctgtgatgattaggttttacttgcttttgagtagaggttagaaaaagtttatgactcatagcaaagtatgataggaagaggaaaggaaaatatagggagatttgtagaccatggtaaggaattttgtttgttttgcagtgtggtgatgcggagtatttagctgactttgaggagaaaaaagaaaaaaataatttcaaacattgtaggtattataaatattacagtattgctagtaccatataatgtttacttccataaagattataccaatttgataggtcattggatggggtcaaaataaataaataaatatatatataaaaataatgtcagtgcgtagcagtttgctcttaataatttttgttgaataaactgaatgaatgaagagatatattttttaaattccatcattaaaaagtttaaatgtggagaaggtagaactctcatgtattgctgatgggattgcaaattagtgaaaccacattgaaaaacagtttggcagttctcaagaagttaaacagagttaccatataaaccagcaattctactcctagatatatgcccaagagaaatggaaacagatgtccacacaaaaatctgtacacaaatgttcatagcagcattattcaaaatagccaaaatacgggaataacccaaatatccaacaatcaactcatgaacagataaataaaatatgatatattcatacaaaagaataatatccagtcataaaaaagaattaagtactgatacatgctacatggatgaagcttgaaaacattatgttggtgaaagaagctagtcacaaaaggccacataataatgtaggattccatttatataaaatgtttaaaatagtccaagtgtggtggctcatgcctgtaatcccagcactttgggaggccaaggcaggcagatggcttgagctcaggagttagagaccaaactgggcaacatggtgaaaccccatctctaccaaaaaatataaaaattagactggcaaggtggcacacacctgtagtccagctacttgggaggctttggtgggagggttacttgagcctgggaggcagagggtgcagtgagccgagatcacaccattgaactccagcctggcaacagagtgtgaccctgtctcaaaaaaaaaaaaaaaaaaaaaaaagttttaaataggcaaatccatacagacaatgtcaggacttagaaaacaatacccccaaagtacagtaccttggcatgctgcatcctttaaattgaagcactttgggaggaccccagaagcagactctttctaaacttattctcctgccctcctttctcctcctttcctcctctaaggtaggtcatagaaactagaactagaaccctattgagaggtgacaacgtgctagcagccctcactcgctcttggggcctccttggccttggcgtctgctctgccagtgtttgaggagcccttcaccctgttgctgcgctatgagggcccctctctggggctggttgaggctggagccggctccctctgctcacagggaagtgtgaagagagaggcgcaggcaggagctggggctgcgtgcggtgctcacaggccagtgcgggttccaggtgagcgcaggcttggcaagccccgcactcagggcagcgggctgatgcctgctgggcttgatcagaggctgaatcccatgcatggaccgccattcccttttcacgggatgattggccacaataccaggtctccatctctttctcgcttcccctcttttcctcttgattgtctgggacgagctccctctgggctgccagagtgcccagactaggtgccgcaaagtcccacagtgaatgccagtgagaggtgaagctgattgggcttctgggacaggtggggacttggagaacttttctgtctagccaaaggattgtaaatgcatcaatcagcattctgtgtctagctaaaggtttgtaaatgcacaaatcagtgctctgtgtctagctaattgggtggggacttggagaacgtttgcgtctagctaagggattgtaaatgcaccaatcagaactctgtgtctagctaaaggtttggaaatgcaccaattagcactctgtcaatatggaccaatcggctctctgtaaaacggaccaatcagctctctgtaaaatggaccagtcagctctctcaggaggatgtgggtggggcaagataagggaataaaagcaggcgaccagagccagcaggggcaactggctcaggtcactttccaggctgtggaacctttgttctttcactcttcgcaataaatctcgctgctgctcactctttgggtccgcaaagcctttatgagctgtaacactcaccatgaaggtctgcaggttcactcctgaagccagtgagaccaccaacccaccaggagggatgaacaactccagacaggagggatgaacaactccagacgggagggatgaacaactccagatgggaggaatgaacaactccagacgtgccacctttgtgaactgtaacactcaccacgaaggtctgcagcttcactcatgaggccagcaagaccacgaacccaccagaaggaatgaacaactccagatatgccgcctttaagagctgtaacactcactgtgaaggtctgcagcttcactcctgaagtcagtgagaccacgaacccaccaggaggaagaaactctggacacatctgaacatctgaaggaacaaactgcggacacatcatctttaagaactgtaacacgcggccaggcgtggtggctcaagcctgtaatcccagcactctgggaggcccaggtgggtggatcatgaggtcaggagattgagaccatccaggctaacacagtgaaaccccgtctctactaaaaatacaaaatattagcagggcgtggtggcaggcacctgtaatcccagctacttgagaggctgaggcaggagaatggcgtgaacccaggaggtggagcttccagtgagccgagatcgcgccactgcactccagcctgggtgacagagcgagactccgtctcaaaaaataataaaaaattaaaaaataaaaaaagaactgtaacactcactgtgagggtccatggcttcattcttgaagtcagcaagaccaagaacccaccaattctagacacactatcccccaaagccagtcataaaacctagaaacgttactgtaacctttctatgtaagagctggccataaagacattctctgatctggcaattattaaaaagtcaagaaacaacagatgctggcaaggctgtggagaaataggaacacttttacactgttggtgggaatgtaaattagttcaaccattgtggaagacagtgtggtgattcctcaaagacctagaaccagaaataccatttgacccagcaattgcattactgggtatatgctcaaaggaatataaataattatattataaagatacatgcatccatatgtccattgcagcacttttcacaatagcaaagacatggaatccacccaaatgcccatcaatgataaactggataaagaaaatgtggtacatatacaccgtggaatgctatgcagccataaaaaatgatgagttcatgtcctttgtagggacatggatgaagctggaaaccatcattctcagcaaactaacacagggacagaaaaccaaatactgcatgttctcactcataaatgggagctgaacagtgagaacacatggacacagggagggaaacaatgcacactggggcctgttgagtggaacaggggaaggaggaacatcaggataaatagctaatgcatgtgaggcttaatacctaggtgatgggttgataggtgcagcaaaacaccatggcacatatttaaatatgtgacaaacctgcatgccctgcacatgtatcccagaactcaaaattaaattacatttttttaaaaaaacaccttctcagatccaccttgtctgaaagtagagcattaagaccttcattgcagaagacctgctgccctatacctgaaaggaaggaatgccacacatggatcaagaggcatctaaataggtaggccttgctgggtttctccactcaagtctattaccattagatcattccctttttttatcctatcacatttctgaatgcagtgccttagactgctcggtcatcctgacacatgatacagctgtcactccatttaatctaagcataaaaatggacagctgtcccttgagtctctggatctatttctgaagtttcttgggctgcataaaactttgattaaatgaattgttatgcttttctcccattaatcttcctttgtctgttttatttcaaacctagccaggaatgctagaagaattgaggaaatatttcctcccctatgacagaaagtataataatagtttccaggtactaaggagaggaagaattagagttactgctaatgggtatgagctttctttttgggattatggaaatattctggagctagttactgatgatagctgcataactctgtgaacatatttaaaaaccaccaaattgtacactttaaaagagtaactatcttatgttactctttttcatgatttttcaaaaaatcatcattagaaatgagtttaaccgataaatatatacacttactgtgtacccacaaaaatgttaaattaaaaaaagtttttaaagagtttgacgtgtctgtagtacaggggttacaagagctaaggcaagaaatatagattgaagctgatgaaggaaaatggaaatggtttagtcaaggcacctaaaatagagccaggaggccatttcagctggggcttcaggcacaccttaagcaatgaatactcaaccctagaggtcacaacttcctagtttgcgagtgcaaaaacatctgctgtcttatcttctgctatttcctgctgagctgagaagtccctgaccatgggcccacctttcaaagtgctacaaccaattccctgactccaatactgctttagatacaatcatactgataaaggggcaaagcggcaggggggtggtgcaggaagggaaatgctgggtagagaaggccagggtccctggtgagggatccacccttgggcctttgcccacggacataagtgaggacagccactcttgtttccgtacccaaatgttgcattttccaagaccactctggcccaccacatccccccatcctgtgcccataaaaaccccaagaccctagcaggcacagacacacgagcagctggacatcgagaggaacagaggatcagaagagcacactgacagacaccagcagatgctgacaggccatcaatggtgggaccatgtggaatttggtcagtagtgatcagaggagatgcctgccgctgggcagcccaaactccagggaaacaccaccatcccattccatccccctctggcctccccattcacctcactgagagctacttccaatcaataaaactttgcagccatcctccaagcccacatgtgattcaatttttctggtacaccagggcaataattcaggatacagaaagccctctgtccttgtgataaagcagaggctctaattgggcggattaacacaagctgcctacagacagcaaaacagcaaagctaaaagagcacactgtgacacacacccactgggacttcgggagctataaacactcaaccttagacgctgctgtggggtcagagcccaaaaactgcccatgacctgcccatctgtatgctccccctaggggtttgagcagccaggcaccaaagaagcaagccacatccctgttgcacgccctgcgaggaggataagaaaactcctcccatttcaatacaaattataatagttggaaaacaacttttgttaccaccctcttttctttaaaagttcacaattctcttttgttccctggaacacttcccaggataacttggaagtgtttcctgggctgcagtcatgcaaatctgactcaaataaattctttagtatttaagctctgcctcagtttctttccaggtccataaggcggtcttacaaaaagcataattgctctaatgtgccatcctaaggacttttaactttaccctgtgaatgatggaaaacaaagtaatgatataatcacatcagattcaaaaaataattattgagaccactgctaatctgagtataaattatttaatacttatgtatttatagttttaaattacaatggatcacttctatttatatactaggtcatttctttcatttttaatgacttcatataacatacagctggaaaaaaaattagaaataagcaagtccaatttactaactttacaggtgaggaaactaggcctaaaaaagttaacttgcccaatgtcatacagataatgagtattattatttatgaatgttttatctttaataaatatatattattataatatatactaatgggccctatatgaaagttgggtcaataaatgacttagaaaacatctccaaaccctttgagatggcttacaaaactactactgatttgacttttgctgattgtttatggaacaattcatagagtgagtgcaaaaaaacacagatttgaagtcatagaaaattacttctaaggattaaaattttgatccaccaccttctaattaaaagaaaaaaacacttcagccaaattctgcatcatgaattcagtgcctttttactcctctgcctccctttctcttgtaattattccctatctcctaatactaggcttcctgttgaattgctaacaaaatccaggaaatgcccaaggaatttaattcaaatgcaaatggaattatttgtgttattcctgtctctgcttttaaaaaataataatatgaaacagtgtgctattgctgaaagcctcacagacttctcagcttgacacctgaagtaatttagaagagtaagggggaaaaaaatctgtaactggtttacagctaatttatttacaacaactccagaattgagaaaacccacccacattcgtgtgcccacagagaaagagaaatgaattctttacaaagcagtagcactttttgtcctgctggtccttttttctcatttatttttcttttctttcctcctcatttcaggtaacttcaatgagattttagttacaattcttgtgaattcaacctaagtagaaattacaccaaaagaaatggggcaccaccttcattgttaagcaatctcttggaaatatattatgttggagaactcccccacggaccaacaaaaaatgtgtgtacaaactgagtggcaaacaaatgatattatacctatgcatttgattaatctgggaattatggaagatattcaaaggatctgggaatcctttgaagataaaataggacaaaatacattttgtttatgaagtaaatttaggagtaaggcttcatcttttaaagtattaatagataccatatcttcaatatcagcatttttttccttttaaagtttgcataatatatgacaacatgaacaatacaaagaatcctgacttgttggctctgggttttaaaggagattttaatattctcaaaggtctcttttagatcttaaattctattattctatgattcttcattctctgttcctatgtcatagcataatcatttgacatgacatttcataggcaaaaatgtcaaagtaaatacttgcaacactgaattaatgtttcaaaaagtaaaagtcagtcctagcccaagggcatttatttaaaaacaaatgaaaacagtcaattatatcaataagataaatataagttgtatgtagtcatatgtgtttatgtgtgtgtggatttaaatgattttggaaggatatacatcaaaatgttactatttctaggtaatactgttgctaggtgtagctatacaaaattgattctcttttttttaattataatttaagttccgggatacatgtgcagaacttgcaggtttgttacataggtatacatgtgccatgggggtttgctgcacctatcaacccgtcatctacattaggcatttctactaatgctatccctcccctaggcccccatcctcaacaggctctggtgtgtgatgttcccctccctgtgcccatttgttctcatcgttcaactccgacttatgagtgagaacatgcaatgtttggttttctgttcctgtgttagtttgctaagaatgatggtttccagcttcatccatgtccctgcaaaggatattaattcatcattttttatggctgcttagtattccatggtgtacatgtgccacattttctttatccagtctatcattgatggacatttgggtgggttccaagtctttgctagtgtgaacaatgccacaataaacatatgtgtgcatggatctttatagtagaatgatttataatcctttgggtatatacccaataatgggattgtcgggtcaaatggtatttctagttctagatccttaaggaattgccacactgtcttccacaatggttgaactaatttacactcccaccaacaatgtaaaagcattcctatttctccacatcctctctagcatctatagtttcctgactttttaatgatcaccattctaactgtcgtgagatggtatctcattgtggttttgatttacatttctctaatgaccagtgatgatgagctttttctcatatgtttgtcgtctgcataaatgtcttttttggagaagtgtctgttcatatccttcattcactttttgatggggttgtttgtttttttttcttgtaaatttgtttaagttctttgtagattttggatattagccctttgccagatggatagattgcaaaaattttctcccattctgtagggtgcctgttcactctgatgacagtttcttttgctgtgcagaagctctttagtataattagatcccatttgtcaattttggctttagttgccgctgcttttggtgttttagtcttggaagtctttgcccatgcctatgtcctgaatggtattgccaaggttttattctagggtttttgtggttttaggtctaaaatttaagtcttgaatctgtcttgagttaatttttgtataaggtataaggaagggatccagtttcagctttctacatatggctagccagttttcccaagaccacttattaaatagggaatcctttccccaatgcttgcttttgtcagctttgtcaaaaaatcaaatggtggtagatgtgtggtgttatttctgaggcttctgttctgttccattggtttatatatctgttttgctaccagtaccatgctgttttggttactctaggcttgtaataaagcttgaagtcaggtagtgtgatgctaccagctttgtcctttttgcttaggattgtcttggttttgtggactcttttttgattccatatgaaatttaaagtagttctttccaattctgggaaaaaagtcaatggtagcttgatagggagagcactgaatctataaattactttgggcagtatggccattttcacaatattgattcttccaatccatgagcatggaatgtttttccacttgattgtgtcctcttttatttccttgagcagtggtttgtagttctccttgaagagatccttcacatcccttgtaagttggattcctaggtattttattctctttgaggcaaatgtgaatgggagttcactcatgatttggctccctgtgtgttactggcgtataagaacgcttgagatttttgcacattgattttgtatcaatcaaactttgctgaagttggttatcagcttaaggagactttggggtgagatgatggggttttctaaatacacaatcatgtcatctgcgcacagaaacaatttgacttcctcttttcctaattgaataccgtttatttctttctcttgcctgattgccctggccagaacttccagtactatgttgaataggagtggtgaaagagggcatccttgtgttgtgctggttttcaaagggaatgcttccagtttttgcccattcagtatgatattggctgtgggtttgtcataaatagctcttagtattttgagctacgttccatcaatatctagtttattgagagttttagcatgaagggctgttgaattttgtcaaaggccttttctgcatctattgagacaatcatgtgattttgtcattggttctgtttatgtgatggattacgtgtattgatttgcatatgttgaacaagacttgcatccccgggatgcagccaacttgatcgtggtggataagctttttgatgtgttgctggattcggtttgccagtattttattgaggattttcgcatcaacattcatcagggatattagccggaaattttctttttttgttgtgtctctgtgaggttttggtattaggatgatgctggcctcatgaagtgagttagggtggattccctctttttctattgtttggaatagtttcagaaggaatggtaccagctcctccttgtacctctggtagaatttggctgtgaatccatgtggtcctgggctttttttggttggtaggctattaattgctgcctcaacttcagaacttgttattggtctattcagggattcaacttcttcctggtttagtcttgggagggtgtatgtgtccaggaacttatccatttcttctagagtttctagtttcatttgcatagaggtgtttatagtattctctgatggtagtttgtatttctgtgggattagtggtgatatcccctttaccatttttttattgcatctatttgattcttctctcttttcttctttattagtctggctagcagtctatctattttgttgaacttttcaaaaaaccagctcctggattcattgattttatgtagggttttttgtgtctctgtctccttcagttctgctctgatattaattatttcttggcttctgctagcatttgaatttgtttgctcctgcttctctagttcttttaaatgtgatggtagggtgttgattttagatctcccctgctttctcttgtgggcatttagtgctataaatttccctctacacactgctttaaatgtgtcccagagattctgctaccttgtgtctttgttctcattggtttcaaagaccatctttatttctgccttcattttgttatttacccagcagtcattcagaagtaggttgttcagtttctatgcagttgtgtgatttttgagtgagtttcttaatcctgagttctaatttgattgcactgtggtctgagagactgtttgttatgatttccgttcttttgcatttgctgaggagtgttttacttccaattatgtggccaattttagaataagtgtgatgtggtgctgagaagaatgtatattctgttgatgtggggtggagagttctacagatgtctattaggtctgcttggtcctgagctgagttcacgtcctggatatccttgtaattttctgtgtcattgatctgtctaatattgacagtggggtgttaaagtctcccattattattgtgtgggagtctaaatctctttgtgtgtctctaagaacttgttttatgaatctgggtgctcctgtattgggtgcatatatatttaggatagttagctcttctggttgcattgatcctttttccattatgtaatggccttctttgtctcttttgatctttgttggtttaaagtctgttttatcagagactaggatataacccctgcttttttttttttttttttttttgctttccatttgcttggtaaatatttctccatccctttattttcagcctatgtgtgtctttgcatgtgagatgggtttgctgaatacagcacatcaatgggtcttgactcttatccaatttgccagtctgtgtcttttaattggggcatttagtccatttacatttaaggttaatattgttatgtgtgaatttaatccctccattatgatgccagctggttattttgcccattagctgttgcagtttattcatagcgtcgatggtctttacagtttggcatgtttttgcagtggttgatcctttccatgtttaatgcttccttcaggagctcttgtaaggcaggcctggtggtgacaaaatctctcagcacttgcttgtctataaagggttttatttctccttcacttatgaagcttagtttggctggatatgaaattctgggttgaaaattctttatgagtgttgaatatcagcccccactctcttttggcttgtagggtttctgcagagagatctactgttagtctatgggcttccctttgtgggtaacctgacctttctctctggctgctcttaacattttttccttcatttcaatgtgaatctgacaattatgtgtcttggcgttgttcttctcaaggagtatctttgcggtgttctctgtagttcctgaatttgaatgttggtctgccttgctaggttggggaaattctcctggataatatcctgaagagtgttttccaacttggttccattctccttgtcactttccggtacaccaaacaaatgtagatttggtcttttcacatagtcccagatttcttggaggttttgttcgtttcttttcactcttttttctctaatcttgtcttctcactttatttcattgagttgatcttcagtcactgatatcctttcttccgcttgatcaatttggctattgatatttgcgtatgcctcatgaagctctcctgctgtgtttttcagctccatcaggtcatttatattcttctctaaactggttattctagttagcaattcgtctaaccctttttcaaggttcttagcttccttgcattgggttagaacatgctcctttaactcagaggagtttttattacccaccttctgaagcctacttctgtcaatttgtcaaactcattctctgtccagttttgttcccttgctggcaaggagttgtgatcctttggaggagaataggcattctggtttttagaattttcagcctttttgtgctgttttctccccatcttcatggatttatttacctttggtctttgaagtcggtgatctttggctggggtctctgagtggatgtcctttttgttgatgttgatactattcctttctgtttgttagttttccttctgacagtcaggcccctctgctgcaagtctgctggagtttcctgaaggtccactccagaccctgtttgcctgggtatcactggtggaggttgcagaacagcaaagattgctgcctgttccttgctctggaagtttcgtcccagaggggcacccgccagatgccagcctgagctctgctctatgaggtatctgtcatcccctactgggaggtgtctcccagtcaggatacacgggggtcagggacccacttgaggaggcagtctgtcccttatcagagcttgaatgctgtgctgtgagatccactgctctcttcagagctgccaggcagggatgtttaagtctgctgaagctgtgtccccaaccgccccttcccccaggtgctctgtcccagggaggtgggggttttatctataagtccctgactggggctgtgcctgtttttcagagacgccctgtccagagaggagggaatctggagaggcagtctggccacagtggccttgctgagctgcggtgggctccccacaatttgaacttcccagtgtctttgtttatactgtgagggtaaaaccacctactctaccctcagcaatggtggatgcccttccccccaccaagctcgagcatcgcgggtcaagctcagactgctgtgctagcagtgagaatttcaagccagtggatcttagcttgctgggctccgtgggggtgggactgccaagccaaaccacttggctccctggcttcagccccctttccagaggagtgaactgttctgtctcagtggcgttctgagcaccactggggtatgaaaaaaaaactcctgcggctagttcagagtccgccaaaacagccgcccagttttgtgctggaaacccagagccctggtggcttgggcgctggagtgaatctcctgggtccgcaggttgtgaagaccatgggaaaagcatagtatctgggctggagtacatggtacagtccctaatggcttcccttggatagacaaggtgttccctgaccccttgcacttcccggatgaggtgacgccccaccctgcttccactcgccctccttgggctgcaaccactgtccaaccagtcacaatgagatgaaccggttacctcagctggaaatgcagaaatcacccgccttctgcatcaatctcaccaggagctgcagaccggagctgttcctattcggccatcttgccagccaattctcttctttatacttttcgataatgtctaaatatttcccaatacaattgtaaattgtacaagtatgaaaaaaagcatttccattcaaaaatataaaaacgtcagaggcatttgagccagagcaactccatcttgtataggggctaggtaaaataagactgagacctactgggctgcattcccaggaggttaggcattctaccaggatgagataggtcagcacaagatacaggttacaaagaccttgctgataaaacaagttgcaagaaagaagctgatcaaaacccaccaaaatcaagatggtgatgaaagtgacctttggtcatcctcactgctcattatacactaattataatgcattagcatgctagaagacactcctgccagagcgatgaccagtttacaaatgccatggcaacatcagaaagttaccctatacagtctaaaaaagggaggaaccctcagttctgggaattgcccacccctttcctagaaaactcatgaataatccatcccttgtctaccataaaatcaaaaattaacaataaatataagcagctgagcagcccatgccaccactctgcctatggagtagccattcttttattcccttactttcttaataaacttgctttcatattactctatggatttgcctccaattctcttgcacaagatctaatcaattcgttcatgtaacctcacttctcctggatgccagacaagagctcaggagccacaagtatgatacaaaaggacgtcatactggccctttgccctcactggcagaggacagccacctagcatgaaaaggtggagggcccactgagctgttaacacctaagccatagtggatggcagagctaaaagagcactgtatcacatcacctggggctttgggagctgcaggcaccccaactggacgctgccacggggcctgcatggagtttgtgctgccagcgcgcaaaggtgcttactctggttcctgcacccactcacctgcgtgctccctcctgcaaggggtggaatgcagcaggtccaagtgagtggggtttgatccccctggtgccactggtgccgctggtgctgaagtgcctggtggattcaagcactcatgcacgccagttcccaggaggagttgagagcggcaggctgagtaaaggaggcacccactgttgcaagtcccatgaaggggtcagggaaatatcttgcttcaaaggcagaaacatctgcatggaacttttcctaacaaaagtggcaactggctagtttgggtacggcatattctacccctgctattctgcactatatgagactttctctggctaactctccagttcaagaacagttcctctttactgtaattactaagaatactttttctagagcctgtcatatttaaggccatggcctctggcatgatgaacattagttgctgaatgccgtatttccaaaggaaagaaggaacaagttagccacctagatcctaagaaagacttttcagaaacaattgtgtctaacagtcaagaaagaaaatacagaaatagaagtggcacaatattgctcaaaatcttcagtagcttcttgttaattttaggataaaatcctgacaccattatcaaaatatgaggtaaaggaggaagtgaggtaaaccagatatatgtgttttgaaaacactttcccagatgattccgatatattagtgcccatttctatgaagcatttttgagatagacaacatcatctctatatactgagtagatagtatacatacttcaaaggtcaatttgtattaggtgtagaaatatgagaagcagaatggttaagccattatgttcccccaaaagatgaccaaatatgaatatataatcagcaataaacatcgagaaaaaaaactgagttcaaagtaggtgccatcactttctaaatataatttttttctagtcatgattagcccagtttttctcagacttcagtttttaatgtaaaaataattataattgtaccaatgttgctttaaatactcatattttaatgccatataaatacatactaacaaaattagatctaaactattatgcatataactcctttataactattaaattaatataaattcacaaattaaatatatttaaaaattacaaaaacattgacattcaaattaataacattaatttcataagaaagatgatgtttagctgaaatggtattgatgttgcatgcaaataatatcaagttcacatataaatttaattattttctgaatttttgtttcaataataagagtattcctgttcaagccttccagagtaacaatgtgccacaatgagtagctgatgttatcccactactaatatatacagaatgctggataaaatatagtccacaaatactaagtacatatcaaaactaaaaagaaaaaagtagaaatcctcaggcataagaaaaatggaggtaactcaagtcataacaataagcagagaaactaagaattcagtgggaaaagagagtatcaggtccaaatatatatacccctaaggccttgagatcacaattttaatggtaagcaggaactgaggcaggatctgaaaataaaactcctttcactggaacctgaaaggttcctattcatgaaatgggacttaaaagaaaaaaaaaaaaaaaaaaggcttcagcatgcagcccaaggcagtagcaagaatgttcatcttttctgctgagtgctgtgagtagaaaagaaaagccttctgtgagaaatcaaaactccaatctcacaacgagtggtgctacaagaatctcaaaccaaaatattaacaaaaaaatggcctcataacagtggaactcctggaatacccaaaagaaataaatgcaaaactcatttctaggtatatttctacaacacatatggctgttacagaaaaacagacttctgctgaaaattaactcacaaagtttacaaatcacctgaggacttttcacttaccaaaagggagtatcagtagacacaacaaatggttaaaacagcaccctcccaaaaaaaaagtttagaaaaataaaacaatctgatatttttaaataattattcttgatattatttaaaaaataaaagaaatacagttatactgaaagaccttccaatgaaaaatagtgacttaaataaaataaatagaacttctaaaaaggcattaacatttttaaatctcaatgtatagattaattagcaaattagatattgctgaagaaaaaactattacatgggaagatgagcttaagaaaattacccaaaatccaatacaataaaaaaatagaaaatataatgacagaatgaatgttatggaggatagaataagaaacattcatctatctatttaaataggagttccaagagagaataggaaagagaaaatattgaagagaaaatcgctaagaatttgcccaaaatgataaaaaacatgatcaaattcaggaaacaaatctcacgcaaaaaattaaaaagaaatccacactggatacatcattgagaaacttcagataattaaagacaaaaataaaatactaaaagcaacctcagagaaatgatacattgaatgcaacagaaaaacaattacatggagaatgccctaattataatttcatttattcacaaatatttattgaatgccaggcactgttttagttcctgaggatatagcagtgaacaaaacagacaaaaattcttgccttcatggagattacatactggtgataggaatagaataatatctgcaaaaaacaaacataaaacaaatgtgaattctaaattcacttttttctttcattcaataaatacttattaggtactttttatatgccaaacactgttttaaggtgttgtgatgcattaatgaaaaaggggacaaaaattcctaacttcattaagcttacatcatatgtaaatatataaataatagacataaaaatagtttttaaattatcatatgttggactataacaagtgctttttttttttggaggtacacaacaccatgcccggctaatctgtttgtatttttggtagaaatggggtttccagctaaactacattgaagaataaaataagtacatttgcagatgaaaaactgatattaattgattcttactgaaagagattaaatgatgtgtggaggaaactacatacaaaggagtggaatataaaatgaaatgttaataatcaacattcctttcatgtacacattatacatttataaaaattatccatataacagatcacactcatctctcaacaaatactaaataccaagaataagtttacagaatataaatcaacaaaattggagaacaaaagtaaaaagaaaatcaatttaagaattacattaaatttccacataaaaattatgttacattcagcatcttctgcttgctaaaaagtaaattatattacataaaaattatactgctaaatattcatagtttaagtttccattttatatggatatacagaatatttagaaagtaacagcatgacatataaaaatatgtgggtcgcagataaagtagtacttaacagttatagccaaaaacttaaaagtcatagccaaaaagtatatatttgagaagaaaaaatactgaaaacttctatccaagatctcaactcaagaagtttttaaaaggacaatagagtaaaataaaagaaagtagaagaaaaaagaaataatgggaatcaaatttaataaaatagaaatcaaagaatagtataaagcaaattaacaaaaaaaattgagtatttgaaaacaatagtcgtcgtcaaacttctgatagtattgaacataaaaaatattagagaaaataatattagaaatgaaaaataaacaattacaagtagagatttaaaaatcagaagataatattatgaactaacttaagccaagaaatttgaaaacagacaggctgggcaagttgctggaaaaaatataattgaaattgccttagcaaagattatgacagtgaaagaagtctaacatggctgactccatttgattctaacatcacaagctggctgtcctcactcattcctaaatacaggccaagctaactatgggaagaatttagttcatagcttggctttgaaggaaggaagacaacagtccctccctaaaactaaccctctccttgcttaaggaccaaaactgcctttgtaaaactaatgaaagcccaagagattaggactggggggagctgaattctgctaagatgtagacgcagtttgcccttctatgatcgtttattgcaccagaggtcacaagatttgcaacttccccaattgctcctataggtaacaccctattttagaacctaaggttggtctttgagattttttttcggacttttgcatcctgacaactgactgactctacctggacctgtgaatcatggctcaaccagtcccatggcccccacccagaggctgacagtgcacaaggatcattttccacacacatatgatttaactttcaaccagtctgctgcacccattccctagcccccctgcccaccaaagtatccttgaaaaacctaacctctaagcctctggggagatggagttgagtagtaactcctgtcctcccacttggctgcctcatgataattaaactctactgcaataacactgtctcaagtgcattgggtttgtctgtgcagtgggcaagaataacccatcaggcaattacataatttacttaaactgactaaaaggaaatatactacttaaatagatctatacccatttaagatattgaatcagaagtcataaaattgacctccagaaaaaacatcatgcacacatggtttcacaaaaacttttactgcaccttcagacaactgagatctcctatcttatacaaaatgtttcagggagtagaattctttataaagctcatgtaacctcaatgcactaatttataaaactttgaccttcacattgttgaggtgcagagaatgataccccaacatatagtgctttggcacactgaccactcctaattaaaagaaatcagaaggccttagaagctgcctaattttctaagcatctcttgttttttcccacccacctccaagtacgaggagggactctctctggaattttatgactaaggaaacttctttccaaaagataaccaattgtcttcttgaataaccaggaaaaaaattaaccactggagaagagactaaaagtcatcaccatacccagagagacttttcatctgttccatggagtaactccaagagattatctagggaactctgtctgcataataagacaacctttgttcacaggcccctcatttttctgccacctccctcagagatgagaggaactttgctccaggcgagtgccctttgggtttatttatttcccctgaaagttatcaactatttcatcaaaattgtctatacctcccatttctctctgccctgggaagaaggtatttgagcctcaaccatctggcccctctttgaattttacatctgtggggactctcatgtccatgtatacataaatcaatttgtaagcctttttttattgatctattgtcagtcatttcaataaaccttcactgagcatggaagggaagctttccctccacctctacaacataaagatgaggtttacattgagatattgttgaaattggcattatatggttatctaatacaatgttctaggaatcaaatacaagaagtctactcattgcgtgtttactattacagttatataaaatcttattatgtaatctacttcatttgaaatttggatggagagcctaagcacctcactggtttagtaccctccctcctctgttaatgctcacgcactgactctaggaccctgcaactaactttgaaagccactagaattaattagaattacttttaaacaggattatattgtagtttcttcataatttataactttccttggacatacccaagcctatcataaaggcattatatcaaacagactttttctttacaaagtcgattattattttgcatgtattcttctagtgtttacaaattaatttaatgttataaatatatcacaaagccttttgactgtaaagtgtttcttcagataaatagaggtttgtcttactttttatataactaatttacttattaagatcattttcctaaaatccaaaagcttaagggaatctaagcacagatgtggcagcagatgtaatgaattggacaaatcttttaagcccacctatgttcaccaggtaatcagaatgacagtaacagcaaaatgcctcacaatctcacagtagagcctacagaatttttctttaaatgaccaacttcaatcaaagcctcatacaaagtttattctctcttctagttatccaaatatagagatgaaaaaaatatatgtcattagatgattaaatttctgtgatatttgtctcttgaaaagtaagtttgaggaagtcctagccactgcaatcaggcaagaggaagaaataaaaagctccaaataagaaaataagtcattatctctcttcactgattatatgattccatacctagaaaactctaaagattctaccaagaagctcctggaactgataaacaacttcatgaaagtttcaggatacaaaatcaatgtacaaaaatcagtagcatttccatgatgagaacagtaataataataaccaaactgagaaacaaatcaagaactcattcccctttacaataaccacactacacatacataaaatacctaagactacatctaaccaaggtggtgaaagatctctgcaaggaaaactacaaaacactgctgaagaaaattacggatgacacaaataaatggaaaaacattcctgctgatggactggaaaaatcaatattgtcaaaatggccatactgcccaaagaaatatacagattcaatactattcccatcaaactaccaacatcatttgtcatataattagaaaaaactatcctaaaattcatacagaaccaaaaaagagtctgaacagccaatggaatcctaaacaaaaagaacaatgccagagtcatcacattacccgacctcaaactacaccctaaagctacagtaccaaaacagcatgttaatggtacaagaacagacacataggccactggaacagaataaagaactcagaaataaagccacatacctgcagccttctgatctttgacaaagtccagcaaaaacaagcaatggagaaaggacttcctattcaataaatagtgctggcatagctggctagctatatgcagaagaatgaacctagacccctacctttcatcatacacaaaaattaactaaagatgaattaaagatttaagtgtaagacctcaaattagataaaaatcctagaagaaaaccaaggaaacaccattttagacattggccttgggtaagaatttatgactaagtcctcaaaagtaattgcagcaaaaacaaaaatagacaagagggacctaattaaaccaaagagtttctgcacagcaaaagacactacaacagagtaaacagacaacctacagaatgggagaaaatattagcaaactatgcatccaacaaaggtctaatatcctgaatctataaggaacttaattcaatgaacaaaaaaccaataatcccattaagaaacaggcaaaagacatgaacaggcacttctcaaaagaagacacacaagtggccaacaaacatatgaaaaatgctcaatatcactaatgatcagagaaatgcagatcaaaaccacaatgagatgccatctcacactagtcagaatggctatttttaaaatgtcaaaaagcaatagatgttggcaaggctgtggagaaaagggaatgcttatacactgtttatggtaatgcaaattagtttagcagtttggagatttctcaaagaacttaaaacagaaccaccatttgacccagcaatcccactactgagtatatatgcaaaagaaaataaattattataccaaaaagatacctgcactcacatgctcattgcagagatatttaaaatagcaaagacacagaatcaacataggtgcccatcaatagtggactggataaagacaatgtggtatatatacaccgtggaatactatgcagccatgaaaaagaatgaaatcatgccctttgcaataacatggacagagctgaaggccattatcctaagtaaattaatacaggagcagaaaatcaaataccccatgttctcacttatacataggagctgaatattggatactcatgggcataaagatggcaacaatagacattagagactactgtgaggaggtaaggagtcgggcaaaggttgaaaactaactactgggtactatgcccagttcctgggtgacgggatcaatcatacctcaaacctcagcatcacacaatatactcaggtaacaaacctgcatatgtaccatctgaatctaaaatataaattgaaaacatttttttaaatgagaagctaaaactaacgtgcagaactaaagggaagaaacccctatagtatgtaagctgtgagaagccctgaaattcaatttagaaatagatagtggtgatgttatgaaatgaattgtcaaaatggaatatagggttccaaaaagaatccatttagttcacatattatatggcttccattattattattattttttttttttttgagacggtgtcttgctctgtcacccaggctggagtgcaatggcatgatctcggttcactgcaacctctgcctcccgggttcaagtgattctcctgcctcagcctcccgagtacctgggactacagggtccaccaccacacccagctaatttttatatttttaatagatacaggatttcaccatgttggccaggatggtctcgatctcttgacctcgtgatctgcccgcctcggcctcccaaagtgctggaattataggcatgagccactgcgcccggccacatggcttccattattgctaggtctcttcaccagatcagaaagcaaaccgaaaacagtatctcacttcaaaaccattaatttatatatgtgctattcttaaataattaaatatattaaaaatttgtaaatattaatatctaacagaagacttttgttaacctaaaaaaattctcaaaaaaagtaagtttgatataatggaaattcaaaatttgggcaaattatttaagacaggtaaataccatgtaaaaaaaaatttaagcactgaagttgctgttcatgtagaaaactaacaacaaaaaagcgaggtatcttaaatctcaaaatctaaaatacacacacacagatagatggtgattagttagatgattgatagatagatagatagatagatagatagatagatagatagagataaatatccctggtgtaaagtgtgttaatcagccccaaatcctaatatcaaaagtggaatgaagcagaacactcaagaaaataaaggataaaattattgataggatgttatgaactagtagtaacacaagctatgagaaaaccatttattataaataaattaaaaccacaataagataccactaattccctagaatagctagaattagaaagatagacaataccaaatgtttgcaaggatatggagaaactacatcatacattgctaatgggaatataaaatgacactgtcattatgaaaaataatttggcagttcttgaaaaagttaaacataaacttaccatacaacctagaaatttcccatctaggaatctaccaaagacaaaagaatacacctgtctaaaccaggacatttatacaaatgtttacagcaacagtttatatatttaaaaactggaaacaacccagatgtccaccaaccagggaaaggaacttttttaaatgtgatatgtgtatattatggaatattattcagcaataaaaaggaatgaactactgatataggctacaacatggatgaacctcaaaaacattatggtaagtgaaagaaactagacatgaaagataacatattctaagattcaacttatatgaaatgtccagaaagggcaaatttatacaaacagaaagtaaatcagttgtgggctggggctggaagtgaggatctttttatgatgatgggaatgctctaaaaccagattgtggtgatagtttcacaactttgtaaatttactaaaaattgttgaatgatacacttataatggataaattatataatatgtaaattagtcctctataaatatgtctttttaaaagtgctgtgagctggctaggcacagtggcttatgcctgtaatcccagcactttgggaggctgaggcaggaggattctttgagcccaggagtttgagactagcctaggcaacatagtgagatatcgtctctacaaaaaatttaaaaattagccaggtgtgatggtgtgtgcttgtaatcccagctattcagggagttgaggtgggaggattgcttgagcctgagaggtcaaggctgcagtgagctgtgatcattccattgcactccagcctggatggcagagtaacaacatcctatgtcaaaaaaaaataataaaaataaacactgtgagctgtgtaaggccaggcatggtggctcaagcctgtaatcccagcagtttgggaggccaaggcaagaggatcatttaagggcaagagtttcagatcagcctgaaaaacatagtgagactccatttatacaaaataaataaataaacacgattagccaggcatggtggttgagacaggaggatctcttgagcccaggagttcaaggttgcaatgagctatgatcatgccaatgtactccagtctaggtgacagagcaagaccctatctcaaaaaaaaaaaaaaaaaaaaaaaaaaaaaaaaaaaaatagctgtgtaaactttcatttttctttactttaactgagagtaaatgacaaaaatattttcaaaaaccctgcacttcctaccagtattacaaaagggaaactatattcataatttttcaaattaaagcttaagcaactgttcatcaattttcaaaatttccctcgcattagcacttaaaaatctgaagtaatagtacaatgaaggcaagaagcatgtttggcaataaccaattatttgaatagacaaagcataaaagtagacttgtcaaatcaacctcataagaagttttagcaagcatggttctatagagatataagacattgtatactaacttcattatgctataaatcttacaaccgttctaatcacaaactggtacagttctctcagatctctaagtcttctcactgaaatttctctcttaaataatttaataatgatgtttatggcaacaatttgattgaacacttataatatgccagttactatgctaaccattcacatttaaaatcgcatttaatccttgcaaagatctttttatatattcattgatcactccattttacagatacagaaagtgaggctcagagagatagagtaaaggcgcaaggttacacagccagtaaattacttatctgcaggttgagttagtggccaatatacttaaccacagaactatgttttctaactttcaaaaaagcaatactgtacctttgcttgaaaaaggaactgtaccaccagaaaatgtcactgtaggtttctggttacaaagcaagaatgcccacctgtgctggagttaattctactgtcacttttggagtaaagtgtaagagtcatgagcagtgggtgaaaataaagttgatccaggcaacttttatattacttagaactactttcaccctagagtccttgtaaatctgaaaagaacaagttttaaattattatttaatttagagctaagaattccttgggtatcagtgagaagagaaaatgagagaagggaaatgtttaccatttgtattgaccattcgattttagccagaaaatttgctacactcttcatgtatatattttatttcatttatcctcaaaacgaactccttaaagtattagtatcttcaatttgcatattaaaaactacagacttctgagaggtaaggtgaattgccccaaagcacacagttaataagtggcaaagccaggatctaatccagaagctcatgttttcactataccatgctcacagtctagtattctattgtttatttcagaattgcttttctccagttcaaaaatggccttgtctcatgcctttcatcaaacagtaagtattccctaaagcccgatcatggacttcccatctattcattcattcattcattcccatctgctgagcccttttatgtgccagtcagagctaaacagtgaattagaggaagctccttcctttagaaaatggcagtctggtagtacataattttaaaaattaaaatgtgattttaaaatgacagcattaagctcaagacacaatgcaaacatagagaagggagtgcctaagttatttctccagttcttccagtgtataatatcttcaggattaaatatatattctttggctcacctttaaagcctttaattcctctggtcacatttatactcaattcaatattgactgagcacctgttgtgggtattaaaaggctgtatgccataatggaaagaggacagacatagagtcagataggcatgagtttatcccattctctctcgcttactagctatgtaaacttgagcaagcagctttacctcctttagcctcagtgggattttttaaatcaagtttattgaggtataatttacataaaataagatgcttccattttaagtttacagtttgatgcattttgacaaatgtctatagtcatgtaaccaacacaacaatcaagatatagagcatttccataactccaagagttgcacagaaatatttatagctttttcatagtagcctccatctggaccccaaatgtccattagtaaatgagtggattaaaaaaaaaaaagttcctttgtgccacttcccagccaatctgtccttccactcctggactccaaaccttaggcaccactacctgctttctgtcaagacatactagacttttaagtagaatttcatataaatggaatcatatagtatgtactctttcatatctggcttactttgttcagcatagtgtttttgagattgatttatgttgttgcatgttgtatagtttaatgaatttcattcctttttattgctggataatattcctttatatggatataccaaaactggtttatctgttcaccaagccatggacatttggaattcagtctggggctactacgaataatgctgctataaacattcttatacaatgctttgtgtgatcaaatattttcatttcccttaggtaaatatatacaagtggaaaggtaggttaaaataataagtttaacttttttaaaaagtaccaaactgtctttcaaagtggttgtaccattgtacattcccaccagaaatgtatgggttcctgccaacatttcgtataagctttttaaattttaagctatctagatttgtctagtagtatctcactgtggttttaatttgcattttcttaatgtctaaagatggtaaacacattgttagtgcttacttgccattagaatatcttgttttcaaaaagttttttccattattacatggtttgccttctacagttgtaagacttctttataatacaagtcatttgtcagatgtatacatcacaaatatttcctctcattctctggcttcccttttcattttcttgatggtgtcttttaaaaggcagaagtttttaactttgataaggttcattttttcctttttactttttttcatgcactgggggccctgaaaaatctttgctcattccatggttgcaaggattttctcctatgttttcttctggaggttttatattttcagttcttgtgcttaggtctgtgatccattttgagttatttttcaacatgatatgcccaaagttcactttttccacattctagttctactggtgctagaactcaatgttctagcatcacttgttgaaaagactaccatcctccccattaaagtattttgccacttttgtcaaaaatcaattcaccctatacattgaatctatttttggtctctctactctgttccattgatctatatatgtatcctatgtcaataccacattttctggattattttagctttataataagtctcaaaatttgtacttgtccaacttctccttctttttcaaaactgctttcattattctaggcttttggcatttataggaattttagaatcagtttgtcaatttttttaaaagcagagattttggttgacattgcatagaatttatagagcaatttggggagaactagcatcttaacaatattgaatttcccaagcaatgaacaaaaaatatctttctatttattcaggtcttatttaatttctgatagcaaagttttatagttttcagtgaacaggtcttgattttgttaaatctatccctaaatatttcatattttgatgtgtggtaaattgtactgtattattttaatttttgttatcaccagtatataaaacaattgatttctgtatattgatcttgtatcctgtgatgtttctaaactcacaagtttcatgagcatttttgtagattccacaggattttctacaaaactaattatgtgagctatgcattaaacagttttacctctttctttacaatatgtatgttttttatctctttttcttcccttactacactggctaggttctctagccagtgatgagaagtgatgaaagtggttatccttgtgttaggggaaaagcattcaatatttgatgattaagtataaatgtaagctgtgggtagaggggttgagacaaaattcacataaaatgaaattcatcactgtaatcattttaaagtatataatttagtgatttttagtatattcacaatattgagcaaccattaccactatataattccaaatttcagaacattttcaccaaccccatactcattaagctgtcactccccattcccctgacccttagcctctagcaaacactaatctactttctgtctctatagatttgcctacagcagacatttcaactggaatcatacaaaatgtaagtgacctttagtgactggttctttcacttagcataatgttttcaagttttagccatattgtagcatgtatcagcacttcattcctttttatagccaaatgggtactccactgtgaaaataccacattttctttattcatcagttgatggacatttggattttttccactttttagctactatgactaccgctgctatgaacattagtttacacatctttgtgtaaatatatatattttcaattctcttgggtatataccatgaagtagaattactggatcatgtggtaactctatatttaattttttgagaaactgccacacagtttttcacagcagctacattttacattccctccagctatgtatcagggttccaatttttaccatgcctgccaacaattattattttccatttgtttttatcatagccacccaagtgggtgtgaagtgatatcactttgtgcttctgattcaaatttccctaatgactaatgatgttggacatctttccatgtgcctattggtcatttgtatatctttttaggaaaaatgtcttttcaaaaatttgccaatttttaattgggttgtcttttttatgttaatccatagaattctttacatattctgaatactagacccttatcagatgcatgatttgcaagtattttctcccattgtgtgggctgccttttaactttcctttgaagcacaaatggtgaagtccaatttatctcttctttcttttcctgcttgtgcttttggtgtcatagttaagaaatcatggccttatccaaagtcatgaagattgtcttagtcaatctgggctgctatagcagaataccatagactgggtggcttaaacaacaaacatttatttctcaaagttctagaggttggaagtctgaaatcagagtgccagcatggccaggttctgatgagggctctcttcagggttgcagatgctgacttatcattatatattcatatggcagaaagagggcaagagagttcccatggtcccattcacaaggggtctgtcctcatgccctaattaactctcacaggccccacgtcctaataccatcactttgggggttaggattttaaaatgtgaattttgtggggaacgctaacattcggcccattgcaaagatctacatctatgtttccttctaagagttttacagttttagctcttatatttaggtctctaatcccctttgagtcaattttgttatataatgtggagtagggacccaaattcattatttttcatggagctagctatatgtcctggtagcatttgttgaaaacacttttctttcccccttgaatgggccttggcattgttgttgaaaatcaggtgaccacacatgtatggttttatttctggactctcaattctattccattgatttatgtgtctatctttatgctagtgccacactgtcttgattactatagccttgtaataacttttgaaattgggaagtgtgagtgctccaaattcgttctttcttttcaagattgtattagctatttgagacgccctcataattttgtacgaattttagaatcagctttttcacttcttcaaaaacagctattggtattttgatagggatatattgaatctatatcaatacaggaagtattaccatcttaaccatattaagtcttccaacccatgaacataaaatgtctgtttatttaggtctttttcatttatttgagcaatgttttagagttttagtctttcacttccctgtttaaatttattcctaaatactgtattctttttgatgctattgtaaatgaacaattttggattgctcatgactgatgtaaaactagcttttgtgcattgattgcttttgtattctacaatctttctgagcttgtttattagctctactcatttttttgtagattctttagagttttctaaatacaagatcatgtaatctgggaatttatttttactccttcctttccaatttttttggaaagaattttcctaattttcctagctggaatttccagtacaatgtttaataggagtggcaagagcaaacatcctcatcttattatcagtcttaggaggaaagctttccgtctctcactattaagtatgatgttaactgtgggttttttgcagattcccttttgcaggctgaggaagtatctttttagtcctagttttttgagtatttgtattatgaaaatgtgttagattttgtcaaatgctttttctgtatccattgagacaatcatttaaattttttcctccattttataaatatggtgtattacactcattggttttcacattgtaaaccatctttgcattcttggaataaatctcaatccctcatagtgtaaatttttttaatgtgctactagatttttttttttttttttgagatggagttttgctcttgttgcccaggctggagtgcaatggcgcgatcttggctcagtgaaacctctgcctcccaggtacaagtgattctcctctctcagcctcccaagtagctcggattacaggcatgcaccaccatgcctggctaatttttttgtatttaatagagatggggattcaccatgttagtcaggctggtcatgaactcctgacctcaggtgatccaaccacctcagccttccaaagtgctgggattacaggcgtgcgtaaccacacctggccactagattttgtttgctaacattttgttgaggatttttgcatctgtattcataagggatgttggtctacaattttcttgtactgtatttggctttggtatcagagtaatatggacctcatagaattaattagacagtattctcccctcctcaattttttggaataatttgagaaagattgctcttaattctttaaacatttggtagaattcaccattgaagccatctggtgctgggttttttgtggttggaggttttttcattattaattcaatatctttacttgttatcactctatccaaatatttcctttttattcagttttggcaaattatgtgtttctaaaaatttgcacatttcaactatgttgtctaatttgttcggcatacaattgcttatactattttcttataatccttatttctgtaagatcattgtaaagctcacactttcaatcctgattttagttatttgagtcatctctcttttttttaatagtctagctaaaagtttgtcaattttgttgatcactttgaaaaactggtttcggtttcattgattctctctgttgtatttctatttcccgttctgtttatcaccactctaatctttattatttccttccctgtttgctttgggtttagttcattcttctttttctagttcttaaggtggaagattgggtcatttatttgagatcattcttctttcttttttgtttgtttgtttgtattttgagatggagtctcgctctgtcgcccaggctcaagtgcaatggtgtgatctcagctcactgcaacctccacctcccaggtttgagcaattctccttcctcagcctcctgagtagctgggattacaggcacccatcaccacacccagttaatttttgtatttttagtagagacgaggttttgccatgttggccaggctggcctcaaactcctgacctcaggtgatctgccctactcggcttctcaaagtgctgggattacaggcatgagccaccacacccagcctcttctttcttaatgtaagtatttatagctaaatgtttccctctgagcactggtttaactgcgtaagtttggtatgttgttctgttttttctttattcatcttaaagtattttctaatttcacttgtaaattcttctttaaactactggtaatttaagagtgtattatttaatttcaacatatttgtgatttttccacatttccttctgttactgattttcaatttcatttcattgtggttgaagagcacactttgtatgatttcggcctttcaaacgtgaaaaaatgctcattatcattaatcctcagagaaatggaaattaaaaccacaatgacctaccatcgtacatgagtcagaatgactactactaaaaagtcaaaaaacaacagatgctggtgaacctgcagagaaaaggggaagcttatatgctgttggtgggaatgcttatacaccgttggtaaattagttcagccattgtggaaagcactttggagatttctcaaagaactcagaagcacatttggcccaccaatcccattactgggtatatacccaaaggaaaatagatcactataccaaaaagatacatgcactcacattcatcactcagagcacagatggacataaacaaagggacaataggcactgcaaactactagagggaagagggggacgtacgaagtggggcatgggttgaaaaactacctagtagttactacgctcactacctgggtacaacatattcatgtaacaaacctacatatgtgcctcctgtatctaaaataaaagttaaaatgttttttaaaaaaacaaattttgaaaaacttgcatcacccactgtaagcttgatagttttcctatatatgagatggatgatgatattaataaatgtggttatctgatattatataatgaaatatgtcaacatttggaagatctgaaaaaaattcattgagacttattttgtggtataatctatggtctatcctcaagaatattccatatggacttgagaaaaatatggattctgctgttattggtggattgttctatagatgtctgttaggtccacttggtttacagtgttgtttggtgtcactatttctaatgagaaatcaatggttaatcctattagactcccttgtactaatgagttgcttctctctttcttcttttaaaattctctttggctttggcttttatcagtttgattatgttgtgtggatctctttgagtttactctacttggggtatattgagcttcctggaagtgtaggttaatggtttgcatcaaatttcagaagttttcaattattatttcttcaaatacttcaaatgtctttcaaatacttcaaatttccatttctctgtctctttctctcctctcttgataatttcattatgtgtatgttggtacacttaattgtgtctcacagatctctatggcactgttcacttttttcatttgtttcctctctgttcctcaaattgcataatctcaactgatttatcttccagtcgctgaatttttttctcctacctgttcaaatgctgttgagcctcttcagtaaatctttcgattattgtacttttcaaaccagaattcctgtttgatttcttataatttttaatattcttattaatactctttattttgtgaaatattgctctcatggttttctttagtttttttaacatggttcaatttagtctttgaacatatttaaaacaaccgatttaaaatctttgcctagttaatccaatctctaggctacctaaggacagtttatattcattgttttttctcctgtgcatgggccatgctttcttgtttctttgcatgtcttataaatttttgtttaaaattggtcacttaaaatataatgtggcaacttgtgaaatgagattttctcacccttccctaggatttgttgtttcaggatgttcagttgtttttgtgtatttgtttagtaaccttttatgaactaattttgtaaagttttttgtattctttgtcatgtgtggcctctgaagtttcttttccctttgcttagtgatcagctgatgattagacagagatttccttaaccattagaaaccacaaatcctcctgtctttgcagaaaaactcttgtgtatgctaggatacaccttcaaccctcatgcaagcagttacaactctgccttagccttcatattctgattctgcagaggctcaaagtcagccaacaggaactttgaacttgctcagattaaacttgcttaggtttcttgggcatgtgcacagccatccatacacatgcatttggtctcccaatttcataagaaaaagtcagaacttttcaaagcctttatccccaaagtatcttattacgcagcttcttcccaagaattttagttagtcttttgctcacctgaagtgttatctattgcatccaatgaaagcaactaaaatatttgcttataaatgcttttgactaatgtaccagtactgggtttactattttagtactgtgtaagttctgagttaggtgagataaagataaatcttttgagctggtctttcaagaagctaccagatatatttatctgttttaatagatatacccgtagcagaaatgcaggttttatttccaggggtaatgctgatctgggaaacataagatagaaccagattaagttttttttaatccataaaactcactgtccttacagagattcagcttctttctcttgacaaagtgctcttctaatcgctacaagcttttggttaatttccaaagtgctgagaaagttgattctgaaagttttggccagttttttatttgcttttatggaggggtgaacttttaaaagtccttactctgccatttttccagctgtaggttttcataatgtttctatatttagggttcactgagcttctgcgatctagagatttatagttttcatcacatggaaaattataataactattgaacactgttgttgcaaggcttatcaatagtttacataaggagcccacaacaagaccttgcagatggcactcaatgaaaattattattggatgtatgccagacacacagtgagaaaaagaatcacaaaatttgctttctgggaactcaaaatgtatttcatttttatttcttccaaaaaattcccatgttttccttgtcacagtttgttttatttccattccttattttccccaaatatctatattttcctccttgtcccctatgcatttatctttctttgcataccaagaagttgtatcccattcaagtccctattcaagatttccttctgggaagcccacccacaattttctttgtaagaaacatgagatgaatgcaggaaactgcacccatttgaaccaagtaactgagaaatacacaaaattcacacatgcacgcaactcaaacctactaacttcctaagttcactgcatgtgttagggacacattcatccacatctgctattaagtttctgtctgatttcaaataacctttgatatagtttggatgtcctgcccaaagctcacgttaaactgtaatcctcaatgttggaggtagggactgatggaaggtatttggatcatgggggcagatccctcatgaatggcctgggccattcccttggtgataagtgagttctcactctgagttcacacaagacctgatcatttaaaagtgtgtggcatctccccttcccgtacactctctcttgatcctgctttcgccatgtgacatgcctggtcccatttcaccttcagccatgagttaaagcttcctgaagcctctctgaaagctgaactatgtaggtgtcatacttgtacagactgaagaaccataaaccaattaaatctctctcattataaattacccagtctcaggtatttgtttatagcaatgcaagaatggcctaatacaaccctccttccaccacttcacaataactcacaagctacaacgtttatggcacctatttttacaagcaaacttcagttctttttcaaggtaaagtgctttatttacatatttattaaacaggcaaggacttttaccctccacagagtgaattaggagtactgggatggtcaaaaataattcatggtgactatagtagaatcaagagtgtaaggcactgtgataagtgttaatgagtcagagtccagtagtgtagtggctagtagccactggtgacagccaagtgccagtgtgccagtatcacactctttctgtggagaaatcttgactgtgctttgtgtttcttggttcctattttctgagtctgatctccagccctcctgtagtttctgtcaactaacttatatccccccaataaatccaataagtcccgtttttatttaaattacatagtttcgttctgctatttgcagtcaagaactctgacaatttcaaaagtcatctatttctagccctaatctctgtcacattagcaatgatcttgataaatcaattccagaagactcaaaagctaaattcatgtgtgttaataaatcatgtagaaccttaaaatgcttgaataacatgacctcttttaaatttgaaattgaatcacatattgctactatttacagaaattagagctcaagtcagttagactaaatttcttatctagaaattgacattttcaagaaattgggagattaattttttaatttaaaaaaggtaaaagctgataaaaaaaagcagtgctatattcaactagctggtttcaaatgaaatattaatgaaactattttgcataacatttggcaagaaaataatgttaactacctcagttgtgaatattatcaagcttcagagaatttaataaaaatttttcatattattgcgcatttcatgacctcttctccttcaaatatcatggttttaaaaacactgatactctgccttttctcccaaatttaaatttctaaccttgatatctccctggtaccccaaatttctatatcaaactacttacttaatatagcctgattttctaccctaccccccaaatatgctgctttcctacacttctccatctctgaaaataagaatgccatacctctagctgctcaggcaaaaaaaaaaaaaaaatgactcctccttgactcttctgttattcttatacctgccacccaatccattagcaaactccttagctcagatatagtttggatatttgtccccaccaaatctcatattgctatgtgatccccaatatgggaggtagggcctagtggaagatgtttgtgtcatgggatgaatccctcatgaatggtttggtgcccttcctgtggtaatgagttactgcaagatctgattgttaaaaagagtctgggacccacccctcgtctcttttgctccctctctcaacatgtgacataccagctcctctttccctctgccatgactaaaagcttcctgtggcctcaccagaagctgagcagatgcgggtgccaggcttgcacagtctgcagaactgtgagccaaataaacctcttttctttataaattacccagtttcaggtattcctttacagcaacacaaaacagactaatacagtccctatcttcaaaatctagaatctaaccactctcactattcccacttctcccacaccctaatctaaaccataactatttctcacctggaatattacagaaaacctccaactcctctcctacattttcttccttgcatcctctcagtcaattctaaatatataatgcagagatgatcattttaaacataagtcagaccctattattattattctcaaaatctggattcctacctcattcacaaaaaaaaaaaaaaatctttataatggccaagaaattccataatctgtcttcccaccaaaactaagcatttcctactactgtttctcaatcaggactgattgaggtcaagtgcagtggctcacacatgtaatcccaacactttgggaggctgaggcaggaggatcacttgagcctgagagttggacactagcctgggcaacatagggagaccccatctctatgaaaaaattaaaaattatccaggcttggtggtgtgcgcctgtggtcccagccacttgggaggctgagatggatgggaggattgcttgagcccaggaggtagagactgcaataagccatgattgcaccactgcactccaacctacatgacagagtgagatcctatctcaaaaaaaaaaaaaaaaaaatagtgactgagtacatcacagtgtgctcctggtattcctggaatgatctgggcatactactacctttgcatttgcattgcatttgcatttgctttctcctttgcagataactatacaactcactgtctcagctccctcaagtctttactcaaatgtcttcttaaataggactttaataattactctatttaaaacagcaactcttcttctactttatggtgctccagattacccttcctggccctatttttctccatactatacatttgtatattgctgatatctaccatgtaactacaaatttcataagagcaggaatatctgtctgactttaacatctagaacagcatttggcacactataggtgctccataaatatttgttctattaacaagcaaattaatgaaaagcttagaaaaatataatgaataattgcatcaataagaatactttttaatgatagttttacatttgttgagacagctgagattcagtcaagaattctaaaagaaaatgttcaaatatgtaagaaaaaatgtatctcagaagtcctctagattaaacactagaagctaagtcatactattaaaagagatccatatttttattctgtcaaattgtcatagtattgcaaatatcatatttttatattatcagcagtaacctcaaaaaggaacagaacatgtaaacaagtaaaatttgcatactttaataggtctatcaattttaaatgatgctgttttgattgttgcataccagcaaactccaagagattgcctagcaatgcaatagcataattaacctgatgtactttcctgacctcataaatcacactttctgatcctctgagctcttggcacaaagaccctggaaagaatataaaatttctactgaattaactataaatttttgtaaacccaaagatccattttaaatggattttttgaacatagtacttttcacaaagaatctaataattttgatttaaaagaaaaagcaaaaacaaagcaactgttaacgtacttagcttgtcaaaatttaaaagtcaacagtcagtaggaaattagcttttccctcagtcacaaaattgtatcagcttatgttatagtccatgaactctgctaagtgttaggattaaaagagtgaacaagacaaccaagttctttccttcaagaagatgacattacagttgggagggaacacatcacaaataaatataaatatatatgttgataagtacaataaataaaaattatctagagtaacagaaaaaagagtaacgggagaagggtggctattttagatggaagtaaggaaaggcttaagatggcaattgagcagacacataaactagtaagaaagtgggcaaagaattccacacagaggagacagcatgtacaaatgctctgaagcagaaagtttattcaaggaaaagttcaagtccaacataattggagaggagtaggcaatggggggcatgttagtagaagaggtgggagaagtagctaggattcagattatgtaaggccttagagtaataaggactttgattttgtttagaaagtgacaggaagccagtgaaagatttttaaaatactgagataaactaacttttgctttaaaatatcactctgtatgctatgcagagaacagattggcataaaagtgaaaacaaatggatacagttaagaggctactgcagtagaccagataagagactatagttgctcaggacagtatggcatgatggagatagtaagaaatggtaggattccggacttaactggaaattctgccaacaagatttgcaaatagattgtattggggtgcaaaaaaaagagaaaaatcagtgatgttgcctgtgttctgagtgtgagtaaactggataaatgatgatatttattgagatagtgaagactaggagaaaagcaagttgagtgtgagcaaagggaggaattaagagtccagttttggccatgataagtttcagaatgctcgacagacaaccaagtggaagatgctaaataggcaatagtatatatacaggatacaagtcagggatacagatataaatttgggagtcataagccaatagatatttaaaaccatgggattgaatgaacctacctaagtacagagtataatttttttaaaaatgaggtaaggaaatcagagattacataaacaaatagaaaaacattccatactcatgctcatggataggaagaatcaatattataaaaatggccatactacccaaagcaacttatacattcaatggtattcctattagactaccactaacactcttcacagaactagacaaaactactttaaaattcatatggaaccaataaaaagcccaaatagccaaggcaaccctaagcaaaaagaacaaaactggaggcatcatgctacctgacttcaaactatactacaggcctagagtaaccaaaacagcatggtactggtataaaaacatacacacagacaagtggaacagaatagagaacccagcaataagagcacacacctaccacaatctgatcttcgacaaacctgacaaaaacaagcaatggggaagggattccctaatcaacaaacagtgctgtgataactggctagccatatgcagaagactaaaaccaaaccccctacttatactatatacaaaaattaactcaagatggactacaaacttaaatgtaaaacccaaaattataaaaaccctagaagacaacctaggcaatgccattctggacatgggaatgggcaaataattcatgataaagatgccaaaagcaattgcaacaaaagcaaaaattgacaagtgggatctaattaaactagagagcttctacacagcaaaggaaactctcaacagagtgaacagacaacctatacaatgggagaaaaattttgcaaactatgcatctaacaaaggtctaatactcagcatctataaggaacttaaacaaattcaagaaaaaaatacattaaaaggtgggcaaaggacatgaacaggcacctttcaaaagaaaacatacatatgccaacaattatataaaaaaaggctcaatgtcactgatcattagagaaatgcaaatcaaaactacaatgagataccacctcacaccagttagaatggcaattactacaaagtgttaaaataacagatactagaaaggttgcagagaaaaacaaaagcttatacactattagtgggagtgtaaattagttaaaccatcatggaagacagtgtggcaattcctcaaggacataaagacagaaataccatttgacgtagcaatctcattactgggtatatacccaaaagaatataaatagttctattataaagacacatgcatgtgtatgctcattgtaacactattcacaataggaaagatatggaatcaacctaaatgcccacagatgatagactggataaagaaaatatggcgtatatacaccatggaatactacacagccataaaaaagaacatgattatgtcctttgcaggaacatggatggagcactggaggccattacctttagcaaactaatgcaggaacagaaaaccaaatattgcatgttctcacttataagtgagagctaaatgatgagaacacatggatacatagagggaataacatgcaatggagcctttcgaagggtgaagggtaggaggagggagagaataaggaaaaataactaatgggtactaggcttaatacccaggtgatgaaataatctgtacaacaaacccccatgatacaagtttgcctatctaacaaacctgcacatgtatcctcgaaatcaaaataaaagttaaatttaaaaaaaaagagagagacctgaggacttagcctaaggtgcttctacatttaggttagaagaaaaaagtgaacgaagtggtatgtacaagaaggtggacacgatcaggtatgtcaaatgctcctgaaaataaaaattcgccaatgaaatttgaaacatggaggtctctataaccttgataagtatgtgcaactttacttgtaccttgggtggagagtgaaggacacaaaagcatgatatggggtagcttcaggagaaaataggagatgaaaaggcatgaactgtgaggacaaacaacttttttttttgagacagagtctcactctgttgcccaggctgaagagcaattgtgcagtctcagctcactgtaacctctgcctcctgagttcaagcaatccacccacctcagcctcccaaagtgctgggattacaggcgtgagccactgtgctcagccataaagaactttgtatgcattttgctgtgaaggggttcacagaaataggagagaagcctgatatggtttggctgtgtccccacccaaatctcatcttgaattgtaactcccacaattcacacatgttgtgggagggacccagtgggaggtaattgaatcatggggttgggtctttctcatgatgttctcatgatagtaaataagtctcacaagatctgatggttttataaagaggagtcccactgcacactctctctctctttgcctgccaccatccatgtaggatgtgaattgctcctccttgccttctgccataattgtgaggcctccccagccacatggaactgtaagtccattaaacccttttttcttcccagtctcaggtatttctttatcagcagcataaaaacggactaatacagggccacatgacaagaactgtggctttatgtagaagaatgcattcactgccaaatcatggcccagaagtaaggcagccaggagaagaaagatcccaacttctctttcttcccactcactaatgacccactagtaccttgcattggccaaactcaaacagaagtcagagaacaacagaagacaaggtaaagggagatgatagatgaagggaatggattttaaagatgacaatagtagcaaacacttattgagcatttattatgtgctaggcacagtgagaaatgcaatacacatattaatttatttttcctgacagcaatcttattaggtgaatacttttattatcatccccaatttacagaaagcaaaactggggcatggaatggctataaaactttcctaaagtcatacaacttgcaagtggcagaggagccagaacacaaacccaggcaatctggctccagaatccatactcttaacccttacaccaaactgtttaacagaagatgtttgtgtgctaatgaaataattaaataggaaaataaaaattaatttcaaatagaggaagaatgatattctttgagtaaataaggagaagtcaggacataacctgccatggttcttctccatttgtccttacagattatgtttcttccattatctaccctgttctgtgccccaggaggctgacctcaacagactgtatcatctagctcccttatcctctggcttccaactggggtccactaatgggggggcaccagcaggaaatcagggaagggaagaaataggggttgggatgttcattcccccagctctcttcctaccgggccctgatttagcagtggctgtgctcctcttcctaaagccatagcttctgtcaggcagccccttcaataatactgtactgtgttacagtaacagctcgctctccatgctccttaagcagtctcaccgttcctagcccaccagtgcttccatccctggttggctcccttaactccgctcatacctttgtaatagatctttcacttaaatctctttgagaacgccttctctggccaggcacagtggctcatgcctgtaatcctcgcactttcagaggccgaggcagacagattgcctgcactcagttgaagaccagcctgggcaacatggtgaaaccccatctctactaaaatacaaaaaaaaaaaaaattagctgggcgtggtggcgtgcacctgtagtcctagctactcgggaggctgaggcaggggaattgcttgaacctgggaggtggaggttgcagtgagctgacatggtgccactgcactccagcctggtgacagagtgagactccgtcttaaaacaaacaaaaaaacaaacaaacaaacaacaaaaaaagagaaggccttctcttacctgctaggactatgactgatattctaaccaggtggaacatttgacagataagaggagagaccatttgttcactttaataaaagggaaggcagagtatatggatgcagatgtaggtaagttggtagattgagtcgtgagacaatgagaaagttctcttttgtttgtttttattgtctcaataaaataagaagaaaggtcagcagctaatgttgaagaaggtgaggtatattgcatttgaggagaaagaatgtacgaaaatgttccctgggagaacaagtggactgtctgaggaagtgtaataggcatttggtcataaatttaaagtgaaaacagttaacagtatttctccagctatatttgtctgccttgatgtaggcatagaggagacatacacaggttgatgaagaggctgatttttgccccccaatgaagagaaaaacaaagaaattgaagatgcatgcaaattgagtaatcacagtaatgaaccatgtattctaagtttggtgaggtaggacatgaagacttacggtagctaacaggcatgaaaatgtgtagagccaatgatttagtagtagttgtgggatcaatgattgatatgggaactatagaaatgaactgggtcaataagaggaagtggtaagtggtggtcagagagtgggacgttttaaagtgagatgttagagcctatgaacaatagtaagatatagcataaaacataagagtgggtggctaagatgctgtggaggaagaaattattactggataggcaatcaaggaacagatccaaaaactacataatccacaaagacaaaataatgatgataatccaaatttgagagtataaaatcatgtagaatattagtgtccaggctgggcacggtggcttattcctataatcccagtattttgggaggccgaggcaggtggatcacttgaggtcaggagttcgagaccagcctgggcaacatggtgaaaccccatctctacaaaaaaaaaaaaaaaaaaaaaaaaaaaaaaaaaaaaaaaaaaaaactcgtgcagcaactatttctgaagcacaaggcttattttggaaattatttttgaataacttttttttcaaaactcaaggctttgctgaaagcatttaatatgcagtataatttgtttctgtgtgttttaaacttttagggactcatgattaaggcattttgtaaggactggcataccctctggagtttgctggctctaggtacattagatgattcaatttgcaaatatatattcctgcaaagagagttctaaccttatgattttgtgaaggcttattgttttgacagcaaactagaaacaatatcagctagaacctggggaatcaagaactagaaaccaggggaaaaaaaaaatatatatatatatatatataatatatgtgatgtgtgtgtgtgtgtgtgtgtgtgtgtgtgtgtgtgtgtgtgtatatatatatatatatatatatatatatatatatatatgttttgtttgtttttaaacagggtctcactctgttgcccaggctggagtgcagtggtgtgatcagagctcactgcagcctcaacctcccaagctcaaggaatcctcccacctcagcctcccaagaagttagaacaacacacatgcatcaccatgaccagctttttgttgttgttgttgctcctgttgttgttgttgttgttgagacagggtctcacaatgttacccaggttggtcttaaactcctggcctcaagtgatcctcccacctcagcctctcaaagtgctgagattaggggtcttaaccaccatgcctggactgaaatatattctatatggtatatctgtaggttattattgaaatgtttggaattcctaacacagtctaagaagttctgtggcttctgagcagagagcactttctgatgtaaaagtgaaatgtttccttaagaaactcttaggactggcccttatagatgaatactcctcattctctaactcttctatctttcgctaggagccagaactgacaggataaaggagaagcctatgagatactcatgagatactttctcttccactgctctttcttttggttggtccttttagtcaatacccaataccaaattggaaaggagtataaaggtgaaaaccagcattgagatctacatgcctcagtgtattggggttgcaaatctaagttgcgtcacaccacatatctgcaaagaaaatgtggttttttaatgtgtttatgatttttttagatgcttcacaagctctcaacccctggttaattgggaaaagtaaccatctaatccagtttatttttttctaattttaatttttgtttttctttcaatagttttagagaaacaggtggggtttactgcatggaaaagtaatttagtggtgatttccaagattttggtgtacccattacctaagcagtgtacttgggtacactgtacccaatgtgtagtcttttttccttcaccctctgccctcttgatgcctctccatccttgtagcttggttcccacttataaatgataacatacaatgtttggttttccattcctgagttacttcacttagaataatggtctccaaccccatccaggttactgtgaatgccattatctcattccttttatggctgagtagtattccatggtgtgtgtgtgtgtgtgtgtgtgtgtgtgtgtgtgtgtgtgtatcacattttctttatccactcgttggttgatgggcatttaggctggttcacagttttgcagttataaattgtgctgctatagacatgcatgtgcaagtgtctttttcatataatgacatcttttcctctaggaagataaccagtagtgggattgctggatcaaatgatagttctacttttagttctttaagaaatcttcatactgttttccataatgattgtactagtctacatccccaccagcagtgtaaaactgttcccttttcaccacatccatgtcaacatctggtactttttaaatatggccattcttgcagtagtaaggtggtatctcattgtggttttgatttgcatttccctgatcattactgatgtagagcattttctcatatgtttgttggtcttttccatatcttcttttgagaattatctattcatatccttagcccaccttttgatgggattacttgttttcttcttgctgatttgttttcattccctgtagattttggatattagtcctttgtcgaatgtatagactgcaaagattttctcccactctgtgggttgtctgtttactctgctgattatttcttttgctatgcagaagctttttagtttaattaagttccatctatttatctttgtttttgttgcatttgcttttgggttcttggtcatgaggtctttgcctaagccaatgtctagaagtgtttttccaatgttatctcctagaatttttatggtttcaggtcttagattgaagtctttgatccatcttgagtggatttttatatacgatgagagatgaggatccagtttcattcttctacatgtggcttgccgattatcccagaaccatttgttgaatagggtgtcctttccccaccttatgttgttgttcgctttgtcaaagatcagttgactttaagtatttggctttatttctgggttctctgttctgctcctttggtctatatgagccctacctaactttttaattccaatttggatgccctttcttttttcacttgtctgattgctctaagtaggacttccaaaactatgttgactagaagtggtggaaatgggcatccttgtcttgtttcaattctcaaggggagtgctttcaacttttccccattcagtataatgtttgctgttgatttgtcatacacagtttttattaccttaaggtatgtcccttctgtgctaattttgctgagagttttaatcataaatgagtgctggattttgtcagatgctttttctccatctattgagatgatcatgtgatttttgtttttaattctgtttatgtgatatatcacagttttttttttttttctaagatggagtctcactctgtcacccaggctggagtgcagtggcatgatcttggctcactgcaacctctgcctcccaggttcaagctattctcctgcctcagcctctggagtagctgggactacagatgtgcaccacaatgcccggctaatttttttgtatatgttttttgtagtgacagggttttgccatgttggccaggctgatcttgaactcctgacctcatgatccaccctctcagcctctcaaagtgctgggattacaggcgtgagcctccacacccaacctgtatcacatttattgacttgcagatgttaaaccatccctgcatcctggtatgaaaaccacttgattatggtgtatgatccatttgatatgctcttagatattgttagctagtattttgtggaggatttttgcatctatgttcatcagggatattggtctgtagttttctttttttgttatgtcctttctgggttttggtaaatcccagaatgatttagggaggattccgtctttctctatcttttggaatactgtcaataggactggtaccaattctttgaatgtctgatagaattcagctgtgaggccatctggtcctggacttttttttgttggtaactttttaattactctttcaatttcgctgcttgttattggtctgttcagagtttctatttattcctgatttaatctagaagggttgtatatttcttggaatttatccatctcctctacattttctagtttgtccacataatggtgttcagaacagtcttgaatgatcttttgtatttccgtggtatcagttgtaatagctcccatttcgtttctaattgagctcatttggatcttctctcttcctttcttggttagtctcacagtctatcaattttgtttatctttcaaataaccaggttttgtttcatttctcttttgtatttttttgttttgatttcatttggttctgctctgatctttgttacttattttttctgttaggtttgggttggtttttctttgtttctctagttccttcaggtgtgactttagattgcctatttatgctctttcagactttttgatgtaagcatttaatgctatgaactttcctcatagcactgcttttgctgtgtcccagaggttttgacaagctgtgtcactactattgttcagttcaaagaattttttaatttccatcttgatttcattgttgacctaaagatcattcaggggcagattattgaatttccaagtatttgtatagttttgagggttccttttggagttaatttccaattttatttcactgtggtctgagagggtacttgatattattttgattttcttaaattaatattgagacttgttttgtggcctatcctatggtctatcttggagaatgttccatgtgctgatgagtagaatgtatattctgcggttttggggtagaatgttctgtaaatatttgttaagtccatttgttctgggtatagtttaaatccattgtttccttgttgactttctgtcttgatgacctctctagtgctgtcagtgaagcattgaagtcccccactattattgtgttgccatctatctcatttcttaggtctagtaataattattttataaatttgggagctccagtgttgggtgcatatatatttaggattatgatattttcttgttggatggatctttttatcattacataatgtctccctttgtctttttcaactgttgttgttttaaagtctgttttgtctgatataagaatagctactcctgctcacttttggtttccattttcatggggtatctttttccaccccattaccttaagtgagttcttatgcgttaagtgaatctcttgaagagagcagatacttggtgggtggatttttatccatgctgccattctgtattttttaagtgagcatttaggtcatttacattcaacataagtactgagatgtgaggtactgttttattcatcgtgctagctgttgcctgaacatcttgggttttttctttttgttagtgtttaataggccctgtgagatttacactttaacgaggttctattttggtgtatttcgaggttttgtttcaggatttagatctcgttttagcatttcttgtggtgctgacttggtagtgatgaattcactcaacatttgtttgtctgaaagatgaccttatctctccttcatttatgaagctcagttttgctggatacaaaattcttggctgaaatatactgtgtttgaggaggctaaggatagaccccaattcacttctggcttatagggtttctgctgagaaatctgctgttaatctgataggttttcctttataggttacctgatgctttcgcctcacagctcttgagattctttcctttgttcttgactttatataacctgatgacaactatgtgactgggtaatgatctttttgtgatgaatttaccaggtgttttttgagcttcttgtatttggatgtttagttctctggtgaggccaggcaaggtttcctcaattatgtttcccaaacttttagatttatcttcttcctcaggaacaccaattattcttgggtttggttaacataatcacaaatttcttggaggctttgttcatttttttttctttgtcttttttggattaggttacttcgaaagccttgtcttcaagctctgacattctttttcctactcattcaacatcattgttgaaactttctggtgcattttgtatttctctaagcgtgtctttcacttccagaagttgtgattgttttttctttacaatatctatttctctgtagcatttttcatccatatcctgtattgttttttaaatttgtttaaattggttttcccctttctctggtatctccttgagtaacttaattatcaaccttctaaattctttatctggcaattcagagatttttttttattggtttgaatcaattgctatgaagctagtgtggtctcttaggggtgttgtaaaacctcatcttgtcatattttctgattccttctcatttgggtagactatttcagtggaaaaatctggaactcaagggctgctatttagattcttttgtcccatggggtggtcccttgatgtggtacactgccccttcccctagggatgaggcttgctgcaagccagactgcagtgactggtattgctcttctgagtctagccaccgagtacggctaccaggctccgagctggtgctggggaatgtctacaaacagtcctgtgatgcgatccaccttcaggtctcccagccatggataccagcgcctgccctgttggaggtggcaggggcgtgaaatagactctgtgagagtccttggttgtagatatgtttagtgtgctggctttctcaaatgctggttatgctagcagtgacactgtcacgtggacagatttaggaccactggttagccaggatgttgcagggcacacggaattagctgttgttttcctcttccttggagcagcgttattctgtcattgagttgctgcaacgtcctgagttggtcagactacaggcagaaggtggtgctttcaagagagcaccagctgtgatagaagaggggggatataagcttgccctaagttgaccaagataagtgttcaggtttctcaagtaatgggcggggtcataaagctcccaaaagtttatgtctttcatgatccactactgggtatagagaaatactgtcaagtcagggcagggttaggcagatctgagctcagactccccttgggtggggcttgctgcagccactgtgggggtgtgggaggggtggttctcgggttaaattccaaaggggattatggctgcctctgttgccaggaaagtgagggaaagccagtagcgataggccccacccagcttttacccagttggtgaggcctgtctcactcccactgtgccatctaaaaccactgagtttgtctccaggcagcctgcacatgggactcagacctagccccaagttataagtttcccagctgagaaagcaagcagggctttcaggttacacccctccccatctgcccacattgtcccccatgactcctcctctcctttctgccgcagttcctgcttgcccccacattctgctcaagagagtttgtgcccagtcaaaattattgtaaaaatcacaattacttttgcgtagtatctaaacattttttaatatagtataataatatgaatttgatcagctcaagaaacttctaatgattttaactgtttaatccaaataaccatttacttcaaaggactcatcacaattatacttatttaatatcttacttgtttaatgtagtagacaatgagctccatgaaaacaaggtgtacatctctctcatcactaaaaccccagagcctaatgtggtgtctctttgatagtgggagatcaaatgtattttttcaaatgaaagaaatttaatgaagaactgttcattccatgccagatttggctgaattagaactggtccctgcattcaagaagctcacagtctgctgagggagagcaacatgtaatcaataaacaatagtacaatataataagtgctgtgccagaaatataaacaaataccatagaaacataagggaagaagtgattaattctgcttaaaggtagaaaatattaagaagtttttgaccaagtaataaatactcatttccttgggatggatgtttatactaagaaataatgtctatatcacattctattaacttgattagttccacagttcagtaaaacatattctatattgaaaaatttttttagatattactacgctatttcaggacatcttgaaagggcttattcctaaaataatcttttagaattttttttatattctctctctctctctctctatatatatatatataaattccctgaaagtagttcaacaacaaaaagtaaaattcaaggctataatattaataatactagtttgcttgctataggaaaacctagatgagaaagcctattgcttttttgccagctaccacatattagttacagtgatcatcaccaaattttcacttattatgtacttaacagaaatcaccagatcctttcacactcccaacaatagctttggggtttcactatctcactatatagggaaatctcatatgcactcaaaataaaagatttttttcctatattagctacagcacaaataatagcatccttcatttagaaacaaccagcctcatactcatctaaagcacataaatttagttaaatggtgccatctggtgacataaatcttgcagtaaatataaaagtcctgagtcagagtccagaatgatacccaaccctcttgatggcatccaatccaaagtgtctaatttaacttaagaaatacttgatcctgcctgacatgaaacacacaactaatcacactcagtatatggccgtttaacaaagggaattataacaattgtttgagccacattttatgctcaccactcttgtttctcaactctttggaagagacttgtatctaacaggatgccctatacaactcctagaagacattttaaaagcataaatatcaaggacattttgaatccctgttccaggcagatccatttcctcactctcctttgaacgtacatcaatgtgtataattttcaacacttcaaaatgtcacttccttaagaaagctgtcgaccaggtgtggtggctcacgcctgtaatcccagcgctttgggaggccaaggcaggcaaatcacaagctcaggagttcaagaccagcctggtcaacatggtgaaaccccgtctctactaaaaaaaaatacaaaaattagctgggcgtggtggcacatgcctgtagtcccagttactcaggaggctgaggcagaagaatcccttgaatgggaggtggaggttgcagtgagccaaagatcaagccactgcactccagcctgggtgacagagctagacttcatctcaaaaaaagaaggagaaagctgtccctgtttctactgttaaggttaagcctctcattcatagccaactctacttcttctttgtatataaactcttgacgaaattttgtttaatgcttgtctccccagtgtgtatcatagcgtttggcaaagtgttcaataaatatcctgtgaacgaattaatgtgtaaatggatggtgaaaacatccttctctactctctcttctaatgcaaatcctattaataacaaggctcagctcaagtttacattttatataaaaccttctctagcaacaacaatgtacaataagcccatgcttctcctatgccattttagtctagccccaaaaatttagtcctccactatatgatgttttgtattgtttttcatgtacataaatattactttcttaattgaccttaagctccttaagtgtaggcatttggtcttaatagcatccatctgcataagtctatgtaaataagtaaacacttcataaatactttgataactattattattcaattgcaataactaaaacacttgtactctttttatttaaataagtattgtaaacaaataagtagaaacataatagaccttagcaactaagaatttcaccttcactgttttgaacagtcaagacttatttaaagatccatgatatgtaatttgtttgtttcaactgaagcacatgctttgagattgtgagtggcagcaagcattacctaggaaatgcctctctcacatgggccagcaacaacatatcaatgtagctttatccatagagatacttattgtaacagaattctatccatagaataattattgtaacataagtagaaactatcttgtaacataaatagaaactatcattaattatccaaagagaaaaaaatcccttaaatgttttagatattctattgtaaggctgggtgtggtgcctcatgcctgtaaccccagcactttggaatgccaaggtgggagaatcacttgagcccaggagttcaacaccagcctgggcaaaatggtgaagtctcctttccgcaaaaaaaattcaaaaattagccaggcatgactgcgcataccagtagtcccaggtaccagggaggctgaggtgggaggattgcttgaccccagaaagcagaggttgcagtgagctgagactgcaccactgcactctagcttgggcaacagacaagactgagaaaaaagaaagaaaagaaaaaaaaagaaaagaaaagaaaaaagaaggaaggaaggacggaaggaaagaaaggagggagggagggaaggaaggaaaataaaaagaaaattaaaaataaaaagatatgctactatattttaaaaagaaaattggacaccataatgataattgtgagtttatggattacaaagtactcaagatatgtcccagaatgataatggctcattatagtcgttacagattaaatcagatcctataaaacacaagaaggaaaaaatgccactgtcatattctcccaagtttagtaataatattcacacactgttaatatattactttccctgaatggccaaatacctaaccatttagaacataggttttcaaattttaacatgcctcagaatcacctgaaaggattagtaaagtaccatttgctgagccctacttccagagtttcttattcagtcagtaggtctagggtgagaaccaagaatttgcaattctaaccaagttcacaggtgactagtgctgaggtccaagaaccacatcttgagaatctctctttttgaagattacagccaggttgtttcaccattaatctttaaatgggttaacaaaaaaagatataaataaactaaaagaataataaatacagccaagttgctccaaattcacacaactgtaggggccttcacacccactatttaaataatccttcacttccttatgatcagatggcaaaaaatacacattatgattaataattaagaccaaaatagccgtgatatattcaaagagatgttattttgaaataaaattactacattcgaattactattaggaaaatatgtagggttttttttactcaaactaaaactcttatacatatttattttatagaccttaccatcattataattgaataataattaattgtgtgtttaatgtctcttttcccctacttgtccataagggtattgactgtcctctatagcttactgttgtatccctattgcatagcacaatgtccaacacataactggtatttttaaaagaagtgttgataaatgaataaaaatttattaaaagtctattataattattaaaggtccacattatggggatataaaaaggggcagaagtatattcgatttaccataaggcaatgtgataaatgctttttagtaatatgaaaaaaatgctatgagatacaatgaaagggctagttaaagctgccagcaagtaggaatgtgttagaaggcttcaacaaagagatgataaatcccaatatgtaatacatctgctgtatcacccctattgctagtaatctccaaaatccacaaggttctctgttaagatttatggaaatgaaatgtactctattctaacacaaagtctaacatgtaaggtttaactgcctccattaaacaagataagcccttttctaagattttgccactggtagagtttttttaaagtatcatttaccgcttgttctcctctaatttccctctaattcctctccaaaaaattccccctcacacactgggaagaaatataaggcaataagttagataaacaagactaatatgattttagaaggggttgaaatctgtgaaatatatctatagttatttccatactttataagtaatgactaaagaataacacataattttcaataagttacaaaaaacatttgtgttacatatctaaaatttaactaacccataatattatttatttaaagtcttcaaaaacaattatggtggtaatatagttgtttaaaaattaaaagtcaatttagaagtacaaaaataatttttaaaaatgattcaaggccgggcacggtggtgcatgcctgtaatcccagcactttcggaagccaaggccagcagatcacaaggtcaggagttcgagaccagtctgaccaacatggttaaagcccgtctctaccaaaaataaaaaaattagccaggagtggtggtgcatgcctgtaatcccagctactcgggaggctgaggcaggagaatcgcttgaaccaggaggcagaagttgcagtgagccgatatcgcaccactgcactccagcctgggcaacagagtgagactctgtctcaaaaaaaaaaaaaaaaaaaaaagataaatcttgcttctttatcacctaactgaagaactgaagaataaataacctaataaaagtgccttgaaaatcttaatgttttatatattctaaataaaagagatttacatattctaaattaatttgtaaaatatcacagaattccaattccatctaaatgtgcagcttctagtatattgccattttaggtttgttttgttttggaatattaatgaacactgattattattattttatttagctattctaaacaaagagacataaattaatcataaaatattatggaattccaattctcttatattcaaattctggaaagtgttgatgctgtaatcatcttaaaactttattcatttggataaatgtttccttagtattaccacaagatgtcaccctaagcctagcatctaaatgtgcagcatctagcatattgctgtttcagggttttttttattttttgcatttggtttgggcacactaatgaacaccaattgctgtctttcaaaaaattaaagtgactttttctactctcagttattggcaaataaaaaatcaaaataaataatacagggactctagaagaaaggaggaagaaagttaatcaaacagttcattctccatgcttatcaggtatcttgttacttaccataaaagcaatgtatttaaccattgaattttatatgattttactttattttcaaaaatattaaaaattaataaatgttacttttataatcaaagttatgttacaaaataccagtcacagttatgtacacagaattcctcaaagaagataccatttaaaacatgctagtatttttttaagcatatgatgaaggaccacaaaaggaagacattattcattttatggtgatgcttttcagctgggggcagtggctcaagcctataatccaaatactttgggaggttgaggtgggaggatcacttgagcccaggagttcaagaccagcctgggaaacatagcgagaccccatcgctactaagaattgaaaaataagggtcaggtgcagtgattgacgcatgtaatcccagcactttgggaggctgaggtgggtggatcatgaggtcaggaaatcaagaccatcttggtcaacatggtgaaatcccatctctacaaaaaatacaaaaaattagccaggtgtggcagcacgcacctgtaatcccagctactcaggaggctgaggaaggagaactgcttgaaccgggaggcagaggctgcagtgagcccagattgtgccactgcactccagcctgagcgacagagcgagactccatctcaaaaataaataaaacaaaataaaatagagtgatgattttcatctgtagagagagggactggcttccttgtcacatgtaaatattacagcatgttctgcagtaatggtattttattatccatttgtgttttctacattatgattctcttctatttctacagctaatgagagtcgtgcgaggtactatttcaatgtgttggctatgtattggccagaataatgggtgaaaccactatcttgcactacttgtaacaggaaaaaaaagggtaggatggggtgggggagttggttcaaacagaatgcaaattatagaccataacaatgcgctatatttcaatggctccctacctatcctttacaaagatataaatcttctctaggatgcacaagtctacatggcttttcttcttttgtgtccttaaagaaaatgcacagtaagaccgcccaaacattcaataataatagattactaatcagtacataggtgcccacattgaattcaaaagaaaattatgttttgttgtataatgttgctctcttgtttgcactctggtttatcctaaaatgacttttaacgaccagctgaagtaaatctatccattcaaagctgggcactgggattacttacataacagctttttacagattattgttgcctctaattttactagagaaattcaaactacattattggcgttaagccaagatatttatcattcacttaaaataatggcaaaatacaattgtcactcatttgtctttgtattccctgggtaatggtgttacattatcaaatgattatattattaaaaatatagtagagttatctaaattatccaacaataccctttctaaatcaagttctcaaaaatgcaaattctcaaaagacttagccagtcttaagtaaacacatcatacaagtctgttaagatacattgccatttagttaatgacctttactaattatcaactattaataaatattaattttatcaaaaatttgatgtttaaaaatgttctcaaaaatattatctttgctgaatataaggtttattcaaattctgtaggactccatttagagtttttatttaataccagctaagatgattacagttatgtcattaattcttgctagccacaataaaatattttttaaaagttaatccacaggcaaaataatcctgtaaagctttacacttctatttttattcaatagaccgattttcaaattttcaaaattgaataatttttaaaattacattcaaactataaagttggagtttttatcaaaaagtacagatatttataatgaaaacaaagtattttcataattaagccttataagttcctattttttgattttatatcaataataaccagcatgaaaaagcaatgaaaatatctaggagactcagttatttctttaaaattatttaaaatcagttatttatttaaatctggcaaaatatattgtataattgagtgggtttttcattgtttagttagttggttgtttttttgggaaaagtatttgtttatttatatattttgttaatttattttacttcctaaaatataaaaaagaattaaaagctatttgcacaaatataagagatgtatataaaaaaaaatatataaataaaccatatccttaattttctttacaatctttaataaataggagaataaacataagtttaaacattatatggttagcttcatgacaaattgctaagaattccaaagcactgagattttcatcaataaacttttcaattctggatcataaactttcctaagacaagcaagaaagatgaaaagatgtttttatttttgttttaagaagagagtaaaagtgtaactttgattctgagtagaatgtgaaccatcatttttatgttacacaattccttccctgaaggaagacaacttccttctttagcatatttgtcctcaatgttttataacacactactcagggttttcttctgtgtaaacttttcttcctttatgaaacattctttcaatatttatatctttcaataacctctttttatttatattttcaaacaattcctttctaggttaaccttatataaggaaaaggaaaacaaaaaacaaaataaaacaaaacaaatcttcccttccagtattaaagaaaattatcccagtttgaaacttggttaacatcaggttctttgaccacattattcaaactatcaagcccaattctgaccattaaaatgatgaataactttcataatacatacctagcaaagcttggaataagctgctcttaaagatacccatcacctttttaaccgcatttttcaacagctgctcctctggtttccttaattttttgcagtattcttccagtaatgataaagctcggtcagtatctgaaaaacatgatattattattatattttatggtcttagcaaaatagaaaactaacattaaactattctataattgtgttcctaacttaatgacatgaaataacttaataaaataatcataatttctataaactaccatatgaaaataattatactcaatggccaatttcaacaatccagttttatttctatagtcttgtcttccaaaagaatccctaactgtaaaacaaaacaaagaattcaatcctggccacgatgttcaagttagatataactctctcttgtcagagacactgaccttaaaattgatgacttcctgcaaaataatatccaacttccttaacatgacccttgaggcctccctcccatgatcaaatattttcagccttatttcccactatatagtccacactctccaaacacacatacagtgcctaagtcatactggattactcacttttcccttccattttcctctacacgcatgcatgcgcagacacccacatacatacacacacgcatgcacgtgcacacttgctctctcccccacctctctctttctctctctctctctctctctactttttctcacctctgtacttttctttgctcctactgttctctgtgctggtatttcttcccctataccactgtatatactccctagaatcagcgtgctatcttgaaaaggggttcttgtcaggcaaatctaggtatgacccagatcttacttactagctgtgtgtgacctttaacacgttccttaacctctctgagcttcagtttcctcacaggtgttatgattagacaatatatgcacaatccctagcacaatatccagcacacagaaaataatcaagtaagtcaactgaacacctactttctcttcattcagatctaactcaaatgctctctcttccataaagccatctctgatggttaaaattaatcatcattccgtcttcttctaaaccactttgcctatacgaatttgtcggcagtcttaaacccatatcttattattttatgacttcttgaataatgtcttcatccttcacaagacaaaacatccttgaaaaagtcactagagttatacaacctttgtgtttaggtgataattgtctttgaatttaaaagccctccttcccttccaatctatcactttcaaaaaagcctaaataccaattataataacaatagcttatatttattttctatttcctcctttctcttgaaccttccaactcttcttcctcatggccattctcagctgatggtattacttcctattacatggaaaatcagaaggcagattccacaagctcctaacataacatctactgacttacctgtaactgcacccacatagtctgccttcccttatattactatgaataaagaatttgtttctaaggtcaactcctctcttgagcactggaatatatcctctcttgcttactcaaggaaattgttccattatcaattgctttcttttccactcaatcatcccatcattactaaatccagcagtcaattatcaatcatttcatttggcccataagcatcatttgatattgtcacactcttgaaaacacttttttcactaggcttccacacaggtgtgctggtaaatacttaaaaactagttcagataaaaaggaaaacatgggcacctacacgcacatgagtttgttataattttactgacacaaggatgtatagcaaccagtctacaaataataataagatatacaacctttaattgtaaattccattagtcagttgattctcaataatatttttattggtttttaccaaattcttgtattcatagccaacttagggttataactgatgaatgagtagttccaacatatatgtggtttgattatgttgtcatattaataaaatgaaaataaaacaacaaagatagtttttgtgaaaacctcactcaattatgttatttgtttactgaatcagataataatttttgaatagtggacaaatatttcctcaatttctgtactaatatcaatgtaacagcaacagacacaaaatgcttttaacttgcgcttaaattattagtatttactttatcactttcttatcagcaaaacaataaatcaagcccaaatttgtagcatttgcaatttccaaagtctaaatattcccaccatggccaatttcaaggtaccaacatgatgtctctgaacatggatctgagaaaagatgcacagcagcataccattatgtagcttatccaccgcacaaatacaatcaatgtaaataactcaagagcagagatggtatgaaaatgaaaaataattaagaattgatgactgttgagtatttattactttttaatataatttagttaagtttatgtgtaattatttttgttagtgatggggtctccctacattgcccaagttagtcttgaactcctgacctcaagcaatcctcctgccttgacctcccaaagtgctgggattacaggcatgagccaccatgcctggtccatagtttatgcataatttttaagtggttgagtttaactttttttttttttgagatggagtctcactttgttgcccaggctggagtgcagtggcgtgatctcggctcactgcaacctccgccttctgggttcaagcagttctcctgcctcagcctcctgagtagctgggactacaggtgtgtgcaaccacacccagctaatttgtgtatttttagtacagacagggtttcaccacgttggccaggatggtcttgatctcttgaccttgtgatccacccacctcggcctcccaaagcactgggattacatgtgtcagccaccgtgccaggctttaacatttttgaaatggctgtattgtcttgcaaatttgctgaaaatttaatgataagctcttgcaagctgacatgagccgtctccagcacaccattatttccagggcagcactctctcccagattgttttcccacttcatggatgccctttctcaatcacatttattagttccctctaatttctcaatgagggcttaagatgtttagaatacctctgaacatggtaagacttctttaatcttactccctggataatcttacccagtttccttgataatcttatctaattccgtagttttaaatattaccagcaccctcaagacttccgaatgtatatctgtagctcagaactttactctgaattccagactcatatccagctgaatgctcaacatttccatttggatgtctaataagcatctcaaacttcacttgtcaaaactgaactccagatcttatccacccaccctcagtctgcttctcctccaatgtatctccatctttcacccttccaattattcagacccaaattcctgaagtcagcattcattcttttctctaattctctacatctatccatcagtaaatcctgtgggctccaacatcaaattatatgcagaatcccatcacttctccctacctccagtgccaccaccctggcacaacccatcatcatctatcccctacattactgcaatgttctactagtttacatgctgtcacctttgccctcctacagtcttttctcttttttttcttttttctttctgtctttgtttgtttgttttgttttttgttttcttttaagcaggatctctctctgtcacccagatgggaatgtagtggggcaatcactgcacatttcagcatcagcctcccaggctcaagtgatcctcccaaatcattttttgaattctgatttttttgtagagatgaggtctcactatgttgcccaggctggcctacagtcttttctaaacccaatagccaaaaatatcctttcaagtcatcaactagattatgtcattcctcaactcaaaccctccagtgtctccccatcccactcagagcaaaggcccacctctctgacttcagctcttagacctctcctcttgctcaatctactccaaccacagtatgctgtttctcaaatatatcaagaactctcctatatcatggcctctatacttgtgattctgcctataacactcttctctcaggtatccataaagcttgctccttcacttctttcatatctctgcttatatatcatcttagtagtaaggccttccctaatactcctatataacatagcaaacttcaagcttatccccttgaaggaaatgagaatttcaattgggcaataagagatggaggaggacattgcgtaactactcctcttctatctagtaagattagaaatatagaaataaatgtggatgaacagagagctcactccaatttatattaacaaagaatggtgatataaatgtgtgctaatatatttgcataaactttaatttttaaaaatgatttcacactttacttgcgtaatgttttaacaactctgaatcaaggacaaatattttaatccccattttgtcaataattaaacaatcagcagtttccccaaaatgatggtggctcactttctaacccatccctacacactatttacaaatataaatagttactttacttaccactgtaggtgatcaacaatacaataattatactatacctctctctctacttatatgtatctgtgggctctaatcacgtgattacctctagtgcccaaagctttagtctttttcatttcctcattaaagtctgccgacatttttcgggaaacctacaagtgctgagcacctttttcttttctctctctttttttttttaatacaattataactaaagcctttttttttaagcttctgtggcattgttgtaggtattaccctagtcgtttattcttttaaagggcaattcttggccaggcacggtggctcacacctataattccagcactttgggtggccaaggtggaaggatggcttgagaccgggagttcgagaccagcctgggcaacagagcaaaaccctttctctacaacaaaattttaaaattagccaggtgtggtggtgcacgtctgcactcccagctactcagaaggctgagatgggaggatcatttaagcccaggagttcgaggcttcagtgggccaccatcctgctactgcactccagcctgggctacagagtgagaccctgtctctaaataaataagtaaaataccctgtctctaagtaaataagtaaaattaagagcaattctcaaaaatgtattaacaatattcccacaatcacatctacaaatataattagataagtaaggggaatttcactcactcatttagcatatatttatccaataactataaagggaaaatactgtattgattcaaaacagctagatgttttctaaaccagcagagcttactatgcctctcatcgctgtaggataaaaatttgacacataaaaaatgctaaaatatttttaaaaggtcgtatataatcaagtctccaagttaggctttcacacaccagcatctagggctggaattgtggctgcccttttatgctgcttttgattattgagaatgatcatcacctggagtcaattctattatgctcttcaactctctctactcaaatccttatttctggttaatgaaagtttgaaggtaatctaaaaatgacaaattaaacaaatgagacaaatggcaaggatcttttcatacaaattaaaaatccctaacctaatctccataaattgaataaagtggaaagctgagataattatccaagcaagtcaagattcatattttaattgatgttcaaataaccaagtggagaatttttcatctaaattgcctcaattctcctgttttcttcattaaactctaccttcataagactcctgagtctacaggaaaaaaaaaaagctaaatttggattacttgagggcaggcacaggaggaaatgggggggaagggagaatcactttttaaaataagaaatttttgcatgaaatatgcaaccaagggatagtgaatgttacataattagaactgtaggtaatcatgtgtctgttaattaaggttcaactctatattgtacatggtttaagaatagcatcaccagaaagttataaataatttgggacaggtaatttaaatttgaaacagtgattggcaatagtgctaacaaatgaacttttagagaaaagaaaatgatgatacataaaatcatttgccatggcttaaaaaatgaagaattacagaacatacagtggtatcattaggaaaactcagatcaaagtataatagagaaaaggtgaatttaacaggcaaattttggaaaataaagcatttagaatagtgaaattattttacataaatctattcaacatttttacagtttaaaaagaacttttaaatgcattatcttatctgattctcaccactgagaagtcatacctattttacatgaaactgaaactcagagtggcttgtccaagatcacacagctactaaataacagatttggagcttaatccaaaagcttttgattccaagtatagtgttctctccacaataccacccttaatcctccagaaatggagatgagcatatttttatggaaaaaataaaataaaacttgaccaatcagacataaatcgtatcactgaattttagaatctagggttaaatgttgaatcacaaatgttcaaatttagtcttttaatttgtatttgtaacatataaataaaaatggtcctacctttataagtctggtagatagagaaaaaggttatttcagccattaatcaagtatttattgactatcttactatatccagacactgggaacacagtactgaacaaaataggcaatagtctaccctcacagagattttagtctcaaaataaagataattaactaggaaattccaacaaagtgaaagattaaaacagagtataagaatgctatcacggctgggagcggtggctcacgcctgtaataccagcactttgggatgccaaggcaggcagatcacctgaggtcaggagatcgagaccagcctgaccaacatggtgaaaccccgtctctactaaaaatgcaaaaattagctggacatggttgcgggtgcctgtaatcccagctacttgggaggctgaggcaggaaatcacttgaacccgggaggcggaggttgaagtgagctgagatcgtgccactgcactccagcatgggtgacagacagagattctgtctcaaagaaaaaaaaaaagaatggtatcataaggtaccaggtaccatgggagtagagaattaagttgatggcatacgtacaatgttaacaagtttggccttataccaagggtagaatgtcaagtcatggaagatttttaactgaagaggaatatgaccattttttagatttagaacgattaactatagtatgatatgtatccattaaaacaagcaataacaattagacatttttcatattttaaatatatacaaaattgaatgatcacaattttatcattacttattagacattaggactagaaaatgaaagtgagaggtgaagccggctggcttctgggtcaggtggggacttggagaacttttctgtctaactaaaggattgtaaatgcaccaatcagtgctctgtgtctagctaaaggattgtaaatgcaccaatcagtgctctgtgtctagctaaaggtttgttaatgcaccaatcagcacttggtaaaaacggatcaatcagcactctgtaaaacggaccaatcagcactctataaaatggaccaagcagctctctgtaaaatggaccaatcagcaggatgtgggtggggccaaataagggaataaaagcaggccacctgagccagcagcagcaacctgctcaggtccccttccacactgtggaagctttgttctttcgctcttcacaataaatcttgctgctgctcactctttgggtctgcgccgcctttatgagctataacactcactgcgaaggtctgcagcttcactcctgaagtcagcgagaccataaacccaccaggaggaataaataactccagacgcgccacctttaagagctgtaacactcaccgcaaaggtctgcagcttcactcctaaagtcagcaagaccatgaacccaccagaaggaagaaactctggacacatccaaacatcagaaggaacaaactctggacacaccatctttaagaactgtaacactcaccacgagggtccacagcttcattcttgaagtcagagagacaaagaacccaccaattctggacacattttggcgaccatgaagggaccatcacctttcgccaagcagtgagattatcgcctatcgccaagtggtgagtaccattggaccactttcacttgctattctgtcctatttttccttagaattcaggggctaaataccagacacctattggccagttaaaagtgactagcacagccgccggactaaagacacgggtgtcaggctttctgggaaagggctctctaacaaaccccgactcttcagagttgggagcattggtttgcctggaaccagcttctgcatttcccgtacttctgggctgagccaagggtcgacagaggggaaagtcattcaactccagggtcccgacaacaagttggttgaccctgcagccatgagtgaaactcaaagtcatgtcgcccaagcaagactcatccatctatcttgatccttgcccccgggtcctaacgcctgccagataaacttcctctcacctgtcttctccaaggctagtcccgcttataaaaaccactcgctctctctggtgcttttctagtttctcctataagaatgatttctagtataaactccaggactctgttaccttcttttggcacctgggctcaccaatcaaaaagacataatttttgcccaaagccccgtcataggggagactatctggaattttaggatccctcctcagacaagcaggcctaataaaggctattcctacagctaggatatggggagcctcagaaattgtatccttcctattcatataagtgaagataaaaggcatcagtcttccaattctggagatccctcccctccctcagggtatggccctccacttaatttttggggcataacatctttataggacatgggtaaaatcccaatactaacagaagaatgcttaggactctaacaagttttcgacaatgcttcagtaaaggtgactacattggatttttctcggtcctctttgtggtctaggaggacaggcaagggtgcaggttttcgagaatgcatcagtaagggccactaaatccgaccttccttggtcctccttgtggtctaggaggaaaactagtgtttctgctgctgtggcggtgagcacaactattctgattagcagggtccagggaccgttgtgggttcttgggcatggggagaaacaaaccaaaaccatgggtggttttgtctttcagatgggaaacactcaggcatcaaaaggctcacccttgaaatgcatcctaagccattgggaccaatttgacccaaaaaccctgaaaaagaggtggctcatttttttctgcactatggtctggccccattattctctctctctctctgatggggaaaaatggccacctgagggaagtataacttacaatactatcctgcagtttgaccttttctgtaagatggaatgcaaatggagtgaaataccttacgtccatgctttcttttcattgaaggagaatacataactatgcaaagcttgcaatttacatcccacaggaggatctttcagcttaccctcatatcctagcctccctacagctccccttcccattaaggataagcctcctctaatctccccggcccagaaggaaataagcaaagaaatctccaaaggaccacaaaaccccccaggctgtcagttttgtccccttcaagctgtagggggtggggaatttggccccacccaggtacatgaccctttctccctctctgatttaaagcagatcaaggcagacctggtgaagttttcagatggtcctgataggtacatagatgtcctacagggtctagggcaaaccttcaatctcttttggagagatgtcatgctattgttagctcaaaccctggcctttaatgaaaagaatgtggctttagctgcagcatgagagtttggagatacctggtatctcagtcaagtaaatgatagaatgacagctgaggaaagggacaaattccctactgaccagcaagccatccccagtatggatccccactgggaccctgactcagatcatggggactggagtcataaacatctgttgacctgtgttctagaaggactaaggagaattaggaaaaagcccatgaattactcaatgatgtccaccataactcagggaaaggaagaaaatccttctgccttcctcaagtggctacgggaggccttaagaaaatatactcccctgtcacccaactcactacggggtcaattgattctaaaagatacatttattacccaatcagctgcagatatcaggagaaagctccaaaagcaagccctgggccctgaacaaaatctggaggcattattaaaccaggcaacctcagtgttctataatagggaccaagaggaacaggcccaaaaggaaaagtgaaatcagagaaagaccacagccttagtcatggccctcagacaaacaaactttggtggttcaaagaggtcagaaaatggagcaggccaatcactcggtagggcttgttatcagtgtggtttacaaggacactttaaaaaagattgtccaatgagaaacaagctgccccctcgtccatgtctgctatgctgaggcaatcactggaaggtgcactgccacagagtgcagaggttctctgggccagtaacccccaataagaagacccaacaacaggactgagggtgcctggggcaagcaccagctcatgttatcaccctcactgagccccggatacgtttaaccattgagggccaggaaattgacttcctcctggacactggtgcggccttctcagtgttaatctcctgtcccagacgactgtcctcaaggtccgttaccatccggggaatcctgggacagtctgtaaccaggtatttctcccacctcctcagttgtaattgggagactttgctctcttcacatgcctttcttgttatgcctgaaagtcccacacccttattagggagggatatattagccaaagctggagctattatttacatgaatatggggaacaagttatccatttgttgtcccctacttgagaagggaatcaaccctgaagtctgggcattggaaggataatttggaaggaaaaaaatgcccgcccagtccaaatcaggctaaaagatcccaccacttttccttatcaaaggtaacatcccttaaggcctgaagctcataaaggattacaagatattgttaaacatttaaaagctcaaggcttagtaaggaaatgcagcagtgactgcaacaccccaattctaggagtacaaaaactgaatggtcagtggagactagtgcaagatcttggactcatcaataaggcaataattcctctatatccagttgtacccaacccctataccctgctctctcaaatatcagaggaagcagaatggttcactgttctggacctcaaggatgccttcttctgtattcccctgcactctgactcccagtttctctttgcctgtgaggaccccacagaccacacatcccaacttacacagacgatcttgccccacgggtttagggatagcccttacctgtttggtcaggcactggcccaagatctaggccacttctcaagttcaggcactctggcccttcagtatgtggatgatttacctttggctaccagtttggaagcctcatgccaacaggctactctagatctcttgaactttctagctaatcaagggtacaaggcatctaggtcaaaggcccagctttgcctacagcaggtcgaatatctaggcttaatcttagccagaggggccagggccctcagcaaggaatgaatacagcctatactggcttatcatcaccctaagacattaaaacagttgcaggggttccttggaatcacgggcttttgccgactatggatccccggatacagcgagatggccagaccactctatactctaatcaaggagccccagagggcaaatactcatctagtagaatgagaaccagggtcagaaacagccttcaaaaccttaaagcgggccctagtacaactccagctttaagccttcccacaggacaaaacttatctctatatgtcacagagacagcagggatagctcttggagtccttacgcaggctcatgggatgaacccccaaccagtggcatacctaagtaagaaaattgatgtagtagcaaaaggctggcctcactgtttaagggtagttgtggcagtggccatcttagtgtcagaggctatcaagataatacaaggaaaagatctcactgtctggactactcatgatgtaaatggcatactaggtgccaaaggaagtttatggctatcagacaactgcctacttagataccaggcactactccttgaaggaccggtgcttcaaatacctatgtgtgcagccctcaaccctgccacttttctcccagaggatggggaaccaatcagcatgactgccaaacttatagtccaaacttatgccgcccgagatgatctcttagaagtccacttagactgatggaagttcatttgtggagaatgggatactacgggcaggttatgccatagttaatgatgtaaccgtacttgaaagtaaacctcttcccccagggaccagtgcccagttagcagaactagtggcacttacccgagccttataactgggaaagggaaaaagaataaatgtgtatacagatagcagatatgcttatctaatcctacatgcctatgctacaatatggaaagaaagggagttcctaacctctgggggaacccccattaaataccacaaggaaatcatggagttattgcactcagtgcaaaaacccaagggggtggcagtcttacactgtcgaagccatcaaaaaggggaaggagaggggagaacagcagcataagcagctggcagaggcagggaaagaccagcagagagagagagagaggaagagacagagatatagagagagagaaaaagagagataggaagtcaaagagagagacagagaggaagagactgaaagtcaaagagagaaggaaagagaggaagatacaaaggagtcaaagagacagaaagaaatagaagtagtaaagaaaaaacagtgtaccctattcctttaaaagtcagggtaaatttaaaacctataattgataattgaaggtcttctctgtaaccctatatcactccaataccaccttgttgtcagtgtcaacaagggcatagcccgaaagcactgaggccactgacaacccatagccttcctatcaaaaatccttaacccagcaggtttcccaacaagggatctaaatcttaactaattatcatacgaaggtctgaccagacctaggaggaactcccttcaggacaggatgatagatggttcctcccaggcaagtaaggaaacaaagacacaatggatattcagtgaggaaactcttgtagaagcagagttaggaaaattgcctaataattggtctgctcaaatgtgcgagctgtttgcactcagccaaactttaaagtacttacagaatcaggaaggagccatctataccaattttaagttaatatggactgaacgaggtcttactaatagcaaagaataattgaaatcccaaacttacaaggttttcaacaaaagtaaagtttgctaaaagtttacagtgtaacatatattatcctaacttctaatcttatgaaaatcagaccttatcagtacccctcaaagctcaagtccatcagcgcagagccatacaactaatacccctacttatagggttaggaatggctactgctacagaaactggaatagcaggtttatgtacttcattatcctactaccacacactctcacaggaattctcagacagtttgcaagaaataacaaaatctatccagtaaggatagtaaccacaaccccaaacagactctttggcagcagtgactctccaaaactaccgaggcctagacctcctcactgctgagaaaggaggactctgcaccttcttaggggtagagtgttgtttttatactaaccagtcagggatagtatgagatgctgtccggcgtttataggaaaaggcttctgaaatcagaaaacgcctttcaaactcttaccaacctctagagttgggcaatatggctcctcccctttctaggtcccatggcagccatcttgctgttactcgcctttgggccctgtatttttaacctgcttgtcaaatttgtttcctctagaatcgaggccatcaagctaccgatggtcttacaaatggaaccctaaatgagctcaactaacaacttctactgaggacccctggactgacccaccagtcctttcactggcctaaagagttaacctctggaggacaccacaactgcagggccccttcttcaccccatccagcagaaagtagctagagcagtcatcggccaaattcccgacagcaattggggtgtcctgtttagagatgggattgagaggtgaagccagctgggcttctgtgtcaggtggggacttggagaacttttctgtatagctaaaggattgtaaatgcaccaatcagctctctgtgtctagctaaaggattgtaaatgcaccaatctgtgctctgtgtctagctaaaggtttgtaaatgcaccaatcagcacttggtaaaaacggaccaatcagcactctgtagaacagaacaagcagcgctctgtaaaatggaccaatcagtaggatgtgggtggggccaaataagggaataaaagcatgctgcccgagccagcagcagcaacccgcttgggtccccttccacgctgtagaagctttgttctttcgctctttgcaataaatcttgctgctgctcactctttgggtatgtgccacctttatgagctgtaacacacactgtgaaggtctgcagcttcactcctgaagtcagcaagaccacaaacccaccaggaggaatgaacaactctggacatgccacctttaagagctgtaacatgcaccgcgaaggtctgcagcttcactcctgaagtcagcgagaccatgaacccaccagaaggaagaaactctggacacatccaaacatcagaaggaacaaactctggacacaccatctttaagaactgtaacactcaccacgagtatcagtggcttcattcctgaagtcaacaagacagaatccactcattccagacacaaaagtattttactaagaagtattcacatatgcttaattcttattgttgatgttattgcttttttacaaatcaaggacactcatgagaaagtaataaagtaatgaatagcaacagaaaagttagtcttgaaccaggtttttttttttttttaaaaattaacattaaaatgtatagttcggccgggcatggtggctgacacctgtaatcccagcacttgaggaggctgaggcaggtggatacctgaggtcaggagttcaagaccagcctgaccaacatggagaaaccccgtttttactaaaaatacaaaattagctgagcatggaggcccatgcctgtaatcccagctactcaggaggctgaggcagaagaacagcttgaacttgggaggcagaggttgcagtaagccaaaatggcgccattgcactccagcctgggcaacgagagtgcaactccatctccaaataaataaaacaaacgtacagttcaaggtgataccacaaaggtgtcattttattactaataatattagctagcatttgtggaacaatgctaggcattctgcactgatcaccttatttaatcttcaaaagaatcctaagaactactactatatacattttcacaaatggggaaattttagactgagggaaatagagtacatttgcccaaggctacataacagtaagtgctggaaccacaatgcaaatgctgatctatctgccaccaaagcccatacaaagcattatgccatattgaaacttgatttactaggaaaggatcacaatgcttctttcttctataattattctttgcaattatactttaccctccctaaaaaagaattgtttgaatatacttcaactaacacctgttgatctggttattttccctgttgaaacaagaagatattattaatagtataaaacggtaaatttatatctctcctttcagacaagccatgctttcaaattttctataaacttgttaaaggggaatgatagaaaatgtgcaaggctacgcagcagtaaacagaaagtaagaaaacaacgaattggccaggcatgtggctcatgcttgtaatcccagcattttgggaggccgaggcagacggatcactttgagctcaggagttcaagaccagcctgggcaacatggcgaaaccccatctctactaaaaatacaaaaattagctgggcatgtggtgggtgcctgtaatcccagctactcaggaggctgaggcaggagaatcgcttgaacccagaaagcagaggttgcagtgagctgagatcatgccactgcactccagcctgggcaacagagcaagattccatctcaaaaaaaaaagattaaaaattgcatcttcagctaaatactgatttttgcatcattccagatttatttatctagaaaaataaataaataaataaaatttggaatttaaatagtgaagaatatgtatggcaagacttaaagcagacctgaagactgcaatcattttgtatatattagatgatttacaaattactttagcatctttggaggagaaataatcttaataagaaatgttataacctgttttttttaaaaacacgcatggcatctcctatctgtgatcaaatgcatcattgccatatctggacaggcttgttccagaagctgaccacgaagctgaacccaaaccactgatggaaggggactctgacatttctcctccttgaacccacccacccccctaaaaaaaaatgcattcagatgataagcttttgtacagcagtttcttatctacaaaataatttttatatggtctaggtctcttgatttgatcctcacaataatcctaagaggtattagtactatacttaagttttaacaggaaaaatttgaagctctatctgttgatttgcttaatgtagtcaactgatggtaaaagctagattccaatcctgggctctcctctactgcactatgatgccattcacttgttcaaagactaccacactcatacagtaaaaaggaaagcatcagacaagcttctggtcctaattccatcactaactagctttgtaaaagtgaagttcatgaacattatcatatttgatgggaaaaagaaacagtatatagtaagggggaaaaaagcattaaatcccttttttaaaaggaaacaagttcagaaggattacatgattttcacaggatcttggtggcatcatcataagaaggcaagtaacctgtattttacacatgggagattggtactttgagatattaaaacttttttctacctaaattttcccatttccttttttctcattccagcgacaactggttccctactttattgcctcaggggcgctatatgccaggacaaaacccagaaggaatttttcagtaattccagttttgctttctaaaaacctaagccctcagaataaaataagagtttgtcagagatgaaaaagagattctcgggtacaggcagagaaagggacttctcctagccccttcacagcgtagaaaaaaattttcccagctgaagaaaacataaaaaagtctttggatctcaagggatcagggatctaggctcttgttattggcaacattgcttggaaggcagcaagacccaagaggaatggcattgtaacgcatctaggcaaacagaaacacagacattctagaaaaaggtaaaagtccatgactcggacatatcaaatatctgtcaaaccagacgagaaagagctatctagacacaacaactcatatgtcagaagtaagctgttttatatagatgatcaacaaccagaagacactcccattccaggcagaaccccaccttaaccccagggaagtggggaaaacttcaaaaaggataagttattttgtctgttactcagttactaagagtaaaggtgaattacagaaaataaatggatacttctaacatacctaaatttacagaccaagtccagctcacggattacctgatcctgtcccttcttttagtagccaaatcttctgactactgttctaggttttttccaccatgtcactgctatcgatgatgatgataacacaggatgtgattatatagttcaaggccaaaaaacaagaaaaataaataatgatctgaaacagcctcttgccatttcccacattgtctggtaaacttctattcatcttctgtatctcatcttaaatattacatcttccctagtgggattgagtgttccttgtctgttttcttgacaaagagcgttaacctcaccacacagcattgaaattgcctgtttttgcatctgtcttcctaatatattttaagattcatacaggcagagattgaatatcatttgctacttcaaacatgcatctggcactatgcctggcacatagcaggcactcataatacacctttgttgaatggataaatgattgaataaataaatgaaagtagagtcattgccttaaatatatacaccagtttacaccatatatacaccagtttaccttttaaaagaattttagcttgtttattacctatgagagatgtttaaatagaacagaacttaataggtttattccaagtattaccatgcttttaatgataaagatgtcacagtccttcaaaatgataagcccctgatagaagcttcaaaattgtatcctaaattagggcctcagtggctagcaaaatggtgttaccagaagaaatgggttacaaaaatcttacccataatctttgaaagtttaaatttaataattcattttcacaggattttctactttattatactataccattcctcttgatcttaaatcctaaaataaaggaggtcaggagaatcgtttcataatgaaggtgatttggccataattcttgaaatagctttgaaaacttactaaaaattgaacccatgcggaaagcttattagttggaattcagaatgactaactggacagaagagactggataaaactcatgatcctttgctgacaaagcaacctacattgaggatatagaaatacttgtgtcttgactgccataaattcctgggcaagaattgtagctggagaacacattcccttatcccaatcaaaaaaaaaatctctcccttatactaaaaaatattttgtaatcactgacatggtaacatagtattaagaaataagcatataaggagaatatatatttaagaaagtatagtattcgtatagttcagtaaatgtattttacagaacagtgagaaatttacttattgacaaaggcatgaatgaacagaatgccttaatccaacattttaaaaacccaatgtttatcccaggcaaattaacacagaaacagaaaacaaaataccgcatgttcttacaagtgggaactaagaattgggtatacatggacataaagacaggaacaatagacactacgcaagggactagtggggcaagggctaaaaaaccacctattgagtactatgctcaatacctaggtgacagaatcattcatatccaaaacctcagcatcacacaatatactcatgtaacaaatcagcacatgtactcactgaatctaagaaaaagttgaagttttttaaaaataaataagtaaaatccaatgttttgtgcatacctcactgactagattcttctacccacaaaagtaaacaataataggcctaagggagaaatcaaatattctatcataaataaaaacacttgagcagatttccaaaaacccagaagttcacacattttctagtatcaagtcattagcatatgctttgtactctcccaatagatatgtaaaataaaatcaattaacagatcattttatctctacgtcttcctcactaagttgcttcatagcaaactcctaatcagtagttaaacacaaaaagtattcttctatttctcattctggaattcattctatttatgcctcctggattaattaatattttacaatatcaagagtctatagcttatccaaggtcaaaattgtccctacggggaatttcttttaaaataaaaaagatatgggatacccaggctggagttcagtggcacaatcacagctcactgcagtctcaaactcctgggctcaggcaatcctccagtctcagcctcccaagtaactgggactataggcacatgccaacaagcccagctaatttttttaattggggaattttaaattaaaaaaaaaaactttagtaaattgtctattttactttgacttacagaaaatgcaaaagtttgaaaactgtgttttcccatctttctctaggatgattcagtgcttaattcttttgagttttatggctgtgaagagattaaaaaaaaaacttgaagttttggaaaacagaaaaaacatgtgcagccatatgcagtggctcatgcctgtaatcccagcactttcagaggtggaggcagatgaatcacctgaggtcaggagtttgaggtcagcctgcccaacatggtgaaatcccctctcttccaaaaatgaaaaaattagccaggcacagtggcaggcgcctgtaatcccagctactcggcaggctgagccaggagaatcgcctgaacccaggaggtggaggttgcagtgaaccgagattgcgcaactgcactccagcctgggcaacagagcaaaactccgtctcaaaaaaaaaaagacaagctctccatatattactggtatggcaaacatgaaaattcaaatacaaatttggtaaaatgcttgcaaaaggaataaaataaccacacaaggccactcaatgaagtcaggtacaggcatagctcattttattgcactttgctttactgcactttgcagacaacacgtttttcacaaattaagtttgtgacaaccctgtgtcaaacaagtctatcactggcaattttccacaggatatattcacttcatgtctctgcgtcacattttggtaattctcacaatatttcaaactttttcattagtcttttatttgttacagtgatctgtaatcagtgatctttgatgttcattgtaattgttttggggcgccacaaatcatacccacataagacagcaaacttaatctgtaaatgttgtgtgttatctgactcctctaccaactggtcattgccccatctctctccctctcctcaggtccccctattcctggagacacaacaatattaaagttaggccaattaataactctaccatggcctctcagtgttcaagtgaaaggaaacgttacacatttctcacactcaaagctagaaaatgattaagcttagtgaggaagttatgttgaaagctgagataagccaaaagctaggcagccctcttgcaccaaatagccaagttgtgaatgcaaaggaaaaactcttgaaggaaattaaaagggccacttcagtgaacacacgaataataagagagacacgcttactgttgatatagggaaagttttagtgatctgaacagaagatcaaaccagctgtaattcccctcaaaccaaagtctaatccagagcaaggccctaactctcttcaattctatataggctgagagaggtgaggaagccacagaagaaagctggaagccagcaaaggttggttcatgaggtgaaaggaaagaagtcatctttacaacataaaagtgcaaggtgaagcagcaagtgctgatgaagaagctacagcaagttatcaagaagatctagctgagataattgatgaaaatggctaaacaacagattttcaattcagacaaaatagccttacatcagaagaaaatgctagagagaaatcaatgcctcatttcaaagtttcaaaggacaggctgacgcttcttagaggctaatgggtgaatgtagctggtgactttacgttgaagccaatgctcatttacccttccaaaaatcctagggtctttaagaattatgctaaatctattctgtccatgctctaaaagtaggtcaacaaaagcctgggtgacagcacatccgtttacagcatggtttactgaatattttaagctcactgttgagaactactactcagaaaaaaaaaaaaaagattcctttccaaatattactactcattgacaatgcacctagtcacccaagagctccaatgaacatatacaaggagattaaagttgttttcatgcctgctaatagtacatccattctgcaggccacagatgaaggagtaacttcaactttcaagccttattatttaagaaataaattttgtaagactatatctgccacagtgattccctgatagatctggccaaagtaaattgaaaacctcctggaaagaactcatcattctatatgccattaagaacattcttgattcacaggaggaggtcaaaatatcaacattaacgggagtttggaagacattcattccaactttcatggatgactttgagggattcaagtcttcagtggaagaagtaacttcagatggaatggaaatagcaagagatctagaactagaagtgaagcctgaagatgtgactgaattgctgcaatctcatgataaaactggaatgaatgaggagttgcttcttatggatgagcaaagaaagtggtttcttcagatgaaatctacttccagtgaagatgttgtgaacattgtttgaaatggcaacaaagggtttagaatattacatacacttagttgataaagcagcagcagggtttgagaaaaccaattccaattttgaaagaagttgtactgtgggtaaaatgctgtcaaacagcatctcatgctacagagaaatctctcataaaataaagagtcaattgatgtggcaaacttcattgttgtcctattttaacaaattgccttagacatcccaaccttcagcaatcatcaccctgatcagttagcagccatcaacaacgaagcaagatcttccaccagcaaaaagattactactcgctaaaggctcatatgatcattagcattttttagttgtaaagcatttttacttaaagtacgtacattgtttttagacataatacgatcgcaaacctaatggactatagtatagtatatactgtactgtatacaacaaatattttggtttcccagtgcatatataccgtagtatacaatatattgtatatatgcatcagaaaaccagaatatttgtgtagcttgcttcattgtgataataggccttatttcagtggtctggaacctaacccgcaatatctctgagatatacctgtacatattccccctcttattgattctgaaaaaaaaatgattttaagaacttaagaaaaactagagatgaaaacagagtatacccgataacaaaaagcaaatgtaaattagtaagatactataaaacaagaagtggagccataatgtgcaggaaacaacaaaagaagaaaactttgaatagggaaaaaataagcaggagagtcataaggtcctcttccccagaggaaaaaaaaaaaaaagaaatgacacttttatgaagtatacagtcaaccaaaagcaaagagataatttaagaactgtgagtccaggaaactgtaatctcagtttcaagggtgcctatgagatatatggcaatatcatgtcttaagattctaaggccaggcgcactggctcatgcctgtaatcccagcactttgggaggccaaggtgggtggataacgaggtcaggagttcgagatcagcctggccaacatggtgaaaccctgtttctactaaaaatacaaaaattagccaggtgtggtggcacgcacctgtaatcccagctactcagaaagctgagtcaagagaattgcacgaaccccggaggcggaggttccagtgagccgagatcacactactgcactcccacctgggctacagagcaagactctgtctcccaaaaaaaaaaaaaaagattccaattatataacattcttcagcttcctttgaaagctataatgtcaaaacatatacatataaaaaagataggacttagctttcagtacatgataaaaatgtttatatatatattatatcactgagaaccactgcaaaaaaataattcaaaggaaataaagggtcatataaataaataatttcagacaaacttctacaccagtttaaaagaagctccgaagacaataggacaatttttttttttttgagacgaagtctctctctgtcgccaagttggagtgcagcggcacagtcttacctcactgcaacctccacctcctgggttcaagcaattctcctgcgtcagcctcccaagtagctgggattacaggcacgcaccactatgcccagctaatttttgtatttttagtagagatggggtttcaccacgttggccaggctggtcttgaactcctgacctcatgatccgcccgcctcggcctcccaaagtgctgggattacaggcgtgagccaccgcgcctggcaataggacaattttttaaaacactgaaatgaaatgaacatttatctcaaagtaataaaggcattgatttcttccacatatttaatgacaatgagaacaaaaagccattcaaaaaagaagctgcattgtactagaaaattctgttaaagcatatttttatctttaaaacagcaactttctgctgtaaaacatggcaaatgacgtacctatcattaacttttatttcttatgttaacacagtaggaaatcatatcagatcaattcaagaagacttgttaaaacagacccttataacacactatggtcttgcatcatatcagagaatactaatacaacttatcctgaattggtcctaaattttcacaaattaaaatatgtccaagattgtcccaagggctcacctgggagcaaataaagttactactatagataagaaaatcttgaatgaaaagcaactgctgaggaaaaaaaaccttctatgaggaaacagaagagtcttctgttgataaaactgagatctgtaaaaatgcgaagagactagagtgagagaagtagaaagtaatgtcataaagcaaacgagcagttaatatggggtttgaggcacagtagtttcagcttatccaagggcagtccagaatggcacctagaaatgggcttagtgagatgtcacacccattcccaattcccaccatggttgcatggtatcagtaaaagaatctcctctctctttgacaaaaatatactaactaaataccaaatgaaaatccatcttatgaaaatttcatactttaatgagaatatgttcaacaatgaataaacacttggctcagtgaggatagttattgtttagaatcacattaagtctagctttttcgtcatgtctaccacatgaaacaatgaagagagaaaaagactcaaggtgacagaggacagtgatccctgcagaataaatctaggttaaacttaaaaatactgttcttatattatataaacagtagagatagtaagcatagccaatgaaaaatacaatatacacataacttgtttggctagttgtctataatattcaagaatatgtatcataatactagcagttttaagagattaaaagcaagatacattgtttctctagatcagtttataaggaaaatatacaacatatactctggtatcatagaaatataaactggtttttctaataagaacttgttgattcctttaaaaattcaatccattagtcaattcattattgaagaaggaaagaagaaagggaaggagggaggcaaaggaagagaggaagaaggaaagaaaggaaattcttctaaagtattataatttcaccaatgtatcagcaatttctgtaacagttctttaaagggaagaacttttaagaaactcggtttatggggtttagaaacattaagttctaaactttctaactaaacctgcttagttaagttatacctagaatatcaattgaccttcctcctcttccttcccacatacctttttatctctttctctgtctctcctccttcccattctctcttcctttcactcttttcctctctgtctctctctctctcacacacacacgtaatgtgtttaattccattattagttcaaaataaggtaatccaaaagaaactctctagagaaatggtagaaagaataaaaacacacatcaacttaaatatgtcaaagagccatatcatttattggctacattcccaaaaccattcttgttctagataaaccaattgtgtctggtctggacaagtgtggctccaaaatctcaggcagtttacttctgtcagtggtattattagaaacagcagggggaggaaacaatcccaatcttaaatcccagtgtgcaaatatcacagttctaggtgttccaaaagttttatatatcattgtccatctctacaaatatcagcttggataaggcatctcagtgattataagtttcctcaacatccctaacaaatccacaggtagaagaattaaacaccatgcagagataagttccactttaacctgcaattcacccagagctttagtttcagattgtagcaactcacataactggacaacatttggatctatattagtccagtatagcagagttcaaggctgttcatataagttttgattcaaaactcttgagaaactctttacagttgatctcaccttccatataatgtcaaaacaaaacaaaacaaaaacagtcccaaactaggatcctttggaacaaagttaacctggggtgcatctaagctaaactgaatccccaagttcagaatataatcaactatgcttcaggaattcactagatcttgatcaattccaataataaaagttgttgaggagggaggaaaaaaacaggtgtttgccccatttggggaacttgacaatcatgttattggataatgcatatatctggaaaagcacaatagtcacgaaagttgtgctttatcacaaaagtgaagatttacactagaataaatccaaataataagtctattttttaaccaaaagataaattataaagctgtaattttgttcagtgcaaatgaaattactttgctacctttcacaattctgtaattagtttgataaatattaaacccatgaggaagagctccactgcacaagtttcttttttaaagactgcttaaaagtaaccttcaacaagctaagaaaacaagctaaaggagactccaaatctgcggtactgaatctattcttattaccaacggtgatataaacaacctgatttatgaaatcataaatatctatcaataaatactatagtcttgcttccttttactttagtaaaataatattactgaattatgtaccactgaaactatattacaataaatatttcccccaaactgaagcaaaactttactctcaaatggaatataatttaaattacaagtaccagaaccaacaaaagggagaaatattatatagcaaccttatggcccacctgtcttcttgactggcattcttgggtctttccactgccacaggagtcaatatctcttttcaggtctcagtttgatccagctggattgaggccaagagccaggtaactgttgcaaaccacttcagtgttcagttttgaaatccaggctgagtcttctatgtcagacaaagaaaataatgatgtattttttccacaactaaactttttacaccgcccacagagtttacagcaacgtaattttttagtttttcaagtttttcaattttcagaaaatatttagactgtttttacaaactgggaaaattattgtaaacatgaagaacgttactgaaattcctcttcaggcagcaacatttttggaagttcaatgactaactcaattaaggcacaaaccaaatttagacaggtctcattactttatacatggtcaaattcaaagatgatgataaagatactcaaatctgtagagaaaaatgtaaccccacctccccaaaaatacttttaaaaatctctttgactccagtctctaaaaagataggtgagtttgaacagttttctgtggcagaacacacattgaaaggcccccttatatttactgatcagaagttccggatctcaccccctcagtaactcagaatccagcttgctgtccctttcatttttttcttctgt

SEQ ID NO: 2257 - DNA, 14895 bp, Homo sapiens
cgtcagtcccatggggaatgtcaacaggcaggggcagcactgcagagatttcatcatggtctcccaggccctcaggctcctctgccttctgcttgggcttcagggctgcctggctgcaggtgcgtccggggaggttttctccataaacttggtggaagggcagtgggcaaatccaggagccagcccgggcttcccaaaccccgcccttgctccggacacccccatccaccaggagggttttctggcggctcctgttcaatttctttccttctagaaaccagcatccaggcacaggaggggaggcccttcttggtggcccaggctttggcgggattatttttcaaagaactttaggagtgggtggtgctttcctggcccccatgggcccctgcctgtgaggtcggacaagcgcagggagtctggggcctctcagagtgcaggaagtgcgcacagggtgctcccaggctggggagcacaggtaggggacggtgcgtgggggatggcgcctggggcatgggggatggggtgtgggaaacggcatgtggggcgtaggggatggggtgtggaggatcgggggtggggatggcgtgtggggtgtgggggatgggccgtgggggggtggggcctgggaaacagcatgtggggcatggggtgtgggggtgaggtgtgggaaagtgtgtggggtgtgggggatggggcatggaaagggcgtgtggggtgcaggggatggggcatggaggtgtgggggatggggtgtgtggggtgtcggggatggggcatgtggggtgtgggggatggggcatggaaagggcgtgtggggtgcagaggatggggcatgggggggtggggatggcgagtggggctggggcctgggaatggtgagtggggcatggggatggcgagtagggggtgtggcgtgaggatggctagtggggcgtggggatggcgtgtggggatggcgagtggggggtgggctgtgagggacagtgcctgggatgtggggctgcagccctagctcacagcatggccttatgaccccggccaccttcctgccccaggcggggtcgctaaggcctcaggaggagaaacacgggacatgccgtggaagccggggcctcacagaggtgagcagggactgccactggttttgtcctggggcccagtgggggccaacatcacctccttcccctcccatggcaaagagccagcccgcggggtggctactgcagtgccccccaaggagggtgttccctgctcgagaggaagtgaccgctccagcttggccttccctgggactggggtgcaggcgattttatcttctttgctccattctgttccttccagataatcgtgtgttcttcatcaggttttcctcagttcttgagagcttttctgatgcaaatctgctttcaccccagggcggtcaccggctctgctcacaccagcctccaagggtgtgggtgtcccgggagtgtgggtgtcccgggggcgtgggtgtcccaggagtgtgggtgtcccgggggcgtgggtgtcccgggagtgtgggtgtcccgggggcgtgggtgtcccgggagtgtgggtgtcccggaggcgagggtgtcccgggagtgtgggtgtcccgggggagtgggtgtcccgggagtgtgggtgtcccggaggcgagggtgtcccgggagtgtgggtgtcccgggggcgtgggtgtcccgggagtgtgggtgtcccgggggagtgggtgtcccgggagtgtgggtgtcccggaggcgagggtgtcccgggagtgtgggtgtcccgggggagtgggtgtcccgggagtgtgggtgtcccggaggcgagggtgtcccgggagtgtgggtgtcccgggggcgtgggtgtcccgggagcgtgggtgtcccgggggcgtgggtgtcccgggagtgtgggtgtcccgggggcgtgggtgtcccgggagtgtgggtgtcccgggggcgtgggtgtcccgggagtgtgggtgtcccgggagtgtgggtgttccggaggcgagggtgtcccgggagtgtgcgtgtcccgggggcgtgggtgtcccgggggcgtgggtgtcccgggggcgtgggtgttccggaggcgagggtatcccagaagtgtgagtgtcccaggggcgtgggtgtcccgggggtgtgggtgtcccgggggcgtgggtgtcccgggagtgtgggtgttccggaggtgagggtgtcccgggagtgtgggtgttccggaggcgagggtgtcccgggagtgtgggtgtcccgggggcgtgggtgtcccgggagtgtgggtgttccggaggtgagggtgtcccgggagtgtgggtgttccggaggcgagggtgtcccgggagtgtgggtgtcccaggggcgtgggtgtcccgggagtgtgggtgttccggaggcgagggtgtcccgggagtgtgggtgttccggaggcgagggtgtcccgggagtgtgggtgtcccgggggcgtgggtgtcccgggggttgtgggtgtcccgggagtgtgggtgttccggaggcgagggtgtcccgggagtgtgggtgttccggaggcgagggtgtcccgggagtgtgggtgtcccgggggtgtgggtgtcccgggggtgtgggtgtcccgggagtgtgggtgtcccgggggagtgggtgtcccgggagtgtgggtgttccggaggcgagggtgtcccaggagcgtgggtgtcccggaggcgagggtgtcccgggagcgtgggtgtcccgggggcgtgggtgtcccgggagtgtgggtgtcccgggggagtgggtgtcccgggagtgtgggtgtcccggaggcgagggtgtcccaggagtgtgggtgtcccgggggcgtgggtgtcccgggagtgtgggtgttccagaggcgagggtatcccagaagtgtgagtgtcccgggggtgtgggtgtcccgggggtcgtgggtgtcccgggagtgtgggtgttccagaggcgagggtgtcccgggagtgtgggtgtcccaggggtgtgggtgtcccgggggcgtgggtgtcccgggagtgtgggtgtcccgggggagtgggtgtcccgggagtgtgggtgttccggaggcgagggtgtcccgggagtgtgggtgttccggaggcgagggtgtcccgggagcgtgggtgtcccgggggcgtgggtgtcccgggagcgtgggtgtcccaggggtgtgggtgtcccgggggcgtgggtgtcccgggagtgtgggtgtcccgggggagtggatgtcccgggagtgtgggtgttccggaggcgagggtgtcccgggagtgtgggtgttccggaggcgagggtgtcccgggagtgtgggtgtcccgggggcgtgggtgtcccgggagtgtgggtgtcccgggggcgtgggtatcccagaagtgtgagtgtcccaggggcgtgggtgtccggggggcgtgggtgtcccgggggtgtgggtgtcccgggggtcgtgggtgtcccgggagcgtgggtgtcggggactgcagggacatgggcctcccctcccactcctgccgcccagggcacctcctgtgaggactcggagtccgtgagttcccacctccttgagcccgattctttggtgtccccgcctgcatcctcagcctccttccaaaccagaccagttctctaggggcgtcgacgtgtgaaactgattttaaagaaaacaggcagtggcctttctctcggccccacgtggcccagtagcgctcaccttccgtcccttcttccgcgctcagtaaccaatttaggccgctcctgcagaactcgggctcctgcccaccggcccacagcgtccacctgaggcctcgtcctcccagcaaaggtcgtccctccggaacgcgcctcctgcggcctctccagagcccctcccgcgcgtcctctcagccccgctcgcctcctcccggggcctccctctcccgcctgcccccaggcccgtctcccctcgcgggctgaggcaggttcgggcagcacggccgccccggggcgggggtcactctccaccaccgcgtggtgcccacagctcacggcgctcccgggtgacggtcccctcggctgtagggcgtcctgaagagcggcctgctcggagctgagcgcacggggttgcctcgccctgggcgtctctggccctcaccagccccgtcttcccatgggcaaaacggcggtcctgtttgtccacaagtaaccgtcggggttacggaggggccaggagctgcggcggggggctgtgctctcaggaccggccccaggaggatccgcgcgaggtctggagctctcaggggtcgcgggggacagaggggccccaagcggaggcggggaaggcggcagaagcccaggaccgccaagagctggcgaggaagcccggggctcgctgtcgggggagccgggcaggggccgcgcctcggaccaggacggaggcctggggaaggcggatctggccgccggagacgcggtgcgggtggagacgagggatttggatttccgcgggcggctgtacggatttccacgcgcggttcacgtgggccccagggggttgcccggcacccggggccgcgccgccttctcctcgccggcatcgacccgcagcctcacgtttacgcggcggcgcccgcagcccccttcggcccggcttccgcgcgtgcccccgagcgcgccctcgggatcagcccccggaagcagagaggccaggccgggaaggatgggcgacgggggtggctgacccgggagcacggcagggaggacacccagccaggcccgcgagcagcgccgctcccctcctccaggacgggcgggaacctgcgatgcccccgccgcgtgggccgtggggcggtctccgaggcactgggcggggcacgcggtgggcgcttcacggaactcgcatttcccagtcttcgtaacccaggaggaagcccacggcgtcctgcaccggcgccggcgcgccaacgcgttcctggaggagctgcggccgggctccctggagagggagtgcaaggaggagcagtgctccttcgaggaggcccgggagatcttcaaggacgcggagaggacggtgagcccagcctcggggcgccccgcgccgcggacactgcaggcggcggtgaaccaggccgcgtggggccgcctgcgtctctttggctgcggctgtgggcggcgaacacgcagcggcgcccgcgcggcgctttctgcgggggtcgctttccgcccggggtgactccgctttcctgggcgatgccccccacccccaggcacgcgctctccccgtgcggccgcaccgcgcatgccggttttcacatcagaaaatacgatttgcaaagcacacttagggtgtcccccttaacttcccaagggagtccccccagtccccgaagggtccagggcagcctgcgcatcgcagacgcgcgcggctcgcagaagggacgtggtgagaagctggcccacagcatgccaccagcggcacctcctcagggcacgtgtcggggagaaacaacacttagggacctgggactttctccagctcacgctcacgggtcacctcacactccaagatcacctcaaagaggacacctcacacagggcacacttcacactcacaggtcacctcacactcacaggacacctcacactcacagggcacacttcacactcacgggtcacctcacactccaagatcacctcaaagaggacacctcacacagggcacacttcacactcacaggtcacctcacactcacaggacacctcacactcacagggcacacttcacactcacgggtcacctcacactccaagatcacctcaaagaggacacctcacacagggcacacttcacactcacgggtcacctcacactcacaggacacctcacacaagacacctcacacggggcacacttcacactcacaggtcacctcacacccacaggacacctcacacagggcacacttcacactcacgggtcacctcacactcacaggacacctcacacaagacacctcacacggggcacacttcacactcacaggtcacctcacacccacaggacacctcacacagggcacacttcacactcacgggtcacctcacactcacaggacacctcacactcagggcgcacttcacactcacgggtcacctcacacccacaggacacctcacagaggtcacctcacacaggacacctcacactcagggtgcacttcaaacccacaggtcatttcacctcacactcacaggacacctcacacaagataccacacggggcacacttcacactcacaggtcacctcacactcacaggacacctcacagaggtcacctcacacggggcacacttcacactcacaggtcacctcacacccacaggacacctcacagaggtcacctcacacccacaggacacctcacacaggacacctcacagaggtcacctcacacccacaggacacctcacactcataggtcacctcagtcttacaggacaactcacactcacaggtcaccttactctcacaggacacctcacactcacaggtcaccttactctcacaggacacctcactctcacaggacacctcacacagggcacacttcactcccacaggtcaccatacctcacacagatcacctcatactcacagatcacttcattctcacaggatacctcacactcagggcacacttcacactcacaggtcacacctcacacagatcatctcattctcacaggacacctccctctcacaggtcacctcacactcacaggacacctcacagaggtcacctcacacccacaggacacctcacagaggtcacctcacacggggcacacttcacactcaggtcacctcacacccacaggacacctcacagaggtcacctcacacccacaggacaactcacagaggtcacctcacacaggacacctcacaaaggtcacctcacacccacaggacacctcacactcataggtcacctcagtcttacaggacaactcacactcacaggtcaccttactctcacaggacacctcacactcacaggtcaccttactctcacaggacacctcacacagggcacacttcactcccacaggtcaccatacctcacacagatcacctcatactcacagatcacttcattctcacaggatacctcacactcagggcacacttcacactcacaggtcacacctcacacagatcatctcattctcacaggacacctccctctcacaggtcaccttacactcatctcacactcacaggtcgccacacctcacactcacaggatgcctcacactcacagaaccacatctcatatgcacaagacacctcacactcaggacacctcatgctcaaagaagcctcacactcacaggaggtccagctgtctgaggcaaaggctaacatgaccctttccagacaaattgaggatggtcatgcctagcatttttatacacctagttttgaaagcatttctcatctgttgtattctcacagcaccccgtgagtttaagttcaggtggccaacagtttcttcagcaatcacttttttctgtggagtgcttttgctgtttgtggaatattttgcatctgctactgcaccctctccccgtatgtgtggccaccctgtcagaggtggagctgtggctcagagcctgtgtacctcgtcccaggtccacagctcagcgacagaagagtcagggttgaacctcgggtgttctgacttgggagcaggaaatgtgtggtcacccatagttccagatgtcctggggaggggccaagattagaagaaacctacctcagctccagaggaaagtctggcttcctgagcccaccccgccagacccaggtccaagtcccccaaccccagttcatggtgtgtccagtgcttaccgttgggtgctctggtgaaggtgcatctcacgaggcttgctctcttgttccttcagaagctgttctggatttcttacagtggtgagtggatgatcaccaccagtcctgcctgcaacccttctcagcttactgacaccagcccactccacagatggggaccagtgtgcctcaagtccatgccagaatgggggctcctgcaaggaccagctccagtcctatatctgcttctgcctccctgccttcgagggccggaactgtgagacgcgtaaggccccactttgggtcccatatttgcagagggccctggggagctggtggaggtggcctggccaaccgggctgcagggtgcacaacctggtggggtgtgtaggccgggcattcagggctcagccccagttggaaattggtctaggtgaccttgaaatcccttccagtctgaggtctttgacagggacccaaggttctgattatcagactcagtggccccttgggctcccggccctgggcaattctcagccctcgagatggcccagctgagagtccctgtgtccctgtcccacttccacatcccaccacgcaggaccgcttggtaaacttccccttctctactttccattacaaaggtttgaggggtttgttttttttttaaccatctgaatattaaattatcacaaagtttgaggcccccaacctcccttgggttcagtaattcactagaaggactcatagaatccactgaagtggatacactcacaggtaccgtttattacagcaaaggatgcaggcttaagtctgcagagggaccaggcacaagcttccccttgtcctctccctgtggggtcatgtggacagtccttaattctcccagaatgacgtgtgacgagacgtgggaagtactgccaacttgggaagctctacgagccccggtgtccagaggttttatcagggctcaatcacatagacccagctgaccacccgcatggctgacctcagtctcagcccctccagaggctacgccgatagtgcggcccaaggccccaccatacatcacattgtcagctagaccatccagcatggctcaaggcccaggtaaacaccaacattccctcaggcaagaccttccaagggcttagcggtcatttcccaggagccaaggcaaaggctaccctttctctggcacagcagttcatccttgaccacccaagaccacattcttacactgaatgagctctcctgtgcagcagccattttcttctctaagcagaagagagcccagcaagctggaggaggctgaagagagaggcttcctgctggtcatctgggtccagaatgcctggagatctctgctcagccctggtgcccagcagccctggtgtgcatcctgcagggcaggccttcccgccggagtcctggacttgctcagggccactccccttgcccatgtcaaccaaagtcaggctgccggttctgcttcttctgtctgagcccatgaccagtgctgggactaactgtccccaggcgggctcacggtggtacgaggccagcttggagaactgtctcagctctctggtcctctcgtcagttgggtctctgattggaaagtcccttggacacttttaccatccccattggactttcactttcccccaggctcccatcagctgctcggaagagtggtcaccctggaggccactgcccaccagccaggcaccccccaaatgcaaccgcagccagcactgccagccactggcaaggctgttcagacatgtggctcctctgatccacgccttgtcctttggatcagtccacggagcaggtggtgccaagctcaggctctgtcacccacagctcagtgccaccttccaggcagaacaccactgctgacccagggcatggccaccccgggggctggctctcgctgacccccagaagcccctctcagggtgtccccttcctgtccccagacaaggatgaccagctgatctgtgtgaacgagaacggcggctgtgagcagtactgcagtgaccacacgggcaccaagcgctcctgtcggtgccacgaggggtactctctgctggcagacggggtgtcctgcacacccacaggtgaccaggcttcatgtcccagtcccagatgacaccagtccctgtcccactacggattatcttactggacaaaagacgggtgggagtggcttcacatctactgagcactaactatgcactgaccaattgtgaggtgggatctgggcaccaagggtggcacaggccagagcgacagtgactaggatgggcaccctgggggcaatccctgaatggcctcaggccccctgccaattctaggcagaccaggggagccaagcaaggcactatctcacgtccaactcccactcgcaggacctccgccagggttcatgaatctacttcggcacagccaatgtctgtactgactgctgcccactctgcattccaaaactcgtaaaggctcctgggaaaatgggatgtttctccaaaccagcctggaacgaatgggctgcacttccaaaagcagggacaccccacacccactgtgtctcaaagaggcggacgtgcccaccctggccacacagcctgggactcagcctgccacctcctcgggcttcctttctggcccaagaccttgattgaagcagatcaaaactaagcatgggatcaaaacaacacagtttgattcatctttaggtagaatttcattcaccttctactaaagtcaaacaacacatcttctccctgaaaagtgagcagagggcggttttaagacgtaagccctctgtttcctccaaaaccagccctgaccattgtctcctcagccagccacttcttcaagggcctctcatggccgggccccaccagtcaggcccagccgaggccctgccttccaccacccctgggccctgggagctcctgctcctgggggcctcccatagcctcggcctcaaggcctctcagaggatgggtgtttctgaatctttcctagtggcacgttcatccctcacaaatctctgcatctttctgacttttgttttacacagttgaatatccatgtggaaaaatacctattctagaaaaaagaaatgccagcaaaccccaaggccgaattgtggggggcaaggtgtgccccaaaggggagtgtccatggcaggtaaggcttcccctggcttcaggattccaagccctgagggtcttgaagccttttgaatgtgaacaacagctctggaagggaaaatgggcaggtcagccccaagcccaccaggctccaagtcagcacacctagcacctccagctcgcggcacccccatgcttttagtggggcaaggaaggagaaaagaaaacgacactcactgagggtctaccctgtgcagagaaccctgcgagatgccccatccgagttgtcacgtcgtcctcacggttactctttgaggtgggatctttgcctgatctttgcaaaatcaggagcattggatcaaagctatgtgaagatcctgtgaggtgaacagtgaaatctcacagcgacatttgtattcttgggccgtgcccaagagcacgtctcggctagagaggggcacagcctcccagagccaggtctgagcagctttgcctgggagggatctgcaaagaccccaggatttcagaaagaaattgtgcaatgccagaggttccttggcatgcccgggagggcgagtcatcagagaaacaatgacagcaatgtgacttccacacctcctgtccccccgcccaggtcctgttgttggtgaatggagctcagttgtgtggggggaccctgatcaacaccatctgggtggtctccgcggcccactgtttcgacaaaatcaagaactggaggaacctgatcgcggtgctgggtgggtaccactctcccctgtccgaccgcggtgctgggtgggtgccactcttccctgtccgaccgcggtgctgggtgggtgccactctcccctgtccgaccgcggtgctgggtgggtgccactctcccctgtccgaccgcggtgctgggtgggtgccactctccgctgtccgaccgcggtgctgggtgggtaccactctcccctgtctgaccgcagctctcaagtgtctcaggggctgtggctctgggcttcgtgctgtcacttccacagacagacagacatccccaaaaggggagcaaccatgctgggcacgactgctgtggccaccgtgctctcagccactttcccatgcccaaataaaacgataaaagactgggggcttctgcccatcctgcctcacttgaccaagagcccagaagaggatgcgacacccagggcctcatgggaccaccggctggcaggggttctgctcactgggtttatgggtgagacgagcactcccaggagggccactgggccgggaagaactgtggagaatcggggcacgccctgtcctcccagctgccagggcacagcatcccttccccacctcaacacccagaccccagattcaccccagttcacttgtccccacacgagccacaggctgccacctggggcaggctggccccaccttggggttagatgcaggtccccttgccccagaaggagactgcagcccctgcagacctagaaatggccacagcccatccccatgcaccagggggtgaggtggcaggtggtggaaagggcctgaggggggcttcttccttccaggcgagcacgacctcagcgagcacgacggggatgagcagagccggcgggtggcgcaggtcatcatccccagcacgtacgtcccgggcaccaccaaccacgacatcgcgctgctccgcctgcaccagcccgtggtcctcactgaccatgtggtgcccctctgcctgcccgaacggacgttctctgagaggacgctggccttcgtgcgcttctcattggtcagcggctggggccagctgctggaccgtggcgccacggccctggagctcatggtcctcaacgtgccccggctgatgacccaggactgcctgcagcagtcacggaaggtgggagactccccaaatatcacggagtacatgttctgtgccggctactcggatggcagcaaggactcctgcaagggggacagtggaggcccacatgccacccactaccggggcacgtggtacctgacgggcatcgtcagctggggccagggctgcgcaaccgtgggccactttggggtgtacaccagggtctcccagtacatcgagtggctgcaaaagctcatgcgctcagagccacgcccaggagtcctcctgcgagccccatttccctagcccagcagccctggcctgtggagagaaagccaaggctgcgtcgaactgtcctggcaccaaatcccatatattcttctgcagttaatggggtagaggagggcatgggagggagggagaggtggggagggagacagagacagaaacagagagagacagagacagagagagactgagggagagactctgaggacatggagagagactcaaagagactccaagattcaaagagactaatagagacacagagatggaatagaaaagatgagaggcagaggcagacaggcgctggacagaggggcaggggagtgccaaggttgtcctggaggcagacagcccagctgagcctccttacctcccttcagccaagcccacctgcacgtgatctgctggcctcaggctgctgctctgccttcattgctggagacagtagaggcatgaacacacatggatgcacacacacacacgccaatgcacacacacagagatatgcacacacacggatgcacacacagatggtcacacagagatacgcaaacacaccgatgcacacgcacatagagatatgcacacacagatgcacacacagatatacacatggatgcacgcacatgccaatgcacgcacacatcagtgcacacggatgcacagagatatgcacacaccgatgtgcgcacacacagatatgcacacacatggatgagcacacacacaccaatgcgcacacacaccgatgtacacacacagatgcacacacagatgcacacacaccgatgctgactccatgtgtgctgtcctctgaaggcggttgtttagctctcacttttctggttcttatccattatcatcttcacttcagacaattcagaagcatcaccatgcatggtggcgaatgcccccaaactctcccccaaatgtatttctcccttcgctgggtgccgggctgcacagactattccccacctgcttcccagcttcacaataaacggctgcgtctcctccgcacacctgtggtgcctgccacccactgggttgcccatgattcatttttggagcccccggtgctcatcctctgagatgctcttttctttcacaattttcaacatcactgaaatgaaccctcacatggaagctattttttaaaaacaaaagctgtttgatagatgtttgaggctgtagctcccaggatcctgtggaattggatgttctctccctgccacagcccttgtcaatgatatttcacagagaccctgggagcacctgctcaagagtcagggacacacgcatcactaaatgcaagttcccaggccctggctgcagtgggaggacctggcaagctgcactcttgctgagtccccagggtggtggaagaagaatgagaaacacatgaacagagaaatggggaggtgacaaacagtgcccccactcagactccggcaagcacggctcagagagtggactcgatgccatccctgcagggccgtcctgggcaccactggcactcacagcagcaaggtgggcaccattggcactcacagcagcaaggcaggcaccagcaacccacctcgggggcactcaggcatcatctacttcagagcagacagggtctatgaactacagccgtgggctgcttccaaggcaccctgctcttgtaaataaagttttatgggaacaca

SEQ ID NO: 2258 - DNA, 14895 bp, Homo sapiens; identical to SEQ ID NO: 2257

SEQ ID NO: 2259 - DNA, 14895 bp, Homo sapiens; identical to SEQ ID NO: 2257

SEQ ID NO: 2260 - DNA, 14895 bp, Homo sapiens; identical to SEQ ID NO: 2257

SEQ ID NO: 2261 - DNA, 2679 bp, Homo sapiens
taagaaactgaagcctctacttcggtctcttggtagccttcctcctgggaagctctttcttgaatctagtcaccattccattccaccacgccacatatgtcttctccaggcaacagccaacatctattgtcagccatgtaagtgagtttcagatgactgtggccccggctaatgtttgactgtagcacatgtgagaggccccatgcagaaccacctagaaacatggagagcagtcaccctgcagaaccatgagtaagttaagcttaggggtggttaattacgcagaaataagtaaacagagcactccaccaggtattaaagattattacaaagattatgtaattaaaacaatacagaacagaccagggttgactacaagatcaatgggacagaataaagttacatatccaatgcctgctgctgaccacagggatttgtcacagatctcatcacttagaaaccctacagtggtttccctggtcaccttccagtcaccactacaccttggctccttttagcactcctccctagcttatcactatatgaaattgctttatctctttgtattgtctgtcacctgccaccataatgtgaatttctagacctccatagcatgcaaagctctagaacagttctttgaacacagaaggtgcttgacaaatattttctgaaagaaaaagaagatacttcaatacctcagtttactaaggacgtggggctaccatatggctgcctgaacaaatacagcttgacattcactttcttgctactgattgaagtgtattaacttgtgtaatcacacaactaccctatggggtaggtgcccttatttctccatttggcagagagggactaagtatcttaaccaaggtcacacggctttcaagtgccagagccacgactcagatctacacaggtctggctccagagcccccaatctaacctcttaacctctctgctttactgggctaaaccttcaccacctatcatatggaaaaagaaattcaatagaaagttatatggaaaaaatacaaccctgtgttaatattagaaaatccatagtaacatgtagaatgaggaagcttcctcaagcccaactatacaggtcagatcggttgaaaaaataaaactaacaaatttttacatgtcaaaatatgcaatatttgaaaatccaaggctaatatctttaaataggcaaagatttattaataccccttgacacacaaacaggaagtgagaaaatgggcaactgacacaaatcgataattaactgtgaggacataggtggtggagtctctcctaatcctctattcttggagatctgaatgcctgccattcccgtatgggaagaacagagacggtcatggaaaacagcatttaatctagaaaggaccacaatgaggtcaaagggcggtctcagggcagtcttaagagctccccatccccaaagaactggcaaggactctccaggtgctcgtatgcgactgctgcccaactcccatcacgaactcagaagacctgtcattttctgaaattttcatgacttctaagacactagttattggggaaaacttcaaattatttaaataatgagaggcgaaaaacattgctaaactcatgaatactctgtatttaaaacctccactggcgatcagggcacatagaatctctactactgatccctgacgctggccatcccccaacccgtcggcccacggaccccagccctgaccccacctcctcccagcatcttacacaaggattctcaccacactccccagagactcgcctgcccagggcccctctctaaccccatatagctcaggtctctgatccagagactgcatcaccgacctctccgactacctatttccagattagagtccctgatcccagaggcattgtctaaaataactagctcttacaactacgtccacttcaggaaccgccctgtgatgtcagaactttgaggccgcccggccagggctgcacatgctcagtgaggtcggcgcccgccagtaacaaacatggctccctgaagccgctcaggctcaagagcaacaaggaggtctgcacttaatcgctcctctccgggggcggccataccgaggaggcgtctcttccgtgcaggcaggctctcctggggacctcagagattctctccagcggcagcggaaaacgggcaatgggtggattcgggtccagattctggcaggagggagtttgggatcgagatctggaaaaaagcactagactggaagaggacgcgatggagtcggagccgctggcggggacaaaaaccagaggccggggaaggcgccggtgggaggcaaggcgcgcatagactttacctgcgcacgcgtcgcagccatctccgcccacagtggtggccaccgccactggtgctgaagtgtcggcgtgtgccgggcgctccgctgggacccgggttgctggccctgagtctcagctttctcatctgtacggttgggacaagtacagtaaccctcgcccgtcaagacgggccagggctgtggcgagggtccacgccttagagcaggcacctatcttgtgcagggccctgagatggggtctgactcagttcctgcggggaacttcaccagtgacccagtcagtgcccttcagttaaagactaccaggggcacacttgtaattaaatat

SEQ ID NO: 2262 - DNA, 20714 bp, Homo sapiens
gtcatttattcaaaatatgaaattttattataattgatgtttaatgcaattcactttacgaaggtttttgtggttttccctaaaatttctgttttaatgaaggctcctgatcatcctggatgtcaacaagttttcttcttcatgtgacgtctctgatgcacaataaactgattagtttttctaaaactgattatattcatagggtttcatctcactctaacataaagtttaagctaaactacgtccatttaactaataagccaaatttgtaagagcttaacagactataaacttaactcttgctttaaagcaacaaaaacaaaaccctgatgaagacctggaagtgaattgttcgtttttcagactctagcttccttgaccttgtgctttatggttttgaacacacaggacccaagtttgctgcagaaataacctccaaatccatattatgaaccaggaagactgtgagggtttttcttttttttttttaagggccaagagtaaatgtaatatatatcattagcaccatatcccatggtcagccccacctgaataaacggcatattgggatttttccacaaactatgagcctaatgaaaaaggaaatggataagggaaacaagttcccagcctatgtcacatgagtttctgcactacgtgttatgtggtaaggtatgcattccctcaggacttcccaaatccattacatgctagggttttctctctggtatgcattctggtgtgatgtaccctaagagctgccttacggacaaaagttttcccacattcatcacattcatagggtttctcccctgtgtgaattctctggtgtactctgagagttgaattttgggcaaaagctttcccgcattcattacactcatagggtttctcccctgtgtgaattctctggtgtgcactaaggtgtgatttctgggagaacgttttcccacaatcattacattcataggatttctcccctgtgtgaattctttgatgtactctgagggttgaattatgggcaaatggcttcccacatacattacattcatagggtttctcccccgtatgaactctctgatgtgcactaacatatgacttctcagagaaggttttcccacattcactgcattcatagggcttctcccctgagcgagttctaagatgtgctctgagatgtgatgtcttggagaaagtcttcccacagtcattacattcatagggtttctcccctgtgtgaattctgtgatgtgccctgagggctgaattatcagcaaacgttttcccacattcattacactcatagggtttttccccagtatgaattctctgatgtgcacagaggtgtgttctttgggagaaagttttcccacattcgttacattcatagggtttctcccctgtgtgaattctttgatgcactatgagggctgccttatagacaaaagttttcccacatacgttacattcatacggtttttcccctgtgtgaattctctcatgtccactgaggtatgatttctgggagaaagttttcccacacttgctacattcatagggtttctcccctgtgtgaattctccgatgtgtactgaggcgtgtcttctggaaaaaagtttttccacattcactacattcatagagtttctcccctgtgtggatattctgatgtgctctaagggctgaattatgggcaaatgttttctcacattcattacatttatagggtttctcccccgtgtgaattctctgatgtattttgagggctgaattatgggcaaaagttttctcacagtcactacattcatagggttttctacctgtgtgaattctctgatgtgctctcagggctgaattgtaggtgaaagatctcccacattcattacattcatagggtttctcccttgtgtgaattctttgatgtgccttgagaacagaaatatgggcaaaagaccttccacattcattacattcataaggtttctcccccgtgtgaattctatgatgtgctctgagggctgaattatgggcaaaagttttctcacagtcactgcattcatagggcttctcacctgtgtgaattctttgatgtgctctcagggctgagttataggtaaaagatttcccacagtcattacattcatagggtttctcccctgtgtgaactctctgatgtacactgaggtgtgtcttgtgagagaaagttttctcacattcaacacattcatagggtttttcacctgtgtgaattctctgatgtgctctgagatgtgatgtcttggagaaagttttcccacattcaatacattcatagggtttctcccccatgagaattctctgatgtcctttgagatgtgatgtcttcccatattcactgccaccacagagttccatctctgcatctgttttctggtgtcctatgaggggtgacttgtaagatctcccacagccattgttatcacaaggtttctcttttgtgtgaattctcagatgtttactgaggtttgaattctgacagaaagctttcccacattcattacattcataaagtttgaatcccacataagttccaggatgctgaataggatgtgaacttgaacaaaaggattttgcacattcctcatattggtaagttttctctcctgagtggggcctctcatgctgaatgaggtgtgctttccagtaaaaggattttctgcatttcccatgttcatcagaaaggtagaatttctgatgtgctgtaaagtctgtgtgaattctctgatgtgctgtaaagtctaatttctggtagagggcatctgtacattcattatgttcaccaaatttatctccagcttgtgttttctgatgtactatatgggctgagctctggctaaaattttcttcacatttattgctttcaaaagcactccatcctgtaatagttctctgagattgagtgaggggtgacttcctactgaaattaatccccctttcattacactcatagtgtgtcatagccatgtgaactttattgtattcaacagcggtggttttgtcacaggatgtcccatattcattaagatcagagcatttcccccttttgtcagttctcatgtggttaaataaagtggttttatcaaagtttttttctaaattcatcatccttacaggacttttctcctgttagaaaactctgaggtgtaatacaaattgtcttatcatataaaccttgtccagatccatcacattcaaaagattcctccaaagtttgaaatttccaatgctgacctttcttataactgaaagctttagcattttcaccatgttcataagatttctcttcagcatgagctttctcatgcttaatatcaagctgcagtttctcacacacattcatgtattcagtcttctttcttgaatattttctttcacttataattaattgagaagcaactggcaaattcattctgtgtgagtcacatttacaggatattttttctgaaagctctggagctatttccagattaaatagtttttctaaaactttctgtccttctttactcaatgttttgtcagcatcactgatgaatatttcttgccacagaggtttttcttgtttttcccggatccctttgatgtgatcaactttaaaatatcctaaaatgagaaaaattgaaaatatagtataaatcttacatttctcatggagaagaacttatactcatattttggttttggttttggtttttgaaatagggtattgctctgtcacccaggctggagtgcagtggcatgatcatagctcactgcagccttgaactcctaggctcaagtgatcctcccacttcagcctccctactagatgggactacagggatatgccaccatgtcctgttaattttttttatatttagtggagagagggtcttgctacattgcccaggctgatcttaaactcctgagctcaagcgatcctcctgccttgacctcccaaagtgctgggattacaggcatgagccactgtgcccggcccctgttttgttatgtattttattctattgtttctggtcatgtttccaaatattaaatacttcatgcacacagacagattctctcctcatccatgctgtttataaaacaggtattatttccggggccagtcaaggtggagtagtaacccctttcttcccacatcttccctcttacaattaaaaatccctagagaaaaaacaaaacaacaaaaaaagattaacaaatatacaaatatacgaatactacaaaatggaaagaaagtggacttcaggacttaagaaatgacacagtatggaattccaaggctattctatatcctagactgggtgctgaagaaacctacaatcctgcactgacaggcacagacaaaaagagcacaaagaaaagcctgcttcttccagccagaggtctgagaaaatggtggtctaacagaacaggaaacacttttgatgttttctcatgctcaggccaaaccaaaatgatacaatcctgtggttccatggaggctgagcagggagctaatgttccctgccgtagatacacaggatctgcatgctcttatatgttttcttccatgagccatgaagaatcctgagaaagttccattcttaggatatgctgggagacggtcacagcagccactaccaaaattctgcctagaaccaaattattatctaatttatggaacaaatgtcttaatctgcaagggcaagaatatagtaagttgttttagggcactgacaggaactcatagcagctatgggaaggaaacaagaaaaaaagaagcacagaagtaagaggagaggcaggaatacacagtagacccaatactcaagcagaagagataagataaagtagcacttgcaataaccatggcttcaaacctgaagacacaatgcattcaacagctgaattcacattcttctgaaatgcacatggaacaatcatcaaaacagactatattctagactgtaagacaaaccttcagaaatatagaagaaataaattatacagaggatgatcttgggccacagagaaattataccagaaatcagtaaacacaaatttatctggagaaatacaaaagaactgtaagttatacattcctaattaacccatgggtgaaagaattctcaaatgagatattttgaagtgaatgtaaacaaaacaacttagaatacagaaatttgtggatgcagctaaggcagtacacatagataaatttggggcttaaatttttttggccagatgcggtggctcacgcctgtaatcccatcactttgagaggctgaggtgtgtggatcacaaggtcaggagtttgagaccagcctgaccaacatggtgaaaccccttctctactaaaaatacaaaagttagccgagtgtggtggtgcacacctgtaatcccagctactcaggaggctggggcaggagaattgcttgaactcgggatgtggaggtgcagtgagccacggtactccagcctgggtgacagagtgagactctgtctttaaaaaaattatatttgaaaagaaagatctccagtcagatgcttgtttcccccttaggaaactagataaagacaggacattaagttgaaagaaagtagaaggatgacaaaaaagtcaaaccaaaagcttaattttttaaaaagtttttttaatgataaaaaccatcagagagaaaaaaagagaagacacaaattaccaataccaaaaattcaagagaggactaactactaacagacattcaagagataataaaacaacattaacaataactctgtcttagttcgggctactacaacaaattaccatagactaaatggcttaaagaataaacatttatttttcccagtgcaggagactggaagtctgagattagggtgccaacatgactgtgttcttgtgaagacctcttctggtttacagaccactcacttcttgttatatccttacatggtgaaaagtgaagtagctagctctgacaccgttttgtaacagcattctagtctctctctctttttttttttttaactataaaagcaaactaactttatttggacaatctaagtggaaagaagaggcaggtgaatgtgtattgtaaccacagggaatatattctatgtcaaatgttaaaacataatggcagaataatctaaaagacatttttttctaaaggagctgtcggtgaaaaggatatttacgacaacatattaacttacttcattatgatggaggatatgttaactgaatgtctaatttactcaaattttaactatgtttgcatatgtaaataaggcttaagaatgtaatgaaatcttcctctatatatgtgtatgtgtgtgtgtgtgtgtgtgtgtgtgcaattccaaagaacaacttctggaccaaatagttttaactagtaaattttaccaaacatccaaggaagaaataataccaatcctacacaatgtcttctagaaaataaaagatggaatatttcccaaatcattttataaggcctgcctcatcctcatagcaagattaggcaaatactattcaagaaaagaaactttcagaccaatatctcccataacataaatgcaaaaatgtcccaaaaagtacaccgaaatatataaacatagataatgtatcagtgaaatttacctcaaaaatgccaaacagttactacactgcaatactataaaaactatagtttttatgctgcatttcaggtcaatgtaatctcctatcattagtctgaagaactaaaatcacacactacatcaatgccaaaaattttaacaaaattcaaaatccatttgttaatttaataaaagtaatctataaaaagcctatcactaacattatactcaagagagactgaatgtcttccctctaagatcaggaaaaagacaaagatgcccactaccagtagctttacacaagattgcactggaaggaccagccagtgcaaaaaggtaagaataaaaacacaaagatacagagtaaatttacacagaaaatttaaaatcaaaaaagttccttgaactaataagtgtttttagcaagggcagaatctaaggccaatatacaaatctatgcctacaaacatacaatgatgaattggaattttaaatcacagaaacaatattacagcaccaaaacaaaattaaaaacaaaaattaaaaaagcctcgttatctgtgttctaaaaactaaaagacattgatgaaagaaatcaaagaaacagtaaataaatcagtagggatattttgtgtatggactggaagactgtacattgttaagatgtcaattctcctaagttctgcagattcaatgccactccagtttaaatgccaacatgtttcctttgtaaagattatgaacctcatttaaaaatttatacacaagatgaaaactggagaagtacttgacttcaaaacttaataagctagagtaatcaagttaatgtggtattggcataaggaaagacatgtagatgaatgaaaaggaatataaactacaaaaatagacccccaaatgtacagccatctgttttctaagaaaggtggaaatgctgttcagtggagaagtaacagtcttttcaaaaagtgatgctggaataactggactccctgttccaaaaacatttaacttgacacataactcatactttctatagaatttaacacaaaatggattatcaactaagtgtaaaaactgaagctgtaaaatttctagaagaaaataggattcctaaatctgttactttgagtttcaaggtttctagatagaacaacaaaagcaggttctgtaaaagaaaacaagtaagttggactttatcaaaattaatattcagttttagtgagcctcctctaaagttatactagcgggagtgaggtgcagcatcactgcctgctacgtggggaaggaagtccagttccccactgatctgacgccctgggggtggaagaggaggcttctactttttttttttttttccttccttttgagacagtttctctcgtcgcccaggctggaatggagtggcgcaatcttggctcactgcaacctctgcctcccgagttcaagcgattctcctgcctcagcctcctgagtagctgggattacaggcacctgccaccacgcctggctaatttttgtacttttagtagagacggggttttgcaacgttggtcaggctggtctcgaactcctgacctcaggtgatccacccgccttggcctcccaaaatgctaggattacaggtgtgagccaccgtgcctagctgaggcttctacattaaccctgggcatgggtgaaagatcaggagccccacaaggactctgataacactaaccaccttgtattttgtcaggtgccaagacccctagtgcatcttcattcttctttccacccttcagtagtgtgatctcagctcaccataacctccacctcccagattcaagcaattctcgtgcctcagtctcccaagcagctgggattacaggcacgagccaccatgattggctaatttttttgtatttttagtagagacagggttttgccatgttggctaggctcgttaaactcctggcctcaagtggtctgcctgcctcggcctcccaaggttctgagattacaagtgtgagccactgtgcctggctagatattgcattctttacaaactgaaggtttgtggcaaacctgagttgggcaagtctgttggtgccatttttccaacagcaagtgctcactttgtgtttgactcagcagtttttagcaaacaaatattttaattaaggcatgcatactgttttttagacatgttattgcacatctaaaagactaaagtatagtgtaaacataaaacttttataagccctaggaaaacaaacattgtgtgtaacttgctttattgtgaaatttgcttcattgtagtggtctggaacagaaactgcaatatctctgaggcatgcttctatatacagatatttagctgcacttagtgggtagagtagaaaggaatacatttactccatccttcccctgggtaatgcattctgtattttattaaatccttccctaagaagagtcattaacctattctatatgatcttctagaatatttctacttttgttttgataattaggtcttaagccaactgaattcgactttttgttttgttttgatctatatggatacctcaagatcctttcctcattgttctccagtgtcatctatctaagatgtctatcaagtatatgttttttcttttctctttttttttttttttttttttgagatggggtcttgctctgtcgcccaggctggagtgcagtggtgcaatctcggctcaatgcaagctctgcctcctgggttcacgccattctcctgcctcagcttcccaagtagctgggactacaggcacctgccatcacgcctggctgatttttttgtattttcagtagagacgggtctccatctcctgaccttgtgatccacccaccttggcctcccaaagtgctgggattacaggcatgagccaccacgcctggcctcatgtttttttctttaactttctactctgtttcactaatttactaaatcatcccaccccccagctccatgctacttagctacacagcactttacataaagcctcaatatctggtagagcagcaaatcctcctgtatcactcgtttttatgaatgggattgtgtttggtatagcgttacctctttacagatgtatcctgacttgaatttattatataggtgtttcctctcttttttctttgatagagttagctgaagtttaattcattttatttttcttgtaagaaacattccatttctgttttccattttatttttaattttacttttaaattcttctgttttcactattgtatttttgatgctgttcttgcttaattaatgagactacgaacttccttctgtccactactttagctatacctgatggtttctaacttgcagttacaattatttcattacagaaatcaaatccaaaattgcattacacttttttgtatattgtttaaaagagatactaaaattttttcaagtggatttttttcattttattattaatttctagatttatcaaactaggttcagagaatactgtttgtgtttattctaatttgttagatttattgaggttttctctttagactaatagtatactctattttatcattattcaattaaaacatgaaagttttgttttttgcattagcatacatatacacaaatgtatggttcactttaatacaaatgtaatttatagcctctctaggcatatttatttaatgtccactgtacctactgtttaatcagatgagacattatgatgtcctaattctaatgagttttaagttcttagaactccattattttatgttttagaaacattgatattatattatttggtgcactcattcaaatccttaaaggttttcatttccctgtgctcttgaatgagagcttttcctactttaatgaatttcttgcctgaattcaaatctgaatgatatagaacatgaaacctacattattttatctttattgactcaacaactttactgattttttttttttttttaattttttgggactgagtctcgctcttttgcccaggccggagtgcagtggtgctatctcggctcactgcaagctctgcctcctgggttcacaccattctcctgcctcagcctcccaagtagctgagactacaggcgcctggctaattttctgtatttttagtagagacagggtttcaccgtgttagccaggatggtctccatctcctgacctcgtgatccgtctgccttggcctcccaaagtgctgggattacaggcatgagccaccacgcctggcccaactttactgatcttttataatgatctttctatgttacttatttagggatatcctttttagacaatcaatatgatccaataatttacatttagtgactcagcaacatacttgatctaaattatgtcactctttatgtgatgctatttgttggtatggcttcaaacaaaaaccttaattgtgcttcacttctaataagatgattttacctttttattctaaaaatgacattgaaaactataactttttaagatttctggaatcatttatttgtacaaagcctaataggcatataaaaagatgcctgatatcattagtgaccagggaaattgttatagacttatttgtgtccttcccaaattcttatcttgaagccctaacccccagtgtaactgtatttgcagacaaggccttcaaggaggcaaaaagggtaaaaatgaggtcacaggaaaggaccctaatccagtagtactgatatctttataagaagcggaagaaacaccagagtattctctctctcccactgcatgtgcacagaggaaaggccacatgaacacacagcaagaaagtggctgtcttcaagccaggaagagacgcttcaccagaaaccaacttattagtactttcattttggactcccagcctccagaatcatgagaatttctgttgtttaaactacccagcctatggtattttattatgatagccctagctgactaatacagaaatgtacatcaaaaccacagtgagatatcagttcacatccactggggtggctagaatcaaaaagtcaaacaataacaagcattggtgaggatgtggagaaatcagaacccccatatgctgttgttaggaacagaaaaatgctgcatttagaaaaaccgtctggtggttcctcaaacagataaagacacagataccatatgacccagcagtttcactcctaggaatatacacaagagaaataaaaccaattgtccatgcagaaacctgtaaataaatgtttatattagcattatttgtaggtggaatcccaaatatctactgactgataaatggacaaacaggtggtacatccatacaacgggacattatttggccataaaaagaatgaaacatgtattttatatcagttgtaaacattatgctaggcaaaataaaccaatcacaaaagaccacatatatgatccaatttatacaaaatgtctaaaataggcatatttatagacacagaagtagactgtggttacctagggctgcagagggcaggggggatgggacagtgataactaaagggtacacgtatgtttgaggtgatgaaaattaactgtggtgatgtctgcatatacagtcatcccctggtatccatggggaattggttccaggattctcttaaataccaaaatccacaaatgcccaagtccttgatacaaaatggcatagtatttgcatataacctatgcacatcctcttgcatactttaaatcatcaccatattaattatgctacctaatacaatgtaaatgccatgtacatagttgttatactatattgttcagggaatagtgacaggaaaaaaatgtctatacatggtgaatgaaagtgcaatatttcttccctgaatagttttgatctgtggttgcttgaagtcactgacctgtacactttaaaggagtgaattgtaggcatgtgaattatatctcaataaagctgttccaaaaaaactttcaaaggtgctctccctctaaagactaagtacccccaggtacttctgttaatgcccactcacctgggtacctctggttcaggaattcatcttctaaagaccatggctcttctcctttctccaacttggagatcaccttgggtttagtaatgcaatatcctgtaaacaaaataattgacatggaccagattcacaggcttttggatttccaaagggaaaaaaaagatatggcagcaaagcattaactgagggtgttcatttgaaatttttaatgggaaagtaatgacatgttgcttttgtttctgtaaaggtttcaactacttcagaccttttaatccaaagccctttaatctctataaagggtccatgtgttttgatagtttttaaaaagggacatgtattctcgagagagccccatggtaagctatgctcacccactgagacgaggtggctgtagttctccagcatcacatctctgtacagcgtcctctcgacagggcccaggtgctgccactcctcccgggtgaattccacagtcacgtcctggaatgacactgatgcctgtaacaacatttatcacaacaaatataacaacggtttgttcaagggttcagaattgggtgacacagaaaatatctttgagagctactactaaaatgaatggttataaaggcctattttagacccaaaattgtcttaacatatgtaactcaaaacattttttaacttgccataatttctctatgtatttatgaattctaggtttttgtaagacaaaaaaaaatcaatgtaaaacaacttccttccaaccacctccttccttcttccacatctccgcaaattatccggggtagtctctaggacattcacaccctccctggacatcatcactgtaaattctgggggctaaggaagagatatatgtgaagtctggagataccctgaccaaactttatatagggtagagcaggtgaagagcagagaacagctacaatagttgtaaccaaagagactggcacaaaagaacactttctacactgaggtcacagcaatggatgtaagaatagggatataatcacagaagagaagcaacacccatttaatacaatactttattgtacagctactcaatctagctgtatgagaagctccttttaaaaaaattttgtttttaattgacagaaagacaaatatttcaaattatagtcacttatatgtggaacctaagaagttcaaactcatagatgtagacagtagaatggtggttaccagaggctgggggtgaggggtgaggaatggggaagcattggtccaagggcacagagtttcagttacataagaggaatagtttttgagctattgcacaggatgatgactagagtgaaaaataaagtaatgtatatttcaaaataagcagctgcttggtggtgccaaaactggtatctgggaaagaagaaaacgtgttagaagattcagtgagagttctgttcatgttgatacgtagctagaactgttcgttcaaccaggatacatatgattttagaacacagaaggtaagatggggatgaagataagcatttaggatttactagcaatttaggtggtgagtaaaattagcagagacagacagctccttgagcacacagggattgaagaaagaaaagaaccaaaaacaacacctgaggaaccacaaagcagaaaaagtacaggccacaaagccagagatgttttccaaaaaataataacagaatcaggagggggcagagtcttagaaattgagaaaagagaaagtttccacaacaagaagacttcaaattcaaattagcaagtgatgacggtgaagatactgaagatccaagaaaattccttcttccataaaagcaacgagaaaccggcaaaaactgcagaatcaactttttcagaactctagaagctaccaaaggcttacagcaatctgcggaacattgatatgagaaaaacagctgcatcacagtaagaacaatgatcttgtgtcatttcaacctgccctatatccatccctctcactcccactcggcattagctttgagaaacatctgaaacaacaggagaatccagcggcctggtatccactggatgaggcagactgggtcacaggttggccaaagcctcactcccagaaaaccctcattatctgacctaatctgtggttccctggaagagctgacttgaaaggctgattgaattaagtcagagttccccagtgtgaaaagccttattcttgaaggcatttgccaaaaacattcaaaggcaattgtttaactcagcagctaactgaggcggtggataacacctgacataaataacagcctaattgaaaagctttttagaaaggaaaaactggagaatgggatgttcataaagcttttgaaaagctcctatagattctagagactctaggtcacctacatgcatagagctgagcatatgcccagggctgtgattatgctctggaaagatgtgagaaggccctaaactgtcaccctgggtgaccctagggtttggggtgaactggaagtgaaggaagtgaaggttaacatggggttataaattgcctggatgtctgttgaaggaatgccccagcactcatgaggctctttggcaaagactgagagccttacttaaggtttcaggcatttaagaaaatttctgcagacttctgcggccacacatgacaataaacacaggctctactgaatcaattaaaaagtcactagacaaatttcaacaacaactcctgcaaatcaagaaagttttctagagttgccaccgtatttaaaatgtatagttttcaacaaaaaatgcaaaacaagaaaagaaacaacaagtaagacccatatgcaggaaaaaagtacaatcaatagaaactactcacgaggaagcaggcattggacttaaacagacgatgactttaaatcaactatgttacatatggtcaaagacttagaggaaatgatatgtaaggaccaaaggaaagtattagaataatatctcaccagataaaggatataaatagacagaaactataaaaagggaccaaatagaaactctaaagttggaaagtacaaaactaaaacaaatattttaccaaaaacacctgttcaacagcaggtctgaacgggtagaatgaagcaactggacaacatgcccactgagattatgcagtgagaaacagaaggaaaaataacaagaaatgaacagttggacagcatcaagcttatcaacatatgccaaatagactaacagaatggagacagaaagggtctaaaacaatatcagaagtagtaatggccaaaaaaccccacaaatctgaaataaatgataaatctacatgcccaaaatgcttcacaaactttaagtaggataaacttggagaaagaaatccacactcgctgggagcagtggctcacacctgtaatctcaacactttaggaggtaggcagatcacttgaggccaagagttcaagatcagcctggccaacatggtaaaaccccatctctactaaaaatactaaaattaaccagacatggtggtgaatgtctggaatcccagctacttaggaggctgaggcacaaggattgcttgaacccagaaggtggaggttacaatgagccgagatcatgccactgcactccagcctgggtgacagagcgagagactgtctctcaaaaaaaaaaaaaaaaaaaaaagaaagaaagaaaagaaaaagagaaaagaaaaaagaaaagagaaatccacacctggacatgagaatcagagtgttaaaaagacagacaatcggaaagctgtaacagagaaacaagtcatcgtattacaggctgatttataatgagaaactatggaggacagagggcaatgggatgacatattcaaagtgctgaaacaaagactgtcaaccaataacctctatatccaggaaaaatagagaaactggaattttcccaggtaaacaaaacctgagagaattcatcacaggcaagactgcctataagaaataataaagggagtggttcagcaaaactatggagatagaggagtaggttagtggttgtttggggctcagagggaatcaaatggtagttacagtgtacacagcttctttctaagggaataaaaatgttctaaaattgactgcagtgatattagcacattatctgagaatgtactaaaaaaaatcactgaattctacactttaaatgggtacatggtaagatacatgaattgaatctcaaaaaaaagcagttttaaaaaaagaaaaaaacaagggaagacaaaatcatttggagacaacagagaagactaaagagccaaggacagaaactgaggctgagccgagtgacaggacaaggaaggtggctccatgaagacatcagccggggaaggaccagtgaggggcaagtatcactaacggaaatgttccaggacagagtgagacattgaggcaagtgctgcggaaaagccaagcaagttaaggaaaagaccacgtccactggatttgattatactatgggtagggacactggaggtcccaggcaagtggcaagaaaaaatcaaggcatcccatggagagttgacgttaaatgctaagtgtggaaatatctgaaagagaacaattttggaccatctgctgagcaacctgaatatcatgggtactcaaaatatttatggagagtgattttaaagatattcagttgattcatcagaaaaatgttaaattcaacccttgcactggagtacttgaaaaatagtactgaacgtgttcaaatttagcattacaatttctacttctattgaagaagtaatattctgttatttggcaatttattaactaagtcacctacttgaagaacaataaatacattttgttatctttatgtttatattccatgataaatcagttggctttatctttctcatcaatgtaaacctttaagtattgtctgtctgacactccaccatgactgtcaataacctcagaaataaatctgaagcttaatttggtaaatttgtaacatcggaggatctgcatctatccacatgccactttgctctgctattcatctgcatttctacatcttctaggaatgtgtctgatccatctctatttctacttttccatgttaatgtacggacacataaacccttacaaaacctattgtaaaataaaccggtttttaaaaacctaactcacctgagacatgttcattttctgctgctcctggaagagtgtagaggactgtggaggttcagctggggaggaggaaagagcagtggggtcatgagagacctggtctgcctctcagttcttacagagatggtccctgacatgagatggttcgacttgataatggttttactgcgacataaccccactgtaatcaaggagcatgtaatcctattcatgtgcctaaaaaaaaaatcatcgcactcagctggagaaaaggattcccaatgcagaatgtccctttgattcttgaaaaggggcaagaaagaccactcaaagatagccacacctgaatatgtgcatctctgatacgattatgtgcgcttaaacttacattttcactgagtaaagtaatactgttttttgttgatttactaataattatgttgatttattaacaattatgttcccttttgactaagaaaaaagtaaaaataaaacaaaggattaagcaagttcaggtacacagagatgaagctgtttaccttcattaaagctaatgtcaaagaactattcagccgggtgtggtggatcatgcctgtaatcccagcagtttgggaggccgaggggggtgaactgctggaggccaagagttcaagaccagcctggtcaacatggcgaaatcctgtctctactaaaaatagaaaaaaatataaaataaataaattttaaaataatttttttaaaaaagaactactcaggctgacttaatcaagttcttactgcctttacacccagaattagcacttccacggaaaaaataaagataggatgttttatgcaaggaatttcaggcccaatatttttgggcttccaatataggaaattcttcctctactacccggaaagaggcagcattagtatcactctaaatgccacatgtggtgatgaacacggtgtgagagggactcacaatgtggaagaagtgaaggcagaaaggaaactaggctgccgtttgggatctggacagctgattacatcttccctggatatcatgacctaaccagccctccagtaaagtgtctttttccacccagcttgatagtcactcatccctctcaacccctgggaattgccttctgcaagttagtccacagcaaagtcacacggtctgtgatggcttctggatgtggcaacatcacgaaatctgatgcatatataaggagtcaacaactgcctctggggaagcaatcaggacctgctcctttctagaatcttctgcctctgctctgacgctctagaagaggtctccgtcatatgggctgttcttctatggcagtaggccctaggactccctcttgactgcctcataggagctgctttgctccagaggggctgggacttaggcctgagaaacaaactcaattgaaaccttcacctaataccctaaacctgactcttgagattcactagaaatgtgctatccagcactgcagccatcagccacatagaaccattgaacacctgaagtttggccagtgctacaagtcgaatatttaggaagtaaaataaagcagtaaaactgactttgtctgcctcttctttttactgtagctactgaaaaattctaaacttttttttcttttttgagacagagtctcactctgtcactcaggctggagtgcagtggtgcaatctcggctcactgcagcctccgcctcgggttcgagcgattctcctgcctcagcctcccaagtagctgggattacaggagtgcaccaccacgcccggctaatttttttatttttgtagagatgggcttttgccatgatggccaggctggtctcgaactcctggcctcaagtgatccactggcctaggcctcccaaagtgctgggattacaggcatgagccaccgcgcctggccaaaaattctgatttatatttgtgttttgccttatctttctattggacagcacagcaccagaatatcaatctgtgcctttgaggagacagcgggaacagtacaagaggattcaggagcctcagcctgaatcagagacccgacaaatcgcagaatgtatctaccacttggtgagattctgtccacatttacttcacaatcatctacacagatctggtgacaggccactctgcataagcgctctgaaggctttaggcaggtactggcaagtctgggtttcaggcagacagcatgttagaacgagcaggacagggagtcctgcatttgcatctctcagcatttgcatctcacctctctcacctactagtgtgtgccctggggtacccatccccatgaactttcgtccatttttttaaaatggcacgtttataccaaagaggtcgttgtgagggtcaggtgaaataccaaacgatgagaataagtgtctcataattgtgagagcagcttacatttcacatagtgactattacagacacttaacaaaatgctttacaggtgacaacttatttaattttcagaataggaacacgagttgctagtaacctcctcctgttcgccgtcaacctcatccacgcacattcctcttcccggcccgcaaccccgcggggcccggcagcccctacacctgcggacaggactcggcctgggcccgcgcactgggccggggaggagaggggagggccatcctggggactcctgagactgcctgctgctgtcctccgcacacaagcccgcccgtccccaggttcctgggccgcgcggagccctgtcaccgacgctctcaccccaggtgcgcagcctgggctcccgcgcagacctaaagactcggacaccgtgtccctttcaggcccgggagggcagacggcaggaggtggggctgggtttacacatgc

SEQ ID NO: 2263 - DNA, 215538 bp, Homo sapiens
cttcagttaagctatttttttaataaattgaaaagatgttctgtacaacataatagagtcataggaaatcaaaagcatatcagtaacaacttttagaaaaagaaatgaatgataaagaaaaacagatatgacctctcaatatcttggggaagtaagttaggatgatgtttcattcacgtcttaatgatataaataaaggataactctgtgtaagaagtattgtttgtatctggtggtaaatttagttaaaaacataatcacaagttacaaaaactgtaattacaaattacaaagaaaaacaggcagacaatcttgtattgacatcctcttgcatcttgttacctaccaatgttctgttccattataaaattcaatactaaaatttcatagctaacattcaatattaatttcaacattaaaatgtatcaaaatcattaaaaacagtcaattagaaaaagcaatacaccaaaaataatggtagtgtttccaggcttcaactgtgttgtattaaccatcacacaggagaataaaagggctgtgaattttagataggccacttggctctggattccaggactatggaaatgccagtgaaggtagtccaagaagcatttcttgttttataaatatcagcagaggaccaaaaaaagggatcccagatatgttttcaagtaacaaaaaacattaaagtgcaattttgtcttttacatctgaacaaaagttctgtcatttttaaaaaataaagtagggccacagctttatagccattttctcatctaaaaccccacaattattaacacagatcaaactgcagttttggaagagagcctttggacggggaaactactgaacagtgatgaatggccatacctaattcattgtttggaaattgatgtggaggactgtgtttcaccgagggagaaagggacctcccagaggctccgaggctgcaggtcttcagccaggtgacagcactgcacctgcttgtgtgcaccctgatggcaacagcagggaagtccacagtcacgatgatagagacagccacagctgccaatcagaagactcgctctttctggttttcatggactgcgttttgcacatcgagctcactgtttagagctgtcctagcactcttctttttttgagacttttgactcattttctttgcgtaactttctctgttgatagatgcgtatggctatggcagtgatgcaaagcaaaataaatatcaccactgctatcacacctagggagagaaaagaataaaacatcataattttttttcttttttctttttagagagagggtctcactctgtcgcccacgctggagtgcagtggcatgatcacagctaactgtagccttgatcctcccaagtagctgagactataggcccactccaccgttcagcttatttttttttttctttttacaattattctttgtagagatggggtgttgctgtgttgcccaggctggtctcgaactcctgggctaaagtgatcctctcaccttggtctcccaaattgttgggattacaggtgtgagttaccgtgcctggcctcaatgtcagagtataaatggtgacttttggtccaatcagaggctttgcagacatcattgctttttaagtttggttaaaataaaccaaacacctattatattataaattgaaaacaccaaaactcagaaatgctgaggtcaagtaattttataacatttaacatacttctgacggactatgacttttggatatggctgtgttaggctttttccctacaggtatatgatgattgggttttagataatgctttcagatttaaaagaatagagacatacatgtctctaagaccgcgtacatccttcagttaacaagtgggaaatgttaaatcattttacaagtatagagtgtttgcatcatcatagatcattacatgttattgttagtacaatgaaatggatacattttaatgaaattgttttcaaatacttttatgataatacacttttcttttttttctgagacggagtcttgctctgtcgcccagtctggagtgcagtggcgcgatctcggctcactgcaagctccgcctcccaggttcacgccattctcctgcctcaggctcctgagtagctgggactacaggcacccgccaccgcgcccggctaactttttgcatttttagtagagacggggtttcaccgtgttagctaggatggtctcgatctcctgacctcatgatccgtccgcctcggcctcccaaagtgctgggattacaggcgtgagccaccgcgcccggccgataatatacttctcaaacgcagtagtgtcttatatatgtaatcaatccctattaccaaaaatattgcaggcatatttattcattttttttttacctggaatgtggattatttgaaagacctgggcaaaatgttttaaaatattgaaaccattagcagtgtccatgattctcgactctagctgcacactaagtcagtaaatcagaataaatgaatggaaggcctggataccagtatctttataaattgtttcaggctttaattcagagccagagtgctaaagcatgaagccatgccacagaatgctgtgtactgaagcaatcatattagtgacaaatgaaagtaaaatctaccctaaaagaaataaatgtgtataaagacaagcttctgaaggtaatcagaatatgtcacccccaaatatgcctttttgacaaatattttgaagtaaaggcaattaagaagcagccaatggaggaagagctctctagatcctcccctcttttcatctaaagacaggatgtaaattctcttttaccggagaccattcttaccagctcagggatgtcagcagaagaatgtacaaacacacgtattccactagtttcttcccatatatttatcttcccacggtttcttgccttcggacacctaaaattgctttccattgtcctgtcatttctccacaaatgtattgttgaagatgagccagacttctaagccactgcgctttgagtttcactgaggtttctcccacgtgctgtgggctgcatgccttagtaaacttgcttgtttttctcttgttaatcagaggtctgtcccaactacaaagttaggaatgatgaggagaaattatatttcctcccccacgcttttactgcctacatcgtacatttaaagtacttcacacaaatattaatttatatcttcagccagtccctattagaaaatgcaaactgcctctgggaaagcccaggggaagccttccacagactccttttcatcccctcgttcaggctaagaatttctcagcggaagagaacactgctaagatgtttccttacgtttactccgtcaatcttgccagtgatatttgaccaccagcaatataatacaattccaaagataagagctggttctatgatcaacttgcccatttccttctcaccaaaagctgggtactaaccctgacattgtgtaaacgtctgtaggacttggaaacctagcgtgaaaatgttcggcatgttgaaattgcttttgcattgcaatgaaaaaaatctcctaaaaaggcatgattgatttaggattggatttgatttaaaattgaacacgaaagtacaccttttagatatgcattattgaccacattcccactggaaactgtttaaaacagtttttgttcatcaggtcatgtatttttaatttacaccttactgatttctaagagaaaaagaattgagatagtgatggaaatgtgaatatcctcaactgaaatttagtcagaactttattatgtcgaaattgttttctgtcattttgaaggaaacaaacacaactagtttactcttgtatgtgctatggagagtctgcagaataagaatacaattaagatttcaataactcggccgggcatggtggctcatgcctgtaatcctagcactttgggaggccaaggtaggtggatcatgaggtcaggagatcgagaccattctggctaacacggtgaaaccccgtctctactaaaaatataaaaaattagccgtgcgtggtggtgggcacctgtatccccagctacttgggctgctgaggcaggagaatgggaggcggagcttgcagtgagccaagatggcgccactgcactccagcctttgcgacgagcgagactccctctcaaacaaacaaagatttcaataattcactcattaattaacaaggaaaggtgaatgcttattttttgcaccagctctaaataaattatattttagaaaaaaagttttcattgccaaaacatatttttaagctatgcttaacttcacttttcttcaattaaaaataaccagaaaacattcttagcctatgagattagttctttccaaagtatgattaaaagtgaaacatacaatggctactgctgcacaacattgtaaatgtccttaatgacagggaattatacactttaaaataacaacacattttaaataatgtgtgcctttaaaacttcttaaataatcacgcctgtaatcccagcactttgggaggccgaggcgggtggatcacgaggtcaggagatcgagaccatcctggctaacagggtgaaaccccgcctctactaaaaatacaaaaaatagccaggcgtggtggcgggcgcctgtagtttcagctactcaggaggctgcggcaggagaatggcgtgaacccgggaggcggagcttgcagtaagtcgagattgcttcactgcactccagcctgggcgacacagcgagactctgtctcaaaaaacaaacaaacaaacaaacaaacaaacaaacaaaaaacttcttaaataagtgaaacactgtcatgggagtatctaaatcatactatttgtcattgaagaaaagtaccataaagtgtatgctctgataattagctgaggtttccattgctttgaacataattacttcaggtccgtccaacagttgtcattaccgtgacaaatatcccacatgtcctagggaatacagctattttcaaattaataacttttcagtattagctttgtaactgttcttcaaaaaaaattgtttcggcagaattcttacatgctgagaacccccagggaagctgaaatcagcaaatattgccttagaaaatcaacgaaggccgggcatggtggctcacgcctgtgatctcagcactttgggaggctgaggcgggcagatcacttgaggccaggagttcgaaaccagcacggccaatacggagaaaccctgtgtctaccaaaaacacaacaaattagccaggcatagtggcacactcttataaccctaactattcaggaggctgaggcaggagaatcgcttgaacccgggaggcagaggttgcagtgagtggagatctcaccactgcactccagcctgggtgacagcgtgaggctcttgtctcaaatagaaaaaaaacaaagaacaaaaaacaaaaaaccaccaccaaccgcaatacatagcacccctctgacctcaccattgagtattgattcttacatatatttcccattgtgctaagtaatggtatcattatctaaagcgataatgacaagcaccaggtcattcagggccttgttacctccgatgacagcagagtctcttctgtctgcattaaccaagggctctccctcatccgctggtccagaacgacctacaacagggaaagggagaatgatgtttattagcttgatttaatcacgccacaatttacacatagcaaacttgtcaattaaaagtgaattaaaataagaacatcacaaaaatgtattttaaaaaaggaaaaaaagaaggatgacagagacggagaaaagaaggcttttgagaaattcacaaacatttgagagaagcgcagtttcaggtgcgcaggggtggagggccacacacctgcgccccccgcgagtcggggagccagttcccgcgccggggagccggacgccgcccccgctgcgcagcgggccataggggccacgtggccgcggacggtgacccgggaggggccgctggggcgcagcgccgccttcaggggagcagcgcggccgaagcgcaccgccgagaggcagccagtgaagccactagtcgccgcccgccttgtgtccgggtccgcgccggcagcctctgaggacagaaggggaacacacagttagggcgcagcggcggagatgggggcgcaggcacaccccgcatctgcaagacagcgaccctcgttccttcactccaggagaggtccctccgaacccctcgttccttcactccaggagaggtcaccgtgaatctttacctgtctggcaactatttccattgtcagggttatgaaaggcaggtttttaacagattcgttcaagtgcagatggctggctctctgcaagtaacagagcttcataggaaagcggttacatggcataaatttaagaaatcctctgccatttaatttttaaaatatagcattaaaataaaattttaatggcgctcacagccaataatccggaggattacagaaaagcgactcttggagatgagggcagagctctggaaatccttcatactatagttgctattttgtatgatgactttcatattatcttaataaactgtatcttttgtcatcagataatatccctctttatctcatttaagattcgattatattccaatcttaaattcaatcttatctgaaagtagtgctgcatttcttaaatttatcagctgttgcctgctagttcttggcatgccccttcattttcaatattgtaagagcatttaactgttaattttaaagctagtttgacagaatttagtccatttgtctttagagtaataaccactatatctgattttattttttatcttacactatttatttcacattatttctttttttccttttattttgctggtttaatcagtttccttcttatttcctgctttcccttttgtgagtttgagagctcaacttccctagccctcacaatcaaaatcatgccttcacactgttatatgaaaacaagatcctctttttccaactttcccccattcccaacagtgagatgagcgattgcatggttctttctccccaccctccctcccacaccaccgcggggttccccacaacagttcttccctaaatgagaggcttgggaaatttttctttttcttctctcacttttccctttttactcttctttggttttactctagtacatttagatcctgaccagaatgacaatttctcttacatttctatttttctatgatgtttccagttcaaggatctttacataatttattttttccaagaaagaactttgacatgatggacaaagattctccctatgaccagatgttggtcaggctactctaagctctctgctcaaccagcctgacctttggtctttcatcgtccagcttagcaagaatcctgccaatttggttttaacccaaatctcccaccctcaatatctgatcactctcaatatctaatcacctttctcatccctctcaccaccccgcaggtgatgtctgacaacactggcctggcatcaccaggaaacctggtgagtcagtttagcaagaattactctcccattttgtagttttccactcagacaccccaccccagccactctgctccttggctacgaatccacacttctccttgttgtatttgaagttgagctcagtctctttccccaactgcaaagctccattccagtaattcctatacctattgccatagtcctgaataaagtctgccacacgatcttaacaagagtatttttatcttttgacatgatacaagatggttttacattaaataattgtagtttagagaagaatcacataattttagggcagaccttttttttttttttttttttgagatggagtctcactctgtccccaggctggagtgcagtggcgcgatctcggctcactgcaacctccgcctcccaggtacaagcgattctcctgcctcagcctcccaagtagttgggactacaggcatgcaccaccacacccagctaattttttttgtgtatttttagtagagacgggatttcaccattttggccaggacggtctcgatctcttgaccttgtgatctgcccacctcggcctcccaaagtgtcaggattacaggcatgagccactgcgcccggccagacttctctttaaaaccctgaataaaaaccttgagcaattgtttaatttggagctgatgaaacagagaactttcttacatctttaataaatgacttaattagaaaatgatcaccatatatactttgtttaagctggaaaatctgaaagaaaggcattcctttgcccactctgaagtgtacctggcaatcacaccacaatccaggaagaaactcgtgattctgtactcccagattttagccagcactactatttattgtttatcagttaaccaatattcagtagaactcaactcttaactgtggtgacatgtagatacagtttcctgtctattaccttgacatggcaacatggtcaaaacccttcacttttgcttctcttagctgaatagctctaatcaaaaatgtatggtgacctgtctgcctccctttctgggctttctcaacttcggggtcctgcacccagcccccttccaattctctattctgttccatcaaagcctgctcccgagtaaattcacgtttgcacaaattcctggtcatggcttttgataacactttcaggggcatatgtattttggcagaagagtcaaaagaatggatctctaatacagaatttgaaatactggcacttgacgttgtgggaaaaaaaatatttgagatagggttgtcttcccagcccactgaagtcatgccaaatagacagatgtctatccttacaaaagggtgccacttggttgaactaaaggaaaaaacgactagataagtggacagtcttctacactgtgcaatacggtagacactagccacatgtgaccattgagattcaaatcaggccaggcacggtggctcatgcctgtaatcccagcactttgggaggccgaggtgggcggatgatgaggtcaggagatcaagaccatcctggctaacacggtgaaaccccatctctactaaaaatacaaaaaaaaaaaaaaattagccgggcatggtggtgggtgcctgtagtctcagctacttgggaggctgaggcaggagaatggcgtgaacccgggaggcagagcttgcagtgagccgagttcacgccactgtactccagcctggatgacagagtgaaactcgatctcaaaaaaaaaaaacaaagaaactcaaatcaattaaaattaaataaaatgtaaaatttagtccctcagttatactagccacatttctagtgcttaaaaactcatttatctcaagtgagtctggggactaccacataggacagcacagactttacacgttttcatcatcacagaaagttctattggacagcattagttttgttgacttatactttcaaagatctcaagacatctgtgatgcccactgaatcctggttaatggaccaagttagaacaatcttagaattttctatcgaagagaatcttgatgataacttagtgcagcctcctcattttaccaataaaggactaattgatataatcattgctctttcttggaaaaaaaaacccacaaaatctcctatcttcttgactttttatagggtttttaggtgttttcattctgtaatgttgaaagaggcaatccaccattggctctgagtgtctcctcatgctttgctgggtttgccaagaagtgcaagatgctgacagcactttactcaggccacttctcaaggctataattgaagcaagcaacattgagggataaggtcatgaccccctccaggacaaagaacagacttgcttagtgcttgttacaaaatcggtggattccccaaactcagtgttcctctgctgcagtggaaacctggccacaggtgcagccttcatctgcacccatcactgccccgtaaggcttcagggccaagggaaaacaatgcaaatgaactgctgctcacgaggcttgctgtgccatgagtagtagggtcctttgtctctgtaccaggacagcatccacaaaacagttaaaagctgttaacttcctagctcgtaaatcaggtaaaatcaaatcccagacccaacataaaacatttcttctaaatgagacaaacaccatagcacagaagtaatataaaatacataggttgatgaattttaaaatgttaaaactgtatgtcttatgtgacatctccttacaaaactcaaaaggcaatttccagaaatatttaattaccaaaactatttggcattcttacatatctagagctctatttgaaatatagtccttcagtgggttttcttttcttcagcctagaatgtatacctcctaaggtatataagctcagctgtattcatatgcaactgtttacaggctaatttttttttactttttgggagcagacaaaaaggcatcttccatttttgcactctgtttttttgatatatatatgtaatttttaagatagtgtttaaggggccaggtgtggtggctcacacctgtaatcccagcactttgggagactgaggcgggtggatcacaaggtcaggaattcgagaccagcctgaccaacatgatgaaaccccgtctctactaaaactacaaaaattagccaggcgtggtggtacatgcctgtaatcccagctactcaggaagctgaggcaggagaatcgtgtgaacctgggaggcggaggttgcagtgagccgagattgcgccactgcactccagcctgggcgacagagtgatactcatctcaaaagtgtttaaatacatgtgcacatgtacacacacaaagcaaaacagaaagaatacaataataccaaagtatctaaaaacaaatcttaatttatgatggatcatctttactgaattataaagtattttaggtgtctgcattctttaaagctacctcttggataaaattcaaagctatatagaaaattcaaaatctaaaaagcttatatttaaataggtttactctgaattgatcttgtgataatcaatctgaatggtcttcattcactaagactactcagaaatggcaaaatcatattgaggtgctcagaaacagcatcttaattatgatggattttggaccatttttttctaaggcattgttagggtgcataataataaattaggctggatatgagcattattttattagaattgctcatatattagcctatgtacctattaacatgtgagtgtagtgagggtgggtaggtatagtgtttcattcagaggctttctcagtgcttaataaactgttcatagcagatgctcaccaagttttttttttttttttttttttgagacagagtctcgctctgtcatccaggctggagtgcaggatctctgctcactgcaagctccgcctcctgggttcacgccattctcctgcctcagcctcccgagtagctgggactacaggcgcccgccaccatgcccggctaattttttttgtatttttagtagagacggggtttcaccgtgttagccaggatggtctggatctcctgacctcgtgatccgcctgcctcagcctcccaaagtgctgggattacaggcgtaagccaccacacccggccactcaccaaatatttttaaatgaagggatgaatcgaagatttacagggactcaagagaaatatattggtaacttagaacagagtgttttgggtaactttctttgtaaaattagtggcttctctattagccaacttgttggtctattttactataagttaaggaaagcacttcctatataattccaaatttaaagataaaattgtagttttggtataattactaaatgatgtgagagtggcaaaaaatgtatagcagaaccaatcctaaaatacagttgttcaaagtataaagtgttttattaatgtttgatgattatctctacctccaaggacaggcaaaatgaatatttataattttctaagatcaattgcttctgagtatatacttcattgctgaatttcaatgtagatttttataccgtaagttacatgcctttgaatataccatccttgaatgaaaacattaacaccttcaattccatgtctcctttatttggaaggaaacaaagatgtatataataaatattattcaactttttgatcctaatattaaagtatagttcattttcttaattgagttacataagatgggtttttttaaaaaaagattactttcctcagttcctttattaaatgtaaagctaactgtgcttttacaacagattatgatagacaatatgatagacaattactgtaactttctaccttgcgtaacagatatttatgaatatgcctccccattcctgttagatactaaagtcaaaaaggatggaaacaacaggcaaagcagggcttgagagaaaaataaaactgtattcatctgctgtaataagattaccagttttttctcttgtgttcaactcaaacgtagttttatcattgaatgatggtctccggagttgatgttgattaatacatacataatctgtgaacttcgtgtcagctttgacaacatttcacttttcaagaaggattagaaaaataccgtgattcattatgcatgattgccaagtgagaggttaagtgtggaggtatttttccaggaacgcccttgcacatctcacaggtagcacttagtcatgattatatgtacactcaggcaagagtacagtttgcaccttgattgtcactcactgtgaaattattattcaagtaagacaaggagcttctttcagcatgatgaatgcttccagagtttgtgacatgacacttatttgggaaaaagctctttctcctacttacctaaaacctttcccaatatgagagatttgacggcgttgaattctgtccctgaggacaagatgacttgtttctttgtgctctggttaacctattagatgtcccatgagaagcaaacatcaacagaaagtacaattttaatgataaggaagcaaaggaagatgaggaaaggaaagatgaaaataaatcacttttaagtaccattacaaaagctcaagaagccaccttcaaataattaatcatttagaaagagaagctattttataagcaattcctatgatgccatcagctaccactctatccacgatgtacccacttgctggctttactcttcttcataatggaaggatctataattggcagaatccatgaaaaagatggaattggttgttttaaacttaaatatgtactcattctgtggagaaaatctgaaacataaaaccaagcattgttgttctctatacagtatattttccttccaatgccgatgacaatgtgtaatttacttcctctgtggtgactcaggtctattttcttacttattcccattttaataactatgttgtgtgcttttaaaccgtgtttttaagttgctaaagtatttgttcttttataatcagaataagacaagttcccactgcagtatcaatgaatagattccaccagcagtcactatgataaactagagaacattcccctattgagtaaagtaaaacaaatagatattttgatattttaaatagtaaaatattaataatacctttgacagaattgcattgctaaacaaacaaaacaaagcaatacagaataaacaaccacctcctctctcccagatcctggccatatttggcttcttcttgacttatggaagagcagcactgaatgggttgctcttctattaatattatcaaattttttcattagattatttgttcttaaaataataatattagttagtttgacttttgcatttgtgggattacctctaccatgaccacagcttcttctctgttaatcttcacttggtgaagttgcccatcagccatgtttttaaaatcaaaggtaaatgcatcaggattttgatgtctatctagcttgtacctaatctgcaaacttcctaaaaagaaaaataaatggcatttaaaattaaagtggtattttataaaactcttgatacagattctagagcacttttattattatttacttacagcacttttgaatctatttagcatcaatttagatgcacccaatagttatctttcccggaacagtgattacttaagtgctattcctgtgccagactctgagtccaatgatgctatttgaaaagtcaagactaaatgtgttgttaataagcagtctccccaaaccttttcatttaaaaatgaaaaggtttaaattatgcatatgagcttggaactcagatctaaattcattatgactttgatatttatgaaatgatgaaactctatgcaatattgtatcaacattcagttcctgtaattataacttctaataaggctcattttaatgtatcactgatatgtgcataaagatttttttatagccagattattttaagtcttctgccataatccaaaaatgaggacaagaaaaggttttgtcaggagacaaggtttccatagtatctacatcttctaatatacatacccctctcctacacagatgtgccctcattatctgtaattctcttttagtttatactaagatcctgttaatcggagatttttttttttgtttgtttgtttgaggtggagtctcgctctgtcacccaggctggagtgcagtggcgcgatctgggctcactgcaagctctgcctcctgggttcacgccattctcctgcctcagcctcccgagtagctgggactacaggtgcccaccaccatgcccggctcattttttgtatttttagtagagatggggtttcactgtgttagccaggatggtctcgatttcctgacctcgtgatccgcctgccttggcctcccaaagtgctgcgattacaggcgtgagccaccacatccagcctactcagagattttgtagatttttttctaggcatgaaatttttgtgctgtgtacctaacagacttaaagcttggtcttcttgttcaactgtaaaaaccttgcaatgccccaactaccactgtttgagaggttgtcattacacttttcttctataaaagtgatataactagtttttcagccactgatgagataaagaacagctgtacttatctgttgcttataggaattggcttttatatagttgtactataacatccacataaatgctcctctattttgcttagaatgaggagggaatgtatgtcatgtatctagatatcttatttcaaaatgaactgcaaaaccaatttgagtcatcatgtactattaaagtcatcctatcaataataagaaatataactgcatatcaactccgtaaaattatcaaacatgtaatgggagaaaagcatcttaatttaatcttgaaatgctagcttttatacataaccattaaggcaggcactgaaaaaccaaacccattggagggcatacagttttctctcatcgtttgtagtttgactgctgaaaagacccatgtcattacagtcctatttttctaactcagggttctctttttctttacacaaaagatattcaccattgttggcgaggataactgaaaggtattcctcatagaaagagctcacatacagcaataagctcggagttcgtgtggttcggaagctcagtgtgatcatttctctggtcaatgttacatctctgtgtaatgaagaaacgagagagctggagttttcacttaaagtgtaatgttcttgaaaatggtatgtcattgaggagccagttgcaaaatatgcggaaatctctgaaatgataaatacatttttgttatgttaacaaaatgtaagtccaacggtcttgttttaagtacatttagagaatgagaccaaaccttaaatatcctgggagataaagtaatagtgaaatcctttcctgtttttttatttttcactttttaaagttttttaaaaactacaacttgaagaaaaagtagcaaactccaatatactcataacccaaaattgactaacacttaatagagattttaattctccaaatcatcctcatcttatatttacatataactaattcttcagtataaatgtataatttataggtgacttatctcatctttggtttccaattttttcccaaattattaatttttaaacatctttattcagatataatccatatgccatgtaatagacccaattacagtgtaaaattctatgtcttttagtatatttgcaggcatgtgcaaacattgccatgatcaattttagagtattttcactcccctcccccgagcaccttcttattccctcctacaaaaacctccataacctctagcagtcattctctgtttctccccaacaccccagcctaggcaactactaatttactttctgtctctgcagaggttcctattcaagagatttcatatcagtggaatcatataacgtgtggtcttttcaatgtggcctctttcacttagcatggtattttcaaggttcatccatcttgtagcatgtatcagtattttatgcgttttattgactaatatttcattggatgtaaatagtaatggatgtgccacattttgcggatctatttaacagttgatagacatttgggttgtttctactttttgactattataaataatgcttccatgaaaattcacgtgtaagtttttctatggacacgtttttatttttcttaggaatatatacctaggagtaaaattgttcaatcttatgataacaccaactttaaaattttgaggagctgccatattttttccaaaatagctataccattttacattccaaacagcaattatgagggttttaatatctccacatcctcaccaacatttattattatctttcttttaaattacagctatacctgtctgtgtgaagaggtatttcattgtgactttgattgcctactggctaatgttgccaactattttttcatgattttattggacattcacacatatttgctgaagaaatatctatttataagctttacctattatttaattgggttaaatttctttttcttattcagttgttggttttttgtttttatttttgttttcttgagacagagtctcgctctgctgcccaggctggagtgcagtggcgtgatctctgctcactgcaagctctgcctcctgggttcacaccattctcctgcctcagcctcccaagtagctgggactacaggcgcccgccactacgcgtggctaattttttgtatttttagtagagatggggtttcactgtgttagccaggatggtctcgaactcctgacctcgtgatctgcccacctcggcctcccaaaatgctgggattacaggtgtgagccaccacgcacagcatcttattcagttgtaaaagctctttaaataatttgaatactagacccttataagagacatgatttgcaatactttcttccattctgtgggttatcttctcttttgttctcccatgttttaagagttttatagttttagttcttacatcgaggtctatttggtacatttttatgtatgtgtgagatagaggtctaatttcattcatttgcatgtgcatgtatactcagtagtctcagagactacttcttcccattgggttgtcctggcactcttgtaaaatccattgaccataaatggcgaggtatctatctggactttcaattttatcccaatgagctatctgtttagtcttaggccagttatatactgctttacagtaagtttagaaattgggcagtgtgaatctatcaaatttcttcttcttaaagattgttttggctattctgcatcatttaaattttcatatgaaatcagcttgtcaatttcaggaaagaagccagctgggatattgattgaaactgtactgaatctgtatattactttagagaacactggtattttatttatattaattattcaatccatgacatgaaatatctctccatttatttacctttaatttctttcaatgctttatagttttcagtgtgttttccatttcttttgttaaatgtattgctatgtatgttattctttttgatgctattgtaaataaaattgttttactggttttattttcagatggttcacagctaatgtgtagaaatacaattgattttgtatattgtttttgtattctgcaattttgctgaacttggttttagttttaatagttctaagtagattctttgggatttttttatataaaaaatcatgtcatcctcaaatagagatagttttatttcctttctaatttggatgtttttcttcttctttttttttttttttcattttcttgcctaatcagtctggcctgaacctctagtacaatgctgaatagaactagtgagagtatacattcttgtctcgttcttgatcttaggaaaaaaacattcagtctttaaaactaaatataattttagctatgagtttttcaaaaataccatttgttagactgaggaagttatcgtctataattagtttactgaatttaaacaaaaatacatgaaaggatgttggattttatcaaatgacttttctgcatcagtagagactatcatgtgtttctgtcctttattctaagatatagtatattatattaattgattttcagctgttaaaacaactttccatttctgggatcatttccactttgtcttgatgtatagtcatttttatatgtgactggatttgctttggtaatactctgttcagggttttcacatctatctacttaaatgatattggtctgtagatttaaaatatatatacttgtatatctatgtctggctttggtattagggaaatactgaccttacagaataagttggaaaatgctcctttctcttttattttttggaagagttttgaagaatacttcttatttaaatagttgatatatttttaaatagttgatatattctgatagttgatagcatcaattgtttgaaaccatctggacctgggctttactttgtgtggtattttaatattattaagacattccttttattgttataggccaatttatattttctcctccttcttgaaacagaagtagtagtttgtgttaattttgtagttagtgtcatcctaggaattcgtccattttatctaagttacgtaatttttttcaacatacagttgtttatattctcttgcaatccatgttatttctgtaaggttggtagtaatatcactctttcatatgtcattctagtaatttgaatcatctcttttattcttggtcagttgtactaaaggtttgccaattttgttaacaattttaaaggactgacttttggtttggttaattttttctgtcacttttatattatccatttgagaaatttctcctgttttatttattatttcctgtttctccttacattagatttagtttgctcttcttttttcagtgtcttagggtggcaggtcaggttttttatttgggaaccatttttctttttgaatattgatgtttacagctttaaaattccctctaaaccctgctttagctgtgttactatatgttttagtaatgttgtatttttgctttcatttatctcaaaaccttttctaatttcccttttgatttcggagtgtatagtttaatttccacatatttgtgatattccacaatttctttatgttattattttcatctcattgtgttttaaaaagacccttcatatgatttcaatccttttaaatgtgttgaggcttgatttacaggtagcatgttgtctaacctagaatatgttccatgaacacttgagaagaatatacattctgctattgttaagtggtgtgttctacagatgtgtgttagaatgattgcgtttttatttttttcaactctattttcttggtaatcttctgagtaattatcctttattgtaagtgaagtattgaatcctccaggttttattcctagtttttctatttctcttttcagttctgtcaggtattctttatgtaatttggggctatattattaactgcatataagtttgtaattgttatatctttttgagggagttaactttttatcattataaaagtttccctgtttctagtagcaccttttgttttagagtttatttttttctggtattagtatagtccctttggctctctagggttactctttgcatggtacatgttttcccttcttttattttcaactaaattacccctttcaatctaaattgtatgtccttagacagcatatagttaagatttcttttgttatccattctgacaatatttgtcttttgattgggttgctcaatcgatgaacatttaatattattattgatacagttagatttacatctgccattttctttttctttttctatgtgtttcatttgttttcttttcactttccttctgacttattattttgtgttggtggatattttggagtgtaacattttaatttctttcttgatttcactatactttggggtaaaatatataaatatataatttgccacttaaccatttaaaatatgaaattcagtagcattaaattcacaatgttgtgcaattatcacctcttttgatacccaaaatttgtcatcatcccaaaattaaactgtattcattaagcaataactctccattgccccctcatctcagctgctggtatccttgaatctactttgtctctacaaatttgtctattgatatctagtaaacatggagttatataatatctgccctcttgggtctggcttatttcacttagcataatgtcttctatgtcaattaatgttgtatcatgtatcagaacctcattccttttaatggctgaacaatataccattatatgtatatactacattttttaatcaattcatgtgttgatggacacttgtattatttccactattgtgattagtgctactatgaacatttgtatacaagtatctgcttgagttcttgttttcaattgttttggttatatatgtagaagtggaattgctgggttcgaaggtaattctatgtttaactactttgagttaactctaaatcaatttctacagtggctgtggcatttactttcccaccagtaacaaaagagagttccaatttctctaggttcttgccaaaacttgttattttctgtttttatttatttatttatttttattgtcaatctagtaggtttgaagaggcagctcattatacttttcgtttgtatttctttaataactaatgatgttgagtatcatctttccatgtgattattgactctgtatatctttttggagaaatgtctcatcaagtcctttgtccaattagactttttgttgttaagttgtggaagttattaacatattctagatagtaaacctccatcagatacataatttgcaaatattttatcacattctgtggattgtctttttactctcttgatagtgttctttgatacacagaagttgttaattttgataaagtccaaataatctatttttattgttgttgttgcccgtgcttttggggtgatttttaaaaaaccactgccaaatccaagatcatgaagatctgcctatatatcttctaaaaattttatagttttatcttttagatttaaaactttgattcattttgagttaattttggtaagggtctaacttcaatctttgcatgtgaacatccacttttcctacctttatgttgaatagactgttacttccctattgaatgatcttgacaaagactatgttaaacatcaattgactgtatgtacgtaggtttatttctggcctctcagctctattccattgatttataggtttatcctcattcagtgccacattgttttgaataatgtagtttatagtaagttttgaagtcaagaagggtgaatcctccaactttgttcttttgtaaaattgttttgcttattctgggctttttcaaattttatttaaatattgataggggctttttcatttgtataaaaagtgctttggggattctgataagaattagattgaatctgctggggttgtattgtcattttaataatcttaagttttccaattcatgaatatggaatgtctttccatctatttagttctttctttaatctctttcaacaacgttttatagttttcaatgtctaagtctttcactttctcggttaagtttatttctaagttttttattctttttgatgatattgcaaatggaattgtttccttaatctcactttcagatttttcattgctagtgtagagaaatacaaccaaatttttggtgttaattttgtatcctgcaacttcgctgaatttatttattttctcttaacagcttttatttcctgaagagttttctacatataagataaggtaatctgagagagagatagcccttctattgaaatttggatgccttctatttcttcttcttgcttaatgactttagctggaacttccagtactatgataaatagaggtggtaaaactgggcatacttgtcgtgtttcttattttacggaagctttcaccattgagtatgatgttaattgcaggtttttcatatatggcctttatcatattgagaaagttcccttctattcctagtttattgagtgtttttgtttttcaatcatgaaaggttactggagtttgttaaatgtttttttttcagcaacaattaagataatcatgttttttttcccctctcattctattaatcttgtgtaatatgttgactgattttcatttgttgaaccactcctgaaatcctgggataaatcctactacgttttggtatataggtcttttaatatatttcacgacaatgttttattttctttagtgattgctctaagcttgcattatatatatcttatcaataatctgcttcaggtttacattaacttaatacaagtgagatttagaaaagttatttctacatagctctatttcttctgttttggaactatttttatgcataccaaacccattattattttatataatttgttctctttttaaaaaatctgagaaaaaaaaagatcaagtaaatatttatagactttgtctataaactctcttatttaccatttctagttctctttctttgttcctctgactcatgttaccatttggtgtcattccttatttcagtacagccttgctcccatctgtctcctctgtgctgtttttttgtaatatatttctataggcccaacaatgaaaatatatacattatatatttgtatattctctattatagttttatacattgctttttaaaatagttaagcactgaaaagggtaagaaatatgacattatactttcttttataattacctgcacacttacctttattagtgctatttgttttttgtgtgtagattcagattattgtctgggttatatcccttcaacctgaaggaacgttctttgttatttcctctaatgcaggctaatagcagtgaattctctgttttttgtaagtagggatatatttactatcttttttaatttttagtttttatgaatacctaatagttgtacgttatttatggggtagaggtaatattttgatacaaccaaacaatgtgtaatgatcaaatcagggtaactgagatatccatcaccttaaacatttatcatttctttttgttaggaacattccagttccactcttctagttattttgaaatatacaataaattattgttaactatagtcatcctgtgctactgaacatgaaagacggttttgctgggtgtaagtttcttcatgacaatagttttctttcatctctttgaatatgttatctcactgtcctgtggcctccattctttcagattagaaggtagctgttgatcctggcgtttccttgtatatatgatttttctcttactgcttttaaaatttccttcttgactttggctttcaaagtttttaataagatgtgtctggatataaacttctttgtgtcatctgtatttcactgagtttctgtatcttagattaatgatttttattaatttgggggtgttttcaaccattatttttcaaatatttttttctgatcctttctctctctcctggtattttcaattacgtatatattggtgtgcttagttatgtctgatatttctctgatgatctatttttttcattattatttctctgtattcttcaggatacataatctctattgatcttgcttcaagtttgctgactcttttttcttttctctgttaaacttccctggcttaactcattactctcttggagttatcaaaattctcttaattgcttactgccaatatcttcataccactatgcttaaacttatccatcctctgttccaaatagaaatcagttcacttggggagggctaccaagctgtgtattttcatggcctccctctacctcttggttgaatgtgcctcactgctctgaagctgtggggagtgagagtggcctgctcctttgtagtaaaacctctgcttacaagtagggcacagggtgggaaaggtaacttcttgccttgcctctcctggtggagaaactgttccttacaagtaagctggagtgagggcaattgggacacaggattttccagctgccacacctgaagaccttatgtcctggaatgaggagttggtgtaggaaggaaaccccagacttctcagctgtttctgcgtggacagagcttctgtcctacaaaactggggatgacaagaaatgctggcacccaatcttggggtaatgcagtatctctggagtaggacctgggtagagaggaaacctctggcttcttggctatatccatatagagtggagcttccgtcatactgagctagggatggggaggtgctgggagagggtcttggcttaaatgcctcaaactctcactattattactgattaataaatgtttcttcatttgatgtatttccttaggacatcttctaaagactttcaatagttgttttttaaaataataatttttactagttatgcttgtttcgtatgagagagggtttacagagctccttatgtggccagcctggaaatgccagagtaccaggttttttatttgaatgttacctcctctttaaaaatcgatttgctttgtaggaagcatgaaacagagctcctgaagtaactagagaaaaggtgatttgaagaccaaccctccttcaaggtcagaatttagaaatgttcttttatgccaaagatgtttctcaaatttactgtctggatagaaaggctaatccaaagtggtatctacagtattctgagagagaaaagttgaagggctttcagattctcttaaaacactttatgaaaggttgatattttaattttatatcaagttaattccaaaaatgtgtttagtacacacatacacatacacacaccccccaaatatatctgtaaataaaaagacaatgttgggtgatgatcattgtcttggaatactactccactctttccatttccataaaatataaagaatttactgaaaatccagatcattcttattagattaggtaatctaactataacatatgccccagccactggaggaccattttccatttacttactatataatgtctatccttaagaaaattttgggttataaaataacattcaaattgcacttagcaaatgtggattgggaatgatttagaaatcagcacttgtgctcatgaaggagtggttactcctgatgttggcttgagatataaaaagggctctgtatttgcaccagagctatgagatttgttagcacagagatcttcaggaatgataaaagacacatgcaagaccttttgaaaatttaaatgacttctagataatgaatcctcaaaatttttttgaaagtcacacaattttatagtgattaaagcctgttttgctgctaaaaatagtaagtgtaacagcccagagacacttaaaaacacaactacattttagctctgatgattcaatattgtaagaggtttcataaaagtattataaatatattaaataagtcagtacagagtacttaatactaaaatcagtccctttttccttttcttttttttttttttccccaagacggagtctcactctgccgcccaggagtgagtgcagtggtgcgatctctactcactgcaacctctgcctcccgggttcaagcaattctcctgcctcagcctcccgagtagctgggatgcccggctaatttttgtatttttagtaaagatgaggtttcaccatgttggccaggctggtcttgaattcctgacctcgtgatccgcctgccttggcctcccaaagtgctgggattacaggcatgagccaccacgcccagcccttttcttttgaaaacatgattgtacctgagcagaagctgtgtgataccccactgcactcctctaagaagagtcaaacatcatagagcacagtgtttgagtgatcctgttaatgactgtcaatatttaaatattattttccccttctagttagtatgcttgttttataagaaaagacatttctataaaggccttttgaatcacttcaagtcattgtcacaagggacaatgggtaagacgattgctcaagcctaggagttcaagtccagcctgggcaacagagaggcttgaatagcaatacgttgtctctaaaaattaaaaacaaaaataacaatgatggtttactgatgttaaaattagaacagtacaaggacagagttttgaaaaccaaattatttcaagaggattagcattgaacagatgctaggggtaacccagagatcttctaaataagaaacccagagaggactgatagccttaagttttcaaaaacagtcatatcccttctaaattcaatagaggaatttggtacagaaattattccatttcaaataattcaatcttatcctctctttataatatcaaatgccagaagcattcttcatgttatttaagtttcatgtactttccctataacctgctccttggtcacacttaccattggagcagaacggcccatcataggctgagaaggcacagtcacaggtgacccccctgcgtttctctctgcatctccctccattgcgacacaagtgtccataggtgctgcagtgtcctgcacaccctggctccactcctggcgtcactgtggctctttcttccagatccagggccaccccgttcaactgcagagaccgaatgcatcctagaaagcctctctgtctggtggccgttccacctacaacggaaacactgcaaatagaaatgtgttccttggtattttattcaggattttatgtccatgtcaaactcaggccttatggagagtggcaataatcacaatgtgtcaaaaaattttgtgaacatacacaattttgaaaatgtaactgttatgagacatgaagctttaaatgacattgaataaaacacttatttacataactttcaaacatggtgagtctggcaaatagtcctaaaacatttccttaacttcaggtaagaaagaatttcactttagttccttcacaaagaacaaaatacataatataaaccacatcaaacactattctactttgtttaggaataagaatgtgtattcatcaaacattattttaatttctttatgaataagaatgtgcattataatggttaggtatgaacttccaaatttttcacaataataaaaatatatatggataatttcttacttggatggactctaaaaataaagtgtgaaaggaaatggagaggcaaaggaggggaagttggaaggggtgacaccgtaccccaggatctcctcctctcagagggtacagtgctaaacagtaattgaatactgcatgcatgcacattttgtcatgtcaaacttgaatgctgaagaaaccatttagagaggtttacaacacctgtgtagtgacaaacaccattatgaaggcgacaattctcaatgttaggagcatggaaattacctagagtttctggaaaatgcagtttttagcctcctcccagagattccaattcggtgggcctaaggtgggggccccaaatctgaactatcaatcagctttgtgggtgattctgaagccagtgattcatccaccgcaatgaatgctgattctaggtgaattttacgctaattgtgtttctaggcattcccttaaataatctccaagattacaagtgagaaaatcaagttcttggtttgacccctccgtgtagtcctcctttccagtagtttgatggtttcatgtcctttgaaaaagcctcactgcaccttaatagaagagctaaccacgcctgaagctaggttttaggaagtcatggtataacaccccatccacatccacatacatacgtgggttcacgtgtagcatttagtacctggaagttgtatctacccttccctgtaaattaggttggatgataatttgtgatttagtccagttttaattagattgcatccttattcactttaaaacacttaagaaatgaacaagtgagagctttaatctgtgtagctcctaagttagaatagtttcaaaagcaatatggaaaaataaacaacagtgataaaacagtaagtaagcaaactaaaggaaagacttccagagctatcacctttaaataaatggagtgcaagaacagatgagccagaccaggttataaacaaggagcctgtgatgagagagccccagaagtgagaacagcagcgaggaaaaccgggagtgggctcctggaagcctggccgcgggggaggtgcgcagtgctgcttccaatcagcgggtatcctgcgatctggttttgagtggaccctggaggacttctgtcccaattacaagctctctaactccaccgagaagtgaaactgaaggaatggataaaaatgtctaatgatctcactaatagtgttgataaaatatagctgtcacatatgccaatcctctgcaatgtgaatggttcaagtttgggggtcggctatcctgggatccctctcattagctggttactccacttctctgaggcttggctatctcatctgtaaacagatgacaatacctaaacattgatacctaaacactgagatactgcagggcccggtggctcgcgcctgtaatcccagcactttgagaggctgaggtgggtggatcatcaggtcaagagatcacgaccatcctggccaacatggtaaaaccgtgtctctatgaaaaatacaaaaattagccaggcgtggtggcacctgcgcctgtaatcccagctactcaggaggctgaggcaggagaatcgcttgaacccggcaggtggaggtttcagtgggctgagattgcaccactgcactccagcctgggcgacacagtgagactctgtctgaaaacaaaaacaaaaacaaaaacaaacaaacaaaaaaagaaatgtcaaataagaagcacacagcaagctcctggaacctaccaggttatcagcaaatagtaccaataagcagtagttgttgttggcaactgttgctctcagtacatcacagttcttattttcttttggtccctctctggactcacactaaattcagttataaaccaccagcactcaccaatgaagagctggctgttgagctgtaaacgaacgtgcccatcagcaggggcaggctgcatcttctgaggaagctgatcaacttgaagagacgctcctttaacatttctctctgccctcacgtggtgccactgattgtcattaaagggagtgggtgactgcaccgtgacctcacaaggtccattccccacatcgaaggaaaaggtcacttctgtgggagctagaaatattagatatgaatattgctcaagcaaattcacagaaaattgagtcttgtgcagacacaggaaaacatgaaggcacgctcaggatggaaggagataatgacggcgatgcagaaaaacgggactgtgagttggggtgggggcagaataaatctgtatcctggaggaaaacagaacggattttaacatatttatcctcagagttcacaattcaaccttgttaagtcctaaatagtagagatatgtacccatagctggactacccatagctatgtacctatagctagaataccaaatagtatttgtttttgaggtttcagtaattttatttacaaacggctcaaagtctcatctaattctataaacactgaatgtaaattttgacagtcataaattaagctttgggtacataaaaaacaatatgtctggtcaaatatttttggaattcagtaaacaatgtgatgagtttggtttaaagctctggctctgctgttctgtactctagggaaggcatgacattttaatggattattacgtgcttcatgcttcattgttttattttctcttaaaaatgattactggctgggtgtggcagttcacacctgtaatcccagcactttgggaacccgaggcaggcagatcacttgaggccaggagttgaagaccagcctggtcaacatgggaaaaccccacctctaccaaaaatacaaaaattagctgggcacggtggtgcctgcctatagtcccagctactcaggagactgaggcaggagaattgcttgaacccaggaggctgaggttgcagtgagccaagataatgccactgcactccagcatgagtgacacagcaaaatcctctctccctctctcaaaaaaaaaaaaattacctaaaatcatagaagtttagtattttataatgaaatagaatcacaaaataagaatgaaatactaacattttgttgagttaaagcttttattgctaaataatgggtaccctgtgacttgtccagagtggcgagcttaccacgcagctcaatcctgatgaaatctgtgatccccaggttctccataaacaccccggaggaaactgtggtcttaaaaaagaagcacacgtcagcagtgagttctccgtggaaagcagggaaatgaaggtatgaagtctcagtgttgaaggaagctgaattccagaatgactctgtttacaatagagaaaacgacaaaaggaaaaaaagtcatgaaacaaaaataacagctacatttgatacttacaggattatgactgctaaatacattaatagaatctatatgagctttcactgggggttctgagcatccatgtcatatactgatgacatcaagagctaaatggtgattatggtgaggattagaattctgtgttcagagaaggccaaacaaaagcgaagcaaaagcaatgagaccagtcaggggatcgcgcagcaacacagtagggacagggtcaagttcagaatcacctcaaaggtacgaccaacagaacttactgaagaactcggtaagatgtgagaagaagggtggagtctgaggtgactttggggtttttggtctaactgggaggggaaataattctaaagaggcaggttcgagcagcagctcagtttgggacatgtttcatttgagatatctattaggcatccaagtggagatttgaaggaggtagttggataaatgactccagaagccagaacacagactcttgctttccttcctgcacatacacatacacacacacacacacacacacacacacacacacacacacacactgtcttaattcctttcatggcaagaacaatcaagaacaagaagaagcttatttgttcccttctgtccaaaacccatcacaggactgcacatcacatgtattcctcaggcctctttagtgtccttcattctggtacagtgtgtgagtcttttcttatcttttgtgtacttttgactttttggtatttttcagttgacttgcagaatgttcctcaacttggatttgtctgacatactcatgattggattcatgttgtgcatttttgtcaaaaataccacagaagggctgctgtgttctcctcagtgtgtcgcagcagcaggcagcaatgctgatcagcccatcactggtcctgttagtttcaactgctttgtaaagtggcatttgtccactttctccaacatgaagttattatttttctctttgtaattcatgtatttttgacactttaaggttacagaaacacaactttacccagttaaaaatttcttcatccaatggttttacaatatattgatggctcctgattgaatttttattctgatggctgccagtggtgatcttctaagctctgtcattccttccacattaattggttgacatgcctccgtcagaaatagcttttctcggctaggtgcagtggctcacgcctgtaaccccagcactttgggaggccaaggcgggcggatcatgaagtcaggagatccagaccatcctggctaacatggtgaaaccccgtctctactaaaaatacaaaaaattagccaggcatggtggtgggtgcctgtagtcccagctactcgggaggctgaggcaggagaatggagtgaacccgggaggcggagcttgcagtgaggtgagatcatgccactgcactccagcctgggtgacagagcaactctccatctcaaaaacaaacaaacaaacaaacaaaccaagaaatagcttttctcttgatcttttactaatttatttgtgtatttatccattggtttattcacatcactcttgaatttgtattctattcaatggtttatactctataacttattttgatgcttaagttgtctcaaatgtggcagctcctttaagctgacacccatgcctttttcagctttttctttcccctttgtcataacaaaatgatccaggctcatcttacattttctctgccacatttctggaatcagccatttcttcaaggagtcgtggtttcttttttagcagagaatgatagaaaatggtgtttagaagccgagatctgcaggctatttactagggtgtcattgcttctagccctctcagtagtcagctaggaaatatgtgtatttgtatctctctctctctctctcacacacacagtctctctcttctatgtgtattctacagttatctattatgtatattaaaatccatgagttcatgtggatacctccgtttttaacccagcaccacagggttcattacagtcttcctccttcccacatgtataactctttcctcagtgagaaggtcactcctactctcctcactgtatttacatatttgctcattccccagtgtggaaccaagcttctaacccagtggtcattccttgaccctatccctgcagatcccctagtcccagctgccccaaaagaagggaaaagaatcaataagtgttatgttaaagaaaacagagatgaagataaggaaaggaaaagagaaaggaagaggaatctacaagttttacagaagagaatattttatttttctttctttcttcattaatcaatttatttatttattttagagatgaggtctcactttgtcacccaggctggagtgcagtggcatgatcatagttcactgccacctcacattcctgggctcaagagatcatctcacctaagccttcctagttgctaggactacaggccaccatgcccagctaatttttagtttttttgtaagagacggggtcttaccatcttgtccgggcttgtgttgaactcctaggctcaagccatcctcccatctcagtctcccaaaaagagaagggaatatttcaaatatcacactttctcttctccatactttcagaagtcttgctgaaagtaggatataaactgaaggtgaatgacatatcctgaagagtctcacaaatacagccacgtttggagagaaatgaagggctgaggtaaatttccagagagaaaataatctagaaaatgtttttgagaagtacagagtacctagaaaccagtgtttgatgtcagagtatcaataggcaggggaaaaagctacaaatttccaggggttattactgaactgtgggaggcatctgaagcctgcagatataccctccatgcttcagtgtgatgcctggcacaggacatttaataattcttgaagataaaacggcacagagaatggccagtaaatcagatacaattcaacagatccctcccttgagctcttagattatgggaaaaaaaattgataggatgaccaactctagtcctgctattgcagttcagaagggacaagaagtatgtgtctgattgtgaagagatgaatgtcgagaagaattcaactccattccatataaatgaattaaatgtctggacagacctgccagacagacctgtggtgtagacttacactacaagtataaacaatgtttcaaaaagcgctgaaacagtgcaaacatactgagaaagaaaaagaaaaaaagaagacaggaaagaaagaaagaaaaagaaagaaagaaaagaaagagagagaaagaaagaagagagggagggagggagtggggaaggaaggaaggaaggaaggagtataaaagccagactgaatgggagggaggaagggagggagagaaagagggagggagggagggaggaaggaaggaaggagccatctgaatgggatggaggaaggaaattaagagagaacacaaggaaagaaaaatttcataagagttttacactatgggaataatataaaaaccaattcagtaaaataagagctaaaatatgagataaacagaaaagatgatttttaaggaaaaaaaatcaaagacccaaacaaaatcacagaggtaacagataaatcggaaatatctggaaatggagaacacagctgataacaaattactgacattgggagaagcttagaataatcatattgaatgcataggagaaggacaaagagattaaagccattggaagaaacagaaaaaatgtatggggggcaaaggaaacaagtcaacagtcccagatgcagagaatccaacaaatgaaacaaagtattcaaagcataataaaaaccattttttcttaaaagagaacagaatatttcggtcaaaataagcatatttcattttagaaaaaattaacagaataattaatgccaaggcatattctggataagtttttgaaattgaaggataacatatctgtcaagagctgtgaggagtctgagatttcaccctacttgcaagctaacaatttagcttgccacagattaatggatgctgatagaaaacacaaaatttccgggtcagagttaaagaactttactgctcacagcacagcatgcagcatgagtgtcagaatatttgcattggttccccctatctccaaatttcacagggcaacacaatccatcagcccaggtggatgctacacacacagtgggtaggtctgcatctcagatgaggagcccccagacaagggtccgggactccttcatcaagcaggagacaagccggtcccccccctctctggggagtgagtacgcatcgatagtgatgttgtgttctctttgaactacttagctgcctacacgactggctacagaaactgcttggtattaggggatggagacgccacgccatctggcacactcggcaagaatgtacagagaggctcaggctccttggtgaaccacctctctcagaagtagcctccacacattgaggtagagcaggaaataaaaatacatttagtctcagacttctccacggcaatgtatgatgctagtgggtaagaaacactattaaaatttttctcagggaaagaagatttttactagcttagttgtggttcccgtgctacgcagtaggtagatcctctaagaaccctgggcttatagtgccactgaggtggaggagcgaggacttgaccatgaaagccacccatgaacgaaaatgctgcaggaaagagattaatacacattcggtgccatgtaatgtaaaacagaatgtacagaggtcagaaaatagagagtgtccaataatttcctaccactatagttgtctgaagagtataagggcaatgaataaatatcccttagaattcagaaaatagttcatctcatgattgttctggaaaaaatacaatcaattgataataaatccagccaagcaagtaataagttaaaacaaagatgattcattttctataaactaatgcttcagtaaggaaacacagatcttcagtactgactgtgcctttatggtatgtgtgttttcctgatattcgccccagtcctagtactgccactattctctttctggcaagaacaagggcatttgtctactcttttataaccaaaaaaagttattatgaaaataaagctttttcttgacactacttacgatctccgcggcagagcagtggccccagtgtataagctgcttcggaatgtggtcggcctgcgtctgtcatcacaatctgagtgactggcaggtgctccttttgggaaaggactattgtgtcactagtcctaaagaacaacaaccgaaaccattaaaattattctgattaacatacgggcaaaattaactctgatctcttatctcaatttgaaaccaacatcatagagcttaacagaatacttaacattttcaatattttgagagcacagagactaccatgaatctaaatcagggatgggcaaacattttgtgtaaaggaccatacagcaagctatcttagctcagcaggccatgcagcttctcacagcaactactcaactctgccaccaaagtgtgaaagcagccacagacacaggcatggctgggttgcaataaaaatttatggatatgaaatctgaatttcatacaagttttataagacatgaaatattctttttatttttcaaccttttaaaaatgtaaagaaaacattcttagctcactgccatgcaaaaatagactagtggtctggatttcacccaaagcaagaggttatcaactcctgacccgtttgccaattcctgatctaaatgattacagagaaggggaaaaatcaagaaggtaacttcccttctaaaattgtcttagaataatatctaagtgattattcattacaaataaaaatagtaacactggatttagatattcattttgcagaatattaatttatcattattttttaaagtccttttatgattactgggtatttctttccttgttaactttgtaaatgcaaaatgaatcccacagattcaaaaccaaatacatactacacccttataagtaatacatagactaatgagtgtgaaagtggtctgtgaaacactgctcccagtagttcaggcaacaaacacaggccgggcacagtggctcatgcctgtaatcccaacactttaggagactggggtgggcagattgcttgagctctggagttcgaaaccagcctgggcaacatagtgaggccccgtctctacaaaaaatacaaaaattagctgggtgtgatggtgcacacctgtagtcccagctacatgggaggctgaggtgggaggatcccttgagcctgggaggtagaggctgtagtgagccatgtgtgcgccactgcactccagcctgggtggcaaagtgagaccttgtctcaaaaaatacaaaaaacaaacaaaaaaccccacacactcagcgctcaccttttgtcaaacagacattgtcctgggaattgaggacacagagtaaaaaatatattttagtctctgccttctgaaagcacacagcctattgaataccatgagtattaattatgtgactgggaaaataaatgcacacgtctgggtccaatacaaagagacctggaggatcccctaggggaacctggggtcctggtcttagctatgccactaattttgtctctggccaaaataaaggcatttgtctactctgctgcaaaagtattttattatatatgtgtatgtaactgtatatgtaataaatatttggccaataataaatattgcatatatgcatatataacaaaatgcttatatttatatacttttggttatattttatcacatatatgtctcaactgcatgtacattctgatttacagacaaaacactcttagtccagttatggttagaaactccacagtatctagtaaatactgtattttttaaattgcccagttctcaaaccttcttttgtatgcatttgtggcaaaagatcacaataattgatatttcatcattgcaacacttttgtattttcaaaataaggctttctgaattaaaaaaaattaaattggcatgtcagagttgtacatatactgggggcacatgtgctattttgatactagaatacaatgcataatgatcaaatcaggataactgggatatccatcactttgagcagttatcctctgtggtgggaacattacaattctcttctggctattttgaaatatccaataaattactgttaactataatttctctagttctatcaaatactagaatttcttttacttaactcgacttttgtacccattaatcaacttcttttataaaagactttaggtatcaaactttcaaattggaaaatataaaactaaaataaagtggctatattatttaagattattccctgaaaaaatacacttaatggtaaagaaagcttatttctaaaattcagactaaaaccctgttgctttacctagttaagattctgttattcatttttatgcaaagaacagaatatggattatctaaaggcatcaccattcagctttagagtggattgatggtagacaagctagaaatatgtctcctgctgaatgaggtaggtctaggaaattttttattaatgtggtggtagccattaaaaattaccatttcaacttctgtgatcatcattttagcaagatagtctagtagagaaaatgcaatttaattatttatggaggatgcttgtattttaaaagatctatttcacgggagctccaagtttcattccattttcaatactgactgtgcaaaatattgagaatgtgtaaatgaaatccacatttcagtttaattagggcagatactataataaagtcttgttttttcagttgttttggaaagtctggtgttttcattctgagcataaagatagccagtgtttttcaccagtttcttattgttacaggcagattcccaacctttggagatcaaaatagaatactcaggatttgtcatagttatcagacttcctcaaaacttcctaattaatagggacatctcatttttcttttctattattttctaaagcttatactatagtctacacttggaaatagtgctttcataggtaccataatctcttgcagcagtattaaaaattcagtaagagaactttcaaagactttttgcttttattttatattttattaaaatttttatttattagaaattcctacggttctggaaattgtactttcctaggaagtgtgaaaacttctaaaagctactacttattatttgccagggaactttatttaaggcaaagtagggccataagtttgggaggttgcaaagaaagctaaaagggagaaatgttaagtcaactttttaactttttttttttctttgagacagagtctcactcttgtcgcccaggttggagtgcaatggtgtgatctctgctcactgcaacctccacccccaggattcaagcaattctcctgcctcagcctccagagtagctgggattacaggcgtgcgccactatgctcagctaatttttgtatttttagtatagacggggtttcaccatgttggtcaggctggtctcgaactcctgacttcatgatccgcccgccttggcctcccaaagtgctgggataacaggtgtgagccaccgcgcccagcccaactgttaatgattattttgggggagtaggtcagcaataataaaatcattatgatccacatctaacacacttaaaaaatttctagattctcagtttctgtttaattgcctatcttctggccaattcaacctgcattaattactacagcaatacagtatgtcttgacagctaacagaactagtttcttcactttatttttcatcttaaaaattatcttgcttatcctttcatccttaatttccatatgaattttaaaaccaggttgctgcaatccacacaagtaaaaccacttggcatttttttgaattttgttaaaattacagactaatttgatgagaatgtcaactttaaaagagggtatctcaacagcagcgttactgatattttgggctaatttttttttgttatgggggggctgtcctgtgcactgtaggatgcttagcagcaccctgatttctaattaatagacactaatataaacaaccttcctctctgtgtgatgacaaaaatgtcttcagacaatgccaaatgtcccaagagtcgaaatcacccccgattgagaactactgctttaagatactgagtcatactatccacgacagtagtgagtcaatccatttatttggctgtccttaattctcttgaataagttttgtaattttgtaattttttccataaaagtactgcagttattccacagaactttacatttttgttaatattgcaaataaaatttttctaggtgtgtaatggtaattattttaagattttatagaaattcaagtaattcctcaatactgactgaccataaattcagcaaacttactgaactctcatttttcctgatatttctttatattattttggattttctatgtaggcaatcatattatctacaatatctgccaggtttgtttcttttccaaactttttatcacttacatctattttatttcctcttgtgtctttaactgacacacgcatgaacttttaaaaattatatattcattattgattacagttaagaatatagtttccatcatgacaattccataaaatttgttaagattccatccatttacaaaattttttatacttattcaacaataatgtataatacattctataaagaaataatttttccttactaaacgatatatggctgctatatcaagtttgttaattataatattaaaatattcttacctgcttcacttactcattcccaaaaatgttatgttaattattccactgttttgggtgtcaatttgcctttgcatatttgttaattctctctctctctatatatacacacacacatatatatacacacacacatatatatacacacatatatatacacacatatatacacacacacacacacacacatatatatatatacacacacacatactttttttttttttttttttgagacagagtcttggtctgtcgcccaggctggagtgcagtggtgtgatcttggctcactgtaagctctgccttccagcttcacgccattctcctgcctcagcctcccgagtagctgggactacaggcgcccaccaccatgcctggctaatattttttgtatttttagtagagacggggtttcacctgtgttagccaggatggtctcgatcttctgacctcgtgatctgcccgcctcagcctcccaaagtgctgggattacaggcgtgagccatggcgccctgccacttctttatatattttaaacaatctgatgatacacacaagtgtagtgagatctttctagtgagtttatctcagcattagatagagttcaagtttatccctaacaatgcttttcatctttgtctgacataatacagctgtatctgctttcttttgatttgtatttactcggtaaatattttctattcttttagtttcaacttcactgagtgcttatattttatcttttgtaaataagctatagcttctttaaaaatccaatatgataaaatctaatgtctggtttttaaatgaacagagtttactcatatttattatgattatttgtacacttgtatgcatttaaaccatcttattttatgcttttttttgtggttacttttaaagactctaagataatcacacaaaagtcctatttaaattcttaagtaaaataatattacagttacatgtgtcatcattatattagcaaaacaacttgtggatttttgcagacagctgaattatatgttatatgtatattttagagaatatattggtctatttgaacatagtccactatacatttatacacatatattgacttgcagcatagttcaatattttaaatcattatagtgccttttaaatatatttgtttttataataaatctttggcatgttatagttatttgatagaatattcttactgtgcctgaggaactgtctgatcataaacttttttttaagtaatatgctttagacgagttgctgattacagggacaacttacggaaaaatggcgatggtttatattaacaatactgcctgccccattaacggacatatgcctgaagagacttaaaatagctttcactttactttcattcccaaatactatttttattataaactttccaccaggaaaaccttactaggcacacctcagtaatagaaaataagtaataaagactaagatttatgttcttatgtctacaccttaatctaaattattacaattataaatcttttcatttcatgagactggtaaattccatttttataaactgaaaaatcaattttatttgaaaaattaaaatagaaattgtaatttcccacccccccacccccatacacacccccacatttacaaaacaatctacaaaagttgggataggatttcagaatgcttgtggtcttactgttggatagacctgtctactggaagctgcaaagtaaataaaataaggttaaaaagcaaatgactccacaatgctcccttctgaatgtaggaggggagttaatttttaaaacctgcttctctcctaaatttttttccaaatgaaagcccagggcttctgtcacaccagtgcagtccttgacggtgctgaagtgacatggctaagggtatcagaggacctgcacccacctcagttcctcccattcccctcctcaaactcagttcatgggagggtcactcaatacaggtggctccaagtgatacgttcctctggttactgccctaagcatacgtgaagtctacaataaagtatgcacttaatactaacagaaggttctgtaacaaaaaaacagttgaccagcctggccaatagtgaaacccagtctctactaaaaatacaaaaattagccgggtgtggcactcggctgtaatcccagttactcgggaggctgaggcaggagaatcgcttgaatccgggaggcgcaggttgcagtgagctgagatcgcaccactgcattccagcctgggcgacagagagagactctgtctcaaaacaaaaacaaaacaaaacggttaacattcttcgaactaagttataaagccactagcatatatgccattctggctttcttgtaataacctgccaatgctctcctctctgacctgtagagaatgggggtggggacagaccaatgagctggaggtcttctgaacagccaggagctggagggctggagccctcacaggcaggagccccttgtggaatggaggaaatgaaaacctctaggattgttaaagatgtccgtcaaaagatttgaaggtcgctgtttgtctcattagagcccaaagctaacacacatcatcacattatcataccagacactttaaaatgtacatcatacaaaatattgtacaaaaccattttaactcatgggaaattacttcagacctgaaacttactggtggtcagatttgaaactatggatcagatctgttcctgttactcactgcactaaaactgcattcatttttaagtaagagaaagttgtattaagattgcatatcaaaatattcaaaaagagtgtctcataaatctgtatgatcatttagtaattttgaacttgaggaagattaaaaataatatccatgtaaatgtatagtatgtattctatagaaagctccagtagattcaagtgagttttcccaacttcacaatattttttaaagtgatgcaaagtagactttttatgccagataaataagtggactaccatgcaggccaaacaactccatttttaggaatcaaattactgcttagattagctattttatgtccaaatcaattatactgacacctggattgaccattacattttttatttattaattattattattattattattttgaggtggagtcttgctctgtcgcccaggctggagtgcagtggcgcgatctcggctcactgcaacctctacctcctgggttaagcaattctcctgtctcaccctcctgagcagctgggactacaggcacacacagccacacccggctaatttttgtattttcagtggatacggggttttgccacattggccaggctggtctcaaccttctgacctcaggtgatccacctgccttggcctcccaaagtgctgtgattacaggcgtgagccacagtgcctggcctaagtttttttttaaagcacgtactctacatgatctagttgttttatgacaatgctttttaagttgctgacatgaacccaaaggttgaaaacatttacatattacaaataaaaaaaagaaaaccaatatgcatttcaagagtaacctcaaaaagaacttctgaaaaaaaggcattgcaatctacatgagaaaattgtttctgctcaaaggaaagcttacaaaataattttcaaattccagaaagtctatgttagttgtttcaaagtatggtctacagaacagttggtgcttgaagctttgctattgcactgaagatttcaatgagtgtgggaaattgttgcttctacaaaataaacacagtccttttatgcaggacctctcagagtttcttgtgttaatgttaatttctaaaagaaagatagaatatgcagcattatatcccaaatcaatttaagacaaagatttggaggaatttgctttttgaattgccacatgaatactacgttaattaattaactaaacttcgcagagaatgatatttgatttccagtgagtggaaaacttaacagctgtttctcttttacgaaaaataaaaaacacattatatagtattcacaacgaactagtaaatctttggtcataaaatttaatccttagattaactgatcatatttcatcaaaacttgtatttcagcttgcttgaacatactttagttaccttattgtaccagcttgtctgacatttaattaactatgcataattaaagaataaaaaccacatttttgtgcagggaaatcatgtggaaatcaccattcattccggccagcatcacagttgcagtaatactgagaatcaatgcagttcccctctaatccacaagtacacttttgagcatcaggcagagaacctccccaggaagtgtgtgtttcattggttcttccaacccaccagctcagtggggttccatctgaaagacaagtataagaaacatgacatctactttgtccctcactaccaccctccccatatagctccctttactcccaggtgtaaagtgtatgtgtgagagacagagagagagaaaatgaaactatacttaaatacttgtattttacctctgaaacgtttatttaagcctaaccaatgtttttcccccaatatttcaatatctaggcttaaatgattccatctatttttcttctattagaaatcagtcagttgcatgtgatacatactttctatagaaataacattcaaaaaaattcaccattaaaataaataccagagtaatttgcacactaaagataaaatctatttgaaattatgaaatgttcattgagaaagtttaatattatacaaagacattgatttatctcatcccatctttttgctaactacctgtatattacacatttggaaagatatggtactctctgtcagtacttactaatttttggaggtatttgtttttattgcattggatgtcctgactctttatttggaggttaaggaatgacattgataggcttttctcatctctgaggttagagatttctcatgcgaagaaacaaagtgccctgggtcaactacagctctgacgagtgcacctccttctcagcactgacaatgattaaatgatagagtcagacactaactcagatctatagaactgcatattaggacaagggatgctgccaggggttgggagtgaagattggggtgatggactgactgcacatcacagtaaagttaggataatttaaaaagcaggtgtcaggccacctatcttaaaaaaggaagggggtcaggggccacaagttgcagtcatcacagatgaggccatgaggaaaatgaaattggattaactcaaccagttttttaaagatgcttgatcatgtggtgctgtttttcaaatttcaataggttgttaccattggaatatgaattgagatctggaacttagcttctaccttactgcttattacaactcaattataactcatccatagataagatctctgcattcattaccaccaccactatccatcacctgcccctctgccaaaaaaaaaaaaaaaaaggcaatctgggaaaatttaaagaggaattagtaccaggaatcttttaaaaatgtgctaaaaccttgtcactacaacgtaaaagatatttttaaaaattaatacactcttctcggaatgccactttaaaagttaccgacttcaccattaaactgtcgcagattaaagagcaaaacactcactatatcctaatgtacaagtgtaaatttacacctaaatctcccatattccccataaagtagtaaaaatgtattttttttagaaacagtagcaaaaagatgtaagtgggtgaacttctacactgataaaagatcttgtagacttgtctatccctgctatttccaccaagtataatgatagattctggaaataatacagaagacaaccgaagagaattctgaaaggtagaaagaggaagcttaggaccccaggactggaagatacaataacataactttttaaaaaactctgaatgggctcaagaatagagtgaaaagacagaggacagaatcactgaacttgaggacccatcaataggctttatctaacctgaccaaaaaagagaaaacagactgaatataaaaagaactgagccatagggtcctatcagacaatatcatccgaatctcaaaaagagagaagaaagtgtgctgaaagagtactgaaaaaatactggctgtaaacttcccacatgtggtgaaagacacaaacccagagatttaggaagtaaagtttaagtccaaaaaaggataaacccaaaaatatcgacaccaagatccatcataattgaactttttggaaacaaaacaaaacagaaatcttgaaagcagcctgagagaataacacattacctgcctgtaaaagaaccctaatttgaatgatagtagattactcatctgaaattacagaaccagaaggaatggcatatttttttcagggctgatagaaaagaattgtcaactataaattatatatccagagaaactatccttcaagaataaaatggaaataaaacctttttaggccgggtgcggtggctcacgcctgtaatcccagcactttcggaggccgaggtgggcggatcacgaggtcagatcgaaaccatcctggctaacacggtgaaaccccgtctctactaaaaatacaaaaaatagacgagcgtagtggcgggagcctgtagtcccagctactcaggaggctgaggcaggagaatggcgtgaacccgggaggcggagcttgcagtgagccgagattgtgccactgcactccaacctgggcgacagagtgagattccatctccaaaacaataacaacaacaaaaaacctttttaacacaaaagaaaactaaaataatttgtcgctagcagacattccctaaagaatggctaaaggaggtttttcaaaaagaaaggaaaatataacaaaggattcttggaacatcaggaaaaaaatgaaaagagaagaaatatggataaatgtaatagactatccttatcaatttttgaaatgacatatgataattgacacaaaaattgtaataccatatgatactcaagacaatgatatttagaagtggggaagataaaggacccaaatagacataaggattacatatttcattatgagagtgaagatatttaagttgactgtggtaagtcacatatgtaaactataataccaagcaacgagtaagaaaattataaaaattaccttaaatgtaaatggttaaaatataacaaaagttagacgttggcagaatcaactgaaaaaaaataacacaacgagaaatttataagaaactcacttcaaaataaacataggcaggttaaaagtaaaaggatggaaaaaatacactctgcaaaaattaaatttgaaagaaagcagaatggctatctcataaaatagacttcagaacaaaaatactagaacagggacattacataatgatttaaaaaaaatcaccaggaagacataaatgtatatgcaagaaacaatacacccttaaaaaaatgaggcaaaaattgagacttctggtttccaatctgatatgacgttaagagtctggaagtcatcgctcccattctcacaacaagaaaaaagctgcactaactaaaaataaacagttcttcttacacagttaaagtcatagggcaaacattactcctaaagctgcagagacaagtgaaaacagcatcacagctaatggagccaaagcagatggtggagtctggtaaaagcacttagaatgtaactgactaattgatggatactgagcaaggacaagctacagagattgaaaactcctagagtgggggataggccttagagggtcaacacaccttcaagagttttatctccaggaagagccccatcaagttctcagaataaagataggaaaaaaaatgctcttatgtctccagtcctggggtcctaagacataaggggagggaaggagaaaacatttttgaaataagcgcagaacattatgttctctccttaacaacattctaatcccccaaaaagctagtttactagagcctaaaccacctaggggaatggaaatacccagcaccagccccctctacccttcttttcttacccaagggaaggggaaggaagctgagaagcactctgaaggtcacagtccaggaagacaggttctctaaaagactgacctaatcctaagagtacaggatgcttctggccgggcgcggtggctcacgcctgtaatcccagcactttgggaggccgaggcgggcagatcatgaggtcaggagatcgagaccatcctggctaacatggtgaaaccccgtatctactaaaaatagaaaaaaattagccgggcgtggtggcgggcgcctgtagtcccagctactcgggaggctgaggcgggagaatgacgtgaacccaggaggcggagcttgcagtgagctgagatggcgccactgcactccagcctgggctacagagcgagactctctcaaaaaaattaaaataaaataaaaacattaaaaaaaaatgagtatacgatgcttctcctcttcccgcaccttatcatcaatcacatcagtacattacctgtatagtaacaggagattaaaaatgaaagagctgtcaattttagaccctatttaagacagagtctctgggaaaactcaaaacggaagaaagaaaaataaaataaccttagaggaaattttggcctctgacaccacagttatgcaaagagcaaattcagcctaactactaactagataaacataaaaccttacattaaaggcttccttacctcagttcctttgccaatacaacatgtctggctttcaacagaaaattgcaaggtatgctaaagccaaacaatacagtcttatgagacaaatcaagcaaacatgcagatatgacagatttggaaatatcagataaagaatttgaaataataatcagtatgctaagggctctatgttgaaaaagtgggcaacatgcaagaagagataggtactataaacaaagatatgaaatttcaaagaatcagaaggaaatacagagattaaaagtaaaaattgtagagtgtctttgatggcctcatcaaagtctgggaagactgggaagtgctgaggaaagaatcagtgagtttgaagatacgtcaataaaatttttccattaaacacaaagagaaaaagaatgaaaaatgaaacataatatccaaactgttggacaataatttttttttttttttttttttgagatggagtctctctctgtcgcccaggctggagtgcagtggtgcaatctcggctcactgcaagctccgcctcctgggttcatgccattctcctgcctcagcctcccgagtagctgggactacaggcgcccgccaccacgcccggctaattttttgtatttttagtagagacgtggtttccccgtggtagccaggatggtctggatctcctgaacttgtgatccgcccgcctcggcctcccaaagtgctgggattacaggcaagtgagtcaccgcgcccgaccctgttggacaatttcaaacggtgtaacctatgtaacccataatcggaataccagaagtagaaggaagagagtgagaaccagaagaaatatttaaaataatgacagttgagaatgtttcaaaattaatgacagacatgaaaccataggttcaggaatctcagcaaacaccaagcaggttaaatacaaaaaaatccacacctaggcatctcatattcaaattgcaaaaaattgaagactttcttaaaattaaaataaaatcttttaaaaataaaatctcgaaataaaccagagtaaaataaaacaccttacctacataggagcaagaatgagaattatgccagatttcccttaaggaaccatgcaagcaagaagaaagtgaagtgaaatatttaaactgttgagagaaaacacacactaatataaaattctatatccagtaaaattatcctaaatagtaaagtagaaataaagacttagataaacagaattgaggaaatctttctccagtagacctaccttgcaagccatgttaatagaagttcctcagagaaaagaaaaacaatataggtcaaaaacacagaaatacataaagaaaggtaggagcattagagaagaaaaaatttaaaataaaatctagtgtcttcttcttaattgatgtaataggtaacagctctaaataatactaacaatgtattgggtgattatggcttatgaataagtaaaatgaatgataataatgtaatacaaaataagacagaaggattggaaatgctgtgttataaagtaccagcaccattaatgaagtggaatagtgttgtttgaaagtagattgttatagtgtatatttcatactcaaaggctaccactaaaacaatgaccaagaaatgtaattaatattctaggagaagtgaggatatggaatcatataaaatgctcaattaaaacaaaaaatgtgacaggggaattcaggaaaaaaagaagaaacaagggcaacaaataaaaaagagttacaatatggcaaatattaatccaagtatcaataatcactttaaatgtaaacagtctaaatataccaattaagaaagcaatggcaacaaaagccaaaattgacaaatgggatctaattaaactaaagaggttctgcacagcaaaagaaactaccatcagagtgaacaggcaacctatagaatgggagaaaatttttgaaatctacccatctgacaaagggctaatatccagaatctacacagaacttaaacaaatttacaagaaaaaatcaacctcatcaaaaagtgggcgaagtatatgaacagacacttctcaaaagaagacatttatgcagccaacagacacatgaaaaaatgctcatcatcactggccatcagagaaatgcaaatcaaaactacaatgagataccatttcacaccagttagaatgatgatcattaaaaagtcaggaaacaacaggtgcaggagaggatgtggagaaataggaacacttttacactgttggtgggactgtaaactagttcaaccattgtggaagacagtgttgcgattcctcatggatctagaactagaaataccatttgacccagccatcccattactaggtatatacccaaaggattataaatcatgctgctataaagacacatgcacacatatgtttactgaggcagtattcacaatagcaaagacttggaaccaacccaaatgtccatcaatgacagactggattaagaaaatgtggcacatatataccatggaatactatgcagccatgaaaaaggatgagttcatgtcctttgtagggccatggatgaagctggaaaccatcattctcagcaaactaccgcaaggacaaaaaaacaaacactgcatgttctcactcataggtgggaattgaacaatgagaacacttggacacaggaaggggaacatcacacactggggcctgtcatggggtggggggagaggggaggaatagcattaggagatatagctaatgtaaatgatgagttaatgggtgcagcacaccaacatggcacatggatacatatgtaacaaacctgcatgttgtgcacatgtaccctagaaattaaggtatgataataataaaataaaagactgagactgtcagagtaaacaacaacaacaaaacccatgatccacctacatgttgtctactgaaatcctctttaaatataaaatagcaggtagatttgaagagctagagaaagatataccatggtaacactaaccaaaaagaaagccagagtatctaaattaattttagacaaagccaactgcagagcaaggaaaattatcagagatgaaaaagggtattacacaataataaaggggtcaatataacaagaagatataataatgcttaatgtgtatatacctagcaacagaagagtcaaaatatattagggggaaactgatagaactgcaaggacagagagacacatccattattaccactggagacttcaacacccctctatgagtaagtgacagactcagcaggaagaaaatcattaaggatagatttgaactgaacagcaccatcaatcaactggatctaactgaatactttagaattcaattagcgttgtagaatattttatctagacactgcagaatacacattcttctcaaatacaaatgcacaattcattaagttaaaccacattctaggccacagaacactttaccaaatttaaaagaatagaaatcacaaaaggcatgttcttgaattagaatggaattaaactaataatagcagaaagagagctgaaatatcctcaaataccaaaaaatttaaaaacacatttctaaataataaaacatggtgaaagagaaagtctcgagagaaacaaaattttttaactaagccagtaattaataaccttcccaaacagaaggtaccaagcccagatgattcactggtgagttctatcaacactggagaaataaatgataccaattttccacaatctgttgcagaaaatagaagcagagtgactatttcttaactcattccatgggccagcattaccctaatacccaaaccagcaaaaccttacaaaaaagtaaactgcaaacaaatatctctcttgaacatggatgaagcaatccttaaaaaatattagcaaattgaaccaaacaatttttaaaaatgaacaccacaaccaagtgggatttactctagatatgcctttaacatttgaaaattaattaatatagtccatcagatcaacaagctaaagaataaaaatcatatgcttccagtactttctgctcaatttctatgtaaacttaaaattgctaaaaaatataaagcctattaatataagaaaactgatggagcagaatggaaaaataaacagatccacaattatagtacagatttcaaaatgtctctcttagcaactgacagaactactggacaagaagtcagcaaggatatacaagatctgaacaacataatcaaacaacaggatctcactgaaatacatacagaatactccacttaagaatagcagaatatacatttttttttcaaatgccgatgaaacatttacaagacagaccatatcccggcgagccaaacaaacctcaacatatttaaaagaactaaaatcatacaaagtatattctctaagcataatggaatcaaactggaaatcaataccagaaagagaaaaagaaaatctctaaacacttagaaatttttaaaaatacacttctaaataagctacaggtcaaagaatatgcttcaaagaaatttattaaaatacttaaatgaaaatgaaactacatgaaaaactaagtgaaaatgagaatacaacatatcaaaatatgtgaaatgtaggtaaaactgtgttgatagggaaaacgtagcactaaatgcctacattaggaaagaagaaagccctaaagccaataatgtaagttcttacctctagaaactagaaaacaaaattaactcatacaagctgaaggaaggagataacaaagagaagagcagatttcaatagaatttgaaacaaaaataatagagaaaatcatgaatcgaaaatctagttctaaaaaacagtaagattgaaaaacttctatcaagactgacagagacaaaaacagatgagacaaactatgaatatgagaaatttaagtggatatcactacagatgctggagacatcaaacaaataataagaaaatactataaataattctacacaaatcaacttgacaattcagattaatggacaaatttctcaaaaagtacaaactaccacaattcacctaacattaaataggtaatttaagtaattgtaactattaagaaaattgaattcataatttaaaattactgaaaaaaaaatctcttggcccagatggttttactggagaattctttttgttttgttttgtttttggtttttatttttgagatgaaatctcgttctgttgcccaggctggagtgcagtggtgtgatcttggctcactgcaacctctgcctcccaagttcaagcgattctcctgcctcagcctcctgagtagctgggattataggtgtgcgccaccacgcccaactaatttttgtatttttagtggagacggggtttcaccatgttggccaggcaggtctcgaactcctgacctcaaatgatccatctgcctcagcctcccacagtgctgggatcacaggcgtgagccaccctgccgggccttactggagaattctaccaaatgtttaaataaaaattaaagtcaattttacataatctcttccagaaaacaggagactagagaatgttaccaaattcattttatgtaggcagtattgtcctgatactgaaaccagataaagacaatatgaaaaaagaaaactacatatcaatatctcttatgaatttgaatgcaaaaatattcaataaaatattaataaatgaaacacattagaaatgtattttttaaattatacattatggcaaaatgggagttgctctagttatgcaaagctgattcaacatatcaacagacaaaagaagaaatataatattttaataccaattgacacagaaaagacatttgacaaaaatccaatgtcctttcaaaataaaaactgtcagccaaccaggaataaaagggaactacctccacataacataggaaacaagaatgaatgcttttcccctaagacaggaaacaaggcaaggatgtctgccctcaccactctagttcaacctaggattgaaagtctagctactgcaataaagcaagaaaaataaattaactccctacagattgacgaggcagaaataaagctgactctacttgcagatgacatgattttccatatagaaaatcccaaggaaactaaaaaaaaattaagttcaaaaaagagcttataagattagtatgaaacaatcatatttcatattctaacaagaaacatgtaaacaaaaatgtaaagcacaacagcacttataatcaatcaagaaactaactaaatgcctaagcatacttataaaacatataatctctggatgctaagaattacaaaatgctgaggcaagaaatcaaagatccaaataaatggaaagatatctcatgttcatggattggaagactcaaaacagtgaaacaccaattttcccttcattgagctattatgtttaatgtcattcccataaaaattctagcaagatgtttgtagacataaacaaatttattacaaaatttatacagaatgaggcaagctacagacttacttaaacaatcttgaaaaagaagaataaagcaggaggaataactcaaccctgctatacagctaccatgttcaagacagtgtgatattggtggaggcatataaattaatgaaacagataaagaatgcagaaacagacccaccacacaagtaagttcaaccaatttttaacaatatttaaaatgcaattcaatgcaggaaggatagccttttcaacaaatggttctggagcaactgaacattcatagtcagagagagtgagagagaatcaactctcacatcttatataaaatgtgtcccaaaatagggcatggaattaaaagtaaaaggtaaaactagaaaacttttaggaaaaaaattcaaaaatctttggaattggaatttagggttaggtaaagaatttttagaattgacacgatgtgtacaacccataaaaggaaaatatgataaactgaatctcatcaaaattaaaacttttgctctaaaaaattccagttaagagtcgatgaataggcaagcaacagagtgggaaaaaatatttgcaaatcacatatccagcaaagggctagtatctagaatgtataaagaactgaaaattcaacagtaacaaaacaaatccaaacaatccaattagaaaatgaacaacaacaaaaacacattcacagacatctatctcactgaaaacgatatacagatggcaaataagcatataaaacatgctcaatattattagacatcagggagacacaaattaaaaccacaataaagatattactacacagttatcagaatagcttaaataaaaaatagtcacaacaccaaatgctgatgagcatgtggaggaaatgaaatcatacactgttggtgggaatggtacaaccattctagaaaacaatttggcagctttttataaaactaagtatgcaattaccatatatgacccaccaattgcactttggggcattaattccagagaaatgaaaactgatgttcacacaaaacctgtacacaatgttcataaaagctttattcataattgccccaaactgtaaacaaacaacccagatgcccttcaatgagtgaataaactctggtatatccatgccaccgattgctaatcagcaatgaaaaggaacaaattactgatatacacaattatgcaaatgaatctagagaggattacacagagtgaaaaaaactcaaccacaaagagtacatactatataatttcatttacataacattcttgaaatttaaaaaaacccatagaaatggagaacatactagtggttattaacgagcaataggaggaattcttttttttttttttttttttttgagatggaacggagtcttgctctgtcgcccaggctggagtgcagtggcgccatctcggctcactgcaagctccacctcctgggttcacgccattctcctgcctcagcctcccaagtagctgggactacaggcacctgccaccaagcctggctacttttttgtatttttagtagagacggtgtttcatcatgttagccaggatggtctgatttcctgacctcgtgatccgcccgcctcggcctcccgaagtgttgggattacaggcatgagccaccgtgcccggccaataggaggaattcttgtgctgatggaaatactgtgtatcttgactgtatggatgtcaagattccggctgtgatattgcactatacttctacaagatgtcaccttggggtgggggaactgcttaacggctactcgggttctctctgttacttctcacaagtgtatgtaaatctacaattatctcaaatttttttttaaattatcttttcaaaagaggagaaatagggaaattctcactgatgggagtagaatattccatttcttgtgttattttagcccctagcccagtagtttccaaaagatcacctggggattttttttttaaacaattccaaagccaaggctacacttcattcaacagcaatgaactaacaaataattaagttttgtaatgccaactttaaaaaactggagaactgggaaggagagtttcttacttactgaacttatgtaagctatctcatttataaaagaaaccccatgagatcaatactacagggtccatttcatcaaagaggaaacaaagtctgagaaagattaaggaatggcctaaatttccacagctgctaagtgacagacttaccacttgaacttcaaactttgaatgcaaccagacctttgctctttctactagaccaaattggctggcaggcatccaggggagagagggatcaccctgggaagggacccagatgccgactgcacaggtctagcacagtgggtaagatttaagagtgtgagggccgggcgcggtggctcacgcctgtaatcccaacactttgggaggctgaggcgggcggatcacctgaggtcaggagttcaagaacagcctgaccaacacggtgaaaccccgtctctactaaaaatacaaaaattagccgggcatggcggcacccgcctgtattctcagctattcgggaggctgaggcaggagaatcgcttgaatccgggaggggagggggttgcagtgagcaaagatcgtgccactgcactccagcctgggtgacagagaggccaatccaggcagaggaaatggtctggcatattccaggggctgattggccagacagattagggaaggcaatgcaggtatgggttagcggatcagcgcaaaccaccttcagatgacagtcatacaccactttccaacttaaagattttgtattgaaaattaaagagtgaaatttaatttaagtggctttattatgctaccgacatatactgtttttgtttttttaagacaaggtgttgctctgctgcccaagctggaggcagtgaagcaatcacagctcactgcagcctggacttcctgggctccagtgatcctcccgcctatatactatttgggattgctaaaactaaaaaaagaaaggcaaatttcagtatttaactataattagcaataaagtgctttcaagaaactatatggaaactgttggagagcagcagtgagtcctgcaggggacttgtggggattccggaaaggagggggaagttggtctttaacttaggagaagatggttttgatgcaggcagagtttccaaaacattacttccatatatgaagattaaggtatacatttctcaagatataatttcaaaaaaatgagacacccactgacaaaaggttttaataaccctagtcattatttcatcctagaccacagtgaaagtggcggggctgaggaagggcatattcagttaatctaaagggaggaaacaaacgttccaggtagatttagaggaagactttgaccagagtaaggtggttaccggttcccactggtcttcatgaagaattgttagacccagcctgccctacagccattatctcctcagtgtgaacggaaagctaaggcataagttatcagcaaaatttcccttgattaagaaaggacaagtcactagtcctgcatatgaacgcgctgaacgtctctcaacggtcaggaaggcgctcttgaatgctctttggtccaaccaagagcgggaagagaaggagagagtggtcagggctttgaactaagagccacgggagggaccctggccttttctccctcaaacgcatctcgcagcccgagggccgcgccccggccccgtgaacccctgtagcctccaggagtggcgcttacctcgtgagtccgggcgccgcgccgtcccgcagcgcagagccagccgctgctcgcagcgctccgccaggttcaccgcggaccgcagctgccccgcgcccgctgcgtacgcgaaggacacagccgagcgcgggtgcccgctgggggcacctcggagggtcaccgcgtcggggccaccgtgctgcaccaccgtccacgcggcgtctgctgagcagaaacgggcaaaggagaggcatcactggacggcagaggccagcagcaagaggcaaagcagacctgtcttttatgtgaattaacgtttaattgaaatttacattactgcatgtttgccgcgatttgaggagttggacctgtgtaacaatgtactgagccagaactcagcctctaagagaaagcatattggaagaactgatgaccaaacttttgtgacgtcacgcctaaaagtgtatcatgtaagcaatgactttttagttgttaaaaccatttttttatatcaacacaagcatggggccaaactgttactacctggacctttatctttttaaactcatctgcattttcctcatctgtatgtgcctctatttctttcattatcgaataaatttataaaagatacatattgggacgatgtgacgcacatactcacaggtatgataggaagcagctctattaaaataaagtggtttaattatgtcagcttatccatcagtgaccaagcccagaggaatcagaggccttgagcttctaacagcactttccaggcggtgaccctgagcatctgactgcctgctgacatcatttctgatgtatctctgtcacttgattacttatattgttttgatgaaataaaaacaaaatgactccacaatctcaaaagggaagaagtgcatcttgagttctttagtgttcccaaaaatggacctcccaccagacttgaagtcactttaattctactatgctggtgctgtctggtcctttaacctctaataagatgtatttagaataatggacattttacataaaaattttccgaactggagaaatgaagaaacattcgtatggggattttttaagaactacgaaacaaaacaatgtgatacattttaccttgagaaatcaccctgccagcccttcacatctcaggatttctaatggcttggctgctaactgtgcgtaagacaaatttcacagccttactgttacttacacacgcctaacaacagagatcagaggaaagaaggaaaagaaaaccagccatgctactgaaatatctctttagtcacagaacccatggagaggaaaggtgtgatatccacaaatgagccacaagtacagaaaaaaatctgcaaatttaaataatgaatgcaattttaaattaaattatcactccactcactgtactcaccaaaggaggctctaagtgtgcctatggtaatttcaattccatgggttcttcctttaatattgctctattttttttattttagattttttatttaatttatttatttttgagataagagtctcgctctgttgcccaggctggagtgcagtggcgctatctcagctcactgcagcctctgcctcctgggttcaagcagttctcctgtctcagcctcccaagtagctgggactacaggcacacaccaccacacctggctaatttttgtatttttttagtagagacgggggtttcaccatgttggccaggctggtcttgaactcccaacctcaggtgatccacccaccttggcctcccaaagtgctgggattacaggtgtgagccaccacgcctggcctcattttagaatttttacaacctggtgttactctgtgcacatcacctactctcaccttcagagttttcctatcaactgaatcaaatatagaaaaacctatggaacactaagttgggcattgaagatgatcaaccacatgccatttttggccatgtgttcatgatttgttgtacaatgggagagaaatgatggtccagagtagttcacataggccggtgggcagtatgatagatttgcagtcacccatggttaagatgtgatcacagaaatgccctcagtactgagaagggaactgttcagaatacatctgtaaaacttgtttttctgaagagtagaatagtaaccagggacattataggctatgcatttgtgtttataaaattccacttgactcacttctccttataatatcagtagtaaaacacccaaagaaggacatagaccattgtggtttccttaattgctcataatttatttcaattgattataagcatattggaactggaaaggatcttaaagagcatctaatataacccttatatttttctttttcttttttattagagatagggtctccctctgttgcccagcttggagtgcagtggcaccttcatagtttactgcagcctcgacctcctgggctcaagtgaattggacctgagtagattaattataacagtggctaaatgtggaaaggggatcagaggtgtggctgagtctgaacacactggaggctgtctcactagcccagaaggagggtaactgtaacacgttgatccctgttccactcctgttgctcaaataaatatccgactttgaaaattaagctaatttaacttcatgattttgattggaattaacagtacagatgttcctcaatttatgatgaagttgcatccagatgaacttattataaattaaaaatgcactttaatacatgtgacctactgaacctagctcaacccagcctaacttaaatgtgctcagaacacttaaatcagcctacagttgggcaaaatcatctaacacaatgcctattttataataaagtgttgaatatctcatgtcatttattaactactgtactgagagtaaaaaagaaaataataataatggttgtggccaggcatggtggctcacgcctgtaatcccagcactttgggaggccgaggcaggcagattacgaggtcaggagatcgagaccatcctggctaacatggtaaaaccctatctctactaaaaatacaaaaaattagccgggcgtggtggcacgtgcctgtagtcccagctaccggggaggccgaggcagaagaatcgcttgaacctgggaggtggaggttgcagtgagccgagatcgtgccactgtactccagcctgggtgacagagcaagcctctgtctcaaaataataataataataataataataataataataaaaataatagttgtatgggtacttgaaatagggatgcatatggtttcacatagtgaagtcgcaatattgtaagtagaaccattgtaaacggggattgtctgcacttaaaatttacttagtatatcatatgaaatccccagcatctggtatacccattcctatatgtcccagaagaagaaagaaaataagatccactgttctgttgtcaggagcatacatattaaggttatctcttttagagaactgaccctttcatttgtctgagaaaatctttatttcttcacttttcaaggagaaggttttgttttgttttgttttctctctttcacactttaagtatctcactccattcttgctggcatgatttctgaagagaagtcgctgtaatacttatctcctatgtaggtaaggtgctttcttcctctgattatttttaagaatttacttttacctggcctgggcacggtggctcatgcctgtaatcccagcactttgggaggctgaggtgggtggatcaccttagttcgggagttcaagaccagctttaccaacatggagaaaccctgtctgtactaaaaatacaaaaattagccaggcatggtgtcacatgcccataatcccagctactcaggaggctgaggcaggagaatcacctgaacccagtaggcggagttgtggtgagccaagatcgtaccattgcactccagcctgggcaatgagagtaaaactccatctcaaaaaaaggagtttacttttatctttgaattctatagtttgaaaatataagcctggtagagttttgggggcatttctccttctttggtgttctctaaacttcctggatttgtggtttggtgtctgatactaatttgtgggaattctcagtcattatttcttcaaatatgcttctgttcctttctttctttcttctcctagaattctctttacacgtatgttacaccttttgtagttgtgccactgtactcagatattatgttctgggttttctttttgcggggggttgggttcagtctttttttctctttgcttttcagttttgcaagtttctattgaggtatctctaagcttagggattctttccaaagctgtgcctggtctactaataagcccatcaaaggcattcttcatttctgttatgctgtttttgatctctagcactcctttttgcttcttagaatttccatcttgctgtttacattgttcatctggtcttgcatgctatctattttatccattacagctttttccatattaattatagttgtttaaagtcctggtctgataattccaatgtccctgccatatctgactctggtttttgtttgttttgttttttggtttttttgagacaaagtcttgctctgtcacccaggctggagttcagtggcatgatctcagctcactgcatgctccgcctcccggattcatgccattcttctgcctcagcctcccgagtagctgggactacaggcacccgccactatgcccagctaattttttttgtatttttagtagagacagggtttcaccgtgttagccaggatggtctcgatctcctgacctcgtgatccacctgcctcagcctcccacagtgctgggattacaggcgtgagccaccgtctgtttttaatgcttgctctgtctcttcaaagtgtgttttttgccttgaaattttttctttttctttttttggagacaaggtctttctctgttgcccaggctagagtgcagtggtgtgaccatggctcactgcagtctccaactcccaggctcaagcgatcctcccacctcagcctcccaagtagctgggactacagatacatgtcaccatgctgttttttgttgttgttgttgtcacaatgctgttttttgttgttgttgttgttgtagaggtgggggtctcactgtgttgcccagactggtcttaaaactggtctcaggctatcttccctcctcagcttctcaaaaagtaataggattataggtccagctgaaattttttcttgataaccagatgtgatgtaccaggtaaaagtaactgtaactgctgtaaagaggcctgcagtactataagtaacatgtgtgggaaggggaaaggttctatagccctgtgattaggtctgagtcctttagggagccttagcctctgggctgtgaccttcacaagagcttctcagccctccctcccatcaccacccttacttggggacaggatggccagaggtgggtaatttccttcctccaggcaggttaggctctgaaaacaaaaaacaaaacaaaacaaaacaaaacaagaaaacaaaacaccagtagcttaggtgaaatatttgcccttgaggaaagaccttgttaagaagaacagaaagctctggtgtacttcaagatggttccttttcaccttccctttctggaagcatgaggagatttttctccaacattcactgtgagaacctggtcaagctaggtgtcaaactcacagaagtgtggggacccttctctgtctgggtcttcctggagtttttaactctcagatgtgtccacatcgaacatccaacaattcgtcaattaagtttaggttttcctaccttgacaacggtttccccaaaggttagtgcttgtggaagaaaattgtcattctgtatataagcctgcctgtctctccaattttgaggggcagtggtttgttctgtgacctcacttctctgctggatctaaaaaaattggttgatttttcagtttgcctggctttttacttgttcttaagacagagtgctgacttccaagctctgaagcaactgctttttgaaggttattaccatatatacatttcaagctattagagtagtttgaaattgcacattttataatcattattgcttgatttgtacaactagagaatttattactggctatagcgcaatggggcatctaaagagaaggtgacattttctagggcagaaaagagaccagagtttagtgattcccctatcattagctagattttgtcagtagatacttccctaaccaacttttctgagccttggtttcctcatcttaaaatgatgacaaccaaggtccttcctggttgtgactttggttgagtcttttgatatccaccaagaccatttttatgggatttctcactttgctttcattgtttgagtcaggggattttggaggtaattggtatcttatggcagaacgcctgtgtttctttatcttcagcacattgctgtgcaggtggctctgaatcttctgaacgtcccctgtaaagttttactactttttggcaatctttgctaaggcactttaaatgcccatgtaatttcagttatttgtttctttttccttgatgcttgctgacccatttggttattgtccaaatttatgaaacttttgaaaccttttgtcagcacaataaatgagaacagtttattccagatttccactttgcagagagttggaagagctaggtgacaacaaatttctgtaaaaatgtaactatttaaaaggcattctagtgcaatcttctataatcaagctgtgttcatttctttttttcctttttttttttttttgagatgcagtcttgctctgtcgtcaggctggagtgcaatggcgcaaccttggctcactgcaacctctgcctccctggttcaagggattctcctgcctcagcctcccaagtagctgggactacaggcgcgggtgccaccatgcccagctaatttttgtatttttagtagagatggggtttcaccacgttggccaggatggtctcaatctctggatctcgtgatctgcccgccttggcctcccaaagtgctgagattacaggcgtgagccaccatgcccagcccaagcagtgttcatttctaatatctaaagcacgagaaataatcaagtttctttggttatgaaaaaattatatgccataaaaatcactaaattatttaagatgcacatagaacattaacatatctatgttatttcttagcacttttaaagacctctgttttttctaaatacagaaagcatgtaaattaccgaatcagaggtttgtatttttcatgatgcacatgaacagatgtattacgaagagtgtaggagctagagagatgccttggcagagcactgaatctttcctataatccaacccaggcaaacaagaaatacaagaaaattttgttgacaacaaaattaataaatatatatttaatgcttctacttagcaagtacacactatcaaactgcatgttttaataatgctgccaactaggtaaatttctccttggtctattctgatatatgcatataacgattatcaacatacctgtcatattgcagtacacaagaaatggtcccagggggccacttccatctgcatcaatatagtaaagcccagacgggttccctcggtgcttgtgggcttcacaagactgctcgtagagagctgtaggagaacaccagccataagaaccagaaaaaatatctccagatgttgagtcagtgtccaaaggtttgcatttctgaattacagacatgtgatacatatgacccaacatcattttgatagtgtatgacagtatatttgatgagatgcaaaaaaatgacatttaaaaaattaaatctatttttattaacaaaggagaaaaaaattacctagtcaaaatacattcaaatgttggatgttgttagatgctgaataaatatttggtcacagtgtatttctattttgaggaagaaggaaagattgtgttggtgttcaaacatgaagatgtgcttacagtgggaatgcgatactatcttcaatagacaatcttttggcaatgtctagagactgtagtttctctacataaatgttttcttttgcttttaggcaagaaagcatgcaaactctgaagcacagtgtaaaacacttgaagagatatgagaggaaaactttgtgaatctgaattctgcgtgctattgaaacatggttcttttcaaactcatggcaactatacctcagaattaaactctataattaaggaagaaaccctcattcaccctgtaataactgaatacctgagcacattaaactgcctaaataatctggtattttcccataagcattctgtaaagtttttcttaagctatgcggcagttataccctttgcttcctttaaaacaatatgaatgagcattttaaagagataaatagaatttataagctatcaacatctcatcattaaaaaataattaaagctgatttaaaaaagaaacttccctaagtattttgcaagtgacaattcaagacagctgaaattcaaaacaggagagaaacttttttgaaagatatccctatataatgtaaatttactctagcataattgaatattttcatttgtgcaagcaaatgttttaccaagtacaaggtatggaattaatatctgcaggagatggacattgctaatctttatttttttgccacttatggcatattgatttaaatagatacatatatttgtatatgtctggtaggattcactcaaattaataacaatacttaaatatagggcacagactaggtttggaatggagacaaatattgaggaaagtgactagaatttgtgctttatgtgaattttttggctttttaaatgataatgtacacatgtattaatgtatagtatatatcaattgaatacaattaatgagttatatacaattaataattatatacaattaattagttgcacataattgatacatgttatacaattagaaatacaaaataacctattcaactaggtgtggcagtctagtctcacagtgaatgactgtggacttggcaaatttctacctatagccgtcaactattagatgagactgacacttgaaatactttttcaatctcctgatattttccctcagaagtttttggagttatattttgattgcagtgaataaccatggactaatataactcattgattaattgcaacattaaatgcaatcagatgatgctgagtgtggtggtggatataaatttgccaggtaacacacaagattaggcttctgcttttaggtaagatactatgcctggaggatgaaagatacacagaagtaaaagatgtactccctgcaccaactctatgaccttatcaagacattcaacctctggtgtgagaggccactcaactcctagaaaatgtgtcacagcggctgggcatggtggctcatgcctgtaatcccagcactttggaagtccaaggcaggtggatcacaaggtcaggagatcgagaccatcccggctaacatggcaaaaccccgtctctactaaaaatacaaaaaattagccaggtgtggtggtgggctcctgtagtcccagctactcgggaggctgaggcaggagaatggcgtgaacccgggaggcagaacttgcagtgagctgagatcatgccactgggctccagcctgggcgacagagcaagactccgtctcaaaaaaaaaaaaaaaagaaaatgtgtcacggctttataaacagggacccttctagtacaaaaatcatacttcatgcttcaatctgtgagagtcactcctggactgtctcctcttttgcccagatcctttacagaacctcaggactgggagcgcagaattctcattccatgtatgaactgtggttttaacactccacagcctgcctttctcctgtggcttttgtgaaaatcaaatgtctcacggaagagttcttaaaagtttcaattaggaactcaggatgagcaagtggaactgaggactttgcatctctgtttccttgaagacccagggatgggcgaaatattcctgaggagaagttgctcagaaacgtcagtagagatatacagaaagaaaactttaaaagttaaaaacaaataggaaaaaaaaggcttttcagattctgtgatgttctaattataacaggttagaggtcaataaaatggcatggcctttgaaattcagagggtgattcttcagtaaagacagatgatttttaatatggcagaggcagttgagaagtgttagaatatgccatcccttagacattgttcttacacttaaatgtctaccagaagcatgaggaaggttggttacaagagactcggggccccatctccagcgattctgatttagtaagtttgggtaaggcctgagagtctttacttgcaacaggctcccaggggctgtgggtgctgctggtgcatggaccaccaatcaggcatcctggagccaaggctgtggagccaacctccttagctcaactcctcatcttcccacaaactagctgggggccaagttacttaacctctttctgtcctcaactctgcaatgaagataataagagtactttcttcctggagcttctttagggttaaatgagttaatatatgcaaagcaatagcagagggctgacataagtactcaatacattaatacttttacacttattcactttacaatcatcatcaccaccaccaaagaaaatcacagtcattgtaagagatcttaaaggtcctctagtttctagctgatatcccattacctcttcaaaaatcttaccatgtacaatcccatgattgcatcatcccagtgattgttaaaaaatctttaaataccttaaatgtagcattgacagcctggcaaggggttgtttttccacctttctttgactgagaagattctcagaattaaaagtatggtccaactcaagtaatggaacaagctgttacatcatgcatttttaatttaatttagtttctaccttttactatatctgattctcctagacttatttccccattgcttgccagtttctttttttcaatcctatgcgtaccacgtatttctgtgcactgtctcaacaccttgtattaaataaggtggattaaaagtaaactagaaattgagtgctgaaatatctcttctgatgtgtttgcatgattgcaaatatgcagatacatataaacaactaatcaaaatgaaatgacaaagagatgctgacagaaacgagagggaggcgtgaggcttacaggaatggcaggtctcgcccgtatagcctgtgcctagacagtcacaggagaaggtgtcccacgactgggaacactcgcccccatgctcacagtagctgggcaagcacctaaaagaaaacagatacaactgctgtttccctttttcaatcatcaaaaaataagtgtcttaccaaaaacaggttaaccaaaaacaggttaatgtgaaagagcagcatatgcaagataaccccacatgacgtgattactgggtctgccatcaaggttctctaattatattgacaaactttagataaatatatccattagcatgcagctgattattaggtttctgagacagctgaattttcaacacatttctttttttctttgtcccaagtgacacaataacttgacatgtggctagcaaaaccaattacatacataaaactatgaaatatggcatgctccgttactatattgtggtcatttttaaaagaaagaaggggaaacagggaggaagatacagaggggagaagaaagaaacaggaacagcttcagtcacatagtgacagaggttcagaaattttgaagaacatttaatttaggtcatcttgtcaccttttagatttgcaataagcagtcggttattgctttttaagcaatcttaacactggtaatatgtcaatatgacccaaagcaatccacaaattcaatacaattcttattaaaatcccaatgcctttttttgcagaaaacaaaaatccatcctaaaattcatagggaacctcaagggaccctgaactagccaaaacaatcttgaaaaagaacagttggaggtctcacactttcagaattcttggaatctgctgccgcccactataatattgggggcctagcatgcctgcctctcaggattgttaggggaacagggagcagggtacactatggaaactgaccagcacctgacacagagtgtcaccaagaggtagtgtgaccttctggaggcctggcctgaataccatgacccacctctgccttgagcagggttggatctcagcctctggccgctgtctcccactgctgagtacacagctaaggacctggtaaagagtgaagattctaaaggacactgaccttccaggccgtgagggacatcatagtccatgctggagcggcagaggcggggagcacccaagtgcccctcaccatgggacccagagaagtaacagaagaggggccgggaggttgtgacaggcctcctggctgtggtggaaggacgaccagcagagaactggggtatgaagttgacagaaagccccaggggcctgtatttggcctcgggagaggtcctttgaggggaacctgaggggctgggaagaatccgcagcattccctaccctccccatgcccccagccccctatcctggctctccagcactgcaccaccagctcagggccaagacttccataattacatggtgttaatgagcatttagtctgcattcagagaagagttaggggccatgagaatcacaacttttcaagtatttcaaaggccaaggcatggaaaagcctgtgtgaactgatcagaagaggggcagttggagtgacaggcaaggttggctggggtgggggcccaccctcataccatttttaaaagagcagctgttcctcttcccccacatccttctccctctcctccccttccttcttaatataatggagcatcttaagatcatacctgacttgaagattccacaaattttaaaaaacattaaaaaccactgctgtttgatatcaacagggagagaataactttagttcaaaatatttggaaataagaactatttaagtgatctagagactaccaacaagtatacactatttttcttcaactaaacacaacatgaattgtgaaaaatttacacgtagtacaaataatagaggaagtagctagcatgcagaagaccaacagaggggaagatggcagagggagggcaggagtggggtcagcagcctggtcagcacagccaggtgaggaggtgacggaggcctccctgctcagggagccccagttggaatgcagcacaggactccattggaagctctgccatgtggtatacagggcaaaccttaaaagagtacagcagtctgatgtaagaggtgattaagaagttaaaacctatcctggccgggtgtggtggctcacgcctgtaatcccagcactttgggaagctgacgcgggtggatgacgaggtcaggagatcgagaccatcctggctaacacggtgaaaccccgtctttactaaaaatacaaaaaattagccaggtgtggtggcgggcgcctgtagttccagctactcgggaggctgaggcacgagaatggcatgaacccaggaggcggagcttgcagtgagccgagatcgtgccactgcactccagcctgggcgacagagcgagactccgtctcaaaaaaacaaacaagcaaacaaacaaacacctatccaaacataaacatccattatttgtgactctgtcatccaaagtgcccattgctattttttgtgtagcttaaaattttgactaaaaaagataacttcataccccttatctgtccctaagtaggatttttaggtctggtatttgagtaacatatgtttctactttgtgaattagtgatacggtttggctgtgtccccacccaaatctcatcttgaattgtagttctcataattcccaccgtgtcatgggagggaacctgtgggaggtaactgaatcatgtgggcagatctttctcatgctgttctcatgatagtgaataagtctcacgagagctgatggttttataaaggggagtttccctgcacaggttctcttgcatgctgccatgtaagacgtgtcttgattctccttcaccttctgctatcattgtgaggcctccccagccatgtggaactgtgaatccattaagccttttttctttataaattacccagtcttgggtatatctttattagcagcatgagaacagactaatacaattagatttttgtttgtttgttaacaacaacaaagaaaggctgacatgcttacaggcctgttttcaggatacttaaaagtgaattttcagtattttcaggttttcaaaacttaatgtaaagggaacagcaaaggtatttaattttaactctgtagaatgtcattttgtgtccccaaagttttctaattttattgctttataaaattcaggttttcaaaataatctcagaggagctagtcttctacgttactgactttgggaatgaaatagtaaatagcctttatttgtagccctatttgaaaataatttaaaagtgctttcttaaaacccttatctgcaatgattattgtacacatcatgactgaagtttaagtgtggctcacacatacatgcttagttgagcatgtttacaagtaactttggggtacaatttggaggcctttttaaaatgtgggatcttagagaccaagttaggcaccaatgtaactcttgggactttaaggttaaaacaaaacagcctataacagtaaaaacaatagttttgtactttaggagctacatgcacaaagcaggcaacatggatcatctctgaaaagaggcagcctcacgatatatatctcataacagaaacactgcaaatggatcatattttgtgagtaattaacaaggtatcaaaataatgtcatacaagtgaagaaaatcacacttgcatcacagttgagctgacagctcttgtcactcacagtgtgggcccatgggacattaccccttaactcagagagagctgagctccctggctagttagctgagcaacttgggattatattaagtgagcaaatggccagaaaccttcccaactacccttcccacgactacagagtggggttctggagctggtgttgagatataaatgcagtcccagctgtgtgccaagaattcaaatctcaaggtcaagaatgagaggtacttgacaaattcttgcacttcatatactcctcatctttgaattaattcatttttcctacaaatcaacagaatgttcacagggggaaattattccatgctgaataaatacagtccatatgaatgaacttttcatttagtagtaattacgtttttttagtatgtcactaactatgagttataaattaaaacctgtttagccagagaggataattttacagttaatgtttaaaacagaattgactaactgaatttactccatgaagaaggcaggttttgaaagttctaccagatgcagatataactttttttttttttttttttgagaagagtctggctctgtcacccaggctggagtgcagtggcacgatctcattcactgcaagctccgcctccacggttcacgccattctcctgcctcagcctgccgagtagctggaactacaggcgcccgccaccatgcctggctaattttttgcatttttagtagagacggggtttcaccatgttagccaggatggtctcgatctcctgacctcatgatccgctctcctcggcctcccaaagagctgggattacaggcgtgagccacggcgccgggccagattatcactttttaatttttaaatctgtagcatttatttattcactgaaagtaaataccaaatgtactagggcaaactgtatgtagaaatattatttttccaggtgtgaccctatgattcttctcagccaaaatctttgtaaaattatggcacagctagcataactgtggttgtaatacttatttgaattaaatgtttttcttgtctaacctccatatttcattatgtccttctgcacacatcttcatccatctttatgattcaaacttttctagcagaaattactttttattttctctgcagaacatgtggggttgggtggctgatgaatagtaacctggcaaattcctctgcctggaaaaacatcatccaactgatgggtgtggggttgcaaaagcgagcttgataactattagctgagcaacttgggatcatattaaggtaaaattcataaggtgtatgtcttctaataaaatactatcatttaaaaaatgctatttattccattagagatgcagtttttgtttttgtttttttttttgagacgcagtctcgctctgtcgcccaggctggagtgcagtggcgcgatctctgctcactgcaagctccacctcccgggttcacgccattctcctgcctcagcctccccagtagctgggactacaggtggccgccaccacgcctggctaatttttttttttttgtatttttagtagagacggggtttcaccatgttagccaggatgaagttgatctcctgatctcgtgatccgccagcctcagccgcattacaggtgtgagccaccgcgcccggccaagatgaagttttctaatcctcatagtaattatgactatttcattccctctcgaaagataacaacaacaaaaaagagaacggaatgcctttttccagctgtctacatttgctttcttcaactttgaaaacaggcaagctaaagtgacctaggatggcccttacctgtctgtgatgccgcaggagtctatctggaggtccctgaaactccccagcgccccctgctgtactaagatgggatccaccgctttgtcaccaatggtgatgagccttaggcagccctgaaaccctcccagggggcttttacatccagagccagagctgttgtccaggcagcctaaatatgaagacaaaaataggacaaaagcaacaactatgacaaaactattccacagtatttactatatgaagactgctgctcccgcttgtttatggacatcggtatgatgcgatgagcttcaccattcattagagaggtgagaaggggcaaggttagaactgatcaaatttaagataatacctggaattcagaataagaaattatgggggaaaattcagatctaaaattcctataacaggaattatttcccaaccaagtgaaaagaggtttggcttcttttgtgaaatctcatctaagaaataatcatgcattttagcattatgtagtgtaagtgaaaaaaattaaagtggaggttaaattaaaataaatgaaatcataggccaaattttatttaggatatgctgtgaaatgtgaaaaatgctacctgaaaatataattgtgtactaccatttatctaaaatatgttaaatatctaccctataggtgtttttgtgtgttgcgatgtatgtatatttgggagtatttaaaaacgtatttttttatactgactgggtggaaatacctagatttgcttttctagtaacactttctttggtattaggtactttagtcaaatatataactaaagattaaattctaatgttaacaacaacacaaaaagtaacaggacctaacacactgttagggtacataaggataaaaatttgcagtccagaatgttctatgaatagaaagagataaaatagacatttgattatttccaatattagaagttaaatattaaaagtttcactacaaccgtcagctaatttcacctaaattacaaatggcaatgcttatgacatcacttccctttactatgtgggcttgttttgtgaaacaagaacagtacttataagaagcagtggtgagtgcctgactttgacgtaagcagtattactccacaccagtccaagcatataggaaagtagtgtcttgaacttactcccaccctctgagttacaatatataacctaataatggaactgtaagtttgaaaagtaaggaaaaggatgaaagtacacactctagttaaagaaaacacaataactgtaaaatctttttatttaaagacaactgtttgtagaaagagtcatattaattcagaataaaatcataaggcatttgtctaagtcaggagtctgcaaaggttttctgtaaaacgcagatagtaaacacttttggttttgtgggtcacacctggtttctgttgcatgtccttcttgttataaccctttaaaaatacaaagcagggctgggcgcggtggctcatgcctgtaaacccagcactttgggaggccaaggcgggcggatcatgacgtcaggagatcgagaccatcctggctaattcggtgaaaccccgtctctactaaaaatacaaaaaaaaattagctgggcgtggtggtgggtgcctgtagtcccagttactcgggaaactgaggcaggagaatggcgtgaacccagcaggcggagcttgcagtgagccgagatggcgccactgcactccagcctgggcaacagagcgagacttcttctcaaataaaaaaaaataaataaataaaaatacaaagcaattattcatttcggcttatataatatgccatagaccgtgatttgtctacctctgatctaaatgaatacttaattttaacatacaaatatgaaagaggcacctcatttcataatggtgtaatgccaatgacaagagaaattgaataactaaattgtatattatgaaattatatagcttttaaaaattttatcctttgccttattttaaaaaagaagcctgcttatattgattctgtaagtattgtctctttcaaacttgtgagatataatttcttactttcttttcccaatcattcaaatattaggtattaaacctaatattggcatgacactttgagtccacgcaaatacccttttctccaaagattatagtaaatatacatcaatatttatcactagaggattgagttttctttacagtgttcactaaaatgaaaaaaatgaagtatagaatttgtacttatgtgtttttcattgacctctctttgaccttatactgttaatcactagcacaatttcaaaaaatagtcaatgaagattcctcttactggaataaatgaagcacccctcaatgcctgtactcttatttcctccctgaaagttccataaaaattaaatgttgtgtttagatttctattttaataactgaagctttatctctttaactttaatattttctgctttagatttctaaagtaaaagcctccctcatatttaaggcttctttttagcttatcgaaactatacataacctcacagacacttggaagtttaacatttaacaccatatttgtttaaaagtttgaagactaaaatcttttatatttttatatttacaaaagaaatataagtttaaatggtacagcagaaccttctgaagaatgggatagagagtgaactttgtataattctgcatctcactaatcattaagaaataaacacattaagttaagaattaagaggattattaattcaataaatattttccagtaatgaattataggaatatcaacagttctgctaatctttctttcaccatgtggtgtttcctgacacataacttaggttatcttttttttttgagacctgagtctcgtgctgtcgcctaggctgcagtgcagtggtgtgatctctgctcactgcaagctccaccacccaggttcacagcattctcctgcctcagcctcccgagtggctgggactacaggcacgcgccaccacaccctgctaatttttttttttttgtattttttttcagtagagacggggtttcaccatattagccaggatggtcttgatctcctgacctcgtgatccacctgcctcggcctcccaaagtgctgggattacaggtgtaagccacagcgcccagccaggttattcttaaaagaaaatgaattcaataactctgttagaaaaaaaaaactaaaatccaggtgtcccacaaaaagttatgaaactttcaggacaaattctaatcataaagtactgcatggatatgaaatcaaacaaataaagatattaagacccatgaaaattttagcccggttattttaacttgtgtaagcatatgaggttggcaagaaaattgtcactgtgtgttattgcagtgacagacttcaatgcaatgttgccacaagttctcagtctagcagcttcctacaagaaggatgtgaggactggcgacacaacagtcaattttgtattctcaatatcatggaaggaggcatggcattgaatagcagaaagattccataaaggtaagtttaaaagaatttgaccttcagtcaatctctatttcaggcatgaatgcaaaaaaatgcaggctatatgcacaacctgcaaccgtacagagtgctgcttgaaaaacacttcaaaaagatgaaatcacagaccagaaaaaaaagaatggacaaatgacagtacagaaggtaagtctgcatctgcgaattagactttctctttctttctctctctctctctttcttgacagagtctcactctgttgccaggctggagtgcagtggcaccatctcggttcactgcaacctttgccttccaggttcaagcaattctcctgcctcagcctacccagtagctgggactacaggctcccgccaccatgcccagctaatctttgtatttttagtagagacaaggttgcaccatgttggccaggctggtcttgaattactaacctcagatgatccacccgcctcagcctctcaaagtgctgggattacaggtgagagccaccgcgtctggcctaaactttctattaaaataaatctagtgagatccagaaatccacatccaccagtgattgttccaagtctctcaaggtttctttggtgcaaataacattttccatttatctggcatcaggaaattggtgggtttttcttcttcttcatttcttcatattaacctggctacccatgggtagagtcagcagggcaacattaaatagaaaaaaaaaaaagatgcccccatacgatggcctgagagtggagaccagtgactcaaaagcagaaggctggttccaaaacatcaaacttctgcagtctcagcttcaggtgaggaaggcagctctcactcagggaaagagccaaagttagaaacagtgcagctcttgccagtcattgacctaaggccaggcggctcctcagatgacctgcaaattggggacacaccacggcatgcagcagctgggctgaaggatcctgctcccagtggatttttgcaggggacgttctgattcccttagctgacgaatatgatcctatgttcccttatgattatgagaaagtagtgaagtgccagagagaggaacgacagacacagcaggagctagaaatatgaaaggaaatagaagaaagggaaaagaggcctgaagacaggcaagaagttaggggagttctgatcaaggcgaccaaatccagattctgatgaaggggaagattaggagggagagaggaggaaaagtagtagggtggagctgccattgcccttcccacttctctggtagagaaagaccaagagtcaccccgagattttccttatgaagaggattcaagacctcagtcatggtcttccaaagcagccattcctcccccagtgaaggaggaacaggacagactgagatctccaaaccggcctagcagctccttcctcgctaacgtggtgggaacggtggcgcacaacatcatgcagaagcgcggcttccgggaaggccggggcctcggggagcacctgcaggggctgcgagatgcctttccggtggggaagactagcagatcaggcggcaagatcatcgtgggcgacgccgcagagaaagatgcattgaaggatcaggtacaaatccactgactgaaatacttgagtcctactaaggtggtcctactaaggaacatggttggtgaaggggaggtggaagaagacttggaagttgaaaccagagaagaatgtgtgatgacatatttttcagttgatatggtttcctatgagacatagcatcattaaggataaaataagtgaaactgaaaagagtatagttaatctagttttcataatgagttcattctgttatgtttctttttcttttccattgtcaatttatattggctcagagaaaacaggcttgatggataaagtccatggtatttcccaattttgccatgaaaaatatggcaaagttggaaaacgtgtgatatgtgaaattcttggtgtccctgatgatgaagcagtacagacctttttagaatttgagagttgagtcagcaattaaagctgttgttcacttgaatagaaggtattttggtggacaggtggcaagaggatgtttttacatttgtacaaattcagcatcttggatttggtggaacaagtttgattttaagaactagagcatgagtcatctctggtgacccttaaatgaccagcaggctgagaaaagaaggaaaaaggtcacagcctccatggctgttagatactgagactcttggaaggacctccaaggtatacgttgattgatcccttttcattttgtggtttttaaatattgtataaaaatccaaatcctttttaataaataaataaaatgtgcagctgactagtttcaatcattggtagatattatactgtaggaatgaagttagtgtctgcagctgtacatattcaggccattctaaatatataagctagttaggaagaaaatactgtggattttatccatcaagcctgttttcttcaggccagtataaaacaaatggaaaggaaaaagaaacataatgaaacgaactcattattaaaactggattacaggattaattttaatgttttcagtttcacttatttgactcttagtgatgctatgtgtcataggaaaccatatgaacagaaatatcccaagaagtaaatttgcttagaaaacagaaaagggcttattagtctctttcagtgcactgcacagcattcaagaagaatttgggtcatgtggtctttaaattactaaaacgagtaatgaatactagcggaaccaaaggctgtttctatgtgaagaaatgatctattttgggtttacatacatcagtaaaatttaacaaccagcttatgctgttaaacatggtggttagagctggtgtttcccgaagtttactatacagatgggtaaataaagttacaaaagcacacacaaggaatgcaaaattcactggaaaaactaggtatgttaagaatattttaaaaactaaattttaggctgggcatggtggctcatgcctgtaatcctggcactttgggaggctgaggtgggtggatcacctcagaccaacctgaacaacatggcaaaactctgtctctacaaaatacgaagaaaaacaacaacaacaaaaattagctgggtgtggtggtgcaggcctgcagtcccagctactccagaggctgaggtggaagaagtgcttgagcttggagaggcagaagctgcagtgagctgtgattgcttcattgcactccagcctgggcaacagagtgactccctgtctaaaaaaaagcaaaacaacgaaacaccacccccctaaattttataaagcaaatctaaaagcaaaaatgaaaattgcctaacaatagcaaaatgggacagtagaactgataaaatgtggtatattcatgtaacaatatatacattcttttgaaaaattagcaatatttttaactgtacatatatgatctatttcacagtaaaaatgaataaaattatgatatgcataaaaataacacaaaaacatttctcacattagcatgtatatatttatggaaatgggctcttgaataacaggacgttataaaatctcacctgtagaatttaaaccctaaaggtgatactatatttatactttgacaaatcattttctgtaatcaactttatttagtatcacttaaaaaaatgaatagtactttcattcttatcccttttagtgcttcctaaatattttacttttgaaatgataggtcttggatatattggcttgttttttgttataaaatctgtcatctatagcaaatgttttaatacaatttgaggcacatatgcacacctcggaatatgaggaaagaaaacaatcagaaactttgcagattgacattgtctgttttcacagttgctctgtggaaagtttgctctgaaggactgttagagtttagaaaatgagttttataatttccatgctgacagccaattttagggatgaattttacttttttttttgagacggagtctcactttgtcacccaggctggagtgcagtggcgcagtctcagctcactgtataagctctgcctcccaggttcatgccattctcttgcctcagcctcctgagaagctgggactacaggcgcccaccaccatgcccagctaatttttttttttttgtatttttagtagagacggggtttcaccatgttagccacgatggtctcaatctcttgaccttgtgatccacccgcctaggcctcccaaagtgctgggattacaggcgtgagccactgtgcctggccgaattttactttcatattgtgctgtctccaacataattttaaaaggattctggaaaaaaaaatagtaaaatgcaaaactatactaatactctcaagaagcacctcaagcattgattagcaaatgtatcttattatttacagagttaaatgacatttctaatgaccaaggactttctgagtaaacatccctggggagaagatttattgcacccttctgtgacctccccactctgactgccctctcttaggctgcagtgtctcttggctgtactcaatcattgactgagctggcaaatattctgtttattattgtctaggaaaggctgatgcgctccctgacttggtaaaatgtttcactgcatcattactgggcaataaaaataagttgaaataaccgactgagtaaaactattaggcactttgggcaaagcatggcctttcttcatgccgcagtgggaaatcaataagatgctccagaggagccgagtctctggggatacctgtatggtgcaataaaaccagcacataaagcagtggaaaaggtaacggcactcatttcgcactgttaaaattccgttgggcagaatgatgaagggaagctccataaagggtggtctatttaaaatcggttcctgagtgtgatcttttatttaggcctatctggaagacatgcatttcagtccttaatctgtagtcttttttcaacaaccccatgaaacaaaagggatccagcatggtgatactgtttcatggtgatacaaccccatgaaacaaaagggatccagcatgatgatccagcatggtgatacataatgatactgtgttatttacctggaatttggtaagagagcagatttgtaatgacttcactcccctctgccatcaacatggtaactatgtgtgatgtgatggatgtgttaatcaacttgactgtggtaatcagaacgcagtgaatacctatatcaaatcgtcacatagtataccttaaatatacagaatttttatttgtcaaataaatattttaatttttttaaaaaagggatttatggcagtgtagcagcagtgggtggtaaggtctgggtcaggttcagccccaggtgggaggtggcgtcagggaggaacccagtaaacagctctggccttgcaggtgtaacactttaggcctctgtcttcctgaggcgttgttcctgcatgttgtcccagcgtcttccctctctgtgtgtctctgcacctccatttccatttttcataaggacactggtcatattggattggagctcaccttaatgacctcattttaacttgattacctctgcaaagatcttatctccaaacaaggtcacattctggagttcatatgaatttgagggaaaacaattcaatccataatatcatctctgaaataaggacaactttacttatgcatatacaatttgggttgtggttgctgcgtatctgtttcaaatgggttatgggctcttctcacactttcaggtcaaaggggactttggaatccatagtgtacctatgtatgcatgtatgatcatggatcagccttcccatttctgtcgctgtgtccctatatggttcatgatcatgtatgttacttcactcgaaggccatacacaatccaaacaaaataaaacacagaaactgtgttggctattttgactttctgttgaaactattctctttggtcatatatatatattttaaaaatattatatatatatatatttttaaaaaacattttatatatatatatatttttttttccagtgattatcctgcctcagcctcccaagtagctgggattacaggcacctgccatcatgcccggctaaattttttttgtgtgtgtatttttgtagatacagggtttcaccatgttagccaggctcgtcttcaactcctgatctcaggtgatccgccggcctcagcctcccagagtgctgggattacaggcgtgggccaccacgcctggagatagatagatagatagatagatagatagatagatagatagatatatgtaatctttttcagtatattctcagggtgtgtttgaggaaagctttttttttttttggccattgtccaagggtttagaactgaatgggaatgtctgtaaatggatctgatggaggttggaatgtgtatcagcttttaatcatcactgtaacaaatcactaaaatattctctttattatctctcactttagaagtgtgggagggctggactgatgactctgcttatagtcctacaaggacaaaatcaaggtgctcttgggctccttatgaaggccctagggcagaatgtgtgtccaagcacatacaggttagagcagaattcaacttcttgtagttgtaggagtgaggtcccaattcatcactggctggtagttggggcctctcagcaatgtcaggctgcctgcattgctcttcatagtgcccagttcattttctaaaccagcaatggtgcagagagacattctcctgcttctagtttctctggcttcccctcacccacacctctcttctgtgtctcttctgcctccaaccagagttaaatctcttaagtgctcatgtgattacatggagcccactgcatgaatcacgatcgtctcctaaggtctgcaaccttaattacatctgcaaaatcccttatgtgatgtaacatattcagtttccagggcatcttggagagtcattctcattcttgctgccacaaaatattcctcattccttcatgaaatgttgtttgctttcatatatttgtctctagagaagcatcaggtattttctcaacatcccttcatgttaaaaaccctcaacaaatgaggcattggaggacatacttcaacatagtaagagccacctatgacaaacccacagccagcatcatactgaatgggcaaaagatgtgaagcattccccttgaaaactgggacaagacagggataccctctctcattattcctacccaacatagtactggatgtcctcgcccgagcaatcaggcaagagagagaaataaaaggcatctaaataggagaaaaagaggtcaaactgtctctgtttgcagatgatatgattctgtacctacaaaaccccatcgtctctgcccaaaagcttctcgatctgataatctcagcaaagtttcaggatacaaaattaatgtacaaaaattagtagcattcctatataccaacaacatgcaggctgagagccaaatcaagaatgcaatcctattcgcaatgaccacaaaaagaataaactacctaggaatacagctaaccagggaggtgaatgatctctacaagaagaattacaaaacactgctcaaagaaatcatagatgacatacaaatggaaaaacattccataatcacggataggaataataaatatggtttttaaccatattggaccatactgcccaaagcaatttatagattcaatgctattcctatcaaatcaccaatggcattcttcaaagaaccagtaaaaactattttaaaattaatatagaaccaaaaaagagcctgaatagccaagggaatccaaggcaaaaagaacaaatctggaggcatttcgttagccaacttcaacctctactacaaggctatagtaaccaaaatagcatagtactggtacaaaaacagacacacagaccaatggaacagaatagagcgcccagaaataatgtcacacacttaaaaccatttgatcttcaacaaagtcgacaaaaacatgcagtagggaaaggactccctattcaataaatggtgctgggataactggctaaccataagcagttcctagaccccttccttacaccatatacaaaaatcaactcaagatggattaaagaataaaatgtaaaacgtgtcaggtgcagtggctcacgcctataatcccaacactttgggagggtgaggtgggaggatagcttgagccttggagtttgagacaagcctgggcaacatagcgagacctcgtctctacaaacaataataataataataataataataataataataataataaattagctggatgtggtggcacgtgcctgtagtccaggctaatcaggaggctgaggtgggggaacctcttaaagcctgggaggttgaggctgtatcgtgtcattgcactccagcctgggcaacaggtgagactgactctaaagtctcaaaaaaaaaaaaaaaaaagtaaagcctataactacaaaaatcctggaagataacctaggaaatataggaaatgccattttggacacaggacatggcaaaaatttcatgacaacgacaccgaaaacattgcaacaaaaacaaaagttgacaaatgggacctaattaaactaaaggtttctgcacagcaaaagaaactatccacagagtaaacagacaacctactggaagaaaatattcacaaattatgcatctgacaaaggtctaatgtctggaatctataaggaacttaacaagaaagaaaaaaaacgtaccccattaaaaaacgggcaaaggacatgaacagacacttttcaaaagaagacatacatgtggccaacaagcatatgaaaaactcctcggcatcactagtcatgagataaatgcaaatcgaaaccacaatgagataccatctcacgccagtcagaattgctattatttaaaaggcgaaaaataacaggtgctggtaaagctgtggagaaaagggagtgcttatacactgctgggggaattatacattagttcagccattgcagcaagcagtttcgtgatttctcaaagaacttaaagcagagctgccactcaacccagcaaccccattgagtacacacccaaaggaataataatccttctaccataaagacacacagacgtgcatgttcattcacaatagcaatgacatagaatcaacctaaatacccatcaacagtagcgtaaagaaaatgtacatatataccatggaatactatgtagtcataaaaaaagatgagataatgtcatttctagcaacatggatggagctggaggccattatccaaagtgaactaacacaggaacagaaaaccaaataccatgtattctgacttaggagtgggagcttagtattgagtacccatgacacaaagaagggaacaatagacaccacagcctacttgagggtggagggtaggaggagggtgaagatcgaaaaactacctactaggtactatgctcattacctgggtgatggaataatctgtaccccaagcccccattacatgcaatttacctatataacaaacctgcacatgtatacctctgaacctaaaataagtttaaaaaaaaaagagaagcaacacgtattttctgaaggaaatgggaattatatatgaatatacattgtcaaagactataatgtttgagattttctattgcttatttcattagtttctttctggacctattccatctgggctagcagctctgaaaacaaagtagtgtggatcaaactctgtcatctgtttctgtcacacagattacagccctcatcctgaaggagggacagatttcagtcccatcctaataaaaaaaaaatctctgttctgtttactgtttttttctacttggtttggaaaaattttgttagaggcaattgtcgataccacatatggctgacagcaggtataggaggtatcctggtactcatacttggaaacccttaatttggcatcatcctcagcacatgaaatttctcagatcactaacaatcttggaccgatgatgattccttaagccaacttcgctcttctgaaaaggttggcaggcatgtctgcatttttctgaggactcctatgttatcatccactcaagatacacgaaggcattaactaattttaaaaatcttggcctggcacagtggctcatgtctgtaatcccagaactttgggaggccgaggcagtcaaatcacaaggtcaggagatcgagaccatcctggcaaacatggtgaaaaccccgtctctactaaaaatacaaaaaattagctagatgtgatggtgggtgcctgtagtcccagctactcaggaggctgaggcaggagaatggcgtgaaccgggggggcagagcttgcagtgagccgagatcgcgccactgcactccaggctgggggacacagcgagactccgcctcaaaaaataaaaataaataaataaataaaaatcttaagctcttcagttttactttgtgtctgcttagaggaaaaaagcatccaactacagatataaatgtatccattaataaaaggtaaatggaggcacaaaagtttatttgagctaacagtgattcatgaatcactgttgaagcagcttcaaatgggaactggttcagggaccctttcaagggaacaaaaagggacagcttctgtaaggtaaatatagtagcaaatttttcactggttgtacttatacaattgccttatttggttgatcctgctggaaagtctctagttatataagttaattggcttctgattggttagccttaagtttgactttttttatttttaaagacatttacaagaaatagctcaagttttgcttatattggtaaatcaagcaaagttaacgccacttaaaaggctttgtctggtcagagatacctcaggccattttaattttctttaacaatttaaatacacctgtgtgccagaggacagctcagtgaagtctttgaatgtctgtggctgtatatttggaaaagtatatattctttgcgaaataccacaaatactgatgaggtaaaatgcaatgtacaggactgcatgtatataacaagtctctattactagatctatacttctgtttacatacaatttttattactaagaaaggctgaatatatttacctttccagtaagaattacaagtaattaagttacctcagtaacacttcagtgtttaggtacagtgcaagtggctctctgtatctgtgtccagcatggaatttcatacgtagttgaaaactttcttactcgagagtgagttttcttatcatatatgtggtgatatgggatgataacagaatgttgtaatgtacaggcatccatgcccccaagtgataagttttctcacatgattgtttctcttaactgtggtttccagatataaaagcttaatctttggattcacaggagcattctagaatacatagcagggttttgctgttattcctagtggttcttttaatttaaaaaaatccaaacttcctttataatcaaaagatccacttgtttccatttctttagctgtatgagttctcatagtcagtttgggctgctattaacagaatcccatgaacagagtggcttacacaacaaacagttatttctctcagtctggatgctggaaagtctaagtctgagtttgaggcaaagcagatgcagtgtctgcttcacagaccacagtgttcgccttataacttcacatggcaggaaaggcaagggagttctcttgggcctcttttataagggcactaattccattcattagggctccaccctcctgacttaattaccctccaaagcctcctgacaccatgactttggggtcaggatttcaacatatgaatctggggtggggaagcaaacattcaatactttgcaccagtgtaacaccaattatactggattcatttaatatgtttgtctcctattaattaatatttgtttacattgtcaatgttttgaaagtacttcataatcagtatatttcctattacgccttctccatgtaaaaaatatttatccatctatctataaactgagctgtgtactaataatgattcaatagtatagatttagatgtagacttaaatatataagtaatattttatgtaagccaatgacttcagacagtacgatttgttttgtttttatgagctaactgttagaagtataaatggatttatctgttgtagagatatgactatgatattgtttgaaagtttccacttatttactacatgtagctcaaatatatttttcttttaatgttaaatgaaaatatgaagttatttaaacagcaagtaaactttctgcagatacttatttttgtattgggaagaaaaactgattaaatgtttcatgttttttataaactcaaaaggtattaatttcatggctagagataaattatttcttagtatcaacttggtttaaatttgactagagactcaaaatgcaaagcaataaagataaaaagtggttccactgccagtgtcattcagttgccttctcttacctccaaaataataggtgtcacctgaatcaatgagcacagccaccaggggctgaacagctgtgtcatcgtccaccaccacattcatatggctccacttggcagagaaggacacagagtgccactgcccatcgtttaatccagcacctggaggaaatacaatcagtcagagacaactctaaattatgagctctgtaaacacttgaaaacaatttgattcagatcactgaataagtcagagaagagtggtatttacatgttcatgtatcactgaaaaaaaaattaaccacctatctttaatttaaaaatttcatttattacgaaaataacacatgaataaaaatattactctttctgaagaatcactgtaacaaattctggtaatttgcttaaagtaactagaatttaattatcaaatatatacagtaggagcctttacaatgggataaaaacaacacagtttggtttaatcttcaaatgcaaaacttacttgctttactgaatctaacaaaaacattttacaagaatcaagaaagtgagttgataaaaaatacgtcaagaatgattgtgaaaagttttttttagaaaaagttgacacataattgcacatacttatggggtgtgacaggatttgaaatggaagatcactggatgtctggcttactgcacctattaattaaggtaaaccctgctttcactgtctgagctattttacagccctgtaaattgtagaaaactgatagtaatgcaaaatgacttgtacccatagaaatacaaatgactagtgcctggcgaggtgcagttgcttactgaaccatttcatatctgtctgtaattcattttggcatttcttatctgcctgtatgtgtagtactttgaattatcctccgaactgattgtaacatcttactggtttcttcatagattagttaaaatctttaacatatattcgtgtgtttctgaattaacaaattatgattatagatataattatactgtcttttaaaagttattattcgctgggcatggtggctcatgcctgtaatcccagcagtttgggatgctgaggcgggcagatcacctgaggtcgggagttcaagaccagcctggctaacatggtgaaaccacatttctactaaaaaacaaaaaattagctgggcatggtggcactagcctatagtcccagtcacttcggaggctgaggcacaagaatcacttgaacctgggaggtggaggttgcagtgtgctgagatcacaccactgtactccagtgtgggtgacagagtgagacactgtctcaaaaagataaaataaaataaaataaagctattatttaatatttgataaaaaatgcttaggaaagaactggagttgtactttatatatgtgcaatatttttatatatttacactcacatccacattattttatgattcttagtagtaattatgaaattaatcctgtcaaataatttggtaacaaaatgaattgtctttgatggtaaagttaaatgttaaggtatttaaaatcactagaggtattctgtgctttcttttacctgataatatgtcaaagatacatgccaataaatgggctaaaaataagattagcttcatgaggcctattaaattaactttgcactgaagtttaaaattaggccaagattgaaactatttcagaagttacatatatcataataaactttagactaatagaaattttcctataaagttaacattttacttgatagtcctgggaaacctgtaaattattaaaatgactctatgcttcatttatttttcttcctaacatgcatttatgtgaagttagtatattattaccatttcaaatgtagtacttcttaaaaattaaacattaacattaatattttagctttcccttttaaccttcagtgatgtatgaaacagaaacagaagtagtaataaagtgtaaggaaataaattattctttaaaatcaaccaagattctggatgtcttcaatgtaaaactaggcattgtctaaacacaatctggaggattatatgattctgcaggtttctgtgccttttaccttgagtttttttttgtttttgttttttttttttgagatggagtctcgctctgtcacccaggctggagtgcagtggtgccatctcggttcactgcaagctccgccttccgggttcaagccattctcctgcctcagcctcctgagtagctaggactacaggcacccgccaccacgcctggctaatttttttgtatttttagtagagatggggtttcaccgtgttagccaggatggtctcaatctcctgacctcgtgatctgcatgccttggcctcccaaactgctgggattacaggcgtgagccaccacacctggccccttctttgaattcttttaccaccctgtgaattgtagaaaattgaaagcaggcaaatgattattgtccatagacatgcaaatgaattttgtctggcaggaatacaattgaacttcttcctggttcctctaccccatcccatggaataagccagttttacattatacacaaaatcattgcagcagtaacatcttactgattctctcataaactaatgagttaaacaaaatctttgacatgttctttttataactgcaaaaagtgccctctttaagaatatcttttgacaaataaaagcagatctttgtataactgttttcatgtctatcatccacatttgttttatttttgttttctattaggttgtatttggcctttggccatagtttatgcacaagaaaatcagatacagtagaatctataaatatttcaatgagaagttactaaattaattgcccacaacatagatgttattttaaacacatttgatatgaagatgatctcttgttaacaactacaacattttaactgcagaggcaaaatatcacactcacaaagccatgagctaaagcaaaatcctgatgagatttaagaactttaattatatttaattctagttattgtgcaacccagaactggatgaagtgcttgttcagcacttcattgaatccagaatatatgcaactcatcagcagtaaaactgaaccaactactataggaaaaaaattgagggcagtctttgcaatgggcaaaggagattactgggtatcttttcaatggaaagattagctgatattacgggattgtaaaccatcatcttggactaggttactttacagctgtgtagtgacagaagttaacttgcagaacattgataataatgcaaataatgcttgtccatagagatgcaaagtgtgtacagggaagggatttgcctttccctttggatattgacaagtttagctagtcggcatctcttttctgactataaatgtgtggtacttctttaaacaggccttactggtgtaagggtaaacacaaaccaaaacaaacaaaagctttcttagtgctaaaagggatacacactttcattcactttttttccttagagcatttctttcagaaaacttgtaattgtacatctttaaaatcttaaaacaaaatcttatttagcctctttcttgtttccaggagtgtttttcttgaggaccttggagacatttctttgaaatgtaaacaccaagaaaggcagtgctcctatctccttgtctccgtgggagtttaacgtaggtgcctggctccaagttgcaactacccacttgtcaaagagacatggagtttagttttcctttgcataaaggagtgtgcctccccaatcaccaggtgaatgtaagatgggctgtgtagcaaacggcgctgtcaagtcctcttacttgaggacaagctgtcctttatctttagaacatgtatgtaatgggttgtatctgcctggctatataaatggatgaaatttctttatctttgcaatcacattagcgattgcctgaaatgtacatcacagtctggcttaatacttattccataataagattatttcatttctaccttgtgaaactgattcactatgttggtgggccattttatctttacttatttccctaacactggttctctcatcaatgagttaaagaaaatctctgacatgtgttcattctgtatctgtgtgtaggtcacgattttaacctttcttggaaaaaatcttattcgtgaggaaatggaaactaggtttgcatttctaaaagataaaaaatatacgtcccctctgaatatctgttttatctcccctgaaacacctgtgtgaggtggacatagattctaacacccaggacttgcctgattgttccagaagtactgagataaggccccgccctctgaatttcttcacgggtcttgaaatcgtgcttttataccacaacatttaatagcagtatagtcacgtgtgcctcttacagccaaaaggaatctttttttgagtatgattaccccctggtctcaagcagaagtcagcctcttcgtctgtgcctttttctttttcagattacgctttttttttttttttaaagcccccatttagttccgatgccaatttaggcacaatgtcaatttaggacccagtgctcctcccatctgcaaatccaaaatcatcaaaatccagcagctctgtagttaacaaacttgcccacatctgactgcatgtgagattagttcccatctattgtaactcagtctggcttcatgggatttgagcccctaacctagcatttgcccaacaaaaacaggccctgatggggagtggggatgtgagggcctgtgtgtggggtgggcattgtgctaataaaatcagacttcctattgttctccctgcaaaggagatctgaggtttaccacttcacaagtgaaaacagctgaggcttaggaggcttcgtgatttacatttcagaagggcagtaagtggaggagctgagattcttccagggtgcccagctatcccagaaaacgaatcagccatcaacgaaagaataagaactcttggtatttgccgggcatctttccctgtaaagtgatagttatcaattgcctactgtgtatagaatatttgtgcacagaccctgagcggcggggcggagaagggaaaggaggaggaggacaggagaggaatgtgcctctaggtattgtctgttccatgaggtcctgaccctagttctttgggatggaggctggtatatgtttgtcaggaaatggagctcaaggatattccttgtatatgggaaggtatgtctgcagaaatatgcatttcatatttctcatacatagtcattttggtcaaaagaacactttagtggcagcggggtgtaccacacagaacagtctaaaaggaaacagcaatctgttcctctagtgggggcatggagcatctcactgcctcactcactcactaattaccaaatgatttccgtgtggatatgtcaggtttatgggaatacaactgttacctgctgtgacattccttggtgactgtcccggctggaagagactcagtttgagcttgccatccttaagaaagaggacgaaactccctgaaccacgtcgaagttcgccgaaaagcaaatgtcctgctctgttccacgttcgaaattgaaaagtgacagacactttgtcctccccagagttgcctggcagagccagataactcctggagctcagaaaagtcacagggacagtctgtggctgtggacatgagaaggacacatttccctataaataaaacaaaagagcacattgagcagccttacaggtggtgcttctatctaattaaagccagattttacgaagacgtacaaggctttttatcaatccaggattagtctgcctgctaaagctgaaatctataacatttatcttctctttcaacataagtattattataattgggcacacatccatgtggctttctgtgtgtgtgtgagaaattctccacttctctacttctcagcattagtaaaggagtctcaatataattttagttcaacaggagtttaatctatgccagctattttccaggccctgtgctagccctgaggatacagcaaataacaggacattttcatactcagtctttctcctgagcaacatttggtcttctctacacaatcctcaaaatctcttttgaaccagcttactattttactggttccctcattaatgaattgactaaatctttgacacatgcttatttgatatttgtatgggtcatatttttagctgttggaaagttatatttgacagcctttcaaatggttttcagatctaatagttatatgcaatgtttgcatatagtatttttagcatgaaaacattgatgtttttatatagtcaattatgtctatattgtattttacagcttctgagtttccaatctttgttaagaaagtttcatactaccctaggtcctacatacaatctcatagattttctttaagattgttgtttgtttctcatcctctttaatttacatattcttagtgtgtataagatagtgatcatgcttattttctgccttatggacacttgtttgttccggcagaatttcagaaataattcatccctgttccactgaattgagccacattccttgttactaacaactttgcacataaactgggatctttctgagatcttgactgttctactgacttctctgttcctatccactaccatactgattctagtatagaagcttttagtatgctttaatatctggtaagtcaacatcttactaggtttttaaatggtttttgtttgtttgtttgttttgctttgtttggctggtgaaaggaataagcaattcttgggcattattcacacataggaatttcagttccagagaaaaaccccagtaattctgattttacttggaatttccatggatttatttctaatatactataaatgattttagaaaaagaatgttactggagcaggacagataatctagggtagtggctctcaaacctagctaaacagtcgaatcaccagaagggctcttaaaatccagatacagaccaattaaaatcccgatctctggaggtagagccaggtaatggtatcttttgaatctcctctggtgactccaagataaagccaagtttaagaaccacactgatccagtggtaaaacaattttcaaaacagaatcacatttttaaaaaattctgtcccaacatactttagaaatggatataattcagttatcattttataataatctttaatacacattctaactgtatacatcaatcagaacatttcttcttgactgtttttgtaattctgccaaatgggaaacagttttcatgacaagaaaacatttgcagaagaaaatttaaaaaagaaaacatttgctgtaacaaactaaataccaaaagcttacaagtaattggcactgatccatagtacacatgtaatcactggactattacatattttttatctttttatcagctgtatatttcttgacctcatcatttaggtgggtagctgcctgctacaacagagaggcagggcttcttgccacagaggagtgcttgttagttgactgaatgaattctggcaactgattttcccaacaaaatacatttttaaatgttttccttttatatattggaacaactattttcctgtttttatacagaacacatagaattgtagtaattcttaaaatggaattcccataattaacattatatatccatatgcacaatttggaatgaattgtctttttgtttttgtgtgaaacttacacattttaataacctcattcaatgtaattagtaaatagttttcttgaggatgatatccagaacccagagataccagcttaattgtggttctccttattggctatactcaataattccatcagtgaacccatcagtaattcagaataacatggaatgtatatgaaaacctgtgtctgttgtcctcaaatagtcttgtctctttgtgtcataaggcccaactcactcttcctcacttcaatgacagtgtctttgtaaatagccccatagaagttagggtgaggaggagggattcttctgaacaccaaggactggcagataaaaggtagcttaatattcagaacgtgttaggtcaggcttcttgacacggatgcccattggccaaacccatctttgtatctgtatctgagtaacgcatctccaacaaagccaacttcaataaccaggtcttttttctttttcctgttgagcagcacttaaatgtcagtttctccatggacagaaactttaggtagagggctgttccatttatctccttcctcttttcatttctttttcatcttgtcaaaggaaactgcactctgtggagccttgttatcactcttccctttggtgtttcctttttcatgtatcttgatggtatttttcatttttatgatctcagcagggtgctgttcatagtaaaacttagacttcaaacccatctttttttttttttttctcctttaccttcttggaaagttcatgggcttcacagctgtttttccctttttctcatgctaacctaagtgatgtattcattgtgtggtctggtgacacacagtcagagatattttcaggttttggtcctgcaacccatgagccaactcctccagcacataacaggaaagaaaacatgttcccaacaatacaaataaatattcccatgatgtgctgctgagatacactgacaactaaacatgagctttccctttaaccccaacttggatatttcaaactttaaacattgaaagaagtttattaactgatttggaagtatttccagttgattagggaatagatcattagggattgccattgcaaaatgattggtctcctgtggataacaacaccaaaaacacgtgagacatatgaattctgatttccatgtaaaaatagaaagttattttatttcatataaaaatgaaacaacgatgtcccatgaggcatatttactttataactttttatgcataataaaaattactatattaggctgggtcaaggtggctcgtgcctgtaatcctagcattttgggaggccgaggcaagtgtatcgtctgaggtcaggagtttgagaccagcctggccaatgtggcaaaaccctgtctgtactaaaaaaaattagccgggtgtggtggcacacacctgtagtcccagctactcggaaggctgaggcaggagaatggcttgaacccaggaggcggaggttgcagtgagccaagactgtaccgctgcactccagcctgggcaacagagcaagactgcatctcaaaacaaaaacaaaaacaaaaacaaaaaaagtgcgcctgtggtcctagcactttgggaggccgaggtgggcagatcacgaggttgggagatcgagaccatcctggctaacatggtgaaaccccgtctctaccaaaaatataaaaaattagccgggcatggtggtgggaacctgtagtcccaggtactcgggaggctgaggcgggagaatggcgtgaacccaggaggcagagcttcactgcactccagtctgggcgacagagtgagactccgtctcaaaaaaaaaaaaaaaaaaattggcccaggcccagtggctcacacctgtaatcccagcactttgggaggccgaggcaggcagatcacctgaggtcaggaattcgagactagcctggccaacatggcgaaaccccgtctctactaaaagtacaaaaattagctgggcatggtggcgggcgcctgtaatcccagctactcaggaggctgaggcaggagaattgcttgaacctgggaggcgtaagctgcagtgagctgagattgcgccgctgcactccaacctgggagacaagagggagactctgtcttaaaaataaataaataaataaaactaaattactatattacatgggcagctgttaaagtaagaactgattcttaaaatattagatgaaatggagacttcacatgaataatttttaaatgcaaaaaataaaatgtccttttttctttccttcccattaggcttccttaccatcatgaggatctgtggtttgtgtttcttggctaattcggtaacatccactccattataataaagattttctaaacacccatgaaagcttttacgtctgaatgcccgcgatcttccgggtgtcggaattcccccaaagctgatcttagaaagaaaaatgacataaataacattgtttagtgattttctgatggtacgtgtttaaagcatttataattaataggtctagtactaactgtcacaaatccattcccattatcttatatttgcatgcttgcttattccaaatgaagtgttctatcataatgacagctgttaatacctttatttctggcaccacacagttttgaacaaacttaaaaggaagaagtcaacacacattttctgccacattgaaattttcagccatgtagtaaatttaccctttgtgggtcatatgatctcttttgcagcactcaactctgacacgaagtaccaatgtggccacggacaatacataaagaaagagaacatgttccaataaaaccttctcttttgaacaaaaacaggctttgtatttttttaattaaaaaatgtccaaacttggcctgatgcccatagtttgccaacctctgcattagatattatcttttgctattacatggttaaattaaagtaataaaactgaataatccggtataggactaggatcttcagtttaatattatatgccaaagccacttacgccagtaaatatcacagtttttctggtttgttatgatccttcatacactttaaggtgtcctgtaaaggactgaaagaatagatgctatttaacagtgtagcttagatacatatgggcaatgggttgcaaaaagcattaatgacttaaaaaatatcaggatattatttatatgtgagcatctgacttttcttgttatttaataaatctattggtgtatatcttgttaacttctcaaagtgatcctaaataatgctatgttggttaggattgcaccaagacaagaaaaaaaatcccccaggaatctgcatagtcaaacaacaagtgtaatataccagatgaaatttcaaatgaaatatattcaaatgagtacatttaataacaatgcttgctactttggtatttctgcatttgtggatttcctaaacctaacactgactgtttacttctttccaaggtggaaaagatgatctattataataaactgacctattagaaggcataaacagtttcatagtaccgggacagacataccatacctattactattagtcaacttagttatgaattactataaaatggcatttctctatgcagctaccttatttttcaggttatatttaatttaaactatatatctataataacctcaaaattaagatccaagtaactggaatctccctttgcttggaaatgatgagtgtgtttgtccacggtgaagttgacctgcgtgtcgaggagctcgatgaggacggaatgccagtgctggtcgtccagcaggctgcccagggtgagggtcacaggagcaatagtggaaggcagcttagcattgccttaaaggagaaggaaaaaaacagttatttctgttcaaaatcacagcttcccttttttagttgagcatcacagtttgcatccaactttccatcttacagagttgttttctcactttctccctatcttgaacacaataaccttaccctgtttttattttttttaagttcaattctacactttgttgaaatttttcttagtattttttctattactcatgacatttggatttacaatgcaaatattttctttcttagaacctcattatcagcattatctcataattttataatgatgtattgtctttatgatatggataatcatatattacatatatattatacacacatatggtgatcttgcacagtttgtcaaaatatatgctgtttacagaaatcatacttaggatatgtatgtattgcatgcatctggtagtaatgctcttaaattttcatttacatttgttcattgcagttctactttgcacttactgtcccagagtaactatcacttgtgtattttttatttcttaaaggtgttctggtttagatgatgaattatatggtcattttatctaactgtgaaaagactgagtaccaacaaatgtaaacagattttttttaactactggtataaaagttcaagtatttttttacctgaattaagaaaaaagacaagctttcctttaattaattccagagtaatgtgatttccatgttgtccttctctgtgaagtagaattccattgctctgcatggctttaaatttcaaagaaataacgtctcttattggttttaaaggttttttatcaagtctatacagcagagcactttgtccatcaaaataaaccacctcagattctaggaaagaagatattagaaagcaattctaaatataaatatgtcatacagtagcacattgaaaatgtgtgcatcaatatgccacaccacacacacatagacacacattgtatttctaagccattcattgaaggaaacaactgacaataatatattttctggtggcatcatgagttgatatatgtaatacccaccgttagaattttctaacattttctcaaacttcatcatctagaaatgcttttattaatctactcccaatggctcttatctttagagcagcccatttcttctcattctgtttgattaaaaacaatcaggaaagaagctgtatttcactacataaattatttattttaaggtcattcttatattaaatatcagtgtcactcaatttaaatacctttgttcattcccagtagctttggcttctcttgattcttacacatgtacctactttactaaagattttgtctgtaaagatacagaaacacatatcatacttattaaatactgctttagacatgtaataaatgtattttaaatgagctgacatgtaatatttttctcaaccctcggctaatggtactgctaatgggcactgcaatgtgtcaacttggctaggccatggtaaacagcttttggtcaaacactagtcttgatgttgcagtgcaggtattttttagaggtaatcaatattaaatcagtaaacattgagtaaagcaggttaaactctataacgtgggtgagcctcatccaatcagttgaaggctgtaagagaaagaaagaaaactgaagttctctaggaaagaaggaattttgcctccagacaacctctggactccagctgcaatatcacctcttacctaggacttgccagtccttacaatcaggtaagccaattccttaaaactctctctctctctacacacacacacacacacacacacacacacacacacacacacacacacacacacaggcacacagacatcctattggttctgtttctctggagagccctgtctgacaaaggcacagaggttttgttttcttggatgctttgttgagagagcatggccttaacacctctgttttggttcttcctgctgtagcttgtcagaactccaatgctgccacactctctcagcactctgtcagggtcttataaattcactataaatgtcacatatgttcagctcatcaaaaaacaagttgtttcattttatcagtaatataaaataatatttgataatatttgtcaaaatcacatgaagaaattaatattacccagaaaatctcttctttttaaaagtaaaaagaaaaataagcaattgtcctttgaaaaatatatttatttaataaatgaagatgcatgaaaacctagtgaaatatgaaactatttgaagctgactagctgatgtcattcaagccaataagatggcattgtttaattatatttaatttcacaaaaatattactagtactttttgcatggctatccatttcattcacattatctgaaatacatataataaactgcacttcaaaagttctccattttatgtatcattttaaaatttagaagtttgattttctcacattgggttaatgtacttacaaggaattaatgtatcaagtgcatgatgaataaacacattctgagtaaaatatgtgtaaattaaacaattattccttgttacataacttattatatgttcatgataaaaacaaaactctctgtcaaatgtaaatgaagacatctaagattattattacctggccatgaactaagggaaacctgaaaaagattgactacagactttcacatttttagcactgccctaatacttataatcatgtctttatttgttgcttaaagaaaatgctaatatttgagctattttttttttttagttgactaacaaaaaaagttttcttcccgaaaaggttttttctggattattgcaacctatacatttctttttctcattctatgtttactattactctccaacagcagtattgatcttctaaggcatgtgaagtacagttcctggaatgtttccctcaggcaaatagaatagtaaaacacttatcaagtaaaagagacataaagcaatgaccttgaaactcttttgttctttagctaataccttgattttttctttactgtaatcgctagtgcttgtatctagaaatttaagaatatacttatagctcattatgcatattttaaaataaaagcagattaatgaattgcaaatccaaactttctaaaaatcataaaacattctatgatttatgaagtcaatacataaaaatatgaaacaaaaaatgatgtttgggatggaaagcattgagttcaataagtcaacagtaacgagcccaccaagatcagcactggagagggacaactcccatgtagtccctcttgaataagatcctcccactggagaagcaaaatttcaagtcttggtccttagaagtaatgctaaaaggtaaactctcttcccacttgtccacaaaagtcatacttttagcattttaaaacacttgcaagagcaaagaaaagttctcccagctggtcaggtgcagtggctcatgcttgtaatcccagcccttagggaggctgatgcgggcagatcacttgggcccaagagttcgagaccaggctgggcagcatggcaagactggtcgcacttgcttatattcccagctacttggaagggggaggtgggaggatcgcttgagcttgggagatggaggctgcagtgagcagtgcttgtgtcactgcaccccagcctgggcaacacagcaagaccccatttcaagaaaaaaacagttctacctagccataatcaatgcaaatattcccctacaatatatatttgaataatacactaaaataaaataattccagtaacacatttaatataatcttttctcagaaacctgttggaaaaaatcctttgtatgaaattcaattatataaataggaaatgtagtgggatactggaaaattaatgtcacttattatgtttacgataaaatccaacgttcctcaaagttttcagaatgaaagccttgctatccaaaatgaataaagaaaacttagcttgtggtttaaagcaggaagtgcttttctaattttacatgaatttagtttataattattagctttattaattaagattatagttttgattgctgaatctcaatcagtattagcaatgtggacccctgacacgttagtctgtcaccattagatcaggagctacattttctagtacactagagtatatactgcgtgggcttgaatcctggctccatcctggataagttacatagcctctctctgcctcagtctactcataagtgaagtgagaatacatacactcctctctcacaaggtcgttgcgagggttaaatgagttagtatttgtacttttacaacagtgctgggcacatggggtaccttcagtgaacgacggcttcattattattgtcagggcactgggcagaaaaagaggtggaaatgagtttaaaatagcacataggggatatataggaaagtagacagcttaaaatgatagcggatttaatttttgaaggacctaggaaatcttcagtttccaccaggaaaaagagatttacaaccattcatccacacttacacagctccttctctgccagccagcttgttcctgggctgactcacttcaatcactggtaacctaaatcttactcagaagtattaatatatctatctcattttcttgtgttagaggaccactagagtttttaaatgatacttgaagattattggtgcaattataatgtttttgtcacacttcctcaaagaatatcggaaaagctaaggacagatgtgttcacaaagttcccaaatacgaattcttgtagataaagaactttgtcatacaaggaagaactgtgtcagaagtaattttgctaaaatgtgttatgtcctcattcatacagctaatattcactgaaagccttccatatgctaggtgaaagataaaaatgcagaagacaatgaattacttttaaggatcccacagtatggaaaaaaggtcatataatcctgaaatacgattgtttctgccacattcacagtgatgcttctgtaaacaggcatctggtccagaatgacttctaagaaaggataaggaaggagtctacctgctttagactcctgcaaagtatgacgtctctgaaaagctaagacataagtaattttgagttgctatttcctttatttccttaagccatattttaccttcacattttacttttattagaaacagagactcactccgttgcccatgctgtagtgcagtggtatcttcacagctcactgcagccttgaactcctgggctagagtgatcctccagcctcagcctcccaagtagctgggattataggcatgcactacaatgcctggctaattttttactttttttctagagatggggggtctcactatgatgccaaggctggtcttgaattcctgggctcaagcaatctgcccgcctcagcttcacaaagtgctgagattacaggcataagccaccccgcctggcctactttcacatttttcacacccagaatgtactcttaactctggcttctcattactacttttctgcttctcactgtcattctaagcacaggcatgtctcatccccatcctaccttgtactgccttttcagaggaaacatcaacattgcttgaaaacagcaagattccatagggtgcaaacactgatgtcttacagaagaaaaaaaaaaacacgattccacagaaattttcttaaagtgttctatcaaccaccttcactcagattgactaggagtgatcacttggagactttagaacgtgagcctcaaccagaccaggaatcaggatttctgtggttgagacccaggggtttgcatatttaataagctaactaggtagctgtgatgacacgaaggcttcaggatgatttatcagggataatgggcagattacagaggtttactctctaaataaattgaatgttaattccaatatggggtgaggcacaggggctcacactgtaatcctagcactttaggaggcaaaggcaggtggatcatttgaggtcaggagttcaagaccagcctgggcaacatggtaaaatttctactaaaaataccaaaaaatcagctgggtgtagtggtgcatgcctgtgatctcagctactcaggaggctgaggtgggagaatagcttgaacccaggaggcagaggttgcagtgagccaggattgctccactgcactccagcctgggcaacagagagagactctctctcaaaaaaacaacaacaaaacccacaattccaatatggaaacatgaatatcattttcatagagttataatttatattcaataaatttaaggttatagttcaatgagttttaataaatatatatacctaccttattgccaaaaaatcaaggtgtaggcaatttcatatcaactcactaattgccatttgcatcaaacccccaacactgtcacccagacccagacccaggaaaccaatgatctacattccgtaactacagattagttttgtcagttccaaaatttcataaaattgtatcgtgtatgtgttcttttgtgtctgcgttccttcttaagtgtaacgtttttgaaatacacgcatgctgttgcatatatcaacagtctgttctttcttattgcttggggtattcaactgtttgacaacttgtttatccatttacctgctgatagacatttgaactgtttccaggtttaaactattataaataaagctgctaggcacattcacacatacatctttatgttgacatatgcattcatttctgctgggtaaatacatgggagtggaattgctgagctatatattaagtgtatatttagcttagaagaatgccaaattgttttccaaagtgatagtatcattttcacatttcccaccagcaatgtataagaattccatatctttgccaaacacttggtgtttccaccctttttaattttagcctttctgctaggtgtatagtggtttctcattgtgattttatttctctaaagactagtgatgattcattttaatataataataagttagaatagatgtattgggattctgtagatcaattcggggaggatgataagaatattgaatcctgcaatcgatgaatacacaaagctttcctaggaaatatttgcctttattcactcacatattttctttccttctgggcataataagaggaacttagggaaaacaggccttggttctgcattctcagtaaaggccttgatctctctctttaattttcatgcatgatctttcctctctatttcttttctttcctctctcttttctccttctcccatttcctggtaaagatagttgattgcacagagtctggaatcctctgtgagtaggttcacattccaattcttcaacttacttatttctgatggacagggatttactttttcatcttattttgagtttctatttattttacttttttatgacaaattttttttttttttgagacagggtctcactctgccacgcaggctggagtgcagtggcatgatcttggctcactgcagccttgacctcactgggatcaagcaatcctcacacctcagcccactgagtagctgggaccacaggcacacaccaccatgtccagataatttttgtattttttgtagagatggagttttgctgtgttgcccaggctgggcaatcaagtaatctgcctgccttggcctcctaaagtcctgggattacaggcatgagccactgtgaccagctttatttatttttaaaaaaatttgttgaaatttaattagcacttcagtgttttacagaaaaataattttccaaaatattaagtagattgtattataaacacattattatatgaaaaaattatatacactttgttttcttcaacacatttcccatggcattaaaagaaatgcagttagttatattttcagttatgacaagcaaacattcagaagactacacttcctaccaaggacaagtagaaaatgtgtaccaagtaaagtttaaataatcttcttgaaagttttaaagatctactacgactgccaggactcaagaatgtaaagatcttagaagacaagctcagaacactctttctgcttctacccttgaagcactggtcaactcccaaggagcaatgggcaagagacaaggtggccaagcagaaagtgacaggacagctatgaggctgggtcacgaagcaggggtctctgtagactcatcataattaggagtcagatggcagaattcagagattttcaaaaaaatgttttggcaaaggccttcaaatctcagttgggactagtgaagcattgtactccagatataagatatcaactaggcctcatggggactgagacgctgcactgagtcagttaaatgcttatttgaattaacatctgtgcctaatctagaagcctaacagaggctgtggtggggattcgctgggggatcactttgtcttctctagcctctacaaatttctgtccaacatgtccagaattcagccaaaattatcagacatcaaaacggaaacaaaaaccagacaatggaaaagatcaagagataatccagatattgaagttaacgaaaaatctttaaaataactgtaattaatatttccaggaaaataggcagcaagataaggagtttcactaggatacatgaacagaaattcccaaactgaaaatcacagtaactaaaattaatagctcactggcatattcaacaacagattggtcacagcagaagatctgattagtagtatagaagataaagcagtacacaatgtctagactgcagcataaatagaaagaaaagatgaaagaggagagggagagagagaagcaggaggagggagaaagagagagacaaagaaagaaaataagatacaaacatctcagacagatgtaattggagtctcagaaaggaggaaaggaaatgcgagacagaagcaatattttgaagaagtaacagtgaagaattacccaatctaataatcactgcatagaaaaaagaaatttagtgaaatccaaagaggacaaattcaatgaaaactaaaatagccacatcaaggcaaaactgctgaaaatcaaagacaaataataaattctcaaaagtaaccagaagaaaaatacacatttcccttataggataaaaatcaattacctattgatttcttaataaacatcatgaaaacaatagaatgccatctttaaaaggccgaaagaaaataactacagaccgtattctccagcaagctgaaacagccttcagaagttcatataaaataaagacaattttcaggcaaacaaaagctatatgacaatttattaccagtagaactgggctaagacaaatattaaaaggagtctttctagctgaaagaatttgattcagaaagagcatgaaaatgcagagaaagtaaatatgtgagtaaattcaagtgaatactgattgcaaaaaaaattatattaaattttgtgattaaaatatatgtacacatatacacatgtatgtatgaaactaaaatgtgtcaacatagcacacatggtgggaggagtttaactaaactaacataagttgtacttaaatcctagtattgtttggaaagtgataaaagtagtagctcaagtacctaggagaacaaaattagaacagcaaacaatagtggaaaaactggaaaaattaaacttgattaacccaaaagaagaggagagaaaaaggagtataaaacaagtgaaccaaatataaaacagagagtaacatgtcagctacaatttcacatatgtcagtaattacatttaatataagtggactaaatataccaactaaaactcaatgatttccagatttggtttaaataataaagaaagagtccttacatatgaagacaaaaagtttgaaagtaaagaatggaaaaagttattccatgaaaacactaaccagaagaaatctggcatagctatacagtactatcatcagagaatgcagacttacaggcaggaggcattattagaaataaacaaggatatttcataattacaaaaaatcaactttaaggaagataaaacaattcccaatctatatgcatttaatgaaacagcttcaaaatatgtaaagcatgtatctcttttcattttactggaattcatatttcaggcatgcttattaatggtagacacaaaggaggacagtaggtacactgtagagttgactctgcctaccattagccaaaggaagtcactggctggctcaaaaatcagggggcagggaagcatacaccactcacaggcactggcaaggaacaggtgcagaattggtgccagtgatgcaaactagcacagcgtgtatatataaaagtgataaaacaattaaaggaactttacagaggtaggtagttctaacttcattagaacaccaatgaagaaatacaaacttggaccatctcaggagttatgaaaatttcccatgtctcaaattctaatcaaggacaggtaaaattttggaagggagaaaataaaatttgcttttgtccagtcactatttgttctatttgttttgttttaccggaaacctccacttgccgtctgttgttcctacggaaaacagtacagcactcagttaatccagatgaagctgctaatattcaactgtatttgatctacaaaactggcaaatatatggttcaaccaattataagtgaagctagaatgatgaataagaaaaggactgattggtaatagcatagctatgtaagacagagtctgaatgacatataaaactatttgaagactaagttataagaaaatgtaacagaaaatgcatgaataaagaattacctgtgagtaataaaaaatgattttcacttgggacattataaaagaaatcttcgtgaaaagaacattttagaattctgttaattatctgggctgtgctccaagtattaaaattttaaagaagaatccaccactcccagaccccctcccccaccaaattttccaccattaagggaccaaaaaagtggcgaaccaagctcttcttggttatttatgaagtcaaccttgaatactaaccattttctttttccttcatgaattattgcccgtgacttacaaaggaatagaagcccaatctcagtttaacagaaacatgaaccagacaaaagccatgtttgagtgttatctaatgaaaatactaaaacactagcatggagtggaatgtaagcccttaaaatctgcactagcggactgggaattaaagagatggaaaggatactaaccacttgagaaaacaacaagaagaggactgttctattttttgcattaatatcaaagaaagtggagtgatttaaagaactctgaaattgaggataattaaagctggcatgataaaaaggaggaaggcacagaatcaaaaactaaatgtttatatacaatacaatgcagcttgatgctgtctctctgaaagtagaaaagaagctgccgccatcaatcaatatagcaatatatcaaaacaagtatcaatataatgatcctttatgaaacctcggcagttattatccatcaagaacatggaattggtagtcagaggactggagtcctctccctgtctctggtgactatttgtagctcctgcactgccggcccttggtgtggcttctcagattgcgtacttggaacatctgggtgttaataactgcctttctactacataaagatgcatcaagtatcagatggaagaatggaaacataactgtaaaatcttatatttgctatttttactagagttattacaatttttaatactatactttataacaatataatctccaagatacctgccttacctggatggctagtataagagagaaataatctgaaatttagattcattattcagattttattatcatctgtcagactttttttctgaattgcttcattcattcattcactcaatgcaaagctatggtgcacttagtatgttcctggctctgtattaggtgctgatgttacagcaatgaatgtaccttaccctagtgtagcctgaagtctaatgaggaaaaaggaaactaggcctctaataagacagatacagatacactataaaaagtgactatagcacatgaagtcatactataggcttcctgggaacttataatgaggaaacaaatgtagagtgagggcctaggaagcatcatttaaactgagatcgaaaagaggaagagtaaatagccagttgagaacatggggaaggagcatttcaagcaggggagaccgcaggcgtaaaggctttgagtcagtaaaaagccggacacaattgacagtggacaggtagcaggtgacggcagcaagaggtggcactggagagttattcagggacaagctccttcaggccttgctgggagtctggatgttattttaggaacaatggaaagccactgatggtattaaacagggacgtaattgtatcagttctgcatttttaaaaggtaacttgagttgcagtgtggagaatataatgtagtcagctatgaacagagacagaatgacctaaacttggaaggcaatttccataatttgtgggacaccaagtttagattaagtcggtagtagagctaaagagagctgaaatcatgcaaggtgtaatttggagggaagaatacagaatttcgtgactcactggacatggagggcaagagagatagatgcgtcaaggacccatagggttctggcctaagattctgggagttcccctttgttcttgagagatgccctcgaaggcctggacaggcagtagagcatagggaatttatttttctgtctaaggcctctgggaaacaatcctagtgtcttgggcgtagctttaagcatgtctcaacaatcgagtttgaacaatcgaatgtgcatgtttttccaggaatcatcctgattattgtgtggactaaaaactggaaagatcaagaccagagacaaatagctgatttaggaggctggtgctcatttaggctaaactggagggagagaaagaaattcaaaacatttaggagatagaatcaggtttcagtcaataggtggctgttggtatcgttttataagatggaaaacaaaggaaaatgagcagatagacaactgagttttaagtgctcacagggccagtgaagagaggttggtaccagaggttggaactcctcagagtaggttgcggatacgtatttggaagttatcagccacagtgtgtaaatgctactgaaaactcatggaagtggataaaaggctcagagagagcttgggagcaggataaaagacctagaaccaatctgtggataatgctagcctttaaggagtggcaagaagagtagcatgcaaaggtgcatggaaaaccaggagaatacagctgtcaagaagggcccgaggccatctgtgctcatggctttattctgcagttgagcagcaactctgggagaacctacaacctatccccaggctagaagtggaaatagaaataaatagagtaagccaggagtctgtgaaaacacacacagtttaaaggaataatgaatctattactgtaaatgaagtgtagaaaagctagtaacactagggctgggcagtcccagctactcaggaggctgaggtagaggatcgatggagcccaggggtgcactatgatgatcaggtgtctgaacaaattttagcatcaaatggtgatctctccgagcggaggaccatcaggttgcttaaggaagagtgaactagccctgctcccaaatgaagcaggtcaagactcccgtgctgatcagcagtgggattgtgcctgtagccactgcactccagcctgggcaacataatgagaacttgcctcttaaaataaaaaaagataaattgataaatacataaataaataaatgggaagagatgctgcgtggcagggatattataagtcattataagcaacgttctagaaaacaagcagggcagtggaaatacaaaggaaaatactgaaactaccattattaacataagtcataaaggattgtattactgtcaacaacaaaaataaaatcaccatacttgaacaattattcttctaaggaaaaaaagacaatgtagatgtccacttgttctaaagaattacttttagctagttagcagtggtcacatattatctgtctgcatgtttgggtttttttactagtagtcccttacagccaacagcatgtgtttacagaagttaacggtgccagcagattgcatggcagctgcaccgctcaccggcccttcctggaatcaggcacggggctttgatcttcctggtaccaacctccagcccaaggaactggagtaatatctcttcatgaaggaacatcaagctaatggcaaatcgccatcaaagagcatgttccactttgaagtcagtaaacctgaagttgtttcagagtaatgagaggagaaggtaacttcacagcatcaaagagagattccaaatatcagacatcttagccattgaaacagagagcacagttataggtcccagaaaacacagggatggaaggagatgaacaataacaggaagaaaaaagactgttggtaaagcaacatcattatatttagccctgtagaaatgtaaacactaaaaaacaagcagagttaggaaatgaactgggttgtacaggagttaagtaataaaatggaaataatagtatctgagatattaaatgctgtatgaatgacagacgttgttatcatgctttagaaaattaatattctgcagggctaaagctgtgagtaggcagagaatgggagtgactgtgtgtaaatagtgtgatatgaacatccggccggacccaaattgaagctgcttaagacatttccatccaggctgctctttgacctgttctccagttttatacaggagtatttttcaattttattccattttgacaataatttaaaacatttttatgataatgtaaagaaagaatacaagtatgttctagatcatcaagtggcaactgtgtcactgagtaccaccaaataatttcacggccggctttttgtttgtgttatattcatgtcggccccatcctttccacttttataacaaagaataggtgagaaaagaggctgactaaacacaggttcccaccaagtgaagatcaagtgaagcgacagcacagtgtgcaaaagaggacgttagcagagaaaaacacagagaaccaagagattgcgagaaatcacaccctgcccccagtaccgctcctgttttcccagacagcgtatcatctcagcttcaaaaaaacagcatcatctgttgttagtttgaattgtattcgtttcatcagatgcctaccatattgcaagtactttgctaaactctgggaatctaaagacaggtaagtttcagttcaggtccaccactaaattcaactataaaagacagtaactaaagtccatattgtcatggggagacactagagtgtttccataaaaaccagttctgcttgcccagctatataaaaagacagaaaaagtcaagttcaacatttcatgccgacattggcttttacagtttggctttgacagaatctcatgctgaccttgatttcacacagggaataaaggccacttactatatgcacatccgtacacttcgatccgcatcccaatcctgcccctagggttccaggctaaagggagaaagcgcaggaacctggcttcaaagggaggctggagtctgtagtgcaccacactgtctgcgtttgtgtttcctggaaaaccctaggagaaaacagagaaagggatcaatgtatctgcaggacacaccatcttcatgtcgtcacctctcatggcaatgagcaatgtatgctcgctttgctaatatgcaaaaagctgctgttttaaaggaaacactgctaatggttaacaaggatgtgacaacctctccagtccctgaattcgtcaccattgtctaagttttctttatttacaaggtagtttaaatttcatccacatcattaaaatgactataaacatggcaacctctatgaagttcacttttctaaaatgctatcccacagattcctccctaatcaagtggtaaagatgctcacaaaaagccacatcacatggcagggcaatcaagcaccacggtaacaggcaaaggatctgcagtgagaatcctggaatctgcaattagagagttggaagggacctagacatgattccagccccacacccttaatttataaatgaaaaactacagtctaggaagaagaaaggacactctggaggtaggacagctatcatagagtgtgggcaggattacatctggctttgatttcaatggcatcattgattccatgttatcaggctgaatccacttcacagtgaacacagctccatgcacctgtggcctgtttcctgggggtgtcaagaggagcacactgccactatctgctccaaggcaaaggggctttcactcttcactccatcttgctatctgaacattgggaaggatcagagtgcaaagcaaacaaagttgttttagatatttttttcattgttctcagatttttaagaatatggcatgtgtgagaacaaggaaagggttaatgctattttgcactagaagtgctatcacctaacatgactggggcacatagttaatatctatgtatggaacaggccagcagttagttcaaccaagaatgaagaatgtttcctgcctaattattttgctttactaaagaatgtaccaggcttagggccagcgcgttggctcacgcctgtaatcccagcactttgggaggccaagttggacagatcacgaggtcaggagatcgagatcatcctggctaacacggtgaaaccccgtctctactaaaaatacaaaaaaattagccgggcatggtggtgggcccctgtagtcccagctactcaggaggctgaggcaggagaatggtgtaaacccgggaggtggagcttgcagtgagccaagatcgtgccactgcactccagcctgggcgacagaggtagactccatcacaaaaaaaaaaaaaaaaaaaaaagaatgtaccaggcttaacaacaaaacaaagagaataaagatcagcctgcctcatacccaaccaccaatgggtgtccctgggtataaacacatggaaataaaaatataggaaatgccttagtgaatgtggtcaattttaaatgctagtgttgatgctcagacttggtaacagttcgtctattgttaattcgtgccaattccaagataatcatttcacctttttttttttttttttttttttttttctgagacagggtctcactttgtcttccaggccggaatgcagtggtgcgatctagactcactacaacctctgcctcccagatttaagcaattctcctgcctcagcctgcccagtagctggcattccagaagcatgccaccacacctggctaatttttgtatttttagtagagacggggttttgccatgttggccaggctggtttcgaactcccagcctcaagtaatttgcccacctgggcctcccaaaatgctaggattacagtcattaagccaccatgcccagccagagataatcatttcactcttgttccaactaaagggtcatgtacatcgacattttttgagttaacaatcgctataccaacttcaggtaaatatttgcacaacctctgcactcacaaccttctgtctggacagcccaggctgacctatataaaagaagccatatcccagctccaccacctcaaaccctgctactctctgctgcaagctgcagtttctccatctgtgaaactgatcttgaagggccagagtactaattgagataacacctggaaatcaatcagcccaccacctgcgtggaggtggctgctgtgattgtgacccaggttggtcattgttggcatggttggtagagatggttgatccatccttttattttggttctaatttgggtttaatatctaagacatacagccaagctaatacaagaacatcagatcctatgagcattttgactccaatgttaaaattcagttgcagaattaaaatcatatttttctgtagctgaataaactttgtaaacctcagcaaaaacaatacaataaaaacctttcaaaggaaccctaccaaaacagaattttttcacctttatctgccaaatgttacttctttctcaatttgtttcaaagtgtaaactctggaaaatatacttctgagtgatgtgataataggatcatgtagcaaaataaaacttaatgtcaatttttgcttaattaaatagattaacatttaagaaactttaaatagacattacctaatagtttgtgaataaggcagatgagaaacatactctttgcaacttcagagatatcaataaaaaatcaaacatttattacatatgactaaaatatatttaaaagtttatatatataatcacattaattcatttgaaatttcagaaatcacattattgtcttatatagaattataaccagcttcatgggataccaaccaaatgaaccattgttctttaaagatatagaaattaaagagaatacattttgggcaggaaagatttatactagcatttcactgtcataacattcagggcttattattgaaataaccttatctataacagtaaaataatgtgtgtcttaaaaatatgcagtgtagtttcttatttattatattcaaagtttgcttcgagagcttgcagagcagacatgagttcatacgtgagcacatgaccactacggacagaaagaatggcgaacacaaagacctattcctgctttgttttattaaggtggaaaaacgaaccttctagaaggataagccagcttttatagaaatatgcagccttcaacaattctgcagaggcttacgtcttcattttagacataaatagcaaaagttacagctctgtggagagtgagggtatacagaatagttttcggaagccatagtccttcaaattcttttctgtcttagcaggcatgtgaccttgggagaaatcatcatctttctttgtaaagtagaaaaattgtatctatctggcaatcttggtaagaattaaactagttaatatatataatgtatttgtaagattataaatcatttattttttacagcattcctctgcaatttgtgtgtgtggtgtgttcatgtataaaagctccatcttattgaaagacagtcacttaagtttgatgtggattctctgtctttgagggcattctagctaagtattatattaagtaatcaaaaatgagtattttcagataaaatgatcagtttccataacatgttccttaggtatacatgaaagtgagtgaaatctgcggcttggagtccactcacatgctggaaatatgtttcataaataatttaggaattaatgacattactgaaaaatttccaacactctactttgatttttagcggtcacattagttaaatctaacagtcacagtcagtgatggtgctcatgtgatatcctggtctgcaaaatgttaagcgcatggatagttgtggttgagtatgaaatacccagattgacagccataagcagaaaaaaatctgtcaaggtaagactcatcaacaactatttttaagaagactgttagaaatttgttatttttccaaatttgtcattttgtcatttctgttttagtgggtttttatcatcaaatctttattttaaattacgagatactgaaatgagtctctgaattttaaaataaacattaaatctctactatgcatagggccaccactgtcctatgcaatttcacacatcaattcagttagtcctcacaaagatgttagaaaagcctgtctaaaagaaacagattcttcagcagcttcagtttattattagtttcccaaacacttaaatgtactacgagagattcttattttaatatgctgttattattttaagctgtctgtgtgtggggtaagaaagtgcccgtgagtccctgagttctaattctgtttccttaattgccagactatgctgatattggatacaaattttagtgcttgtaatctcagcttctttatgagtaacatgggaataatactaactgctctgcccaattatagcttgttggaagatgtttctgtaggtgacttcaaaattctaaggaactatacaaatgaaagatattgctaagctgctccctgtaatgcctgttaacaagattatttgattaagacactttgttaattataagtgttatatgaagaaattgtattaattctaagtatatagcattaataatataattaccatgacatataccttgatgattttatgaagcaattaaaatgtttctatagattattaaaaattagcatattatctttatcaccttagtatgactagtacaattatatttatgcagagttaatcagtaaaaagcaaaatgaaagatataaaacaatattatatgtaagtgtaaatatgtgtgaacaaaagaattatgatttttaaaagagtatgtacaaataaaatgtattggactggggaaatatgaatcatgtacaaaaaaatatgattaatgaatgaatgaacaccaaggcaagagtagggtcttatgcagaccagaccgatcattccttcatgattactcactaaggaaggtgactcatggaaaccttggcatctgatgtctaaacatagtaaataaacaaaaaagggctccagcatgtggacccagtgcctgctgaagagctgttaaccctctgctgctgccccctcaacctcctctgttctcaggatgctcatgggtgaagaagggactcctggcaagtgggacctggggctgccacagagccctcccaaggacatagacaggactgtgaggccacggctccagcaggatgctggctcctgcaactgtcaaagacttcagctcagttttggagtttcctgtaagtgatatatcatatgatgaacacaggctgcgaagctggagagacctgggtctgaggccaagtcccaacatatactggttctgtgactgtgggcaagacactcaaccacgcagagccttctcctctgaacactggggagaatgatgatccggactcacaagactctcacgtatctctaaagctcttaacataggactagcatacggtaaataatcaattagtaggaaacactgcttattattatctgttaatactaagtgatatttcctcttactcattctcacaatgctactctttgaaagcaaggatgaatctatggaccttttcctttgattctcagccggaatcaacttaatcacttaggtctgcatcccctcactagcagatgacattaggcaaggatgatactgcttttgtccctgttattttcagaagattacagataatggtgtaacatgcaaaactgtttcttatttaaattagtatcgataactgcctatgtgaacagttgtacttaattattttaaagtgctcatgaatgcattattttttactaaccattagaatacaatgtttatcaacacaaaatgagaaaagtgtgactttgccttattctagcattattaaatgaactgaagtaggaattaagaaatgtgggtgatggttccagctttttcattaattagctgtgagagccatggtatgtcacctgaggcttcagtttagctggaaagcatgctacaaagtactatggggccaggcacggtggctcatgcctgtaatctcagcactttgggaggctgaggcaggtggatcacctgaggtcaggaatttgagaccagcctgaccaatatggtgaaaccccatctctatttcaaaaaaaaaaaaaaccaaaaattagcctagcatggtggtgtgcccctgtagtcctggctactcaggaggctgaggcaggagaatcacttgaacctgggaggtggaggttgcagtgagccgagattgcaccactgcactccagccttggtgacagagtgagactctatctcaaaaaaaaaaaaaaaagtagtatggaatctaaagttttctctagcactaaaagagcatggcctgaaatagttagtttatattcgggtcaagaaagaaagaaatgttagaaaataaatgaataatcaatgacagcaagagtaccttattggaaaaaatgtatgtatatatgcacttatgcatatctttaattaattaaatatacataatcattgaaaaatgaaacactgcaaatacatttgtatgtttgatacttgagcatcctatcatttttttaaataaaaatgaattaatttaccatatttgaataagtcaaaaagagaaaaacaaagtgtagtgcatgtttaaaaaagacaaataaatgtttgtgtttgctcactactgataactttgaggaaatgatcattcagaaacataaagcaatccaaaatacgaatcaagattaacgtaaatgtaatttttaaaataattcagataatgaagagagcagaactagccacttagctctctgtatatagtgcatataactaaatatatcacaacttaacaggcgttctttctgagatattgctattgactttaaatgatcacgttagttaaatgttaaaatacctttttagaaagcaggcaattcatctaacttgtcatttgacttggatctgggacaaatttcctgtgtgagattgatcagcatgtcttcttgctctcagatttccttattataattataaatctttgtgccttataaaagttcagggtattatgctggtgccatctctggtttctcagagactttcaacaaccagcctcgttctgggacatgataggcattgctgcaaaatcaggaattcttcaaggagaataaatgtctgctgtgttgaattttatgctaggttccccaagatctgcacctttaaccctcccagtatttaccagtgtttaacacacagttggtcccaggcaaatgctggtgcactgacttgattgttagagataatcttcctaatgctatattctatccagtctctctaaacccagctccttgttctgctgtgaggagcagcacctgtcttcctttgcctgggtgactcagagatgcccactccatcttcatctctggactcaccacaagtaattacttagtacttcccaccaactgcagagcaatttacttaattggaatgttttcacactttttcatccctgataatcaacctgcacagatgaaaaaattagctagggaatcactattattaaatcagtgatctaagtgcttttgttattctaactgaaaattgtaatcatttgtttgtttgacatatttactatctgaccatcagacagattcacttattttgtccattttaactatgaccaaatatatattttttcacataagaatctgtgagcattaaactgggtgatccatattaccttatccctgaatattagatattggatatgcacatacaaatggttatgattgttatgattagtgtgctatcatggaaaatagttcatagtcttgatagtctgagaattgctatgataatagtttcaaaaacatttaggatacttgttccctatttttaattttagtttttagcaacaaaaatcatttgaaaagcaaacaaaattatttcaccatatttttacacttgtaatcatgtataatacgttctaagaaaaagccatctctacctataaaatactgcataagatgcaattgtatattcctgtgtgtctctcacacagatccatcaatgaacaatattgccagcattgggaataagaatactgaatgaatcaggcctaggttgagtattttctgtgactatgaggcagtcacatcctcctatttggttaggatctacagagtaactagactcaaaaggtgccacctgcctagaataatattagtatgagataataagacttgctcatagcttatccggcagtgtgctagaaattttctgtctatgaatttgtaaaacagcagcaacaacatgaggcacatggaagttcaatgtcctatggtcaaagctgagctctggaaaccgccttcgcacaaattctaacagtgaaattgaaaccgcctttgcacaaattctaacagtgacaaaattatggcaatggggagacctgatctagttaaccccattcttgcccttgaccttcaagttgcccttaatcattcctgagcttgggcaagccaaccgtgagagacatctagtttatagtttaaatgataatagcccttccccaaaactaaagctaatgagagaccaccaggctaggagaatagaggagcctaaattctgctaagatacagacataaatgattgctagccatttgttcagaggtcacgagatatgcaacttcctcatgaattccagcagataacatcagtattgtagaatctaagattagccttttgagatatccaggttttttgcatgtttgactacccatggctccactggacctgccaacagctcccgtagctccacccataagtaactcagcatgcagaagaatcatttcccacacccctatgattacacccccaaccaatcagcggcaagcacccatttcctagccactcccagcccttcccctaaactacctttgaaaaatccctaatctatgagccttcgatgagactgacttgaacaataacttcatctctaatgtggtgtggccgaccttgagttaatttaaactctttacagcaaataccatgttttttgttttgttttgttttgtttgcagatgacatgattgtatatttagaaaaccccattgtctcagcccaaaatctccttaagctgataaacaacttcagcaaagtctcaggatacaaaatcaatgtacaaaaatcacaagcattcttatacaccaataacagacaaacagagagccaaatcatgagtgaactcccattcacaattgcttcaaagagtataaaatacctaggaatccaacttacaagggatgtgaaggacctcttcaaggagaactacaaaccactgctcaaccaaataaaagaggacacaaacaaatggaagaacattccatgctcatggataagaagaatcaatatcgtgaaaatggccatactgcccaaggtaatttatagattcaatggcatccccatccagctaccaatgactttcttcacagaattggaaaaaactactttaaagttcatctggaaccaaaaaagagccctcattgataagacaatactaagccaaaagaacaaagctggaggcatcacgctacctgacttcaaactatactacaaggctacagtaaccaaaacagcatggtactggtaccaaaacagagatatagaccaatggaacagaacagagccctcagaaataatgccacatatctacaaccatctgatctttgacatacctgacaaaaacaagaaatggggaaaggattccctatttaataaatggtgctgggaaaactggctagccatatgtagaaagctgaaactggatcccttccttacatcttatataaaaattaatgcaagatagattaaagacttaaatgttagacctaaaaccataaaaaccttagaagaaaacctaggcaataccactcaggacataggcgtgggcaagaacttcatgtctaaaacaccaaaagcaatggcaactaaagccaaaattgacaaatgggatctaattaaactaaagagcttctgcatagtaaaagaaactaccatcagagtgaacaggcaacctacagaatgggagaaaatttttgcaatctacccatctgacaaagggctaatatccagaatctacaaagaatttaaacaaatttacaagaaagaatcaaacaaccccatcagaaagtgggcaaaggatatgaacagacacttctcaaaagaagacatttatgcagccaacagacacatgaaaaaatgcccatcatcactggccatcagagaaatgcaaatcaaaaccacaatgagataacatctcacgccagttagaatggtgatcattaaaaagtcaggaaacaacaggtgctggagaggatgtggagaaataggaccacttttacactgttggtgggactgtaaactagttcaaccattgtggaagacagtgtggcgattcctcaaggatctagaaccagaaataccatttgacccagtcatcccattactgggtatatacccagaggattataaatcatgcttctataaagacacatgcacgtgtgtttattgcgacactattcgcaatagcaaagacttggaaccaacccaaatgtccatcaatgacagaatggattaagaaaatgtggcacatatacaccatggaatacaatgcagccataaaaaatgatgagttcatgtcctttgtagggacatggatgaagctggaaaccatcattctgggcaaactatcgcaaggacagaaaaccaaccaccacatgttctcactcataggtgggaactgaacaatgagaacacttggacacaggatggggaacatcacacactggggcctgtcgtggggtggtgggaggagggataggattaggagatatacctgatgtaaatgaggagttaatgggtgcagcacaccaacatggcacatgtatacatatgtaacaaacctgcacgttgtacacatgtaccctagaacttaaagtatataaaaaaaaaagatctgcatagttttggatggtatatatttaacatgatcttcctgttctagatagataaacctctagatattagagagttgtcaattttcactcttataaacaatgctgcaaccctgtaaatatgagtaagatttacgcttacttatctctatttcagaataactttctagggatatagtacactcagcagccctccatatccatgggttctgcactcatgaatccaactgtgattaagaatagtagggaaaaaatggatggctgtgactttgttgaacatgcacaaccatttttttcttgccattattctttaaacaatatagtataacgactatttttacagcatttgcatcgtattattagtaatctggagatgatttaagtatacaggaggctgtacaaaggttacatacaaaactacaccattttatataagggacttgggcatccatgaatgttggtatctttgggggtggggggctcctggaatgaatctcccgcagatatccagggatgactgtatttctagtccacaaggttgctcatcattgagtaacttctttttacctgcacatggaggtgtattttaagtgtccattcaaatcagtgattgatgagaatacacagtgtatttttcctctaggccacagaaactaatttctgaaatgaaatttttttaactaattgactttttgctagtttttgaatagcccaaagaaaatgggattatattctcaaattcaaatcatcatcatcatcatcatcatcatcatcatcatcatagcttatgtttttgagcacttcccacatacttccttaagccctttgctcagagatggtcagtatttcattgtcataataaccataatcaccttcacccaaatttgtctgaaatgcacaactgattcccaagtttatatagaaatattgatattttctttttttcttttttttttttttttgagacagtctcgctctttgcccaggttggagtgcagtggtgggatctcagctcactgcaacctccgcctcctgggttcaagagattctcctgccttagcctctcgagtagctgggattatagatgcctgccaccacgcccagctaatttttgtatttttagtagagactgggtttcaccatgttggccaggctggtctggaactactaagttcagatgatccacctgccttggcctcccaaagtgctgcgattacaggcatgagccactgcacctgaccctgattttcattacttttctttcagattagtttatagatttttagatttgaggcttagaagaaaattccttagtttagtatagtagaactattttcctgtattttatttaaagcttaataatacaaattttagaagtgcaaatatattttattatattctttatctctttatcttttttatttgtaagataaaagtaaagatttatctcacaaataaatgtttataaaaaatgagatagcaaaagcaattattttagcctgcctaggagatttaaaaattggttccacagatctgtaagaataaacacaaacaattttctatagacaaattttaaagtataatttgaagtacatcagaaatacagtcgtctccccttatctgcagttttgctcgctttccatagtttcaattacccatggttaatcacagcctgaaaatattaaatagaaaatttcagaaataagcagttcataagttttaaattgctcactatcctgagtaatgtgatgaaaacgcatgtcaccctgctctgtcctgcatgggacgtgaatcatccctttgtccagcatatccatgccctataagctacccacctattagtcacttaagtagccctctgggttatcaggtgggttgtcatggtatcacagtgcttgtgttcaaatcactcttatttcaatcaacaacggctccaaagtgcacaagtagtgatgctggcatattgctacaattttctattttattagtggttcttgttgttaatctctgtgcctcatttataaaagcaacttcatcacaggtgtgtatgtataagaaaaaaacatagtacatatagggttcagcactgtttgcagtttctggcatccaccagggatttggggactactgcagtcactttctcccaaagtatcacctccatttctcacatctgagttgtcaccatcaaaatactcattgttttgggcctacaagccttttaaagttcattattaaagtttaaatagccttttatggggattcttatcagttagtgcctttttcattcatttgtccaggatgtttattaaaccagaacaccggcactccctggactaggaaacaaggagcgcgcaggctggggcccagagactttacacgactcctgaggacaaccgactcagacggggtccgaagaaattcagatcggtgaacgggtgaaccacacagagaactagaaaaggctacgtcggcccacttcaccattttgccctgagatggttctgtggacttaacaagaaaaggaaaaggataaagcctgtgccagaagaagtggttcaggaggtaagggtttctaagattgtgtatggctttacaatgtatagctccctcctccaagtacatttcagagacaaatcctgagcaataaaaaaccttgagcaagctgaaagcaataaaaatgtactggagtgtgataaaaaggacattttgccaatttataattacactcgtaacatataagctgtttcatactttacaagttgcgcttgctaggagtcaggtctgtgggtgtatgtaatctttcctctctatacttctgcataagcctatttttcttcaaaattttatagctgtttgtgtagtgactccaaataaaaacagtgaaaatacactgattatttttcaactctaaatacccattttaagtatagctgaagaatgaaaggatataatcctcctattggtcccttgttgctaagaagcatttccgttgcagattttgagtattacattcattgaaaaagtcttatgcatattttatggcataattatttttattgtggtaagaaacttaacatgaaatctatcatcttaaacaatacagtaccattaactataggcacagttttgtacagcagatcgctagaacttgtttaactgaaatttatgccgaaagagatagcaagtgttggcaaggatgtgaaaaaaaggaaccccttttgcaccattggtgggaatgtaaatggtgcagctgcaatggaaaacattatggcaaatcctcaaaagattaaaaatagaactatcatatgatccagcaatcttactttcgggtatatacacccccccaatataaaatgaagatgttaaagaaatattggctctcctatgttcactgcagcattatccacaacagccaagatgtggaaataacccaaatgtccactgatgagtggaatggataaacaaaatatggtataatttttaaaatcacaaactgagttggtctaatgtcttaaattggcatgtcattttcagcttgacattcacaccttgaagattcagttaaacacagaatagcaatctgcatctttaatatcatctcggtggggctcagactttcctgtcactgaactttctgtaggtcctcagtgctgtgaggagcttagaggcccaatagcaacctgtcctctgggattccgtcttccaagttggagcaactgggagaacaacaggggccactggaactgtccaacagagtcctgcagctgcaggacagccatggggtagatggaggacagtcagaattctctgctgctttcatttcccacagagctgttgtccccgtcttcctccccacagtcagtgctgtgggctcactttgcaaaccacacaaggaccggcctgtgagaaacttccagtagaaaatgctgccaccctgagaaaccaggactttccagaatctttctgtccacatgtcacctacttataaactgagggaggcagtgctggattctgtggtgaggcagggttggggggaagggtttttaacttggaagatctaaataaaccagagttcaagacctgtcacaattccaagtatgatgtaaatcactcatcccccttgaatttcccatcttccttttgcaaaatagaggtaatggtgattactcctaggatcttatctgagggaagatgtatagatatcagtaaacataatgcactgtggaaaattcaaatgatttccacttcaagtacactttgggatgaagcaaggttgaaagaaaataaggaagacaaggttttgtttttgtttcttgggtcttgctctaataaattcacaaaggagtttgaaaggtgatagcggctgggtgtttcatagccaacaggcctacacataccacagaaaccacacagcaaaatgtaaattttaaaatatgttcccttctttttaactttcagcaagcttaacagatttcaaaattacactaaaactctcccagagttaaatgttgtttttccactctggaaaagggaaattagattgaaaaatagaatattaaaaaataggtaataatggaagaaaatgcattgggtgggggcctctaactacatacactttggaaaaggaagatgttttcctactctgtctttctcgaagagttgcgtctggtcctactcaagtctgcagagggtcagtttcctgttcacttgctcacagcagcttgcagtccttctcagtcccaacttctaattttattcattttcaccccaatgtagaatttgtttctcacagtactcatcaacgtaagccacggttcagtcttcctgatattttattgtgcaatgtatattaaatactgtattacattttaaaatacgagttatgagatgttagtcacattcattaatctgcatgtgaaagtacaactaaaatgtgggcacggtgagtccctggggccgcagttctcagggtttatcgagcacatgatttctttcaaggtgaatgtgatttaacttaaaaaattttgctgtttttataaaggacaatcagacttctctgtattatttggcatcgctgcagggttcagactttgaatgaaggcagaaaattagccttcagcatacaaagtaaagtgtcaataataagaagtaagtggtcactaaagctaaaatcaggaggaaaaaagcagaaagcaaaaccaaagcaaattcaatcccaaagcaagtttaaatgggaaaataaattaaaaattaaattttaaaatgacatagcaaattataaatagaaagaaatgagtctagtcgagttctgcagcctccagcctggagaagggtggggtgagatgaaaacattcagacttccttccttcccttccttccctccctccctccctccctcccccactcccctctcccactcctcccttctccctcccccttcccccctccccccttctgccccttcctcccttccttccttccttccttccttctggtgtgaactgcaccagcaccctgcccctcgcccctctcacctgcatctccttttcatcctttctccctctctcagttggttctctgtttgtgatagtgttttaggaccaaccacttgggttcagatttcttcagaggacaaaatgccagagggactagaaaggaggagggggttcctatgactcagagggaaaagaacttgggcctggaactaagtctcctgccccttctgcatgaaagtgccctggagtcctcagctgagcaaatccatattcctttaaaaggcaggaaatgcattttgcccagcactaaactcgtcctcactgataaattccaaacctgagggggaacagctgtgcctgatcatcgccctcactcccaccagggagacagaatccatagaatccacagcgtgccaaacagtttgggattaatgtttctgtgtggaaccctgaagagagacacgttctgggctgggatggcagcaaaaccacatcactccagaattccaatcagagacccgagagcagccattcccccaggcctctcatccctgtcatccccggacatgtcctcaaatcgtatgccgttgatcctcaggtcaatctgtccttttccgggctctctacactcccatccgcccatgcactccccactactcttcttccttccccacagttttttttctgtgcactctttgaccctcataaagaagggaagggaaaaggaggggaggggaagggaagggagggaagggaaaaagaaagaagagagggaagggggatgaggttgaggggaggaaagaaggaagaaaaaagactactttaatcttatctgagaatattctggtgtagcctagaaattgagactggctccccaggtgggcagcccaaggtttctggtacaggctctgcttgtgtgacatgagctcattactgagcctctctaaagttgtatttcttcatcccaagttaatgatgaaaaagtaaataatagaatgcagctaaaattctaaaaatctcacctggtacacaataaatactcagttatattgggtgtcagacactgatctacaccttgattaaaactcaggtctttcttttggacacccctgcccttgtaacactcaggaatgcagtttcctcatttcccctcatcttatttgtggtggggtctggacacattttcaccgatctcctttgatttcataacattgcacttcctcacaaaagtaactgaacacacacaacgagaaagttatctcttctcttaaatgccatttgactatagctccctctacccttcctggccattgtaattcattttctaaactctgagtcattcccttacacttatcaccatcttctctatcccaaagccacaatatgaacatccttgaggaataccaataagatcctttgacttcaagttccctgatgcaaatgagctccagctgcttcacttcagcctcattcccacggccaacctcatcaccacctgggatgggggcaccatctttgaaatcttatttaaactctgtgttgactgtacacctctagatagtcccagatctctcactcccacactatagcttctttgacatgctgactctttctgattttcgttatcagcctctcttgatctaactgtcctctccacattgcccaaacagcatggtacctttttttccagactcttttgccaatttgttagcatttatgtagccaaatcctcaatgtcagcatgtcagcatacctgcagatgctaattctaggtcagtcttctcagttgccttctcaggttctgcaaacagctgactattgctggggaaaaccccccagctgtgcgggtggggtccctattcatggtctccatcctggggtctgtatgctacgaggacaatggtccttagccttgaatgaatatgggaatcatcaggtggattctttaacatactgcttagttcctactctcttgaggtttggatttaagtggtctgggcagtggtctgggcaggtgtttccagtgtagaaatgtactattactagggactcttgttgttccctgtcaaaatctttttccattccacatcctctactacacacacataaacatttcctaccttaattccacttttcccttatcatttttttgtttgtttgtttgtttttgagacaggctcttgctttgtcacccaggctggagtgcactggctcgatcacagctcattgcagcctcgatcttccagactcaagcaatcttccttagttttccgagtagttgggactacaggcacacaccactacaactaggtaatttttgtatttttttgtagagacaggggtctcactgtgttgcccaggctggtctcagactcctgcactcaagggatctgcctgcctcagcctaccaaagtgttgggattacaggtatgagccacagcaccggatccttcatcactcatatcacagagcttgaatcttctgaacatcaagtagataagaacagccataaactccctttcagaaatttaaaataaagcatatataattagctattttcctcctgtttcagaaaacatcattgtttttcagtgtcttctgtgttctggatccttttccctgccatccctctgggacgttgcccctcagctactctgtgagtttcttctgtctccaagctgttgatgggcatgggagttccaccagcatccctggcagtgaccaggctctagtcgctctagcttccacttcacactgtcccctgcccgtgtatgtccctcttgctactgctgtcccactctctttttctaagcatcccgacttctacagaaagtattcatcatttgctctctccttttcattaactcatttcctctcctcagtcttctgcaatcaggcatctactcttatccattcatcaatttactgatgaactcagatctatcactaatttatacagattattttgttttcattttcacaataatcctataacgtatgttctataataacacctattatatagatgaagaaacaaggtacaaagtggttaatcagctaatccaagttcatacagctagcaaacagtgaacccagtatttgaacccaactgatttgactcaaactctgcattcttacctacgtcctgctttgtcttccaattcacctgacatttgcttgctctgatgacaaaactctgccctacctgatttgacattcctagcattcaagtcagtcttgggttaaatagctgaagtgggactattatttccagactccactgttaaaatgcacaaagaagccagaacagagggagtgtgctgatggttttcactaattattttcctctaccacattagcttgggtaccagatccagccacgtttttggtgccacaacccaaggagctggagggtaaggatccacagaggggaagggatagaggagatgagaggaaggagaggaaaggagaggagagaagagaagagaagagaagagaagagaagagagaaagggtgaggatgaccagctcagtacccagtgttctgcagctctggaaggtaggcctgccttgatctaagatgtgatcctacaggacctctggcaaccagaagctccaaacaatgcccaaagcaggtaacatgaaaaaagatttgggaaggataagaaatgcatattcctgaacctgaactcagaggtagctacagcttactctgcccggtcacagcacacaaatgcagtttcctttcagaaataattttcgcaaaagattttgtgtcatagcttaaggaatttagctcagatgaagaaaaaaaatcttagtattaagattctaaatagaacaataaaagaaacccatagtacaaattaatgagatgtgatagggctaatttctctgtttagagatgttttaactgtgacttgacaatactgacatgcaagctcttcaggagaacctagttttcatttgagcttgcttaattaattaccgaagtaatgaatttattctgattcaagggtagacaactgattgttaatgtaaatttattggccgtttaactttttttattattttggagaagcaagggtggaaaaaataccaccagagtaaatttacattgtgttcttgggatatttttcagtaatttttgcaaacttccttacaataaatagaagccattcctaaacctgaatttatttttcctttcagtcagaagtttagctaataaaacttttgccagagtgtagcacaatagctcccctgggaactctttcaactgtgtaattttttctctctcttgtaaaaagaatgacatggtgtctttaaaatgttcaaggctctgaaagaaagacaagccatttgatatgaatgattaataaggacattaaggaatacaaaataagaggagtttaaatataaaaaaaattctcattttcagaatgcagatcaaatctgacttctcttctattttttctgtttcacagacaaaatcctgactgaggttaagtgctaatgtttttaatgcccatcttttattctcatgcttgacaccaatcggctacttcagaactagtgtcttgacacttgaatcttttccacagcaccaaaggttattccacaaggacatctgcgaaaggaagaatatatttctaacgcaataaacaaaggattttatgcaaagcctatttagacaggaaatggaaacccggatggcagagaagccatgttgttcaggtcctgctatttatgagggtgagttttccttgagaaacgcatgtctctttataagcagaaacctctgtaaggtaatccagcagtgacggaatgagatataatattacgttttaatcaaaaagagagtcattaagaatatggcattattatttatatttattcttatccatattattttttaaagtattaggaaaatattcattgtggagatgatttaagaatctatccatatgaggaaataaggtattacctgaaaggggtcccgatccagatcccaaaaaagggttcttggaccttgtgcaagaaacaaattgggacaagtccagaaagtgaaagcaagtttattaagaaagtaaaggaatgaaagaatggctactccagaggcagagcagcagcatgggctgctcaaataaatatagttatttctttattatatgctaaacaaggggtggattattcatgagtgttccaagaaaggggcaggcaattcccagaactgagggttcctccccactttagaccacatggcataacttctggacgttgccatggcatttgtaaactgtcatggcgcttgtaaactgtcatggcgctggtggaagtgtcttttagcatgctaatgaattataattaacttatactgagcaataaggatgaccagaggtcactctcatagccttcttggttttggtgggatttggccagcttctttaccgtatcctgttttatcagcaaggtatttgtgacctgtatcttacgccgacctcttgtctcatcctgtgactaagaataccttaacctcctaggaatggagcccaacaggtctcagcctcagtattcccagcccctatgcaagatggttcaaatgcttctgataaagggactcatatattaggaattcacaatctgaaatgagcaataatattctgaatgtaaagatagcctaaatgacatgttttagccagtggcatataaaattagatttgtcatgaattgatgtcatacgtataatttgggggaaaggccagcatagaataattgtaagatagaatggaaaataactgagtttcaaatactggcaggcaaagagtaggcaagccattgtagctcatggtaattcagaaaggcatctggaaatggagccatctcagaagtcgtttacatgacagaagagaaattagtaaatatttctgaggtggagaccagtcggcaaacacatggctttactcttggtcaaaggacctaattcagaggtgatgagatgacaaacgtttgggggtgatacctgacaccaaaggaaagcaagaactggagaaatggtcatgagagtaaagatgcaaaactctagtgactgactagtagcagcaacttagaaaccgagtcagcagctgaaatgcaaaaggaagccatcctagaagaaagccgggttaaagtcgcagacagagtgggctgctccaacagcaaagccatatattttgagacagcgatgcgctgcctttcttcacaaggtttacccagcacacccacccaaaccatggcagacttgtattgatgcattttccccttccaaatggatcccctgtgagaactctgggagtctatcaacacaaaggttgatgagaaagtagaggactgagcaaagccaacttactttgaacttcaatactactttagagcacaataaaatattaagatttacatcatcctgcttccttattgtagattacccattgttcagtctactttgggatttcttcattgtagcttgttgcagcacttctgtgcgtgtgtgtgtgtgtgtgtgtttgcatgagaaatagttacaccatgtgaatttaaaaatgaggagaacttagataggaacttgttagtctcaactgcagctgcccctgtggaaaactggtgttgccctccctttacagttttgctgcagaaatgggtgattttaaacctgaaagtcaaagtatatttattagcttgatcatatgaaattgctgtttttgtaggtcaagatacttagatatcagcacattcacaaggttcagccttatagtgcgtgactggattccacatccaccctgcattttgtaatcgaaggggaggaagctcacaggtgttgagcaccttgtgcttggccaggtgtttgttaggggctattttagaaacagcactcagttagttactcttagccaggtgctgtctgcaccacatcacgtgatggtcaaggactgatgacccaggccatgaataagtatcattcattcaacattaaacacgagaaaaaaagattcattaatttaaaaaacaccactaaaataaatattacaattagaatttgaaggctcctatttctttccattgggttatatccactaataaatgttacaaagttaggatgacacttaacttgagatacagttttgtagccgttgtttttttttaatctaataagctccttctgtgctataccaaatgacctccctagctgggactcctcctgacatccaggctgttccttcgcatttgaaagcccacgaaagtctttcttcttaccagtacactgatacccacacatcccagccactgcccttcactctcacatcaagataaggtcttgatgttcactttcaggttttatatcagtatactgagcattagcgattggctttcatcctggagaaatttcaatgggaaaaagaattgcattaaaatcactacttattattattttttacgtttatttcaatttgtttttaattgaaaagccatacgattcacatagttcaaaccacatctgcatccattttatatttttatcccattcccattacccagaggggaaaaatgctatgatttttcttatttttcttatgtgtccttctagaaatatttcatatttacatgagtatatatatatatatatatatatatatatatatatatatatattcattgtgggaatttcaaatgggagaatatcttaccttattctttgattttagaaaaatatcttggaagttcattcacagtaagtatgtttacctcattatttctcaaggctgcatgctattccagagtataaatgtaccatgaccactgaaagagaactgtactaacatatttaccattatattcataaaatgttaatctcttcatgcacatatgcatatattacactatgactgtgggataaattcctagaagtagcattgctgcttaatgtaaactatacattgagagaaactgaaagcatcactctttttgcattacctccattcactacactgcaagttgatcattttttggaactttaattttatagatagtgccaaatggttcttcaagaaatcatattcataaaaaggcaccagttcctgaaattgaatcatctgagttttaccttttcatgtgcacacatgaaacagacctaaaacattcccagatgtggtgaggggttgtgagtaaagattctgcagccaggccacttgggttcaaattattgtgctaccactaactagctctataattggggcaaataaataaagcctgtctttttgctttccttgttttcatctgggaagaatattagtatctagctcatagagttctgcgaggattttaatatatacaaagcacaaagaatcatgtttggtgcacagtaagcactcaagatacataatgtcttcatacttaaatttattcttaaaactgattatttttaacctgagccttatgctgagcaatgatatccataatattgcatgtttgcatactatttagattttaagagactttaaatttaatgcattaactatgaaagtacagttgaaagtaatgtcctaagcaacacagcctcagtaaatgttttagttgttctaatcaattgagtagtacctcactgctgttttaatttgcatttctttaacttataaacaaggttgaatattatctcatgaatttattattattattattattattattattattattatttgagacggagtcttgctctgtcgcccaggctggagtgcagtgacgcaatctcggctcactgcaagctccacctcccgggttcacagcattctcctgcctcagcctcctgagtagctgggactacaggcacccgccaccacacctggctaattttttgtatttttagtagagatggggtttcaccgggttagccaggatggtctcgatctcctaacctcgtgatatgcccacctcggccttccaaagtgctggaattacggatgtgagccaccgtgccaagcattatctcataaatttataaactattttttcttcatgtggaatgcttatcaatccttctcaattttacattgcttttttttaatctttatccattgatgtataagagcactttataaaaaaactatcatgtatattaaaatattatttcccattcataaattgatatcttctggtaagtttcaaataatttcatttattagtccctttactgtggtcttggttttacatcttgcatagaaatacatgcccgctcccacattatatatgcaaacctctcccacaatcttctagaactgtttctgtggctactttaaaatctttaattcacctacaatctactttgatgcaaggaatagggtaatagtccagttttattaattttttcctgagggatacctagtttccccagtaccatttattaatttttttcttactaatttaaaatgccacatcttttatcagcatatatatttgaatttgttagtgaatactattttttccactgctattaatatcaagcatactaaaatatagaatcaacctttattatgtactttttttttttttgagacagactctcactcactctgtcactcagcctagagtgcagtggcgcaatcttgtctcactgcaaactccacctccagggttcaagagattctcctgcctcagcataccaagtagctggaattacaggagcacgccaccacacccagctaatttctgtatttttagtagagacagggtttcaccacgtcagctaggctgctctcgaactcctgtcctcaggtgatctgcccaactcagcctctcaaagtgctggaattacaggcgtgagccaccgcgtccagcctctaggtatttttctaattggtaagactaactcctttttcaatttcttgttgccaattgtactgcttatccttttatgaaaattaatttttttaaatgtgacgaataaaatatgtatgcattatgtacaacttgatgttttgaaacatgcatacataattgaatgagtacatcaagctaattaaatatgcattacctcacatacttatttttgtggtgagaaaactaaaaatctattctcagcaattttcaagaacacagtactttgttattaactatagtcaccattttgtgcaatagatatcttgaacttattcctcctacataactgaaattttgtatcctttgaccaacatctccccaactcccaaactcgctagtccctggtaacaactattccaccttctgcttctatgggctcaacatttttagactccacatataagctggatcctgtagtattggtctttctgtgcctgacttattacaccgaacataatgtcctccaggttcatctatgttctcacaaataaataggatttcttttattttatggccaaatagcattccattgtgtatgtacaccacattttccttatccattcatccacagatggacacttcagttgattccaaatcttggctattatgaataatactgcaatgaacatggttgtacagatatctaaaagacatacggatttaatttcctttggatacatacacaatagtgggattgctgaatcatttggtaattctatttttgattttttgaggaacctccctactgctttccataatggatatacaaatttacattgccaccaacagtatacagggatcctcttttcttcatatcttcatcgacacttgttatcttttgtctttttgataataaccattctaacaagtacgaggtgatatctcattgtggttctaacttgcatttccccgatgatttgtgatattgagtattttttcatatacctgttggccacgcatatatctttcttgagaaatgtcttttcaggtcttttgcccatttttaaaaagcacagttatttgttttcttgctattgagatgtttgagttgcctatgtattttaaatattaaccccttatcagatgtattgtttgaaaatatttcctccgatcccataggttgtctttttactctgctgattgtttcctatgtggtgcagaaaattagtttgaaataacctaatctgtctaattttgcttttattgccaatgcttttggggttgtatccagaaaatgatttcctagaccaatatcatggagcttttcccctgtgttttctcttagtagtttcacagttatgggtcataagtttaactctttaacccattttgtgttgatttttgcatatagtgtgagataagggtctaatttcattctgttaagcatgtatatcccatttacccaataccatttactgaagaaactaaactttcttcattgtgtattcttagcacctctgtcaaaaatcaacagacaataaatgcctggatttagttctgggctctctattgtgttccactggtctatgtatgtgtctgtttttatgtcagtaccatgctattttgattgctacagctttgtagtacattttgatgtcagatagtgtgatacctccagctttgttctttacgctcaagattgctttggttattggaggtcctttgtggttacacacaaattttaggatcattttctctatttatgtggaaaatgtcattagaattttcataggtaatgcactgaatctgtagatcaccttaggtattatgaatattttaatattaattcttccaatccatgaacatggggatatctttcgattcctgtcatctttaagttctttcatcaatattttatagtctactataaaattctgtaaacctcagtgtacaactctttcaccaccttggttaaatttattcataagtatcttattggattattttcttgatttcagacacttcattattagtatatagaccacataactgatttttctgttgatgttgtactataactttattgaatttatttattagttatttggggttattttcttttgagagtcttgctctgtcatccaggctggagtgcagtggcactatcacagctcactgccgcctgaacctcctgggctcaagtgatcctcccacctcagcctcctgagtatctgggaccacaggcacatgccaccatgcccagctcgttgtttatttttttgtagaaatgggggtcttgccatgttgtccaggtctcaaaccactggagtcaagtgatcttcctactttggcctcccaaagtgctgagattacaagcataagccatcatgcctggcctgaaatttattcattagttctaataattttttgttgaagtctttagggctttctatgtataagatcatgtcatctgcaaagagggacaatttaaattctgttttcttcaaatttggatgttttttccttctttttcttgtctaattgctctggatagaactttcagtactgtgttgaaagaagtggtgagagtgggcatccttgtcttgtttggatctcagaggaagagttttcaacttttcaccgctgaataagatgttagctgagggtttgtcatatgtgacctttattttgtcgagctatattgtcctctttacacccaatatgttgagagattttagaataaaaggttgttagagattttgtcaaatgcttctgctgtgtccattgagataatcacatgttttttgtcctttgttctattaacatgatatgttacatttatagatttgcctatattggaccatcaattcatcccacagataaatctcacttgattatcatgaatgatctttctaatatgctgttgaatttggtttgctaaaatttcatagagtttttgcatttatgctcatgaggatattggcctataattgtctttttttgtagtgtactttctgagtttggtatcaggataatgctggttttataaaatgagtttgaaagtattcccttctcttccattttttggaagtgtttgagaataattagtattagttctttaaatgcctcgtaaaattcagcagtgaagccatcagggcctaggtctttatttaattagagctttttactactgattcaattttattgcttattattggtttgctcagattttcttttttttatggttcagttttggcaggttgtatatgtccagaaatttatccacttctaggttgtccaatttgttgatgtatacttattcatagtagtctgttaagatcctttgtatttctgtaatattggttgtaatgttgcctctttcatttctgattttgagacttcttttttcttaaagatttgtctattttgtttatatgttatatttttatatatatttatatatttttaaaaacctgacttttagttttatggattttttaattgtttttctagtctgtattttatttgtttctgctctgatctttattatttctttccttctttaactttgagcttagtttgttcttgttattctagttccttggggtgtaatgtttggttgtttatttgatatctttcttccttgctgatgtaggccattattgctataaacttagaattgcttttgctgtatcccatgtgtcttgatatggcatgggtcaatttttgtttgtctaaagacattttaaaatttccctttaaatttcttctttgacccactggttgttcaggagcatgttgtttcatttccatgtatttctgaattttttttcttttttttttttttttttgagacagtctcgctctgtcaccaggctgcagtgcagtggcatgagcttggctcactgcaatctctacctcctgggctcaagcaattcccctacctcagcctcccaagtagctgggactgcaggcgtgcaccacgcccagctgatttttgtattttagaagagatggggtttcatcatgttgtccagaatggtctcgatctcctgatctcgtgatctgcccaccttggcctcccaaagtgctgggattacaggcgtgagccaccacgcccagccaaattttccgaaattccttcagttactgatttctagaatcataccattgtggtcagaaagtataactgatacgatttcaatctccttaaatttattaagacttgttttgtggcctaacatatgatctatcctggagaatgttctctgtgtgcttttgaaaaaggtgtcttctgctgctgttggatgcaatgttcagtttatgtctggtaggtccatttggtctaacacatagtttaagtctaatttttccttactgattttctgtctggatgagctgtctattgctgaaaataggatatagaatttccctcctattaagtccccctcccttcagatctgttagtatttgccttatatattcagatattccatcatttggtgcacacatatttacaagtgttacattctctgggttaacttatcccgttatccttcttcttttttttttttttttttttttttttgagacggagtcttgctctgtggcccaggctggagtgcagtggtgcaatctcagctcactgcaacctccacctcctgggttcaagtgattctcttgacccagcctcctgagtagctgggattacaggtgtgtgccaccatgcccgactaattgttttgtatttttttagtagagatggggtttcaccacgttggtcaggctggtcttgaactcctgacctcatgatccacccacctcggcctctcaaagtgctgggattacaggtgtgagccactgcgcccagccccctttagcattacatactgactttgtctcttgtggcagttttggacttaaaatctattttatctggtataagtacagctacttctgctctttattggtttcctttgcatggagtatcttttttccatccctttgctttcagtctgtgtgtgtccttataagtgaagtgagttccctgtgtgtagcacagagctgggtctggtttttataatccattaagtcacactatgtcttctgattgaatagtttaatttatttacatttaaggtaattgttgccaggtaaaaattgactacagtcatttagttcattcttctctggctttgtttcctgactatagccctttagttcattctttctagctttgttttcctttgttccttccttctctttccgtcttcctttgtgattaggcaattttctatagtggcatgctttaattccttactttgtattttctgtatatctagtacaggtttttgctttgtggttaccaggaggctgacataaaatatcttagggttgcagcaagtttttttaacttgaatacaacttaaccatgatcacacacaaaaattcaacatttttacccacccacactttgtttttgatgctttttatattgtgtaacccttaatgaattattgcagctttaactatttttaatagtttgttttaaccactgtaataaatgttacttaaacactaccaccacagttttaaaatttgacttacttttgtacttacttttgacttaaactttttgtacttacttttactagtgagtttcaaactttcttatatttttgtgttactaattaacatccttttctttcagcctgaagaacttcctttagcatttcttgtaagacacttctgagagtaatgaactcttgactttgtgtgtgtgtgtctctgcaaaagtccttttctcttttccttctgtagaagagctttgctgtgtattcttggttgacagtttttgttatgttttgtttttttcctttcagcactggaatacatcatcccgctctcccctggcctgtaaggtttctgctgtgatgtctgcttctagtattaatggaattcccttatatgtgacatgcttcttttgtcttgatgctcttttgctgcagaatactctttttgtccttgaattttcaaagtttgataataatatgtcttggtgtagtcttgcttggattgaatctgattagacacctttgaccttcctgtgtatgaaaatgtaaattttcccccagattgataaaacattttctgcctgccttcctgactgccttttttccttccttcctgtcttactttcttctttgctccctccctccttccttgtttctgctactgtttcctctctctctctatccctctatctctttctttacaataaaaacttgctctattagccaggctggagtgcaatagcatgatcatagctcactgcaacctcaaactcctgggctcaagcgactctcccacctcggcctcccaaagcgctgacattataggtatgagccacgacacccagcctattgtttctttaactaaactttctagaactttgtccctctattctcctttttcagtgtccatacttttaagttttgttcttttgatgctttcctgtaagttccataagcattcttcattactttatattcttttttctccaattgtataatttcactaaactgtctttgagttcagagcctttcttctgcttcattgattctgctgttgacattctctattgcaattttcatttcattcatgcatttctcagctccagaatttgttagtttttttgtataatttcaatctttaattttctcattttattcatttaatgacttactaatttttgaattatttttccttttttagataaacagaaatttacttgtaacagttctggagactgggatgctgaagatcaaggtggtggcatctgtgaaggccttcttgctgtatcataacaaggcagaaggcatcacatgggtgagagagagacaaaagtagggtccttttataagaaacccactccctcataacataaattttgagggacacattcaaaccagagcagtcccagttccagatctctagttttttccaacatttattttagattcaggaggtacatacgcaggtttgttacctaggtatattgtgtaatgctgaggtttggggtatgaatgatcccttcacccaggtactaactaaacagttagtttttcaaccactgtcccactccctccttttcccctccagtagtctctagtgtctattgttgccatccttatatccatgagttatcaatgtttggcttctacgtacaagtgcaaacatgcagtatttgattttctgttcctgtgttaattcacttgggataatggcctccaactgcgtccatggtgctacaaaggacatgatttcattactttttatggctgcatagtattccatggtgtgtatgtatatgtgtgtatatatatataccatattttctttattcaatccactactgataagcaccaaggttgattccatgtctttgctattgtgaatactgccatgatgaacacacaagtgcatgtgtctttttggtagaatgattagatttcttttggatatctacccagtaatgggattgctaggttgaatggtagttctcttttaagttctttgagaaatctccaaatttttttccacagttgctgaactaatttacattcccaccaacagtatgtaagtgttcccttttctccacagcctcaccagcatttgttgttttttgactttttagtaatagccattctgactggtatgagatggtatcttactgtggttttaatttgcatttctctgatgataagtgatgtggaacactttttcatatgtttattggccatgtttatgccttcttttgagaaatgtttgttcatatattttgtacatttttaagtggggttgtttgctttttgcttgcctaattgcttaagttcctcataaattttgaatattaaacctttgttggatgcatagtttgcaaatattttctccctttctgtacgttgtctgtttactttgttgatagtttcttttgctgtgcagaagctctttagtctaactggatcccacttgtcaatttttgtttttgttgcaattgcttttaggacttataaatcctttcccaaggccaatgtccagaatggtgttccataggttttcttctaggattcttacagtttgaggtcttacatttaaatatttgatccaccttgagttcagtttcatatatggtaaaatgtagggttctagcttcattcttctgcatatggctcaccagtgatcttaacactatttattgaatagatagtcctttccccattgcttatgtttgttgactttgtcaaagattagatggctgtaggtatgcagctttatttctgggttctctattctgttccattgttctatgtgcctgttttaataccagtaccagactgttgaggttactgtaaccttttagtttgaagttgggtaatgtgatacctctggctttgttctttttgctttggattgctttggctattttgaattatttttctattttctttaagttcacttagctcttttggtggtattttcagatgtcaacagtggttcaaattgatgattctgcagacgaatgtcctatttcaccatcttgctggcatctgtacacttgccttgtttattcttgaatgaacattcttcaaagtaaaattttgaattacatcattttattatgggttaaattagagaggattaatatctttacattactgagtcttcatatccataaatgagaatttacgcagatctctttatatacctcatagtaatgttttaaccttttcttttcccatgtagcttgtacatttcttacccctctcctgcctgccagtggtattttatgccttctaaatctattataaacagtatttgcttcttttcattttaactgataacttatacaaagggaggtatttctgattattaaattaatttccaaaaaaaagtattaaaaactgtgagccgttgaatcttttttttttttttttgagacagagtttcactcttgttgcccaggctagagagcagtggcatgatctcggctcaccacaacctctgcctcccgggttcaagtgattctcctgactcagccttccgagtagctgggattacaggcgcccgccaccacgtctggctaatttttttgtatttttagtagagatggggtttcagcatgttggccaggctggtctcgaactcctgacatcaaggtgatcaacctcccaaagtgctgggattacaggcatgaggcaccacgccggcctaggtgattttcttatgtgcgttttcaaggatcaaataataataatttttacttggttcctattttttatgcctcttgtttagtctcttctctaattgaaatactctttgtatcataggaaaataaggatagaccctagtgagaagggcctaaaattctttttcagggttacaggaatgaaggaataaataaatctttattgccacaaaataaaggaaactctaaactcagcctctctgagaccaaattataaaaaaagtcatacatagaatttgagaatatgatagcaccattaagagggaaagaggaaaagagattatgaggtgttgcattgataatatactgtgacgtataagtattaaaacatttttgtatctctgaatagaaattttagtcaggcctctctccttgaactcctaagacggagtcaaacaaaattttctatttgctttccctactagttatttttattttgccttctagaaactcatcaatttgaagaaatatagtcaatatgagtcattttataggcatccttatatatgtataaatttaaattttacagtgtttgatacacatattcatgttctattacatgtatctatatagatacagtcttgtttatgaaaattgacatagtatgctataagtgaacaaaactatatgaaagaataacagaccatactgcttgatagaaaaagttttaaataatagaaaagtgctgcaacagagataagaagaaaaaatataacaacaaaggtcttatgggagcttattatctgccaagcacagagttaagctcattaagtggataatcttatttttcctcacacaattatgctcattttataaatgagaaagctagaactttgagaagttaaatcacccaactttacatagtttataactgattcttgttctcaaaggcaactctgcgtgactgtgaagccccagcacaggctcccataaaaagggcatttccatttactgtaatatttaaaaatccacaaaaactgatttttcaaaagcctacagttaaaagaaagttgctcaaatattacctaaaatagaataatccgttaaaaaaattgatcacaatgaaagaggaaaaaaaagcagctcacaggaattttctacagaggcatacaaagatacactctctaaacaagaaaaccattatctagtgaatgttcatcagaaactagaatattcacttttgtttaagtaaaactttcactaattatatagagggttatacttcctattgagataatttatcactatagccaaagtttcagtgtagaaaaacacccctgctcatcagtgtctgggatagaagtaaaacagaggatactgcttgaaacaaaactgcttagaccagcacacttctctgatttgtcaatgtcactgatttaaaaatgaaagttaataccttttaagatatctgtacaattctagggcagctgtttcagaaggtcaaatgactcacagccaatggggaactagagagatatctgaggatttggctggtaaaccagactttcactgacagggtcccctttggggctgtggtagaggttctcttaaaagacagagcagcttaaagaaatcactgaggattttcactattacaacaacaaaatgatactgaagtgctatattgattttaaatttgacaaaacgacagaatccctgacaaaacagaaccattactgtggaataaatcagttagattctggatcagccccattattattcatatcatcacaagtgctttctaagatgttgtcaccagattagggcacaaagtggggaagagagctggaagggcttctccttaaagagtatggttattgtacttcacttccatgcttaatcatttgataacactcacccacagttgctattttggatactctataaaattcccaggcagttacccatttaatctaacataaatatgtgttaaaatcttttctgctatttctcaaggtcacgtgtttgcccatggaacttagagtactggcatctcactcagtcaccgcaacaatggcttaaatccttcttgacaggtggtacctctgtgttcctagtggcatcataccacagaaggcttctccctcacactaatgggactgaatcaataacatcagactaaaaacattaaccttaggagtcttattattctgaaaaatataataaaaccttcagaataaaggttttattattaaaactcagacccaattaaaattttacaaatgagaaagctagaactttgagaagttagattacccaactttacatagtttataactgattcttgttctcaaaggcaactctgtgtgactgtgaagccccagcacaggctcccataaaaagggcgtttccatttactacaatatttaagaatccacaaaaaatggtttttttcaaaaccctacagttagaagcaagttgctcaaatattaccaaatattaccaatattaccaataatcagacccaattaaaatcagagagaaaaaaagtaacacaaggctgtgtagctcatgcactactaatatagcccattgactatttaactcataggatgccttttaaaatagtttttattgtggtaaaatatatatcccataaaatctaccattttaaccattttaagtgtacagttcagtggcattaaatatattcacattgttgttcaaccaccacctgcatccagcccctgaactcatttcatcctacagctgaaactcaaatcttctgaataatttgtgaagttggcaacacaccatgctgacccttaatttgtgaagaaggcccacaagtattagaaagatccatttgtagaggtgtcacttgatgtgacattccttgctagcacagatccatctcaaacaaacttctaaagcttgggctactctgctcaactctaaatccacatgaagaaatgtctcctattcaattggcaccacatcctagcaggattttgtgttcttttttctctacactttgcttttcagatggattttatatctatacatctttatctatattatgtgtatacatatatacatatattttgctttgcaggaggatcatttatgtgtgtgtatgtgtgtatatatatatatatataagtgggaatgtttcataaggacaaatacaccactaagtctctcattcctttgctattgtagaaatggagttaggaaacaaggtgaaaaagagccctttcacagccagagactgtttctttaccttcttggaaactgtaacccttacaggaattgtgcaagaattaaatgtgggagtgctggaaacccagagcacacagccttatgcacaaagagctcttcataaatggtagatggcattagcttcaagtttagaaacaatgttttctttttgcttcctagccaggaaaagcccttttgcttcaagcgactaaagaatgttctctaacttcctgagtgttgtgtgtgtgtacttgcctctgctaatgtttagtttgccttacaaggacaatctgcctgacttcgtgttggataaagggaagctgtacatgaagatggagagatacagaaggaaacaagccatgatttcagtaacccagtggccatgacagccagaggcagaatgaaggccgactgaaactagatatccgctgaccacctctggacccacaggtgcagctgtttggaatgacaccacacctggcagcagggctgacgtgtcctgcagacctgctcttcctctgactcactgtgtcgctgcccaccactggctcacggcttggtagctacccagccacaccctcagcctcccttttccctactgtcgaccaactgtgtgtctggcatgtaacacacactcagactgagaatgtttctgtctctgtgctaactgcagtgtctgccatcctttcctgctctctcatagcaggtaccgagtcagtccagacagctgctgcctctgggctcagtgctgatgggcagatctccaacctctgaccttccttctgcctcctccgttagttccactcacatttgctccagtcaggcccggaaaataaagataacaattaggaacaaatacacacaggccatgggagatctactaatgcactttgtccactgccccaaaaacgtcccatgacagctggtggacacttttttagatttcccagttagagcggttctacattttggatctcaaaaattctcaacactgataaagaccagtgaaacaagaattcagttatagcaaattgtatgttctttgtcagaaagttttaaaaaacaaagtccaataatattattcagagaacattttctttctttgcataaaatcttcctagtgaatagagacagacagggaaaaaacaaaattccatacatgggaacaagaaataacgacttccataaggaaacacaaaaccagggaagacacaggctggaggcgggtggggtggggagggcagtgggagctgtgtgcgtgcgtgtctgcgtgtgtgtgttctgtgcacattaggggttaggttatctagaagaattctatcaggaagagataatttacccaagaaacgaattgaggaagctatctatgctataggggaaaatttcagagatactgaatagctagtacaaagatggatcttgcttgacatttttaaagagcagctagaagaacaacatagcacaaaatatttgaagccacagataagcagagaatacggtcgaagttgcttatttctttttatctaaataaggtcagttctttattgaaaatgactacattcatatggtgcataaaatatgtggcaatttacagaaagaattaaagaaaataaaattctatagatttaaattggaagccagttgcaaaggcagaagcaagatgggatgtgaagctgtggcaatggtccaggtaagagatggtgggcaactgggctgtcatggtaataacagaggtgagggaaagttgtcagactccacatatactctgaagctgtgactgacatgatctgtctaacgactgagttgacaggatatgcctatggattgatcgtggagtgtgaaggaatggaagtcattggtaactccacgcatattggctcaagccaacaactggtaaatgctgtgatatttactgagaggtggaagcccaggggcaatagggtttggtgatgggaaggatatggagataataaacttagttttggacgtgactatttgacatccgaaaggaaatggagtctggtgctcagaggggaacttgaaacctatgtcagggatggataatatcctgaatatatctaatcccaaccagaagaaaatttcacaatgaattaaaaagttctatatttccttgcagatttaattctttattctttcagaaataagtgaaaaatagacatgagggaaaatggcttgtcagtgattgctaatctgggactatggttaatagaatgttatggtataatctctcagcatgattccaggacatggttaggtggatttctaaatatcttttctctctttctgattcagaacatttgttcttattaggccacgtggctttttaaggccattcctattactactactatatatatgtatatatatatatacacacacacatgattatcccagaaaattatcttttatcttccctcttctgttgtttattcttttgaccttgtttgagtaatggcaccttttaaaatgatgtagcagatgaggagattattcacctcaagtgagtctgtgtcctgaaacacattttgttaactgaaagtataatacataatgaagcttgttctgttactcagaaaagattcatgtattcctgttgtaagtaacagggattctctcttttcaacggagcttttactactctgaagattccataaatctggcagttacatctagttttcttgggtatttctcaacacaaactcagtctagcccttgaagcgtcaatgtgaagcatgtaattagtaagaatgtggattgatatattaatccattcagataatcaaatgtcagtgattgatatgacagctgtacaatctcttatctaaagccttggtatcagatttgctttagattcagattcatttcatatattagaaaggtcatactgtgtatacaccaaatatgagtgactaggtggtaatcacatatgttactatttttgcaataaaacatatgaatattcacattaagcagagaaagtaaaaaatgcaaatagccgcaaagtcagtacattcagattttgctgctaaataaatttgggtctgcttagggttcaccattttaagaattttgcttttagaattaaaaattgcagataagcaactgtggatctttaataatagaaaacattagcataggtaatgggtaaaaccagaccaaaaaaaacaaagccataaaaagacagagggagagcatacaagaaatatataagactggagaatgcatttttaacgtgtccttaacataaaagtagaggcagcaggatccctaggagagagctggaaatgcattctgttctcctggtacaggaaggttaatacgatgaccctgagggcaggggatgtagctgtggtcaggaaaagataataataataaagataataatgtgctgggaaagataataagcctataaaaacataattttcattaatcaagagtgttaatattttaggtatcaaaaataaatcttaagttattttaatatcatccattcatttctaaaattaatgccttggtaaagggcagaaactctaataagagatgtaatttattgttaaggcagcaatgataagactggaggacagtcaatatcagcccatctttttaagaaaatgataaataggagacagtcagtgaaatttatttctacagaagtagctttgataggaaaaatactagacacaagggacatgcctagtgaagaatatgataactatgactcagctcacatttcccaagagtatattactaacctctaccataattatttgcttatttactaaaagaatggattaatgaataaacaaatggagaatatgtccctgagatgttgatgtagcagttcaagaaacacgaatcatgatggttaccagtggcagggaaggggcgtggggggctggggaggagatggggatagttattgggcacaaaaaaatagtaagaatgaataagacctaggatttgatagcacaacaaggtgactatagtcaataataatttaattgtacattttaaagtaactaaaagtgtataattggattgtctgtaacacaaaggataaatacttgggatggatatcccattttatatgatgtgattattatgcactgcatgcctgtatcaaagtatctcatgaatcccataaatgtgtacacctgctatgcactcacaaaaagtaaaagtttttttaaaaaaaagaaactcaaatatctacataggtattttataatccaaacttgacagcctctctctttgcaattttacaactttcagcaaattccccatattctctccatctcagtctgaacagccatttcacatcttacagctcactgttttttgtgtatctcatccattatccatggttttgtttgcattacttttgctttctgaaatatcctcctgaattgttttccaacaacccatgaggtaacgctttctccaaggcctgccattctcaagtctcttcgggtctgtgtcttataactgaacactcacaagaaccatctctggtttgttttgtgggttctctcttcagtagcattaacatttttttcaccatgcaaattctgtatagttggtcatagagtaggaaatgaagctattaaatggttacaatttgccagtcacagtgatggaggatgaaggagatgcaaagataaagccctatccccaaaaaccttttagctcaaaacgatggaaggctgagtcctgaaccctcatagcactacatttcattgttttagtccaaaacaagtcctagagatctgcagagccaggaaggaccattttcattgtggttgttcaaaaaaggcatcctgggagaggatgaatttccctcattcattcaggaaacatttcctcatgtcctagtcctgttaggcacagttaggctttagaggctgagttagttttccagaactgctgtaacaaagtgccacaaactaggtagctaaagtgatggaggccatacgtccaagatcaaggtgtctgccggccatgctgcctccggaggctctagggagggatctgttccatgcccatctcctagctgctggtgcctccggtgttctgtggcttgtccatgcattatcccaatcctccctcctcacagggctgcttccctatgtgtccttgcactgtgttccctgtgtgtataactgtctctgggtccaaaggtccttcttgatgaggacaccagtcatattagattagggtcaaccctcctgactacactttaacttgattacctctgtaaaaaccttatatccaattaaggtcacattctgaggtactgggagttaggattccaacatatgtttttgggaaaccacaagtcaacccagaatagagatgcagggatgaaaggcaggcacagtgactttgaaaggaagctcacactgtgagcgggcaccaggaaagtaaatcacttgttccagtgaagctcaacacgttcctacacgaggtaagatcatgagagttgacatctgtcattttaagtgttctggattagtaagaaccttaacctttacgctctttccccgcaggctagtaacctttcagagtaagcaaaattggcaaatggcattgccttggctatggtttccctctgaactgcttaacttgataacaaaaatgctgacggtacctctgtcattgatgtatttttttttaggaggaagaaagagccaaattacaaatacgatgcagactctatatgagtcttctcttacagcatctcttttatagggaaactgtccacaacattttaaacattattaatcaatgcagagcaagattttaaacagatacaggttactttcaaacactatgtaataaatacttattattattattattattattattattgagacagagtttctctcttttttgcccaggctggagtgcaatggtgcgatctccgctcactgcaatctctgcctcccgggttcaagtgattctcctacctcagcctcccaagtagctgcaaaagtcaaacaaaaagtgattaccctggcaaagaggcactgacatataatcagaaacagaaataatgtcactgttatgaggatatttacagattcagagaatgtcacagagatctgtagtctatgaaaaactaaatctggccaggcgcggtggctcactcctgtaatcccagcactttgggaggccaagatgggtggatgacctgaggtgaggagttcgagaccagcctggccaaaatggcaaaaccctgtctctactaaaaatacaaaaaaaaaaaaaaaaaaaaaaaaattagccaagtgtggtggcacacgcctgtagtcccagctactaaggaggctgacgcagaagaattgcttgaacctgggaggcagaggctgcagtgagccaagattgtgccactgcactctagcctgggtgataacagcgaaactctgtctcttaaaataaaaaaaaaacaaaaaacaaaaaaaaaaaaaacaagaaaaactaaatctggctgcttaataaaggacacacaattcttcaagttcaaagtctgtgttcctgtacttgtcatacacacagaaactgctcatttattacattttgaaatttcagtgtctttcaaaaacatcagatcaaatcagagaaaataaatgaattcaatctaccactctaaaataatgcagaggcaatgttaaattactttattaagcaaaccaagaaaaaataaattatatatgatttgtattattttttaacttccacactatttaatggtataatataagattgtctttcaatgctttcaatgaaataggtatcttactttcacttagaacatttttttctaagtaattcttaaaattctgtttttctaataggtttgcagcaataggtagcaattattattattagaaacatacccagatgctttcttctcggcgatactgcttccagtttctcccaccatcactgaacatcaggaggtagctggtcacccagtcagagctcccatatcctccttgggtggcgacagcagtgacctccattctctctccaaggtcaatttgcagccattggtatttatttgacacaagtggagtccagccaccagctcctttattgaaacagaaaaagtataaaaatggtagaggaggaagttatttaaacatagctgttactagattagaaaactataaaattatgaatatatattaagaaaatcatcgatttacaatagaaaaaatagaagaattacatgtgactggatgaaccctaaattgtgttcacatttagctagatgacccctgacattctagaaggcaggtgtcctactgactgcagaaaatgtttgtttaatgcaggtggccactagagcattcctgtcaacttttggaactagtgttatttcatagcccttgtgcaagatttgccctttgccaacctaagagactaaattccagtagtaggaagtacagcattaagcactgataaaacaaagacggttaatatattgaccttgcactcaaagtgcttacagtctcataggagaaatggatgtaaaagaagagttaaaacatagagtgctttgtgaggcaatcccacttacatgtggaattttaaaaagctgaattcacagaagtacagaggagagtgatggttacgaggaactggggtgtggaggagatattggtaaaaaaatacaaaaaggtatggagtagcaaatggtcaaggtgagtcctaagcaggttctggtgcactctgctctctctggcagtactgcagggaaactggggcaagtctcacacagtgctcatccaccttggacaaggaaaaggagactgtcgggtattgaagaagatgcgtgcagagcagaaaatttgctttttgctctgaccaatgccaaatctgaaacaaaaacataggcatgtccgctgatgttttattgatgtttgttatttttctagtctaatagaattaggggacactcgaaaaccacagcttctttaataatcaatgtctagaaaaagagagtactctataaacaattcccaagccgaggagtcagaacacttttattattccctggtgctgccacttacctgaaggctctgatagaaagtctgaagttctagacagttcattattattcattgacttatactgtgtattttattattaggggtttatcattatgtcctcatttgtaaagtctttagtacttcactacatgtccaaaaaagtttgatattattagaatatagctaggtgtaaaaacgaataagtgaggacattatactttaatataagttattatggggaagtgttgagaaatataaatatttatatttaaataataacaattcatacttaaataataaatataaatattaggcacctatttgaattgatgaccacacttaactactgtttccttatgattcccaagtttacagattcttagaagtcagattctaagatatttttgtagtgaatctttgttcaaaaatatttttcctctgaatgtacaataagcacctctaaagtttatattatatatatagtatgtacacagacatatatataatttttgtttgttttgctttttattgttccatgttttgaattgaagagtcaggaatttgatctagtagacaagatggaaaattattggtaaccaacactgtgcatctgattgacactaaaatactccatttattttcttaatccagacagctaggaggtggacacagctcttgttcaaagttaaatgttctgctacagaccaggggcatcctccactcatgcaacatggtttcctagatcgggcaatatttattcttggatgatttacagcaatatttatgtgagcccctgccagagacagtgcacagatttctttagccctcagtaggaactacttccacagtttcttctctctgctcattcctccttccaacttaacttttcaggatgtaacagaattccacctacccacttccataatcactcaatttaacaatgaacacttatcgagcatttgagaactctaggtcaggcaaagagttccctttaaataaattttgcatttaattcctaacatacctttaaaagacaaggcctcattactaccctccatatatggtgggcagctcacctatgtttacgcatctagcaaggggcccatgagctttggatccagaacctgtgcaattaaatatttctattatattattttgatgataatcatgggatgtggtgtttctcaaataaatgtaacaaagatgtaaagacgtttgggagtgagcaggtctggctacctaaggcagcagcccccatacagcagggcaacctctcctactcctggtcaggcaaggtctgggtttcggaaagctgagggtgcagtgccaatggggttttctctactggcccttcctgttgactccaccagatctactcttctctcctaagcctatgtaaactttaattggtgggagatccttttggggttggtctaactagcaaccaatagtcctaggtacaacactaatgaaactgtgtatccttttctgtttttcttattactattttatgggggttttttttgttgttgttttttttgtttgtttgttttgagatggagtctcactctgtcaccagcctggagtgcagtggcgagatctctgctcactgcaacctccaactccaactggttcaagcaattctcctgcctcagccacccaagtagccgggattacaggtacgtgccaccacgcccagctaatttttgtatttttagtagagaggggtttcaccatgttggccaggatggtctcggtctcctgacctagtgatttgcccatctcggcctcccaaagtgctgggattacaggcacgagccactgggcccagcctattttatggctgttttaaaagagttgggagaaggtgagggagatgctaacagccaacccatcatcttaggctggatgttgtacattgggaattttatacacagagctgaaacttctgaggaactattcaatatttttggttcttcccctcatcttagttaagggcatcctcttcagcttgtatttcataacctttctttggtgttttcactccctctcattccaggtttagaaaagtaattactatgagaacacatgtggagaagcacaaggaggaaaatgagttggcacggttctggtgtgctaccctggggtggtgtgttttcatcagatgaagagggagccgctggccatccctcttctcggcatccctcacagtttgttagtttgttggtgttcatggttgcactcctggtaacagatgacacatttcagtgacttcattttacctttgatgaagtagtactcaaatgcaaataagctatattttcagccattactgataaagtaatgaaattctggcattaccaaagaatttcatcaggatgttgtagcctcaggaaatctgcaatcccagatgcgttttaagggtaagctgctgtgcacacaatttaattaaacgctgagtggaaatggtgggaaacacagcgtgactgacctgtgcactgctggatagcactagtctgtgtgcctttgttaaaggcagctttgatggttggtatagaaggccactatgggtaacagaaagagaaaggaggttggctgactccacccccaactagagtgtagtaattgtccagtcactcagcctctctgagacaaaaatgttgtcctttgtttaaaaaagaaaagcataaagttgggagtggggggattaacagtcatataaatcacgtcacaagactgtaaggaagacaatgggataactgaaactacagcactttgtaactaaattattattcaaatgtgatgttatactcaatttttgttgtctttaaattaaaacaaatgaaagtcttctatttgttaagtcaagattatacatgtgctgactacttttcaacctggaagtgtcttttcatagtcccttctagtctatggtcaacaaaactttgtacacaaaacaggggaagcagttatgtcctctaagctcagcctctcccccataacaaatgtttcttctccacttcaccctcctccccctgcctctgacaagacattgcacctgagttaaataaagtgtcacaattctaccccacagatcctatgaattatgaaaactcatcccctccattcataatatatgttctgacacacatgttccattactggaatgagattaaaatatgctgagcaactgaaactttctcttacactttatatggcttgagggacagcagatgttattttttaaagggtaattcgtttttataaaggttgatattggtaccacagtgaagatgctgagctgcgctaactgttttgtccctaaatgttcacacaacataggatttatcttatgaaccgttttatccacttttaagttttcaagttctgaggaaattattaaagttttgccacttattttgtaatggaaaacaagggaaaagggggaagtgagaaactctgaagcatatattgtatgctgagaattcgaccagatattttcaagcatattatcattttttatttctaaaagcattcagtgggttgtctttatcgtatctaccttacagatgagaaaataaaatcactaattaaaacacatggaaagatattatttttaaaatcagcttatgtttcatttttatccctgtccatgaatatattcacatgatttgtcaatcacttagtactttttggttatgaataatctggcatgattatgtctctattttgtacagttatatctgtttgttataattctgcacttacatcaggtcaaagttacatttcactatctggggcagggggctctgtgaaagaaaagtagaaaccctacagctggagccttaattatttctgactaacaacaataaaacttcccatgactatagtatctagtcataagtgacagcactgtcacagagtatgtattgactttgtttacaggggaaataatgcacaggtaaatcatcatcatcatcattacaattatcatcatatcaccataatcttataccttccttaactaaatttgatgttgaaggcacaaaatataagtaaacaaagtaaatgttcaaagccagccactattagggacttctgtataccaagcaaacacacagttaagtcaaccttgtccccacgagacacttcccactaagataacaaattgtttcaaatgtgattttatccagatatatttgtttctttcctcatctaattgcattttaattcacattaaaaatttcaggtattacctggggtgagcaggaggtgggaagtgagatgtgaggtagggactgtcacagctcctacactccagtgtgattatatgtaatttatagggaagaggagtgaagctggctttaaatcaactccctcattccacttctgagatttataggctttaaacagccatgctttttgtcagtaggtctgcctttttgctgagggtaatttaaacatttacctgagatctaatttcatttagaaaaaaaagggctaactacacagatatagaatcaggtactacagtctttttcaactatgctgttttaaagtaaaaaatacagaaaccctccctcagaatctgtctttgtgtacatgttctatttcagcagtatttccttcaatcttagcaggttgaagcagaaagaatattcagcctactaaaaatgtgttcataaaaaaagtactgcaattatggttaaaatctcagagtgtatataacaatttataaaatgtattctcttacaaaatgcatctacactccctagtagctttgaaaatggacaaagaataaacaaaaaacaaatagtagatgttagacttaaaattaatcatataatcatattaaaggcaagtagtacaaacactcctattaaatggcaatgatggtcagattagatgagaaagcaagatccaactatatgttgcctacaagaaacacactttaaataaaaaaggctcaaatagcctaagtgtaaacacatggaaaaatatatattatgccaataatagtttttaaaaaagctggattggctatattaaagtagatttcagtgcaaaaattattataaaaggtaaagaaaattatttcgtaatgattaagatgttctttcatcataggacataatcctaaacatgcaaacacttaataacagagcttcaaaatacatgaaatgaaacctagtaaaactgaatgaaatagataaatccacaatgacagtaggagattctagcaccccgtctcggtaactgattgcacaagaagacagaaaatagggattcagaagtattaattatcactatcaacctatatgattcattgatatttatggaatgtttcacctaacagaagaacatgtattctttttcaagttcatttggaacttttaccaaaatagaccattaaacgagtcattaaacaagtttcaacaaagttaaaatcatttaagtcatgtaaagtatatctttgtgatatacaatagattaaaataagaaatcaacaatagcaacttctctgaaaaatccaggaatattaggaaactaataacacatacttcataatcaatgaatcaaagaagaaactaaaagggaaattagcaagtatttcaagctgaatgaaaatgaaaatacaacttatcaaaatctatgggctggaacttctggcttctgccccaggaagtagaaagctataaggagcctcatttccactcttacaaccaacttcaagttcatgatcttttacaaatgcattggagagttgagcttgcagaaccaccacctagcctaaaatctaaagagatatgaacctcacagggagagatgtgagcaggatctcaccttacatagatgaaaccagaggtcagtaagaaaagttcagctggaatagttaacaaaatggtgaaacctactgtgcaggctggtgggacagtgagaaatcctttatcaccccagaagttgggggagtgttccctcttgcaggcacttgctccactggccattggcagaaactcacatgcactccactgagaactctacttggccctcacagaaaatatcagaaagagccctaaaggttaaatgactcagcctataacctccgttatctccaccacatcttgatttttgggtaggtgtagttccattcatcttggtaactaactgcataattcaataaaaccatcattgtgcattttttcatacatccaataaattatctgatgagacatataatctcaaattatcacttgagcaggcaaagaagccattatcttcacttggtgagtagaaacaattaggcaaaagtgatgggtgatgtgcaaacggggcatatgaggagagggctggaatggagtcagggcaccctgaggctgactgcacgcctctcattgtgttccatttcccacagatagtgtgtttaccttcttcagggagtgattaaacacgtgtatttgtctttcttattaaatgacaattgatatcatgcaaggaaacacgagagtgaaatgctgagaagtgaatattttagtgaataccaaattatccatctgtatgtgattgattgctcagtcaaccaaaatcccctagcccaccccctaaaaaaaaaagagatggtaatatttacatttttcctaaggatattatgtagttaaactaattatagtttatgaaattgctgtgaaagcctcgtatgaaaagagacatgcatttgttattgcatgtaataggacactatcaaaatatgatgcaaaaggaatgtcctctaaacattacaataatgtttattttaagttgctattaacagagaaatttttttagaggcaagcacacatcgggtacaatgtggggcatcagaattctgctaaagtttgtcccactgaattctttggaaaaaatatgacaacctaaaaaaatccagttggcaaaaattaatgtgaaagaaaataggtgaatctgcaccatgtcctacagaagttctggaatgcctccgttaacactgactttaataactaatgtaggagagttggttataggaccaactgttgtaatttaccattttcatcattggtcatagtccttttgaatccgttttgaagcacaaattaaactgccagtcagaaattaaatgttatttaagaaaaaaattattttgaaatatagcttcacatcaattggcaaagatagtacagagaagtgatgtgtactcttcacctagtttctaccaatggttacatcttataaaattacagtacaatatcaaaaccaggaaacgatgtgtctatgtagttgtatgacacgtttagggtccgtaacccccaccacaatcaagaaagagaacgacttcactaccacaacaatcctcctcattggtaccctttacagttatacatagcaaccactaatttgttttctatctcaatttcctcaattcctcaggttcctagatggtctgtcttccctacattttttcattcttatgtttattttatatataaagtgccttttaaaatgtacttatcaggaagaatatattaaagacatgtacttcatctctccggagcagaagctggcaatatgatggtgaatacagtgtccctttattcttgagtgattccagttgcctctggtaaataggaagtttcctattcaacctcacctttcttgccaagaactgcatgacagttgagctgtcacatgttatcactggatttttttgaacaggaaaaaagtgaaacgacaacatttttagaaggaagaatgcaaactgtaagagagcgatgcgaaaatcctagagaggagtgggacggcattcttcattaagagtaattggtaacattaaggaacaattaagtacataaagaaatcatggcctatcggtagctttaattttattactaaatagcaaccagttcaatgaatatgccacattgtggttatccattcagtggctgatggacatttgagttgtttccagtttttgtctactgtattagtccattttcacactgctgatgaagacatatctgagactgggtaattcataaagaaaaaaggtttaatggattcacatttccatgtggctgaggaggcctcacaatcatggcagaaggcgaaaagcatattttacgtggcagcaaacaagacagaatgactatcaagcaaaaggggttcccccttataaaaccatcagaccttgtgagattgattctcaaccacgagaacagtatgggggaaccgcccccatgattcagttatctcccactgggtccctcccacaacacctaggaattacgagagctacaattcaagatgagatctgagtggggacacagccaaaccatatcatctactatgaataatgttgctatgaatatatatatatatatataaatttttttttacattttttacatttttgcatttacttttttttttttacatttttttttacattttacaacaggcagagtctcgctctgttgcccaggccaagattcaatgcaatctcagctcactgcaacctccacctcccaggttcaagcgattctcctgcctgagctacccgagtagctgggattcctggcgtgcaccaccacgtccagctaatttttgtatttttagtggacacggggtttcgccatgttggccaggctggtctcgaactcctgacctcaaataatccacccacctcgccctctcaaactggcggcattacaggtgtgagccactgtgcccagccgctaggaacatttaagtcttagagtggacatatattttttggagtggaattgctggtttatatggtaagtacatgcttttactttttaagaaactgccaaactattctccaaggtggtggcaccatttacattcccaccaacaaagtatgacaattaggattattacaattaggacaattccagtttcttccaatctataaacatagtgtgtctctcaatttatttgagtcttctttattttctaatagctatgttttatagtgttccatgaacaggtcctgcacacctttcgtaagatctacatttaagtattttattttttaatgctattgtgaatgaaattcttttcttaatttgataatcagatcgttactactacataaaaaagaattgatttttgtatattaaccttgtatcctgttaacttgctaaaattcacttattagttggtgtcttttagatttctagatttcttagaagatctccatataggatcatgttatccatacacaataatgtatggagagacagtccactttaagcagcttgcactcctacatgttttgttgggtctgctaagactacaaaggcctaaaaactcttttatggacccttttttcatggttgtttatgcagctggttaaccttgagaggtgaggttacattttcttccacacaaagagctttctcacttactacttgctataactgcagtagattccccaagctcattatttctcagctgcaatacaagtctgctatgagtgtaatattcatacgtgccctattgcattgcccctgtgggcctcaggggcaaaggagacagatacaaatatgctgaaactcatgttgttgtttgtggtgccatgagtaatatagctcacaggtgttgtcattctttaattttagccatcctagagaacatattatctctctatgatattaacttatatttctccaatggttaatgattttaataccaaatgttgaccaggataagaagcaactggaattgacacacattgccaatgagagtataacatgttcaagggcttttgaaaatagtttgacagtttctttagagtttcacatactgaaattccactcccaaaagtgatgtaaaagaatgtttgtagaaatttattcataatagatccatactggaaacaagccacaagtgtccattttaaaaagaatggataaacaaacagcacaattgaaatctactcagcaatagaaggaaatgtgccacaaatccacgcaacaacgtggatggatctcagaaaccttatgctcactaaagggagctggatacaaaagcttctgtatgattttggtactgtatgactttttgtaagttcaaaagcacaagccaacctaaataatatgacagaaagtagaacagtgataggtaggaggtgcctagataatcaataaaaagtattaacaaatggtaagggggtgatgaaatgatctgtaacttgatctgggctctggtaatacaggcatatacatctgtaaatattaaccaaatggcacactttatgcatttaattgtattttaagttatgcctcgatttcaaaaattttaaaaataatttttaaagtgacccaagagaatcagaccagccaaatatttgttctcatgtctaatctatattaacatccttatgaatattttgtttgtttgaatgccacttcctgtcatagtactaacaacctattttagatgaattttaattaaagttacatatgctgctgaagcatactctttgcgtaagtaaataagattaatttctttaaaatctacatatttcttcaaccgaaacacattttgctatagataacttgatgctattttgtttggcctgtagtcagctaaatcattcaacatttgtaacatattcacattgtcatatgctacaaatctgaggaaaaaaagcataaaaatagaatgccattggacttactagttctaagaactattaaaaggcacagataaaaaatttagtaaacaatatcctcaggcaaaatattttctgttgtattaatgttctacttttcaggtcctttgttgtatatgtaaattggcacatctaacacctaggcacattgggaagcttagtgtagcttctgacctataagctaaggaggggaatacgcaagaattttgattttatgaaaaatgaggaccaggcgtggtggctcacacctgtaatcccagcactttggaaggccaaggcgggcgaatcccctgaggccaggagttggagaccagcctggtaaacgtggtgaaaccccatttgtaccagaagatataaaaatcagccgggcctggtggtgggtgcttgtaatctcagctacttgggacaagggtaatcccagctattcagggaaagggaaagggaaaaagggtgaaagggggaaaggagaaagaaggggaaagaaggggaaaagggaggggaggggaggggagaagaaaaatgtaggggaatttaattcttattagattagttatcttaaatatttgctacatttacattattctatcagagattgatactctttatatttttaaattattgcatacatttttatcaatttctttcctctagattcctcatacaaaacaacgaaatctcacatcctattctgttttgggatattgcactgtgcagaatagtggaaattccaagtagttaaagatcgcatactataacaaaccatttgtgggtcatttccccaatgtaagaattttgcttttatttattaatatgattttaaactatggtgctaagttttcattaggagttatactttctaatgtgggaaataaatatcttgatattgaaaagcccttacaaatatcctgagctattcattttgtattaaaaatattcagtaattattttctctgcctcttaatcactgaacctagtcagtgtgccaagaaagcatgatcacatggaaggacatctgaatagtggagaaattcgaggagtggagggaaaagatccagtatgtttccatttgctctgtgtttgcagtttagcacacaggtttctaaattatccttgtctgcgaaattcattcccatacaccaacgttaatttccattcaaacccacgggcttgctccctgattgtactctgcacgtgagagttcatggttttcaatatataaagcccgtttgaatcattaacgcttctggctgagaatgagagttaacgcaagcactttctaaaaacagaaaaagagggcaaaatacatatacgcttttgcctagccagtttcaatttgcttctagcaaaattatccatttcatccctactcctgcacttctatttcacattaacgaaggagaatatgtacttattaaaatggaaagttgtctcacataaaatgctactgagccaatccaatgaatgttcgcaattaaaggtataataatcataaaaagaagaaaacttgataagcaaaagaataatcaagtactagcatgagttactaagtgttttatttcttaagcttttgtctaaataactttggatcacatagttttcttaaggagacacttaagaagaatgacaaatggagctctactttttctttatttgccttttcttgtatcaaatgccccatcatattttagaaatcttggttttgcagaaaaatttagcaatgtgcaattccaggaaatatcaatgtaaacttaatgacaacaaagtcaggtttaatagtcaaatccaaatttcaagaatttcatattttatataatggcaccaattttcctgcagctgaatatacacaatctgactatacctatatgtcagtatacatacatatatatactgaaatatatatgtatgtatatactgacacatatagtcagtatatgactatgactatagtcagtatatatgactatgactatatatagtcagtatacagtcagtatatactaacatatatgtatatgtgtatatgtactgacatatatgtgtgcttatatgcacacacactgaccatgtatgtactgacatatgtgtgtgtgtgtatatatatatatacacacactcacactgaccgtatatatgtatatattcctgcaactgaatatacacacacacacacacacacacacacacacacacacatacattcagcttcaggaaaactggtgccattatataaaatataaagttcttgaaatttggatttgactattaagtacacactgactctctctaaatatatatatatatatatatatacacacacacacacacatatagtatatatttagtacacagtacatacacacacacagatatatacatatgtgttgtgtatttatgtacatttattgaacacattaaaatctattaatttgcaaaattatatatacaaaattaatcatacacttgtgatgaaccttttcattctttcatgtttctttgcataaagaagtaagagagttgtttggatattagagtggaagagtatacatacataatcagaaatttccagaggaaacatgaagagatgtcaactatttctccattttttactgataatgctttccagaatcatgacttttgatttttgctgtgctataattactcgctctttacaatgtccacttacttccttgagggatatgacaggaagattgagaaaaactgtggctggaaggccggcagtgctgtagagaccctgggacctgggcccttcttctttggctccaggtcatcctgtggtctccccaccttcctcctgcttccctgggccctcctcacaacacttcacagacttctgtcctcgtcttgttgcaatatcttttctaaaatgtattttacaataatttctctacatttcctaagcatctgaaacgtagtgtgacaatttcatatatattaatactttatacaattcctcattctgttttaggaaaaattacaaatcagtttaaaactattttggcaagcaatctaaattaactaaagaatatcttcttattgctttcctgtaataggaaagaggtggtgatgagatggtacacaggtaattctttatgaaagctatggaattcagggcattgctaattcttactaaaatatgtggaaacttagcaactttgagcatcataaaaaataaataggaaggtacatggaagaaaaaccatgttctctaaaaccccataaagctaagttttctaaatataatgaaatgtaaaattttttaaaaatctgacttttttctggtttattttcctttttaatttttaatttttgtgggtatgtagtagttgtatgtatttatagggtacatgagatattttgatacaggcatgtaatacataataatcacatcatagagactggggtatctgacttaagcagcttttgtactggaccacacttaaaatagcttaaagctaaaataatggtatacaaagaattatcagcatcattttccgttttttcaatctgaaccaaagggagattgttatatctactgacaaatacaaaaatcaaatgggattatgagaatggtcctgtgtcagctagttataaaatagaaaatacacatatatatcctattggaaggaaaatacacatatacacacatcacccaaatggtgatgttttacaacacgttatgtataaaattaggcataaaattgaactttagttttcagtgaagtatgaataaaatagtgaagagctctccaggttgacaattatgggaacaattctaaaactactcatcagctgattgcgactccttataaaattaatttaaacgcaccaaaagccatattgcatttatactatagaaggtaaaactggtacagccatttcataaaaagatttttgatattttcctgtttttttaaattgaataattgtgacacagagaatgagaaatgcattaatcttattcttagaggtttctctgtcgagtttaagttgccaatgtcatatgcctggcagtgcggtggccaatttaaatggaaccataggggattcagtccatgtaaactacttaaacatcacctgacggtcccctcccctgcaccgtgggctgccataacctaatttaacaagctctttcagagtttggacatttctttggtaacaactgacattacctggcattatttcatgttttattcttaattattctactacagaagcttaagtttaattccacctatacatattatttaatgtttgctttgtcatggctctgagctagatgttgtgaaacaatgtgcttaactgccacttttactcccactgttgatactactaattgccgggcgcggtggctcaggcctgtaatcccagcactttgggaggccgaggcggatcatgaggtcaggagttgagcctggccaacatggtgaaacctcgactctactaaaaatacaaaaaattagccaggcgtggtggcgcgcacctgtaatcccagttactcagaaggctgaggcaggagaatcacttgaacccaggaagcggaggttgcagtcagctgagatcatgtcactgcactccagcctgggtgacagggtgaggctccatctcaaaaaccaaaacaaaacaaaacaaataaaaaaaatctactaattataatttttgcttcagcagcactcagtagattttagctactttggatcagatcatatactaattttttaattatggtaatacacatcacatgaaatttaccatttgaactgttttatatgtaaagttcagtagcattaagtacattcacgttgtgcaaccatcactaccatccatctctagagctctttcaccttcccaaatgaaaacgctgaacccactaacaataacctccattaccagcccctggcaacaactattctatttcttgtctctatgaatttgactactctaggtacctcatataaatgagtaacgtagtagttgtccttttgtgtctagcttattttccttagcataatgtcttgaaagttcatctgtgttacagtacgggccagaattttcttcctacactgcactaggcttctccgtttgtccatcaatggaaatttgggttgtttctcttttggctcttgcggatacatctgctctgaacattggcgtaacataacctaattattttatgtgtattaattcatttaatcttcacaacctattttactcaagttaactatttcatgataggtactttactaatcccattttataactgaggaaacaaaaactcagggagataaaggaatttgtccaaagtcacgcagctagtaaggggtagagcctggatgattccaagcttatccctaatcactaaggataagatagcacacttccttcaaggaagttagaattgcacaaaccgtaagaaaagtatacaaatacctagtaagcacactggcatgtgataaatgctgagagctttttaagggaaagtgccagacatatttagcatgcaggcttagtaaaaatctagattagatctggcagccaaaatctagattatgacctgctttacacagccagagaactaagaatggttttacatttgtaaagcgttgcgtttaaaaaaaaaaaaaaaagagggcgggggctgggtatggtggctcaggcccgtaatcccaacattttgggatgctgaggtggctggactgcttgagcccaggaattcaagaccagcctgagcaacataatgagatcccatctttacaaaaaatataaatgttcgctgggtgttatgacatgtgactgtggtcccagctactcgggaggctgaggtgggaggatcacctgagcccacagaggttgaggctacactaagctgtgatcttgccactgtactccaaacctgggcaacagagcaagactgtgtttcaaaaagagaaagagaaagagagaagaggggaaaagaaaaaaagaggaaaggaaaaaagcaaggaaggaaggaaggaggaggagaaggaagggagggagggagggaaggaagacagagaaagaaaaaagaaaaaaaagaaatgtaacagagaccttacatggtccacaataccaaaatcattttccatctgtctctttacagcagaagtttgctaactcccatgtttaaattttatttttaattgatgaataataattgtacatttttaagaggtgcaatgtgatgtttggatacatgcatacactgtaaaatgatcgaatcaggctaatcagcatatcagtcacctcaaatatgtatcattcttttagcggtgagaatagttaaaatcctctcatatatttcaaaacagacaacacttattaactacattcactatgctgtgcaaaagaacaacagaaattattattcctatctacccaaaactatgtacctactgaccaacatctcccccttccctatccaccctctcctctagcctctggtaaccaccatgctactctctactcctgtgagcactgtctttaaattccacatgtaagtgagactatatggtatttgtctctctgtgcctggtttatttcacttaacataatgtcctccaggttcatccatgttatcacaagtgtcagagttccctgcatcacgggttttaatccacacctttgatgtacttggctctagtaagtacaagcgtggggaaaatgtaaaactcttttggtgcaagcattctgcatcatgtttcagactttcaaagaaaattttaagtcatcctcaacaacatcacattaatttgaggctagagaagatacggactataaccctgacaaaagccacttgagcaaatccgtcagaatcattctgcaggtataaatttttaaatcacaaactcatgagggaaaatgtaacttcatttctccataacccagaaagctttctagtaggagctggaattctggctgatacacagactggaagtagtcacagcaggtgtctctgtccagttaagggataagcctgtcagttcgtgtctgtattggtcgcagacccttgaaaattccttcaggggttcttttacttccccttcatccccagagttaactctggtctcttctggctttgctaattgccttggtaaagcggggaggggagtgtgttcaagccccaagtagaggtcagcactgcactgtcctcagggatggcgacctgctgccgatggagccaagtcctcccatcccaggctgggacagtgctctccacaacgttttggtgaccctttctcctccctctgccagacctcaggcaggaacatggtcttgctcacctgcctttggtacctcagggtgtccttggataactggggctgtcctcaccggccaccagagctgcagcagggcgtccagtcctgtcactgaatgtgccgcagcacaacgaggatgccgtgcaggctgctcttggagactggcgtcctcctttccactacacacatgagagtgcccactcagatccctgagcttcagtgaagacttccattaagccaccaccggcaaggctctgcttgagagcagagcttcagggcagtccccacctctctatgcatcctatcatgcagtcctgctgagggttcctagtctgcgagatagcagaaaaattaaaacacctttagcctgctcaattccctttcaaactttttctacctcagaccaaaagatgcttttggacttcagaagtgaagattaatgccttggttcacagtctctgcaatgatccccttttctctctacagaagactcaagacaatctgagttaggagcaaagacggaggtctgagggcactggcgaaaaaattcagtgagcttggaagcagggtcatttatgttaattgtacatgtcatcccacacagaaatggcctttataggaattatcagtgtcgtgaagaaagttttgatttccatttttaaacctcatatcccctcatcaaaagctcccatcatgagtttctggctgacttacgccaggactcacagaatgattcatccctacatgaaaaagtattttcaccagcctcaaaggttttcaggaattactagatcaaagaattgttaaagaaactttccaaaagctcattctacttgcccctccaagcaaaatactaactttgtgatggattttagacattcctagtccgtaacagcggcatgaaactttttttctttttttaatagagacagggttttgatgttgcccaggctggtctccaactcctgggctcaaggtgatccaaccgcctcagcctcccaaagtgctgggattacaggcgtgaaccaccgtgcccggtcctgcacagaagtttttgatgttaggtgtaccaccttcaatgatggctgtgtggatccaatatctgcttctctttcattcataaaattcaccaagttcacattggaaaacattattctatggttattccagaaaatattagattatccccattttgtttgaaaactgactgaaaatatgacatcatgttcccatctggcaggagtgcacagcaggcatggaaaatggggatgagtgcgtccaagttagttccaattttcaaacattcatcccgcaccgcctgttcagttgcctgggtaaaattgccccacgcagagaagcttttaccccaggttaataaagatgctttttatattagtatttgagttgtggtcactagtaatgttttctagttcagattgtgaaatttgtatttgttactatctttgtttttatacctcaaagaaccatttagagtcactgattcatgtccataaagcaggaactttccgaaatttagtaagaatagctaagtacaaatctaaaaaaaaaattacatacttcagaaactaaaaatgcattcactgagatgccttatatcctaattaaatattagctgaattgtaattgatcttacattttgattttgtgaaatatatattgcctttactccaaaatttactagaccaccttcttacgtatggcagtgggcattaggtggcttgtgaatttgagaactgctctatggggttagtgtctgagattcatcaactgagcatggaacaagaagagaatagcactttaaagaacattaactgaggactttgctaagcatttatttaattagggaaagcttcaaaagttgaagttcgatcatgggactttcaaaataatccaagtgagacatgaagagactaagctgagggggagatccatggaaatgatgtattagaatcataagcatgaactgtttcaacagacaatacacagaatttggaaaaaggagggagtgataactctaagatttttttccacaaatcaacattcatacatattattttgtattcatatactgtgatcttcatggagtaaggtgttaatgtaaaaaaattgattattggagtttataaaagcaacttttgaccattttctctgtgtgtgtgtctacatagcaaacttacttcctcagagaagcagaaactctttgtcttactgacactggaatctatcctctgtagttttattccatcaaaaagataactaggctgggcgtggtggctcatgcctgtaatcccagcactctgggaggccgagaaaggtggatcacgagatcaggagattgagaccatcctggctaacatggtgaaaccccgtctctactaaaaatacaaaaaaaaaaaaagttagccaggcgtggtggtgggtgcctgtagtcccagcttcttgggaggctgaggcaggagaatggcgtgaacctgggaggtggcgcttgcagtgagcagagatcgcgccactgcactccagcctgggtgacagagcgagactctgtctccaaaaaaaaaaaaaaaaaaaaaaaaaaaacccaacagcaaaaaaaacagataactaagactttggccctacaatatttacactctgcatggaaaacaacccaccaaatatgttttctgtacttactgaaaaaccaccaactatggttttatattcactgaatacaagtaaattaatgaaacattttcaggacaatcaggcacagattgctattttttctattgagttgagataattatttgggctaataatagaaagaaagtgtgtatccactcctggaaggctgtgtgctgtgctataagagaagctgatgcctctgcttccccatctttgttctgtggagccacacaggcagcctgatacctgggcaaatgcttacctgcccagatccgaagggctggtgcacccagattcgtggctaggttgtgtgcagcacaaattcccgcctctagtttccctgctttcctcttttcctaagaaatcagtacctgagctttttcaaaataactggagaagaaatgaggcagaaagtatctttttaaacacaatcctcattcactcagaaaattgagaaaaaagttctaagtgataattgatgacaacctgtaaaatttttcagcagcttgagtgtctattttctctacaatattgtcatcaactcataaccaaatatcacaaataggcagcataatggcctcattagggcagtttccacagtgacccacaccatcaacaatggcatgcatctgtcatgcatcttcccagaaagtcctaaaattctacaggaaaaacctcttggaaagaaagtttcaaacgttgatgaggtccacccatatagttaatctcttcaggtgagaagctataaacataagacgcttcttcggtttcatccattttgtaaactcatttgctgaaatgttcttcacagtaatatctgtgttcactgcattgtttccaagtatttaaaatccctgaagaagtaagtaatccatgtgttttacgccatttcaacagaaatgtcttaggcaatgtttatctttgctgcttacagatccccaaatgagacagcttgcttcattagtgaaggccccttgaaaaaattctcaaactctccttcggtctaacgcatggttagttattgtacattcattttgcgactttaaaaaggagcaattgcagaggtgtcaagccacaaataacaatgctgtctaacttcgttagaccatgaaaacacatggggttatccttgcaaaaaagcatatgtattgtttaatttattgcagtagcatcttgaatcacatctatcatgagagaatataaaatctttttcatgtttttcacacactgtcataacttattattgttttccattatcttaatattctgctgtctaagagatgtagcccctgggtgacctgaaagtctggtgaagctagtatgatcagggatataataagacagtgaccatctatggaccttggacacaatactagagagcatgatagatgcatgtgggccataatgatgttgatattaatacgctattaattcctctctgactccagtaaatcatctccaccttgtctaggttttgcatttccaaatgcttgccctttctctcttaataattctccttaatatcccacattcctttaacctgaggtggaaaactcataagtggggagggaaatcctaaaactcactaggtgacacaatacactaaagcattccagcttgggtcagcagacatgttacagctgcagactcttatgttttctctctttagaccaaagagtttatctcacactcatcatgtgttggtctgtgagtggccaagacaacattcaatgagcaaccagcaaaccctcccttatgctagaatgcttacttatggggatactaaaaaacactaggtctgttatagttctacttggaaacttcagatgccttttcttctaactctgaaattttaataagatggaagaagcactttctgcataattgtttatttaaaactaaatgcaattccaacccagaagaggcctcttttggataagactagccaagttacagatgaagacaacagggtcttagctgtcagtgagatagccctctttgatcttgggaaattctgaaggaatttctcatttcaaaataagaataaatacttttgggtaaagggaggagagaaaattcttcaggtcaccttccattttttccttataaacaaattacaatcagttgacctcagcctagcattttgattaaaaataactcaagataggactgaaagaaaacaccaagaagagagttttatcctaatcttagaaaggcatattcatatgacaaccagcataagaagcaaggaatctgaattacagaaaaataaactttaaactgaaactgctaatataataaatgcagaggagacacagggcagcaaatgcataaataaatgtatgtctttagccagtatgtgaatgatacccaaaacggctggttttccatctcaaacagtcatggaataacaacttcacagtgtttattaattgttgaaattgtctaaaataagagattatattttcacaaattcatttgacacagacacagctataagcacatgagaagacaggcctaaggaaaaaggtaaaattaattcacctatgtctgtatttgtcaactaaacaaagcatcgatccatttattataaagtataataaaactaaggacaaccattgcataattaaattgcctctgaaagccaattattgattatggagaaaaccaagttttacaactgtatgtgtgtatcatataaagatttcatttcctaatacagatcattcattattcattttgaaatgttaagaatttactatgtgccagtgtatcgtttgaagtctcatattttaaacattttaaactataggttaattttctgaaattttcgattagtgtcagaagaagttacagaaaaaggaataacaaacatgtttaaataattaaatggtttcaatggcatctcggaatttctttgatattattatcaaaatgttttcttcaattctactcaaaaccttatttttttgccctaagtctttgtcagcttatttcagtcttatttttacatgtaatataccacagagttcttcttagcttcaagtgatgcaatgtgaaaggtgtagaaatgcacactgacccttagcctcttaaatttacaacaggtcggccaggcgcggtggctcacgcctttcggaggccgaggcgggcagaccacgaggtcaggagattgagaccatctgggccagcatggtgaaacccctcctctactaaaaatacaaaaattagcctggtgtggtggcgggcacctgcagtcccagctactcgggaggctgaggcaggtgaatcacttgagcccaggaggtggagcttgcagtgagccgagattgcaccactgcactccagcctggcaacacagcaagactccatctcgataaataaataaataaataaataaataaataaataaatttacaacaggtcactttatcctcaaattagccaataccatgttagaggttatactgaaattctaactatgaagatgtagaaagcaaaaacatatttaattagttataatccaatctgtgcaatattcatgataatacatttttacaagttgaaagtaattctggattatgcttcataacttatgaaacctttggtggaaaaactgagtcttccccattaaagggaattaaataagttgcttataaaagtgcattaacttgtttggcccatgggttcatcatttagtggcatggaagaactagtttacttgtggtatccaagaggcatgaagaaagacacctccaaaaagtccattttgattctttacactgggacagacgggatgcatagctaccttgttcccctctcacccctcaggctaaggcttgagtaactatcgcagctgtttccatggcgtcttcccatcacatgggtacaaggcactgggctgcacaacagggaaactacttgttttctgcctgttaatttttagctctgagatctttacactccactggagaaaggctttaatgtctgagacagggggtcattatttgttagtttaattatttatgatcagaacatttgttcagtcactcttccatagaccattctgaatctaataaaggataataaaacactagagataatctatagccttcaataaatcactcccaatttggaactcctttgatgaatactccaggctaccatgagggagaagaaaaaagtcaaaaccaattaaaaaaagcaacaacaatgaatttgtaataaactcagttgatagctaactaaagtaagcctgtttttctaacttcattaacatgaaaataaattttattaagattgatatcatgcttttttgcacgaggagttacaggaacatgaactaagaataaaaatgatccctatgataaagaatcctcataatcatgtactttagtacaaaatatgatttgacatcaagaagagctatggcttgagattgctcttgttttcctttaccccctgtgcccaggcttagtcactgtttcagtgataatgaccatccactgaggctctgcagcaatagaatctaaagtaacaaaacagagcccatatctctgcaacaaatgaaatcacagacttaagaaacataaacagaaaaacaaaaagttaagttgttcatgtttcatagccatactgcctataacaaatgccagaacatatttatttggtccaatgtgcaatgcattaaatgtgctcaaatacagaaaacaccaagaaatgcaacagggagttaaaaaaaaaaaaaaggctgggcgcggttacaggctcacgcctataatcctatcacttcaggaggccgaggtggatggatcaggaggtgaggagatccagaccaccttggctaacatggtgaaaccccgtatctactaaaaaaaaaaaaaaatacaaaaaattagtcgggcctggtggcgggtgcctgtagtcccagctacttgggaggctgaggcaggagaatggcgtgaacccaggaggcagagcttgcggtgagctgagattgcaccaccgcactccagcctgggtgacagattttgtccgtatctgcagaggaaatgggaaaagccaaaaggaggggcgacaactgatgctatggggaggagctttacattcaaatgaggacacctcctggcatctccggatggagctccgaattcattacagtattacttaaaggattttattaaaagaccaaaccacactgcacttgtggttgaatgcctttatcagagatgaatcttacatgtgttaggacaggctgacagtggctcccaaagatatgtctatgccccaatcccgggaccctgtgaaggttacttcagaaggtaaggttctccagatgtgatcaaagaccctgagacgaggaaattatcttgaattatctggctgggtcttaaataccatcagaactgcccttgtaagagagataaaggtgaggatgaacagagccccacacaaaagaatagtcacagtggagcatgaataaaccattttacatggttatttctctacagtggatgctaaggagagaatcaagtccgccataataagaaataaactaagagttgtagttaaaacataataaaaatctttttagacgcttctttactttgccaattttctcatccaaatagggataattaaataatctgggacaacaaaatgtatactgtggcagaacaaaagaatccaaggtaaaaaaaaggacatgacagaatctaaggtcttcgataaataatactcagatattgcaaggggtatacaaagagttcaaacactgtcaaagtcaggtgtgacatgttcaaggcacacaaagatcgtaccaagggaaacccagcaggaccagaaagccgaagtgatcaacttattcctgtcaaatacattcttggagtttcaaatgtgaacaaatatgcttattctgaattttacttccttctgcaaagtaataatcaattataattataattataattattttgttaaatgaattataattattttgttaaatgaaaatccaatgagagtcaccaaggagcaatacaaggaaaaaggcagactcaccatctcttcgattaagccttgaaaaccccgggccgtggctgctggacagctctgaggagctgctgaaggatgacctaggcaaggcagaggccagtggggcatcacagtcagctgccgggaaaaataccgtgatatggttaacactcagattgcagcttgggagaaataatagtccaaaaatatatatgaatatattctaggatgtatggcaatcatcactccttttttaattttttacaatttttaaaatttacattgcagtataatttacagagagtaaaattccagagaatttatttgatgtttttaaagtgtacagctctattcattttgacaaatgcattcagccttgtaacctccaccataatgaagacataaaacaggtccattagccctcaaagttccctaatgtcccacattttctcaattctgcaagatgtctgggtacatcacccatccaacactactttaaactcaatttgatgcttaggttctttaggtacacacacacagaggtagtgtgaattgtgtgcccaaacctcaatagcggctagaaattctcacagtgccccagcacagaacctgtgggggatgggaaaagtgaaatgcaccaggtgttcaggtcagagttacctgcgtgaagccaggacccatgaaaggcaacacctgtagtgatgaactggaaaaagcccactctgtagacccctccagagggaatcactgcgggctacttgcctacaggagatggaggctcctcctttttgcctgataacttgagcattgcaggaacttgctctgcctttccaaatcacgctagaccagagggtttctggcttgctgcacttccctaggcttgttgatttagtctcggcgattagctctgcctaggttcctctctccccactctatggtcttgatttgtcccctgacccctgcctggcatcactcttagcttcccacttctccttgacaagtattcccagcatgctttgtgattcccagcatggtgcctatgaagggtttgggacagaaaccatttcttagtattatgttcatgaaagacagcagaagattaaaattagcctaagggcttcctgtatacaaatcaacattgcattcacagatgtgctagtttacgacaatttttaccacatgaatatgaaatgattaaaaaatcaatttgaggaattgcccttacctaagacagagatgatatacttttcaaaacagcatttcatttgagtatgttaattcttgcacttatttaataaaagtgtattgagcacctaccatgtgcaaagcattatggggcataaagagagacatggttctaggttcaagaagtccagaatctaacatgggagggagatgtgtaaatatctgttataggaaataaacagaagagcaaaatatttagatactactatttattccaaaacacagggaagcatcttaattgcttaggaacaaaaccagcctctgaaagagcaaacactactagggagagatgcgtataaaagtgcttctggaaaagataaacataaaccatgcattttcaaacagcaattcattattctgggatctgataataagaatgaaaaaaaaaagaatgcatgtataatacatggacagattttgtccgtatctgcagaggaaatgggaaaagccaaaaggaggggtgacaactgatgctatggggaggagctttacattcaaatgaggacacctcctggcatctccggatggagctccgaattcattacagtattacttaaaggattttattaaaagaccaaaccacactgcacttgtggttgaatgcctttatcagagatgaatcttacatgtgttaggacaggctgacagtggctcccaaagatatgtctatgccccaatcccgggaccctgtgaaggttacttcagaaggtaaggttctccagatgtgatcaaagaccctgagacgaggaaattatcttgaattatctggctgggtcttaaataccatcagaactgcccttgtaagagagataaaggtgaggatgaacagagccccacacaaaagagaagagggtgtgaaaatggagtgaggcacccacaaggtgaggcacacgggcaaccacaggaagccggaagaaacgaagaatggatgtccccctagagcctccgtagggagtgtggcccatcttgattttggactagggatactgatgcggaacttctggtctccagactatgacagaataaattcttttgctttaagtcagccagtttatggtcaattctcacaagggccataggaaatgaacacactgtttatatggaattacatattggatattttaggggaaatgcaggagagttccaacgaaaatacgattaacatccctttgaatcacacagatactcaattccttctcagaagggcttcgtgatgctaagccactctgccaggctgtggctctccccatgcttgtggctgcacttgctcctcactgtgaaaggagctaaccactgtgttggcggaacctaaggatggaaggagaggggaaggggccaccgaactgctaatatgaggggacggcaccttaaccaccttcgaattatcagaaaaacacaaagcctactattaaagagttcaacagatggttactgtgttatcacagatgtatagaaaacctctttgttctaaaaaaaaaaaaaaaagaaaaaaaaagattcctgtcctttctcagactgtctcgattaggtcaaattcactaactccacagcaggcttctctctggttccacatattgagtcagtagggagcacggcctcgggaatcgaatcacaaacagggaagggggtgcccataccttcttcaggccacgtctggatgttcatctggatacggcgctattccattcttcccatttcatcacctgtcttttcagttcttaatgtaccttaacattatcttaatgagaggttaaataaagcttttatttagaaggtaccaaaagttcatcttgttatgaatctgaattgatctgtgcattgctatctagagggaatgcttcggaaaaagcacattttactcacagtgaacataagcagtaatggtcaatgtaaaaatctacttttttccatataaaaacttctgttttacatggtcttgatctccattcgattatcttcagtcactgtcttccctacatctcactccatggggtctgaagggggctcaccctaccacctggggccagcacagggacacgcctcaggcctggcaactgaatgccatgcctgtcctactggaaaggactggttccaggatggtcaggaagcccatgctgaatgaatgggaacagaacctgggactttcgaatgaataacagcagaacctgggactttcggcttgaactcttgggagaaatacccattcattcattcaacaaatatttgttgaaaatctatactgtgccaggtgtgcccctatgttctggggatataaccataaacaacagaaaaagtctctgctcctgtgaagcttatcctactgagtagaataaacaaataaaggcataatatctgtagaactcaacattgctaagaacagaaataaaggaaaacagtcacgcttctaagctggtaaacggtatgcctgaagctatggcatagacagagctgcccaagaatgaggccagttgtagacgaaaataaaactgcaagaaggaaagaggcagactgctgatgaaagaatctgattgcctaaattcagcctggcttcaatcaagacactttggttccctttattgttcaagtctatttgatcttagattctggtcacctgaaactgaaaaatgctcaataagtacactgtcctgagcccccacccttatcttccctctacagccaataaattgccaaggattatgtactttttgtgtgtatatggcagcttttccattatcatgatcatcatctcactgtaggtcctcatgttaacgacctaactaatccttacagccaatgcttccttattgactgtccccagccacacacacaccttacgtatcaccagagcagaaacggttttaaactattgctgagtgcaagtcacacaaacagccatatcaaccagctccaatggatccccactgcacctgtcctgaaattcaaatttcaggtcctggcattcaattccttccatcgcctgtttcctgtcactctctgcactacagccaaatcccctacacatttctcagatgtgcttcctcctttaatcggagtggtcttctcactgtttcctgaatgtgggatgcatgcaccaacgctccttgaccgctcacccgatgacattgcagcccctcctgtctgcgagttcccatcacttattatcttcagggctcaactcaagttttgtctctgctctgaaggcttctcacatgtgtgaaggccccagtaaggcttactcttctgaaatactgaggtctgtctcatggaaaatgaattacacctctggagaaggagcagcacctcactcacggggagccacacagcagccacgtgtggcggcagatggggatgagagggaacaggagaacctcactcccgagaaaggagccttgcctgctgactgatgattctggggtgaggaagagaggctggcatgaccagctgatgagtgtctggttcccgggacatgacagacaattcctacagtctacctgtgggaacagatgaggcctggaagaagacacatagaaacaggtttaaattctataaattagaatttacagggggtaggagataggggttacacgttgtctctccttccagatgatattttgacttgttaaagaaaacctagcataggaacattgaatacctcctgacattggtgttttcaagtgacttacagcactacaaatataaagttataacaacagcataccaattttaacataccaggaccaaggactttattctatgagaactacaaaagacacaacacaaatgaagacctagaggaaagtttacatagttttttttttttttttttttttgagacggagccttgccctgttgcccaggctaatttttttttgtatttttagtagacacggggtttcaccatgttagccaggatggtatcgatctcctgacctcgtgacccgcctgcctcagcctcccaaagtgctgggattacaggcgtgagccaccatgcccgctcaagtttacataaatttaagcatcttaatttgatgatctactctacagtcattacaacaataaatataagaactatttaaacatgtggagagatgaaggagatgggatgggaaaatctgcatatgagaagataatggacaaagagatctgctggattgagatgagataatgggtgttaaatccaacaaacacagctctggaaacacagaagggattaaacatagatcagctccttttccctgaggaagctgaatagatgatcttgttctctttccttttatttctaaatttcttgctatgtagttaaattatacttctgtgataaattcaatacctatttttaaactatagatttttggctaaagtatataatatgagaataagatgaacctatttttttgagacttactgctaagtagaaagagaggaaaccaaataacaaaattaagtcctgcagaaagacatcagacacgacacagaaaaaaatacaacaacacaggtgcatataatttaaaaagaaaatcatgtggagatgtcatcactaataattgttattacgaatgtatccacagctgtgggaatataagtgataaagatgagctgctaataaagggcaataaatgatctttccacgggtacaaaaaaatagaaaaaatgaataacacccagtatttgataacacaagaggtgactatagtcaataattacttaattgtacatttttaaataacttaaagagtgtaattggattgtttgcaactcaaaggataattgcgtgaggggatggatactccatttttcttgatgcacttatttcacattgcatgcctgtatcaaaacatctcatgtagcccatcgatatatacacctactatgtaaccacaaaattaaaagctaaaaaaattaaaaataataataattctttctatgcacctctgagagttgacagaactagcgtctgaatgagaatgtaaggtatgagaaggatatggcttcttcccaagacatgttacagagggatggaaagaagactgtgttcaacttataacatcttaaagggacgtcatgacctcacaggccagagcaggctacggagcatctgggagctgaagaaagagaacttcagtgatacttaagtaagggttaagagatgcactccaattgcattctgaagacagatcccaacaagaccaatgacatcagctagatttttttcagcccaaagtaatatacctgcaaattatcagaacttgttcactactccgtacttggctctaatatgattagtaagggggcagtgtcagaatccttgagaaaataataaccagaacatcttagaatttattgtgcccaaggaaggagccctgtcaatagacaaatgtttatttgagatgtcaaaaagataattttaaaactttaggaaaacagcaggcattatcccatggcaatatgttttatgtccaaatttcaactctattatttcaagctatgtgtgtgactttagaggcagctttgacttcaattttttaacttaaaaagataagagtatttagaacacaatgggaaatgttacataatactaccttgtagacctccgagcaaccactatacaaagagacactgttgttatgattgaggacaacatcgttcatcaaatgtgaaaagctacccaaatgaaatccagaaaaaacatgttccactgaagaagagagaaatgggcaaagtaaccaaggaaagaatatttacagtgaggctgggcacagtggccaagatgggcggatcacaaggtcaggagtttgagacgagcctggccaacatggtgaaacttcatctctagtaaaaatacaaaaattagctgggcatggtagcgggaacttgcaatcccagctactcgggaggctgaggcaggagaatcactggaacccaggaggcggaggttgcagtgagccaagattgtgccactgctctccagcctaggtgacagagcaagactccataccggaaaaaaaaaaaggaatacttacaatgaaaaggaacattaaaaggaggcaatataaagcaaagtaagttaaagcccagaacaaattaagactttcaaacattgctaaatgcaatcaaagagatatttgtatactcataagaaaaaccagaagaagctgcactctcttgacaaagctcataaggctaagaaaatagacaggtctggatccaagatggtcgaataggaacagctccagtctacagctcccagcatggatgatgcagaagacaggtgatttctgaatttccgactgagctttggtgacagtagtggttctcccagcatggagtttgagatctgagaatggaaagactgcctccttaagtgggtccctgacccctgagtagcctaactgggagacacctcccagtaggggctgactgacaccgcatacagccaggtgcccctctgagacgaagcttccagaggaagaatcagacagtaacatttgccattctgcaatatttgctgttctgcagcctccgctggtgatgcccaggcaaacagggtctggactggacctccagcaaactccaacagacctacagctgagggtcctgactcttagaaggaaaactaacaaacagaaaggacaaccacacaaaaccccatctgtacgtcaccaccatcaaagaccaaaggtacataaaaccacaaagatggggagaaaccagagcagaaaagctgaaaattctaaaaatcagagcacctcttctcctccaaaggaacgcaactcctcgccagcaacggaacaaagctggatggagaatgactttgacgagttgagagaagaaggtttcagatgatcggtaataacaaacttctccgagctaaaggaggatgttcgaacccatcgcaaagaagctaaaaaccttgaaaaaggattagacgaatggctaactagaataaacagcgtagagaagaccttaaatgacctgatggagctgaaaaccacgagaactacatgacacatgcacaagcttcagtagccaattcgatcaactggaagaaagggtatcagtgattgaagatcaaatgaatgaaatgaagcgagaaaagaagtttagggaaaaaagagtaaaaagaaacgaacaaagcctccaagaaatatgtgactgtgaaaagaccaaatctacgtctgattggtgtaactgaaagtgacagggagaaaggaaccaagttggaaaacactctgcaggatattatccaggagaacttccccaacctagcaaggcaggccaacattcaaattcaggaaatacagagaatgccacaaagatactcctcgagaagaccaactccaagacacataattgtcagattccccaaagttgaaatgaaggaaaaaatgttaagggcagccagagagaaaggtcgggttactcacaaagggaagcccatcagactaacagtggatctctcggcagaaactctacaagccagaagagagtgggggccaatattcaacattctgaaagaaaagaattttcaacccagaatttcacatccagccaaactaagcttcataactgaaggagaaataaaatcctttacagacaagcaaatgctgagagattttgtcaccaccaggcctgccttacaagagctcctgaaggaagcactaaacatggaaaggaacaaccagtaccagccaccgcaaaaacatgccaaattgtaaagactatcaaggctaggaagaaactgcatcaactaatgagcaaaataaccagctaacatcataatgacaggatcaaattcacacataacaatattaaccttaaatgtaaataggctaaatcctccaattaaaagacacagagtggcaaattggataaaaagtcaagacccatcagtgtgctgtactcagcagaccctgctcacgtgcagagacacacataggctcaaaataaaggtatggaggaaggtctgccaagcaaagggaaaacaaaaaaaaagcaggggctggaatcctagtctctgataaaacagactttaaaccaacaaagatcaaaagagacaaagaaggccattacataatggtaaagggatcaattcaacaagaagagttaaatatcctaaatatatacgcacccagtacaggagcacccagactcataaagcaagtccttagagacgtacaaacagacttagacttccacacaataataatgggagactttaacacaccactgtcaacaacagacagatcaacgagacagaaagttaaaaaggatatccaggaattgaactcagctctgcaccaagcagacctaatagacatctacagaactctccaccccaaatcaacagaatatatattcttcttagcaccacatcacacttactccaaaattgaccacatagttggaagtaaagcactcctcggcaaatgtaaaagaacagaaattataacaaactgtctctcagaccacagtgcaatcaaactagaactcaggattaagaaactcactcaaaaccgctcgactacatggaaactgaacaacctgctcctgaatgactactgggtacattgagaaatgaaggcagaaataaagatgttctttgaaaccaacgagaacaaacacacaacataccagaatctctgggacacatttaaagcagtgtgtagagggaaatttatagcactaaatgcccacaagagaaagcaggaaagatctaaaattgacaccctaacatcacaattaaaagaaccagagaagcaagagcaaacgcattcaaaagctagcagaaggcaagaaataactaagatcagagcagaactgaaggaaatagagacacaaaaaaacccttcaaaaaatcaatgaatccaagagctggtttttttgaaaagatcatcaaaattgatagaccgctagcaagactaataaagaagaaaagagagaagaatcaaatagacataataaaaaatgacaaaggggatatcaccaccaatcccacagaaatacaaactaccatcagagaatactataaacacctctacgcaaataaactagaaaatctagaagaaatggataaattcctcaacacatacatcctcccaagactaaaccaggaagaagatgaatctctgaatagaccaataacaggctctgaaattgaggtaataagtaatagcttaccaaccaaaaaaagtccaggaccagatggattcacaagcccaattctaccagaggtacaaggaggaactggtaccattccttctgaaactattccaatcaacagaaaaagagggaatcctccctaactcattttatgaggccagcatcatcctgataccaaagcctggcagagacaaaaccaaaaaagagaattttagaccaatatccttgatgaacattgatgcaaaaatcctcaataaaatactggcaaaccgaatgcagcaacacatcaaaaagcttatccaccatgatcaagtgggcttcagccctgggacgcaaggctggttcaacatacgaaaatcaataaacgtaatccagcatatacacagaaccaaagacaaaaacctcatgattatctcaatagatgcagaaaaggcctttgacaaaattcaaagacgcttcatgctaaaaactctcaacaaattaggtattgatggcacctatctcaaaataataagagctatctatgacaaacccacagccaatatcatactgaatggacaaaaactggaagcattccctttgaaaactggcacaagacaggatgccctctctcatcactcctattcaacatagtgttggaagtcctggccagggcaatcaggcaggagaaggaaataaagggcattcaattaggaaaagaggaagtcaaattgtccctgtttgcagatgacatgattgtatatctagaaaaccccatcgtctcagcccaaaatctccttaacctgataagcaacttcagcaaaatctcaaattcaagattttgtatcttgatttgatacaaaatcaatgtgcaaaaatcacaagcattcttatacaccaatagcagacaaacagagagccaaatcatgagtgaactcccattcacaattgcttcaaagaggataaaatacctaggaatccaacttacaagggatgtgaaggacctcttcaaggagaactacaaaccactgctcaaggaaataaaagaggatacaaacaaacgaaagaacattccatgctcatgggtaggaagaatcagtatcatgaaaatggccatactgcccaaggtaatttatagattcaatgccatccccatcaagctaccaatgactttattcacagaattggaaaaaactactttaaagttcatttggaaccaaaaaagagcccgcattgccaagtcaatcctaagccaaaagaacaaacctggaggcatcacactacctgacttcaaactatactacaaggctacagtaaccaaaacagcatggtactggtaccaaaacagagatatagaacagaacagaacagagccctcagaaataatgccgcatatctacaactatctgatctttgagaaacctgacaaaaataagcattggggaaaggattccctatttaataaacggtgctgggaaaactggctagccataagtagaaagctgaaactggatcccttccttacaccttatacaaaaattaattcaagatggattaaagacttaaatgttagacctaaaaccataaaaaccctagaagaaaacctaggcaataccattcaggacacagtcatgggcaaggacttcatgtctaaaacaccaaaagcaatggcaactaaagccaaaattgacaaatgggatctaattaaactaaagagcttctacagagcaaaagaaactacaatcagagtgaacaggcaacctacagaatgggaggaaatttttgcaacctactcatctgacaaagggctaatatccagaatctacaatgaactcaaacaaatttacaagaaaaaaaccaacaatcccatcaaaaagtgggcaaaggatatgaacagacacttctcaaaagaagacatccatgcagccaaaaaacacatgaaaaaatgctcatcaccactggcaatcaaatgcaaatcaaaaaccacaatgagataccatctcacaccagttagaatgacaatcattaaaaagtcaggaaacaacaggtgctggagaggatgtggagaaataggaacacttttacactgttggtgggactgtaaactagtacaaccattgtggaagtcggtgtggcaattcctcagggatctagaactagaaataccatttgacccagccatcccattactgggtatatacccaaaggattataaatcatgctgctataaagacacatgcacacgtatgtttattgcagcactattcacaataacaagacttggaaccaacccaaatgtcaatcaatgatagactggattaagaaaatgtggcacatatacaccatggaatactatgcagccataaaaaatgatgagttcatgtcctttgtagggacatggatgaagctggaaaccatcattctcagcaaactatcgcaaggacaaaaaaccaaacaccacatgttctcactcataggtgggaactgaacaatgagaacacatggacacaggaaggggaacattacacaacggggactgtcgtggggtgggggtacgggggagggatagcattaggagatatacctaatgctaaatgactagttaatgggtgcagcacaccaacatggcacatgtatacatatgtaacaaacctgcacgttgtgcacatgtaccctataacttaaagtataataataataaaataataaaaaattaaaaagttcagtgttcgagttctctgtctcttggcctctgtgatgcctgcagaaacccagtcgcaacccattcattcatattcctctccttagagccaggagttagcgccccaagggcagtgctgaatccctggacaggacttgggataaatgcattccccctgctgtctctcagaggcacagctgtgaaacacattctaccggcttcctgagagcttcccagggagttcatgccccagttgctcacagaagtgaccagctcaatgacacccccttttggtggatttttcttctctattccattcttccctcttttatgagctcactttctaaaagaggctacctgcacaaacgcccatcacaggctcagctgtctaagaaaactctggctgggagagtggactttccagaatggaatgtgggcagtattctaaaatactaaataaaatgcaacaggaaaatcaaagggatgaacgtcacatggcataaagaaggaggtagaggacatctgcctagccttccaagaacaaaacaaattgacaatcaaccctggccacccaggagatgagctttgtcacagcaattcttcctcatatcccagaaaagagaagaagaaatgaggacagtagaatcaactgtgacatccaaaaaaggctgcccaatctcttctctagaatgtgtcaactgtgatttatgaaataacatatgctatttttatattgcaatgtttgcttatctataggtaagagctcactatttcttatatcatgttataattatattcatgaagaagatgaccattgcacagacaagtacactgtgaagaaccgtgaggagagattttaccctacttgcaagctaacaaatgagtctgccagtttgtttcatcgttgcggcagaagactcctgggtcaaagcaaaggactgtattacttacagcatagcaaacaatatgagcatcagcatatttgcatcaatttccttgcctccaagtcctctgggggaatatggatgggcacagatggatgtgtgcacacgcagtgggttacatgacaagtgaggagccctgagcttagggaattcaaagttttctacgggcagcaggcattgcttgccctttggcaacactgctgaaataaatctcttatggttcaagatgtattgataagcatgttaagcttatttttatacatgaagaacaacaaattgttattttctatggttattcacagtatctcaaaatctatgtgatattttactagcttagttttattataattttaaaagaccatttgggttcctttgttagtggacaagaataaaaagagataaattagttactttcttaaagctaagcaacatcattttctattgaggaacccaaaactttcctaacttttacaaatgtttgtaaattgtaggttctgtgacagcctgtgctataaaatttcataagcttataagagctttcttaacacagctgtggacttttctcctggtgttgtacagcagttcaaattagctcaagaatcataaaccctatatttgaacagctatataatattatatatttattttcccatttgatgttgcattactttttctaccaatcttcttacaataaattcataaatatcttaattatagcaaatgtgaagttcttaaagatgagaatcatcaaacatatttctattacagagatatattcttcaaaaagtcatctaaaatagaaacccaactgggagacaccttaaaaggttatctgccacaacagaagctttgcttaaaatactgttctctttgtatttgtgttaataattgatttgtctttgaaattaaattaggaatctactatatctagtggtcttgaaatcaaagccccctccccattccttatcttcactgctgtgttcaaaaagactagactccagggacgtgtccaaagctgggttaaatataggatgcctgagagacacccttctttcatagttcgagggtaagcatgtagctgtatgtgtgtggaggggcgggtggaggaggttagctgtatcagggtaggcataatactatattttaaatccctccttctgttataaatgtaagctgaaaatagtctctgctcccagcggcagcaatcgtaaactcgcttagttctgcctgtaatttaatttaatttaacatgtgacattgagacaatgtttcttttaattcacatataacttcttcctcacccacattccagccaaataaacacatacttatagaaaaatgtgactgttttcctgggcatcccaacaattcaactgtccctaaaacaccaggttcaatttaaactctattagcttgtctgagggctaagatatctaaaaatccaagacaaattatcatttgcgtatatggaggcagctctgattgaacagatatctaaaacggttaggtaatattttagatcaaatcactccatcaagtcaaagactaattcaactgtttgttcagtttccaaaggaatccttccattttggtctagtgttccataaacattgactttacatgaaaaggacagtgaagagatctcttgaaccggccagaaagttgaagctcaaggttgtagaagatttgagctaccaagtccaagccttctaaaagattcccaatatgtatatatatcattttcctaactctacatttgcctgagaaacaatgacattcaataaacttttttccatgggatttagttacaaaataagtcaaggaactacaagttatatatttcctggaaaaatatactattatatatatatattatatattcaaaactccgtaaagcatataaagtataagcatatactgagttataaggcataactcaacatgttattttaacctaaaattttcttagggcctcaattgcaaatgctttaattgccaatggttcataaacacatctgtgaattagaagcaagtaatatcctctgtttttatactctcaaaaaatgtgattatacttaatcaaaagtaattcaaaccacagcccaggcaatacatactagaccatgtcttcttggtaatttaattcttagcaataattttaattgctgccttattaagtaggtatgctacttaaattacaatcctgtagttataaggttaaaactattttaaaatctcaaatgtttttagatttcaatcactcttcgtattattacaacaaaaatgttcattaactggaacacatgcagtatcattttttagcccccactttatgatattttttaatttttattaccagagtagtcatttcattataaaattttaaccaagctaagcatatactccattttttagaaaactagatttactgtagtcctgttaaggctatcatagtaagcaatgaatttcacacttgtcttttatacagtacaacacatcaagcagatatatgaaatccttgacaaaagacatttaaaacaaacaattccatgctttatatgtcaagtgaaaaggaatattttttctacagtgacagagcagacttgacatgtgcacaatcatgtacaaccaagcgtttgcaaatgctcttacaacgtggagcaaccgggcctagggacaagcaacctttcagctaagagtctcgtcaaaggtgcggaagcccattacagaagaccagataacagtcagtctgacgggttcattcagatattcaagctttaaaaagtactttgaagactgatacagatgtcctaggcaataaacttcccgaaaagaatggggaacaatcccagtgccaatcacatctttgtcattcagaaatccaggctaatttgatttagagacatacataaatgaactgttatttctcataactgtttttttttcagcctctttatttttaatctacatctcttaggtaaaatgcatcaatttaactacatttacttattctgagtttttctattggtccatgtttcctttaaacacaattttgaatggttttttaaagtaaccatttgattttgaaaccaatttacagaaaacatggaagaactacgctaatatgctgtatcacccctgaatacttcaatgtacatttcctacaacaaagatgttctcctatataaccataatatgatcatcccagtcatcatggataaagttccaatatttaatccccaatcttgttcaagttgcaccaattcccaatcatgtcctttataacataagcatttaatgcagagtagtatttagttgccttgttttcttagcctccgtcaatctggaatgcctccttcctcactccactcaacctctgacaacttgctataggtcaccaccagtgctgtctcctgtctctccaggtccccacccttgctacactgtggatgctttccttaccctgctggtttctgaatgctctgccacggtcctgggcctccccactacccagcatggatgcctaagctgaactgaatgaccttggactgaattgttcaaaaagagaaggggagaggaagaggaagaagaacgccaagtaatttgatttttcttttttcatgatcaaaccaatgtcttggaattgattatcacttccatgggctacttatgctccgtactgtttgtatagagtttggtgaaaatgaataaaggcaactgaactacattttttggttttttttttgagacagagtctcactctgtcacccaggctggagtgcagtggcacgatctcagctcactgcctcctcacaggcacctgccaccatgccctgaaattttttcatatttttagtagagacggggtttcaccgtgttgtccagcctggtttcgaactcccgacctcaactgatccacccacctcagcctcccaaagtgctgggattacaggtgtgagccaccgcgcctggcctgaactccattttttatagagtaccatttgacactaaaattaagagtctgttactcatctgcagaatctctctttaaatggtattactaaaaggtccaaaatgaaacatctgtaaaaataattattcctacactctgtgagatctctttcctgacacatttcacatctaagtgagtttcctaactaacccacacacactctatagtaggcttacccttctttccccaggctggctggcgaacttgcaaaacataaccatttaggggaaaaaattgaggcaattaaaattaaaagtgttttaggctaagtaatgaataaattaacccactgaaaagttacatcaaaggctattactcagcattttaccagttacaggaatttctgcaaaatctgcccagccatttgtttgtgtatccctgggatcagtgcccagcgttcaatctttctcttgatgcttcctgctgttttcagggactcaatgagagcagtaagtgacctttcactcactgcaagtctatgggcactgaagttaggaaaatatttcccttcatgcagaatcttcctaacaaagctttcccatgtatttgtcgggtcaaataacattcagataaactgcacataatccccaaaatgccaaatgtttagaaagctttttttttttgagacagagttttgtgttttcctcttgttgcccaggctggagtgctatggtgggatctcggctcactgcaacctccatctcccaggttcaagcgattctcctgcctcagcctcccgagaagctgggattacagatgcctgccaccacgcccggctaatttttgtatttttagtagagacagggtttcaccatggtggccaagctggtctccaactcctgacctcaggtgatccacccacctcggcctcccaaagtgctgggattacagacgcgagccactgtgcccggcctatagagctcttcccatgaagagccatttcatgccatcatcaacaggttgccttcgtgggtggccaatgtgcttctcgaaaaccagctgtgaataacgtgagcaactcatggtgtctacatgagaaggaaacttttagatgtccttattgactttcttcttggtattgaaggtggtataattattacagttacatagttttatctggaagaattacttgatctaaaaggtaatttaaaattagtaaaatttattagatatgaggatactaagtttcatcaacgaaagaagactgaaaacacccacagtagtagtattgaaatttcacgtgtcactcagcaactcgcgagagtcccgtctggtgctgagtccatttggaatatctgtccctgccctcccctcctccaaaaagaatgttcactataaacgagaagagcttaatttctatgggctttgtaatccttccactggattccaagcaaaataactaccaatacaactaatcctgagaataaaaagtaatcacaactatgcaacaaaaacaggaaaggtggtggcagggtctcactcagatttcattgctttgcttttctccaggaaggtctttttgaagccctgtttattcaatagtaagagtgacctctagtgactttttttgttgttgtattttgccagttgattggtcaattactctagcatgcctttctataagtagctcatttatatgtttgtttaagccaaacggcagtttccattacaagacccaaggattttgatttaagtaacaacgttttattcacaaagccttctcacaaaagcagattaaagttgaatctgaaacacggtacagcatctgaccaaaggaatccggagcttgttttttggaagggcacaccaagtgtaggattaactgaggcgcaactgaatcatgatgcacagtgagttcatgaacccatgtgcgtgccctgtgtgtgaagaaccaacccacccttgagcccgcgggcagaacagcactgagctacggcaaacttttcatgacagcttaggagaactgctgaaagctacccttggttatcctgcaataatctaaatttccaaacatggccactggcgtttattggaacttatttcgaaagagattttggtaggagagggctgaggctgacagcggggagatgccactgaaagaaaaataaaagtgatttgagaaggaagaggaagacattttaaaaattctaatctcatggtttgattaatcaagaaagaaagacaactctctgctagagatttactccaagccaaaaaaaaaatgtgcaatgttgtgtaaacatttttatgtgtgataaaatatgggtacattatgttttgctcatctgtctggaatatcatcattacattagaatcatagcccattctagaaataaaggcttcctaggtgtttaccaaattaaggaaaataaaaaacagggaacctgatggcaaattaaataatgtaaaatattagcatccagagaggaatcattttcaagatcacctaaatgactggctgagttttgtctttaagcaagaactttctactatgagaaacgaagcccctgacaggggtgttcaagtgttattcccttagtagttaggacaggttattaatttagtttcacctacaggcgctctgtccctatactgcatggaagttaattagcattttaactctgaagctgccaaggtcggcaaaactgtaagctgctaacatctaagttgatgcagtatgatgtaatgtctgccagttttttccctgttagacttaattcctacaaaatattacaatcctaaaaaggaataaatgacagcatttgcacgctaatctcttattaagatgcttttcaggttttacagaaacgtccactttctcaatgaatattcaagtacatcgattaaaaagtcaaaacatgcatggtatatcttagactcccccacaagaggaaagtctattgtaaacaaaatcgtctttttcgggttgcaattccaaattttttttaaggttcttcatgttcaggagcatgttctgcaattccacttccaaatattaccgataataaaaaaaaaaaaacaaagttttccagacagcctagcgcaagttttaaaccatttgctgtacttacgtggatttcctgctcccacggggctccaagtctgagtggggagaagcagcagcaccttgaggacggcccaggccactgaagccatgctcacttcagccaggcgccctgagacccgggcacggcgacggccgctctgcgtcgctcctgctctcactcccgtcccctgcgcggctctgacgctgctctgcctcccctgtccagtctctagctctcttcctcacgcaccagcagcctccctcggcgctgcagaccctcccgccaagccgcgcccggccccagctgcgtctccgaggtcggccccgcggactcgcgccgcagctttct
